United States Patent 11,549,145 (METHODS AND COMPOSITIONS FOR INHIBITING AND TREATING NEUROLOGICAL CONDITIONS) - sequence listing, part 50

SEQ ID NO: 1073 - DNA, 82038 bp, Homo sapiens
gtcatcattcacccagatatacattctactcaatctagtattcccaagcacttttagggtcctccactggggtttgccacactctggtaaaaagaatcccatttttaaaatttcttagcctttttatcttttttttttttttgcctaaatcagttgttctcaaccctgaattcacataatattgaatcattctttgatattaaaaacaaacaaaaatagctaggcatggtggtatacacctgtggttccagctacttgggaggctgaggtgggagaatcacttgagcctggaaggtagtggctgagctgtaattgtgacactgcattccagcctgggtgacagaacaagaccctggctcaaaaagcaaacaaagcctgtaattctagcactttgggaggccgaggtgggcggatcacgaggtcaggagatcgagaccatcctggctaagaccgtgaaacctaccccccctccccgtctctactaaaaatacaaaaaattagccgccgggcggggtggcgggcgcctgtagtcccagctactcaggaggctgaggcaggagaatggcgcaaaaccggcaggcagagcttgcagtgagccgagatcgcgccgctgcactccagcctgggtgacagagcgagactccgtctcaaaaaaaaaaaaaaacaaaaacaaatttaaaaaaaaccccaaccaaccaaactaaaaacacaacactcacagaaaacaagcaaggaaacaaacaaatgaaaatctacctcttccccatatgaagatgggtttaaatcagaaaacatactttaaaacaacacctttttttaaaatagttttcttcagaaaacaagcttcctctgcggccttcttaaggctcttctcttacacatcacatatgtcagagacaaggactgacatggctcattatcaatgcttccagacattactctttttctttaaataagcaaaaaaaaaaaaaaaaaaaaaaaatctttggttcctttaagatatatattgtctttccataccagtgtgtcacacactttaatgcaaaccatgtggagtttgtattaaaatgcagtgcagactatgattcagtaagattggaatagacaagattctgcacttctaaaacctcagagggactccagtgctgctggtccatggaatacacctaaaaagcacaagccaatatcatcctctctttctgtgaatcacctcttcgccctcccattcttttgctcaattttagcctctcgttcacagacttttcttccccatctccttttatcaatcccaatgatataaacatctatatagatgaaataatctcaacctgaacatttttatattaataatctaacattcaatgatgtttccctctacttcaccttaacacttgtaccttatcaacaagaaacaagactacatttatatgtctattttaaatatctggttttcatcttccgttctgctgcaccatcctatgtcccatattcttacagttctcctgatattgtacattcattgccatcatttcctgaattcattatgtccctgagcattttgactctactactttctcagaagggcccttcttgtcattcttggtggggagcagaggcacatgagaatcctattctttctggtatctgcatgagcagtcagcccactaaccactgagcaattcgtttcatgtgaatcttgtcagtggccaagacacttgtgcacattgatcttgactgacccaaaagagtatacaccaagtaagggaacagtcttctctgtttagagatggggatgaaacttatacagttgaaaaaggagacaaaggaagagaacaaatggggaacatttgagtctctattttcattaagatggaattaggcatcagattatctaagtttccagccttatttcatcaaatcctaattctggtactaggctaattattactaaattttcatgtggtgtgctttgctaatcacttcttgtgttttcatgagtgtcttattggaaatttgtgaaaaaacatgtcaatcctatcaggacatgattttaaggtagaagctaaaaaataattcagaatattttggggggagtgagtgattagagaacatgtataatggagaatgatcagctctggagcatgtttactttagcagtgaatggcctaatctacaattacttgcatgtttcttagaacattttcttctctctgtattctactactctacagtgatacgtgtataataaattgccatagtgatttggaattttaaagcaattcaggttaggctatagtatctcaaagcccctaggtaaaatttaaagcagaacacaatttacttaggttattttcattttctgcttagtctcacctttacttatttcttattattagtcttcctgtttgtttcatatagctaatttatttttgtttgcaacctgaaaaaaaagaacactaaaactaaatttggaaaaaaagtcataaaatttcttatatcatgccttatgcctaatatatttaaaatgacttaagagaaaatagccacctatgtcttttagataatttgtaaaataaactttcatatgaggtgtaatggaagaggtctcatattgaatcttgaattgggacagatattaaaatatcagaatcccaaaaaattgttttaacaagtaaaacattaaataaagtacagaataacatatgcacagaaatgaatatactaaaaaagcaggtttttcaaatgtagtccagaataacttggctttcacaatatcacaaaaaggggatttgccacaccagaagaaaccattcatacatatcaccccacttgttttttcctaataataatgtttataattcagacaggtcttcaaagacagggacctaattgggcttatgcactggattggtagacataataaggtgaaagttatgaagagcgtgtcaatgagaaaatttgatagtcttgaaacgtaacatattaatttgcagtcttatctcagcaaaacaagtaactatcttattttttgaaattcgtactgtttatcataggaaaaaaaagtgtggtcccattaatgtttaacataggaaattatgttagtttcagttttcacacaccactgaactgtcttttgatgccatagtttgaaattataaaatgtggaataattaaacatttattgaagttataaaaagtgagaaaaaatataatttttgagtcaagttttcacaaactaaaactattttctgttttactcttaaatctgagtaaatcatctaaaatcttaaaatatcaattttagaaataaaatgaaaataataccttgtttgaaaatttaacaatgattatgtgagaaataatgcaacaacacgttgagttcagtgcctggcatagatatacatctatccatttattcagtaatatttgaacatagatattatgagcatatattaatatgaagacacaattagtcgtgatttctaaaaaaataaatacagataaaaatgatttttatgagtacttgcagctatgctatgtctatttaacttaaatataaagctcatataaataaagggaaacttgagcaactgtaattttaaattccaaagagacttcttgactaattgctacgtaaacatcctttcttcgactggggaaaaagtgaatgtacaaacattaaaaaaatttgttcaccctaatgttgtatcctaatacaaagcttgagctattatttttctaaagagatagttaaaaataaattacaaaagaggaagaatgaaagcataatgtattctgtaatacagttatgttttattttgtgttaaatttattttttgctgcttttaatataccttattagaaaatagaggaagtcacctcacattgccataaatgagaaaaagttgtaattaaatataattaattgaattaagttgcgtatatggacagaatatataaggacacttccccttccaccaggaaagcaaagaaataaaaggtcctttgaacagagcttgaccttctaagacagtttgtgataggaattcactgctcaaacctatgaaataattgcaattgaggaaggaaacaatacaagagcagaaggttgacaaaccagagtggctaatatatgtttattacttaatgttatgtcttttcaaaagtgaaagcagctttggtgaaaaacttccaattggtggctatttcttggctttcttaatctttcaccagctgacttataacacccacccacccacacacacacacacacacacacacacactagtttagtctcccaaagagaaaagtttatcatatttcgccaagaatttccctaaattctgaaatggtgaaaacagtcactttatcagaaggatgttcataatgttaaattaacatttaaagcaagccaggcctgtaatcccagcactttgggaggccaaggcaagcagatcccttgagctcaggagttcaagatcagcctgggcatcatggtgaaatctctacgaaacagacaaaaattggcagggctggtggcatgcacctgtggtcccagctacttgggaagctgaggtaggcggatcccttgagcctaggagtccaggctgcaatcagcctagattgtaccactgtactccagcctcagttacaaagtgagacactgtctcaaaaataaaaatataaaggaataaataaatgtaaaaaaaaacattgaaagcaaaagggactttgtagacctcctacacatggatacaaataagaatttatcattgagcttgatgttcgctttgtcacattgagaaaatttaaatattatttccagatgaataaatttgttgcattaaatgtcaatggtacactgaagcgagaatgtgatttgaactcaagagtctttagaaatttgtatcaaaagataatgtacatgcttaatttttatatgtaattcacaaattataaaatataatttgtcagaataaaaaatggagttttgtacttacatttgaggttttataattttattacaacttaaacatctccatgtctaatgaacaatatatgcattacttctcctgactacatcaatctgcattaaatcatagtgacagttgcattaaatcatagtgactgttacattaacagctaaatgcagatagttctcttcatttaggaacatgcttgttaatcagaattacacaaatcttgtacatctccagaaactaacactgacctagaacttaattgttcatctaaatgctctgtgaagtgtttgaataggtgtaatttatttacttagaaattaccaacacagatgctgtcccccattacacacctcttttgtattcaactatgatttaatggtttcttgtacaaaactagtccaagccaattaaaaagcaaataaatagtcacagtggagggtaaattgccttttctgccttcttgaagcatgtgtgcaccactaagataagatgttgtcaatctgttaaaatctccgtgaatccatccttcttcactgctagtagcaggaaagctttaacactttgaacaactaggaagggtcatttgtctaagttgtggcaaagcctaaggggcagaaaggccatagtatttcctgcaacacattaatctagactttaaaataatggaaaatattccaaaagtgtcactgttaaacacactgttgttggcttaattcaacttcctttttcccttcatttattcaagataaaataatgctgtacattttatttacaaacatgaagcaaagccaatgtcattaggattgttcagtgtagacaattcatctatagagtctcaatgaaaccagttgctaagcccccatctcaagtaacttaatgctgtcacttcctcatcaattcctttgtcccccgctgcccatttgcagttgtttagaattttgtttctgttgcctagaacaataatgagtattatgatgaagttatcaatgacagaaatttttaagcacattaattatgcagttctatttcaatgttaccaatgttcttttgataatatatgtctattatttctattttgaattgcatttattatagactaaagctgttgtaataaagaatccgaccaaaatttttgatgtttgatggcttacagcttctacatctcactcctccttgctctcctactccctcacatctataaaaagtggataagaaagtctgtgtgcttcctactttggcacaggtcagaagctcaaaccatgtaaaccccttcccctcctggccccacctcctaacaataaggatccaaagacaatctcccttcccttgcttttaggccaatttaggaggcctgccttcctctcttcagaaaagccccattatgtgagtaacaaaactttttgtgcgctcttggggtatgtgtggctttatcagtctctacatctgaaccaaactgtgggtaggaatctagcctgcatcttctggttgtatacaatggttttataatttacgtatgcatatgaagtacctggtaagattataaagcatagattcctaaaccttctgcaagtttgtgaattggacactctagtgagacaccaacaagtcagggttttgtttctttttgttgtttgttttttacagatttgtggcatcaacattttaccttttatacccatttcttggataaacttattaactctttcatttaaagtcttgctttaccttgtgcattattctcccactcttctttaaggcttaaatctttgtatcttcaatgacaataagactttagcacacgaatgtgctcaatgttacttctatctcagaactaatcaagtaaaacttgagaaatatcagcaacaataataaatagaaatgtcatcatggtttcttatgtcaatgctaactctaaatttgacaaatttctggtttctagcttgatttagagatggatcctaaataggctgcttgaattttccatcacgtctaattctttgttgcatgtagtttttaagtgccagttaataggcaagcacctgcctgaccacatcagcaacaccagaggcagaaggcattattaaaacacagatttttgggcccactccacagataagttggtgtagggcccacaaaaacgatttttaaagaagcaccccttcaggattcttatgcagtcagctaagtataggaatactagttagtaatgaatgtgttctggagcctcaaaatattttagagcaggaagctgccacttattgtgccaagttttctctccaactcttgcagcccagcatgtcaactgatgaaaaagtgctggcgttccaaaaagcctgggggatggtgctcagaaagcccctgctaggagctagattggattatctcaactcatacctctcagctaacaggtgacaccctgctgaaagctgttgacctgaggctcttttggattgtggtaagagtgtgaattgtgatccatcactctggagaaccctgatcagaggctattagcaatgcacctggtcttggcaattgatagaaaaaggaacactgtgccaggggaagcttgcgacaatgaaaactgtttcaaaattcttctttatatcagcaatcctaactctagaatcatcaaaatataactaggttttattgtgtgtgaaaatgtgataattccaatcaacacagttgtactacttaaatccttcagttagaagaaaaatactaaaaaaatactaaataaacgaacagatttttatgaattttatactgtaatttcccttacacctagtagggaagaatatttgaatttctagaaataatgtatgtatttatctacatataaaaataaaattaagactttacataacacccacctttaatcaacgtaacattttctgacatttatgcattttcagaaaagaaacaactagcctgcaaagcaattgttaaattttaaatgtaggcctccaaaatacaataaacaaactacagaaaacagaagcctatcaacacagtaaacatttgcaatggttttaatataaccataattataaactgaagaacagaaatatattaatggaaaaacaatttactgtagctgtgttattgtcctgaaacaggaagcctatgtatctaataataaggtggaattgcatcatgtgtaaatatataaaatgagactttttcaggcaggcattgaacacatgtttactcagacttttaatgaggtgtctgagagaatagcagtggtcccttcagtatccatttcttcattttcttaggcatatcatctcccaaatgaagagccagggtgatgggctaagacctcatatattaaatatgtacagaaaaaaatgtgtgtgcaactttcctctcactgtttgtgcagaactttctctattttatcttcctataaattgcttgtacaatactttattttatcttcctataagcaaaaacacagacagacatctagttttaatcaatcaaataataataataacttacatgatgaaagatcccaaaatggaagcaattgtctttctgaatgactttttggtaagtaaatctggtcttccagtaagaacttcccatggtcaaactattaagagatgaataaatatttatcttacccaaatcattacatttttgggtctaatttttacagcagcttaacctttaccatatccgatcaaggtagaaaaagaaaaatattcaaagttatatttacagagaaatctaaaataaatattaacagaaaggagaagtgagagattgagaagcaaaaccaaggatacccattgtcactacacctattcaatatagtattgaaaatcctagctagaacaatcaggcaagtgaagttaataaaaggcatcacaataagaaaagaacttgaactatctttcttcaatgacaatacgattttatacctagataacactaaaagactctgccaaaaagctcctagaactgatagacaacttcagtaaagtttcacagtacaaaatcagtgtacaaaaatcagtagcatttccatacacaaataaagtttaagctgagtcaaatcaagaatgcaattctatttacattagctaaaaagaataaaataagcaggaatacagctaaccaaggaagagaaagagctcttcaaggagaactacaaaatactcctgagagattacacaaataaatggagaaacatcccatggtcatggatcaaaagaatcaatattactaagatggctgaactgcccaaagcaatgtacagattcagcattatttctaccatactaacaacttgatttttcacagaatcagaagaaactattctgaaattcatatggaacaatagaagagcctgaatggcccaagcaatcctaagcaaaaagaacaatgctggaaatttcacattacccaacctcagactatgctacaaggctgcagtaaaaaaaaccagcatggaactggtacaatagacacatagaccaatggaacagaataaagagatcagattaagtcatacagctacaaccatttcatctttgacaaattttacaaaaataatcaatgaggagaagactccatattcaataaatggtgggtgctgagataactggctatccatatgcagaagagtgaagttggaccccctatctatcaccatatacaaatatcaattaaagatggattaaataaagacttaaatgtaagacctcaaactataaatatcctagaaagaaacctaggaaatatccttttcaatattggtcttggcaaagtatttatggctaaatccttaaacgcaactgcaacaacaacaaaaattgacaagtgaaacctaattaaactaaggaggtcctacacaacaagagacattctcaatagaataaatagacaacctacagaatggggaaaatatttgcaaactatgcatttaatgaaggtccagaatctataagaaatttgaagaaaacaaaaggcaaaaatcaaataaccccattaaaaaatggtcaaaggacatgaacagacacttctcaaaacaagacagactagtagccaacaaacataaaaaaaatgctcataatcactaatcatcagagaaacgaatatcaaaaccacaatgagataccatctcacaccagtcggaatagctataatcagaaagtgataaaataacaggttacctctgaggctgcagaggaaataaaacacttatacatagttggtggtaatgtaaataagtcactggaggggcagtttgaagattcctcaaagaactaagaattgaactaacatttgacccaacagtcccaatactggatatacactcaacggaaaataaatcattctgccaaaaagacacatgcacctgtatgttctttgtagtgttattcacaatattaaagccatgaaattaacccagggtatatcaacagtgtactggcaaaagaaaatgtggtacatatacatcatagaatcttatatagccataaaaagaaaaaaaatcatttcatttgcagcaacatggatgtagctggaggccattatactaagtgaagtaatgaagaaacagaaaaccaaataccacatgttctcacttacaagtaggagttaaacattaagtatacatagagataaaaataggaaaaaatagacactggagcctagtagaggagggaaagagaggagggcaagggctgaaaaactaccgcttgagtactatgctcagtaccttgctgacagattcattcaaactccaaaccttagcattatgcaatatacttatgtaataaatctgcacatgtactctctgattctaaaataaaagttttaaataagttacgttcatgaaataaaattaggaataaatattagcttgcccttcccatacatatttgaaatatttaataacaatgggaaaatagtttttgaagttgtaagacaattgactgcaattaagaaaatcacaacagggaatacgatgcagtcatagaaaagatcatgtcctttgtagggacttggatggcactggaggccattatccttagcaaagtaacacaggaacagaaaaccaaatactgcatattgtcacttataagtgggagctaaataatgagaacagatggacttatagaagggatcaacacacagggggcctatcagagggtagagggtaggaggagtgagaggatcaggaaaatgactatttggtactaagcttaatacctaggtgataaaatagtctgtacaacaaacccctatgacacaagcttacctgtggaacaaacggcacatgtaccctggaactaaagttaaaaaaaaaaaaagaaaaagtacatccccataaagactaaaaaaaaataattaataagttgtttttaaaaatagttttaaaatatgctaaaaaaactgtttattgtaagtggtaaaaatgcaattaactaactcaataagaaagaaaaaatacattgacagaaataaactatttgggacataaatgatgaaagacaaatttatttcttaagtttttataaattatatatacatataaactttataaaaaatatatatttggagtacaacatgttttggcatatacatacccagtaaatgattaatactgtcaagctaattaacatattaatcacctctcttagttacctttgtgtgtgtgtgtgatgagaagttagttttattggagaacaaagtagtcatttcccttgagcttagataagtcaataaaactataaagtaagtaagggggaaagccagaaacaacagaatatacattcttcttattgccacatggcacatactctaaaattaaccacataatcagatataaaacaatcatcagcaaatgcagaagaactgaaatcataccaaagacaatctcagatcacagcacaataaaaaatgaaagtcaagattataaaaaaatcactcaaaactgtgcaattacatgaaaattaaacaatatgctcctgaatgagttttgagtaaataatgaaattaaggcagaaatcacgaagttctttgaaactaatgagaacaaagatacaacacgtcagaatctctgttacatagctacaaggtagtgagggaaatttatagcactaagtgctgacatcaaaatgttagatctcaaagtaactacctaacatcacaactgaaagaattagagaagcaagagcaaaccaaccccaaagctagcaaaatacaagaaataaccaaaatcagaactgaactgaaggaaatggagtcataaaacaacattcaaaagatcaacaaatccaggagttggttttttgaaaaaattaatatgataggctgctggtagactaataaagaagaaaagagaaggtccaaataaacacacttaaaaatgacaaaggagttgttaccactgaccccacagaaataaaaataactgtcagaaactaccatgaacacctctatgcacacaaactggaaaacttagaagagagggataaattcctggacacacacactaccccaagactgaagtaggaaggagttgattccctgaacagaccaataacaagctctgaaattgaatcaataataaatgccctgtcaaccaaaaaaattccagtgccagatggatttacagccaaattctaccatatgtataaggaagagctgattcctactgaaactgttcaaaatattgaggaggagggattccttcctaactcattctatgaggccagcatcattctgataccaaaacctggcagaggcacaacaacaaagaacactttaggacaatatccttgatgaacattgatgcaaaacccctcaacaaaatacttgcaaatcaaatccagcagcatatgaaaaagataatccatcataatcaagtaggcttcatctctgggatgcaaagttggttcaacatatgtaaatcaatgaatgtgattaatcatatacacaaaaataaaagcaaaccccatgtgattatctcaatagatgcataaaaggctttcaataaaattcaaaatctcttcatgttaaaaactctcaacaaactaggtattgaaggaacatacctcaaaataatgaataatctatgacaaacccacagccagcatcatactaaatggacaaaagctgtaagcattccccatgaaaaccagcacaagacaaggatgccatctcttaccgcttctattaacaacatagtattggaagtcctagctaggttaatcagacaagagaaataaataaagcgtattcaaatagaaagaatgaaattcaaactatcattgttagcagtcaacataattctatatctagataaccccatagtctcagcccaaaagttccatcagctaataaacaacctcagtgaagatttaggataaaaaaaccaacgtacgaaaatcactagcattcttacacaccaagaacagccaagctgagaggcaaatcatgaatgcaatctcattcacaattgcaacaaaaagaataaaggacctaggagtatagctaatcagggaagtgaaagatgtctataatgagaattgcaaaacactgcttaaagaaatcagagatgaaacaaatgggaaaacatttcattcttattggtaggaagaatcaatatcattaaaatggccatcctgcttcaagcaatttacagattcaatgctatttgtataaaactaccaatgacattcttcacagaactagaagaaaagtagtttacaactcatttgaaacaacaaaaaaaagtgcccacataaccaaggcaatcttaggcaaaaacaaaaacaaaaaaagcaaacaacaacaacaaaaaacaccaaacaagcaaacaacaacaaaaaaacaaagttagaggtatcatgttacccagtttcaaactatactacagggcaacagtaaataaaacattatggtactagtacagaaacagatacatagtccaatggaaaagactagggagctcatcagaaataaggctgaacacctacaaccacctgatgttctacaaagctgacaagcagtgtgaaaaggactccctattcaataattttgctgggataactagctagctatatgcaaaagattgaaactggactccttccttacaccacatacaaaaatcaacacacgatggattaaacacttaaatgtaaaacctaaaactaaaagccctggaagacaacataggcaataacattctggacacagaaacaggcaaacctttcaagatgaagacccaaaagcaattgcaacaaaagcaaaaaagagacaaatgggatctaattaaacataagagcttttgcacagcaaaagaaactatcaacagggtaaacagacaacctacagaatgggagaaaatatttgcaaactgcaactgacaaaggtctaatatctagcatctataaggaacttaaacaaatttacaagaaaaaaaaacccactaaaatggttggaaaagtttgaatacacttttcaaaagaaggcatacatgcagccaacaggcatataaaaaaatcttaatataactgaccattagagaaatgcaaatcaaaaccacaatgagataccatcatattacaccagttaggatggctattatgaaaaagtcaaaaaacaacaggtgttggcaaaaattgtggagaaaaggaaatacttatacaatgttggtggaagtgtaaattagtttaatcattgtggaaagcagtgtggtgatttctcaaacagctagaaacagaattatcatttgacccagcaatttcaaaggaacataaatcatactaccataaagacacatgcatgcaaatattaattgcagctctattcataatagcaaggacatagaatcaacctacatgcctattaatgacagattggataaagaaaatgtggtaaatatataccataaaataccagatagccttaaaaaaataatgagatcatgtcctttgcagggacatggatacagctggaggccatcatccttagcaaactagcgcaggaacagaaaaccaaataccacatgttctcacttataaggggaagccaaatgatgagaactcttggccgcaaagaggaagacggaaacaacagacactacagcctccttgagggcggggtgtgggatggggagaggatcagaaaaagtaactattgggtactaggctcagtacctgggtgacaatctgtaaaacaaacctctatgacatgagtttacctatataacaaacctgtatgtgtgcccctgaatctaaaataaaaagagagggaaagatcaatttatcattaaaactgagatacattttaggaatggcaaattacattgtggggccagagtaccccatacatatcataatattttgggtcagggattatataagaataatggacaagatcttgggatactcttgcaactgtccagacctagaaaaaatgggaagttgttgagaaaatctgtgatcatatgagtgagtgataggagatttgtaagtttggaaactgatatatatatattttttcagattagagatgatttaggttggaactcttgcagtggctatagaggttgaatggtgagtgatgacacacttcagtaatttagactcataatgtctattgatgtcttattttggaaaattgatttgattcctagggaaataatagagaaaatctatttcaactatgggtgagatgctttaggttattttgtttgcaacggttggaagagtaaaataaatcacatcacctttttaattcttagaatatttagtcagttacattccctatgttatcctcaaccaaaaagttaacttttccaaagacaaattcattttatgaagttgtgttactttttattgaaaaaaaattaatgtcactgaaattttttttcattctacctcttatttaatatgcaaaaacttgttagtaattgagatagaagacctgtagtttaaatgttgtattattcctgatggatgattatgaatataggacttgactatatttcaagtttatagtttataaagaatgtagtttcagtggatttaaaatagatataaatatagattaaaaaattatttatagatggtttagcatgaaagttttctgctaaacacttacaagtctgttaaatatcacttcagttaacagtgaaatagtgaatctcattcatttttttttaaatctaaaatcagattccatctgtccaatttggtattttggcactaactgttatttgtgatttcgtttgatatggttcatctggaattttagtagtgaccattcattgtgatttgatttgattatacatagctctctgtgatgcttactggaacgcagctttataaatgcaaattgtcctgtatgtctcagttactctaaaattggatttaactatttggaaattgtgggccaagagaagcttcatgaacttcttttaaaaattctgtaaaacatggtatatagcaaatctatttttgaatcttttacatgtaaatttaatggaaacattaactttcatggcagaaataaatatgtatatatgattctaaatgattcattcatcaatatcagaattaaataataaagacaaataaaaaaattcctgtcaatgtggccttctccttgaattataagtcaaatgtattccatacagtacattgaagaatttgtacctatgttaacacaaaagtttgatccatagcatattcttcatgaataaaagaagtaagccatagagggatatgtgtaaattggatacatataaaagtattaggcaatataaattaatagtaaaatatgatcaaatttgaataaactttcttgaaaataacaaattttcaagcaggaataagtaagttatattttataatttccaaggtcattatagtacaaatcatattacgatcacttttttatagttagaattatttctaataggactatctgagctacttcgagaaaactagcaaggtctaccctgaaaacacttcagatatgtgatatttcaacatgtaataatatttataatacatatgtcagatcttaggtgatagactatttactaacataacaattaaaaacaaattacaaactgaatttctaacataaataatgaagattaaatatcctatgcactcacacatatattatcaaaacagtatgttactagacaaaaaaatatcacaaaattataatttttcttcctttttcgagacaggatctcatactatcaaccaggctggagtgcagtggcatggtctcagcttactgcaacctctgcctctggtgctcaggagatcctcccacctcagtctcttaagtgggaccacatgtgcacaccaccacacctggctaatttttgtattttttgtagagatgaggttttgtcatgttggccagcctggtgtcaaagtcctgggctgaagcaatctgcccacctcggccttccaaagtgctgggattacaggtgtgagccactgcacccagccaatttatttcttttttaattcaaaaacttttatattgagtactaaatgtatgcaacacattgtgcagatattcgagatacacagatgaacacaatcaaatgtcttctgacctctaaccttatagaagagtccagataagaaagtaaacatccagcaaataatcaccccaatgtataagtaaataaaactgacaaaaataaaaaaggatagctatatggttccaggaaaccccaatagagaaattcactctagtttctctgaggaagtaaagatttagttatgaaacagcattataaagcaattagcaggatcagagaagaagcagtgcggaaagaccattccaatcagaaacagccaaatgttaaaaggccctcaggagtttggcatcgtgaagaaatgagaccatttgaggtcaggttgagaggtaagactgtacccagactgtgggccatgataaagactgaccacttgatattaaggcaatagaaaagcactggagacttttaagccagagatggaatggagaatcagggagaagatcagatttgtagactggaaaattttgacttcagtatacaaaaagaagtatctgaggaaaagagaggtctggggaaagcaggaagccactaaattagctcatgtgagtgataatggctgctggatataaggagatggaaagaaaggcagagaagtaggtagaatcaataaatatttaagaggttaaaatatataggattagtactggaatgggtggcatttgtgtattgaaagagaggaaggaatacaagagatatttaagaggaacaagtttacaaaactaaaccatatgtttggttataaatatgttgaatctcaattatatttatgatatttacttggaaaacataagtaaacatttacatactaaggtatgggcttcagtgagataaaattttgtgtttattacatattggtgataatatcacaccttgggcagaaaagagactgctagagattataatgcctaaataaaaaaagaacaaaaaattaagaaatctttaaatgtaatgttttgtacaaaaagatgaaccactgaaaaagactgagaaggacgtttttaaaatatcacctgaggccaaggacagtaccgatatcaatgaaagatttcaatgaaagagactttttcaatgagaggatttgagtcctattgaggaaaaaattaattacttaaattagggaaaatagttaatatcattagtaatcacagaaatgcaaattgaactattaagatataactgcaaattagcaacagttaaatgataatatagaatgtaactataaaatgagtatcacaatcttcacatgtctgcttcttactttttttggaagcccagtattactttaaaatgtatcatgtaatctactaccagcgatatttggaacacagtagtaaaaataagaattattaaaatatattaagagtgtatatttggttccacgctgaaatggaaaaatgcatttattcctattatttctgctaataatggctaacaatcctggacattatttgtaaaacaaacagaaaactgaaagttggagggaagaagcaagactagctagtaatcctaggatccgagaaataacatattggtgagcacactgggttttctttatactttatatatcccagatcataagtgcttagaaaaataccttgaactaccaacaagagttcagataaaaatagcacccccaaatgcctgctttaaccaaacaaaagcaatgttgcaagacagaaaacgttaaaataactgacctgctctagccaaacatcatgaaaaattacattcatgaggccaacaagcatatgaaaaatattcaacatcactaatcgttagagaagtgcaaatcaaaaccacaatgagataccatttcacaccagtcagaatagctattggaaagtccaaagataacagactctgccgaagttgtggagaaaagtgaatgcttatgcactgctagtgggaatgtaaactagttcagccattgtggaaagcattctggagatttctcaaagaacttaaaacagaattaccatttaacccagaaatcccatcactgatatacccaaatgaaatataaattattttaccataaagactcatgcacacatatgttcatcgcagcactattcacaatagtaaaggcaaggaatcaacctagatgcccatcaatggtagactagataaagaaaatgtggtacacatacaccatggaatactatgcagccataaaaaaagaatgagatcacatcctttgaaacaacatggatggaactgaaggccgttatcctaagcaaactaatacaggaacagaaaaccaaataccatctgttattgcttgtaagtggaatctaaacagtgagtacctatagacacaaagaagggaacaacagacaccaggagcctatttgagggtgaagggaaggaagagggtaacaatcaaaaacctactcatggggtagtatgcttattacctgggtgaaaaaataatctgtataccaaacctccacagcatgcaattcatttctataacagacctgcccacgtagccctgaacctaaaataaacatttaaacaaatacagacccgctcccaccctcatcttcaaatgttgagtgggaaactagacttctacccatgcccattggaaatgatgcactcctcccgttcttagccagagaggtgtcagcagaggcccagtgaaaagcccaatatcccactttcactgctagtaggaatgtaaactagtttggccattgtggaaagcattctggaggtttctcaaataacttaaaacagaagtgacgaggtatgtcaaaagatgccatttggggaatctggaccttgacccctacctggagctactgactcaggactcacttcccccaccagcagtgtcagaggatgccagctaaaaagatgattttttaaaatatccagaatctcataatactatatctaaaatgtccaggatagaaaacttatgttttccaagtaaatatcaccacgaaggcaattaataaatgacaataccaaaatgtgacagattttgtaatgatctgaaaagaattttcaagctgtcattataaaaatccttcaacgagcaattataaaggtgtttgaaaaaataaaaaattagaaagtctcagcaaagaaatataagatattaagaagaatgaaatgcaattttagaaataaaaacataagtaaaatgtatttttctattttcaagttcacaggagaatggaaaaggcagaggaaagaattggtgaacttgaaaatacaaaaataaaatttgttaaaatgaataatagaaaataaactgaaaaaaaaatcatgaactgaacttcagggacctgtgggactataacaacagtttataagatgtaactttgtgtcatcagagtcccagaggaaaggagaaacttgagggggaagtttaaaaagtatttaaagaaataatggcagaaaatgtaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaattgacaagaagaaaacaaacaaccccatcaaaaagtgggcaaaggatatgaacagacacatctcaaaagaagacatttatgcagccaaaagacacgtgaaaaaacgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatagacccaaaggactataaatcatgctgctataaagacacatgcacacgtatgtttattgcggcactattcacgatagcaaagacttggaaccaacccaaatgtccaacaatgatagactggattaagaaaatgtggcacatatacaccatggaatactatgcagccacaaaaaatgatgagttcatgtcatttgtagggacatggatgaagctggaaatcatcattctcagtaaactatcacaaggacaaaaaaccaaacaccgcatgttctcactcataggtgggaattgaacaacgagaacacatggacacaggaaggggaacatcacattctggggactgttgtggggtggcgggagcggggagggatagcattaggagatatacctaatgctaaatgacgagttaatgggtgcagcacaccagcgtggcacatgtatacatatgtaactaacctgcacattgtgcacatgtacccaaaaacttaaagtataataataaaaaaaaaacaaaatttctaaatctggcaaaagatattaacaactacagattcatgaatctgagtgtaccctaagtggataattctaaataaatccaaacacacatctattcaaactgaagtcagtgagtcagtctgtctgtctgtctgtctgtctatctatctatctatctatctatctatctatctatctagaaaggaatgaatacaaacatgttaactatatgagtaaaacaatttaattgacagcatatttctcatcagaagttcgggggcaagagtgaagtggcacaaaattttcaagggttgaaacattttctttaccccaaattctatggtcagcaatcctatctttcagaaatgaagacatttgtaggtgaagaaaaacactgagaatttgttataagcagatctactctaaaaaaatttttgaggaagtttggtaaacagaaagaaatgataaaagaatgaaccttggaaccccaagaagaaagacagtacaatatgcagagcaaacatgtgtaactccagtacactatcattaactacagtcctcatgttgtacatgattagatctttcaacttgttcattgtacatatttgctactaccatctaagatgatgggtaagttaatttgttcactatagtaattattttatagtatatacgtattttataatgtatcgtacccctcaaatatacacaagaacagttttcaaaacaatctaatatattttatttctctttagtttgaagcaaaagcttaaaattatctaatgggaatcccagtgtacaaaaaggaaatggttaagacaattacattataatcaggggaaatcaagagacttaaaaagaagttacagtttcaacacttcactcaaactggtaaaatacatcagtagatctttgttgtgatgaagtagttctgtacttgactcaggtggtggttacaggaaacatgataaatggaatagaaatacaaaacacacacacacacacacacacacacacacacacacacacagagttccaatactaatttcttgatttcataatagtactatagcagatgtaactactgggaaaagctggttaagggccacatagaatcactctgtaatatctttgcaacttcctgttactctatagttattccaaatttaaaaaaaaaaaactaataaaggacattagttatagggagctcagacatagctgaaggtcctacaaagtggaggccaaggagacatactgaatatttcagaatgttgccaagctttatggtatttttcctgacttctcatctaaaactatggaggctagaagatagtggagtattttaagtgtcaaaacactttaaaaatgaagcatattgattctgagttctgaaactgcccaaaatatcttttatgaatgaagcaaattaagacattttcagataaaagaaactagcagaatcaatgtaactacttttgaaatatatgtgacaccttcttccaacatttaacatacacctgtccagaaattccatttctacatatttatccaggaggggaaaaatgtatgtttatgaaaaagactcatatataaatgctcatgataaacttgctaataacagaccaaaacagtactagtgtccacacacccgagaatgaatcatatgctgatatactcatgcaatggaatactatgtgggagtaaaactttatgacttattaggacataaaacaacatggatattccttaaaagcattatacagactgaaagatttttttttttgtaccacaggatatagtatattactgaatttatgtaaaattctataccaaacaaatctaatttgtggtggaaaagagcttcaaaacagtggtcatcaatgggatataaagggcattaaaatgtaaagaggccagaaaaaacctcctgtgatatctgtaagtatatagatttattataaccaataatattcaagttgaaaaaataaaattattcgatttagataacaaaaatattattttgggaaattaaaacacactgttgggatttgtatataaaacatttagcacaatggaattaaaacaagataaaatgatgaaaatgacaaattgagatgtaatttaaggattctatcattttctcaatttacggttttgttatcctccaagacatagcttctcttcacattgtctcacttgtcatctccattagatatatttcctctgtgctgcaactgcatcctatggattcatctaccacagtatttcctttttgcatatgtctctgttactcctctagaccagagaacgtggctcatttatctttattcttattgctatcatctggcacagaatctgcctacagcaagtagtcattaaaggatcagcaaagcaattcacaactaccaacaattaagtagaaaattcttttcttccttttttttcctattattgtacaacagtgagttcctcagtattgggttaaatgaagttcacaaatgaaaatgtccatattgcccagttaatacaaattattgaaatgggttgacacaaataacttctgaataagtaggaagttgtgtcttatctaaggaaaatcacactcctctcaatgcctgctaaacttttgtcatggaggaatataacctgagcacttcagagcttcagattttcaagagaagagacatatttcagcttttttataatatcagctcaaacttcacatcttggctaaatatctgtgtcacatatattacaattctattctagattctgatctgagatacaccactttgtgatctatgctacgtaatttcttagtctcaagtaaagagtacggaaaaagaaactatgttagaaggtattcttattgtgaattcagtaagctcacctgagcaatatttctttagactttttattcaacttagaaacttgaaggatatggttatattacctttgaatggaaaaatttaaagagagaaaacgaatttggttaaaccagtgatcagttgtaaatatctaacatctgggttcttgatccaaataatttcacagcattcgcaggaaatatttgtgcttaaaaacttaatacaaattgcaaagcaaacttttacaaaaaactcttacttttttctctgtctccatgatcataattcattgatttaaaattgaacagtatatgttccatattagaataaatttttttaaaaagggattaattcactgtgtctactcataatcacagaagaacagagttattttacccattagtttacttactttttttttttttgagatggagtctctgtcacccaggctggatggagtgcagtggtgccattttagctcactgcaacctccgcctcccaggttcaagcgattctcctgcctcagcctcccaagtaaagtagttgggattataggcatgccccatctcatttggcttgttttttgtatttttagtagagacggggtttcaccatgttggccaggctagtctcaaactcctgacctcatgtgatccacccatcttggcctcccaaagtgctgagattacaggcatgagccacagagcccatttactcaccttttgaaacacacacacaccattcttcaccttaataactacctccttttattttttattacacagaaaacaaaaataatatcccattggaaaattgttcacagattttattcacttaatatctagtccactactactaatttatttgatattaatatttaaaaaacacaaaatcgaagaatattatgaattttttcaacatatattgttactattttttctttatgccactgttttatgataataattatatataggtattttccctcacattttatgtaaagttactagtggagttatacattaaaactttacagatagttaagtttattgaagccctgtatctttaggtatttgtgtctaaaagacatatagatggttacaatgaaagatgcattattgtattttagtccaggtctgtcagactatgtaagaggaaaaaaaaaaaggatgtggaggaaagaaatgcctaattaatataagtgacaattcagggattggatgatgcttaaagagagatttcataatcaatacataatggcaatgtcatcaaacagctagaaattaaaatctgacaaatttgacaactcccaggaatctttgcaccactggtatttattcagtaatacacagtttgatcctaagatattcatcattgcttcctcgttcttgccaaaattttcaaatttatataataggagtttttctctgcaggaaaaaagacctctgattttataatgcatttcagaagaatattagtgatttataatcaacagaattggaatatatccattccatataggaatatattactgaactctaatatgactaggtttaaaaaacgtttttacattttggatactctattccattaagtataatttaatttatatttactctttatatatgtttatatcctagaattatactttaaattcaacttttctatgaattcagaatttatttcaggtatcaataggaggaaagttttgactacttttttggtcagtttccttatttttaagagtatatttaaagtaaatatagcactattttgttgagttaagcatataacataaagtaacacttgaaaaaaatactttctgatatttatttaaaagataatgatctctaagcaacgtttagcttatttgtaagaaaacatttttcccccaaggccaaagttcaaaatcacctcattaggaaagaaaataactgacataaacaatcgcaaaaacaaaaataataatgatccattgaatactaattctcttacacttagaaagaattcctaatagttcttagggcatttcaaaaggaaaaatgagaaagaagtgagaacaggatgtgaataaatcatggaaatattctcatcatggtttcctgttcttcctcaaaattaaaagaaatcaatattaatttttctatgcaccagggatgatggtaaattctttaaacacattttcttcaagtaatccttgctttcttcaagtgatggttgctacgtaattacaattgaaatctctttaattattatcctagtgttttctttttgcatgtatttggttattttgttagaaaactattggtttcttttacaaaaacaaatttgcttcaggcagacctgtcaaattttacattttcttccttttttcttattcagacaatcaagagatttgtctcaagggtaagtctaaaggaaacaggttctgaaaatacttattctttttaccatttgaagagttccatttatcagtttaatttttattaattccctaatatgaatgattcaaaaacgttgtcaaagtaagtatatgggtgtcttttttctgtgatctacaatggtgacatcatttaatgctacattatttcatgtgactcattgtcattgtgtcctgtaagctttggaatagtgcattctactttttgttgctttgtatatatttgtactttttgtatggatttcttctttgctctaaaaattacctaacagtatgttttttggtttttaaactgcatttatatttttggtaaaaattgattattaatttctacttttattagatatgactaaagatggtgacatgagcatatctaattattttaatctataaataatttactctgtagccaagcacatgacaaatatttgtaaatactctccaaacaccaaatatatgttctccatttgagggatacatgattaaatatgcacacacatgtcatctctgtataaatattaacataaataaaataaataatggaacatattttttatatttatcatttcaccagaatatttagtttataagagggatattagaattttcgatgaaaatgttgcttatcaagttagctttgcattgctaaaacttcagtatttcttccaggcagttatttgcaagatacaagttcactattattatatatttcccttacatttttcttatgattacataatgtctcatgtcatatatttaggccctttaattctaaatctaatcatatcttgatattaatgttgtcactccttcttggcccattattttaaacttttcttatactttaataaatttgtcccttctaaatagaacatagataggttttgcttctaaacaaaatacatgattacctgttatattagtctgttctcatgctgctctgaagaaatacccaagactgggtaatttataaagaaaaatagtttaattgacccacagttccgcatgactggggatgcctcaggaatcttacaagcatggtggaaggggaaacaaaaacggccttccttacaaggtggcaggacagagaagtgttagaaggggaaatggtatatgcttggaaaactatcagatctcctgagaactcactcactatcatgaggacatcatggggaaaactacccctatgagccaatcacttcccaccaggttcctcccatgacacatggggattacgggaaccacaattcaagatgagattcgggtgagcgcataggcaaaccatgtcattccacccccagcccatcccaaatctcatgttctcacatttcaaaacaaaaacatgcattctcaacagtcctcaaaggcttaactgattccagcatgaactctaaagtccaagtccaaagtctcatctgagacaaggcaagacccttctgcctatgagcctgtaaaatcaaatgcaagttagttaattccttggtacaatgggggtacaggcattgtgtaaacacacctattccaaatgggagaaactagccaaaacaaaggggctacaggccccatgcaattctgaaatccaatagaacagacattaaaccttaaagttccaaaatgatctcctttgactccatgtctcacatccagggcatactgatgcaagagataggttcccatggccttgggcagctctacttctgtggcttttcagggtaccgtgcccctcctggctgctttcatgagttggcatttagtgtctgcagtttttctgggtacatggtgtaagcctttagtgtatctactgttctgggggctggaggacagcggacctcttctgacagctccagtaggcagtgctctagtatgcactctgggtggggactctgaacccacatttcccttctgcactgttctagcagaggttctccatgaggtctccacccctgcagcaaacttcagcctggacatccaggcatttccatacaccctctgaaacctaggcagagtttcccaaacctcgcttgacttctgtgtacccacagactcaaagccacatggaagccaccaaagcttggggctttcaccctctgaagtaatggcccaagctgtaccttggccccttttagccatggttggagatgaagctgctgggatgcaaggaaccatgtcctgaggctgcacggagtggggagccctgggcccagcccaggaaacatttttcccacttaggcctccaggcatgtaatgggaagggctgctgtaaaggtctcttacgtgccctggagacattttccccattatcctggtgattaacattctgttctgttttacatatgcaaatttctgtagtaggcttgaatttctcctcagaaaatgggtttttcttttcaattgcatcatcaggctgcaaattttctaaatttttatgctctgcttcctcttgagcactttgccacttagaaatttcttccaccagatatcctaaatcatgtcttcccaagttcaaagttccacagatctctagggcaggggcaaaatgtcaccaaaatgatttgctaaggcatagcaagagttacctttgctccagctcctaagaactcatctccatctgagaccacctcagactggacttcattgtccaaatcactattagcattttggtcaaaaccattcaacatgtctctaggaagttccaaacttttccacaagtttctgtcttcttctgagccctccaaactgttccaaactctacctgttacaaagctgcttcctaagaactcaactccatctgagaccacctctggctggacttcattgtccaaatcactactagcattttggtcaaaaccattcaacatgtctctaggaagttccaaacttttccacatgtttctgtcttcttctgagccctccaaactattccaaactctacctgttacaaagctgcttccacatttttgggtatttctatagcattgccccattacctcagtacctatttattgcactagtttgttctcacactgctatgaagaaatacctgaaagactgggtaatttataaagaaaagaggtttaattgactcacagttacacatggctggggaggctcaggaaacttacaatcatggaagaagcaaaagcaaaatgtccttcttcccaaagcagcaggagagagaagtgccagcaggggaaatgccagatgtttacaaaaccatcagatctcaggagaactcactatcatgagaacagcatgggggaaccgccaccatgatccaatcacttcacactgggtccttcccatgacacatggggattatgggaactacaattcaagataagatttgggtgggagcacagccaagccatatcacctgtcattatggggggaaatagtgtgaacacttttatctggtattatttctttttatattattttatatttactctttgttttactttttttccccttttttctttttcttatttcaggaagatttatcaaggtgtagattttctggttaatttaggagttttaatactcttttcaattttatataaaagcacatatttctgatcctttatatgaagatgacttattttctaccaagatatctatgcccaattacatccacactaataagatggatattttaaaataaatcactcccctacatgtaggttatgtggttttgttatattaaccccagaataccagtatatttattttctattatgtctttccttattcaagatttcttttccttcacttacattactcattttcaaatagtctgtcattacaggagaatctatttctcatcatgtttcctttgttcttcatctgccatatattgatttgtagactttttcttattttttatcatttttaatatcactctctagagcattttgttctaataggttagtaactaataggttactagtggattatttttcctcatattctttacataaattttaaaaaattttgatttttatctcccaaatttattgtttaataatgtttaatacttattgattattaccaattctatctatttgctcccttgggtattttggtgttcctctttgtttagctaaatgctaaattaatttattttcactttttcttatttaataaatcatatgatcagggctctgaactttttcctaagtgaaactttggcagtattcacatctaatcttcaaaatgtttcttgagtttacaatatttgatagaatctgttgctgattcattatggaaaaacatagaatattatgtattttttagtatgacatttttgacaatgattacataaaataagtttatgacctatttactcaatttgatactaaaaaaaatatggaaaacatttgtagaacatcaaaatcacatgcagacattctgaaaaatgctccaagcatcagaaaaagtaatgactgtgtaattgtatcgaaaactctgaggcagagattaacatgcaggaggttattagagagggcttttagggtcttcatctgtagaagatagggaaggagagataattgggcagagggacaatttcagttctggtataatccgaagaaagtttttaactcaacctgtaggaagctttgaagctagaatggctatttaagattgtcaagatttggggaactaagtgactcattggattcaggctgcctcagaaaataaatgtgatactgctctgactaggtgattcttgaagaaaattgcatgcagaaagctgtctaacagcattccttctagtaactagaagaataagtataagccctcagtccatcacaaatagtaatagtttgattagatagtaatgttctatagcatgtttcattctaacgtgctattttgttttaaatatacaaacacatatatatgcatttaattgtactttgtttacattttcagagattagctatgtattttcagtcaacatataatacattatatttttcttatttaaaatatttggacatagtctcttaataattagattataggaagtctaatttttcaggaaaatatttccagtgttaaatttgttatttaacttatattactggttcagatatttagaattttcctcccactattttattgatattctataattttgttttgatttaatttttaacctaaatgacatttgtaaaatatgtttttattaaagagatcaatgttagtgaaaattacttaataattaaattatataagatacttgtattactaatagcaaattacttgcaaaaggccacgaaccagcataatatttcctaatgttgttcttcatagttgcacccattgcctcatgtcaccatcattgtcatagatctctccaaggtctaggacaaagaaaatgattgtgttgctaagaaataaaattgggtttgcattctgttagataattatgctggcctatgttcttctaggcaggaactgtttcatttctctccatactttacacacctagtgttatgagaggaattttgtccaccaccctaaagatcccagtgttgaagctctaacccctagtacctcaaaatgtgactttatttggaaataggactttaaagaggtgattacattaaagtgagaccacaacagttggccctaatccaattggtctttataagaagaggaactttctacaaatacagaccagggcacatgcacagaagggcaatcaggtaaagagccagaaagagggtgaccatctgcaatccaagcagagacttaagaaaaaaataaacctgccatctttgatctcagactgccagcctccagaactgtgaaaaataaatctttgctatttaagccattagtttgtggtattttgttatagcaaccctagcaaactaaggcagctagtatagtaaagagcatacttaggtcattttgagtactttacttccactttaatagttcagccatgaaataaaatatataaatatatgaatcatagataaaacaatgtaaaataaaaaatgataattttaatattattcattaaaatataaataaatattttcatggctttagattttatgtaacatacaccctgatgctgctctagcaattaattaacaatatgacttcatattgttaattaatttcatgccaataatacacaagagcacagacggcgacacttgtattagaccaaaaaaaaaaaaaagtcaaaaactgcaacttgcctcccgtgttcatgtccttgtgtaatctctaccttgaatattgacaggacctgttactggcttttaactaatgagaatatgctacataagattgtaacatccatctcgcgagattaagctcttctctgctggcattgaaaatgcaagctaccatattataagccaccatatgggaaggccatgcagcaggagctgagggtggccatgttcagttgacagcattcaggagctttcacctcaaaggatctcacagttccagtcaatatttttatgcaaggaagagcctaagcaaaggactcaattgatctgtaccggacttcttacccacagaaattcagagatcataaatgtgtgtgtgtgtgtgtgtgtgtgtgtgtgtgtgtgtgtgtgtgtgtgtgttaaccactaaatgcgtggtaatatttttgtgcagcaatagataaatattatgcctatcttcaaacattatatgacatgttttgctaaatattttagctgggtacttatttttcaccatatctacacgaaggctaattttcttctctattctagagaaaattttcttataaacgttatgctcagtgctgccatgttctttatcaatagtatcattatgatttctaatcagccttctgtattctcttgttaactgcatactgacaagtgacaagggtgatcatcagtgatattttggtataaaatctaataaacagattgaaaagcatctctctggatttctttaagcagaatatagtcatgtaaaaattctttagactgttaatgtaatcacatctttaggcatgatttgttgcactctctggctttaaaatatcattgttaagtagataagactattatggccttctcttcacaagtgacatttatattattaatagatacattattatcatctgatatcattcaaagtgcctccatttattttgcaattagctaataattgtctaacgatagttctattaatactaactacatgttatgccactcagctggtgtccatcatagattgcctttggattcacctattcatttgtaggtcttaaatccttcacaatattttaagctctcggaaaagagggctcaagtcttttgaacctcacagtgccaactcctaccacatataagtagatattttacttacatgatcatgtgattcgataattcattaccttcaagaatcttgaagcatttaaggaaatagaaaattcacgtaggtacaggtgaaaggaagaataaactgccttaaaatggacaaaagtagaaaaaatttcaaaagaaaggagcaaagaaaaggtggaaggaagaaaagaaaggagtgagaaatgaaaaaaggatgatatactgaaaaatagaaaatgtaagacaatgtattttaatagttttatacaatgaaatgcttggtgtattaaaattaatgctaaagtagattaactgtgaagaaactgctttactggataattactatgacagatccgatataaagtaattttataattatatgtttaataattttaaagatcacactctgttatttgataattattaatatatctcttctaaactgtaatggttatatgagcaaagaggaagtgagaagagcaggagaacttttaatacttaggataatctttgagtagtcccttcactaagtacatttaattacctccattaagcatacctactgcttgattactagagcagattattttttccaactgaaatattaaaaaaatggacatgagtctcagattttcagtcaggatatgtaattatactgataggaagggtaaaggtgatttattttcatatttaaattagacaagccactcaaccaaaattaatagttaataaggaattcaaccaggtcacattatcaaaaagtacaatattagttttttatattatttaaaaacaggaaaaattaaaatgccataagttaattgacaaatgggtttagaaaggaaaataagctcatataatacatcttgaaatgtggacaatggaacacaggcatgctacatttcccaagtatttaagttattacacataagcaaatgcactcaggaattttacatcattttgaatcttcagaattacagaagggtagcatgcctttgtagagaagggtggtttttatttcaggtaacattctatcagcattaccactgacaggttagtattgcctgcactttatctagattaagccttaacataactctttcatcaaagctactacactgacatgtaggtgactgattctaatggaattagatgaaaagaagacaaagaaagggctgtcgtgcccacaccaagagctttgccacccaacatgtaccattatttcctttaaagctttcaaatttgactttgaacaggtttcaccaaatacaacactgaagcaattgctattactgatcatgccagagggattagtagaattttctcctgaattatttctttccaaagggggagtttgtagattaaatgagtcttggaaacgtttgctgaaatgtatagattcattttatgactagctttctagtcactgtcttgtgggttattaaccctataaaatgaatattttgattaactgtcctcatttttaaaacatttgacatgaattgttcttggaaattttagtgacagcactcaatatgatttcctcagttatttattcaacagaaagttgtctattatgtaaaaagcattgcagtgtagataaaaattaagcaagtcaaagcattgactaagtaattacattgtgtttggagacatgttagcagtttgactctgctaaagctttggctgaatatgtccaaaggcaggaaatgccactagaaagtttccagattataaagatccttgcataacatgccaaggcatttaataaacagtgagaatacctttatatatttttaacagaagagtaacaaggaagatctgtatttcagaaaatcagccaagcttcagtctgtagattttaattgctttaacttttaacttcttttcaaagagaattaacacaagctaagttggtgacagcagcaatggtgaagggaggaaggagagataatagaaatagtcaagaaatataattaatgagacctagtgcctaattagatttgattgcataagaggaggagaaagtaaaaatagtaataagactgcttcagagactcccttggaattatagtgtattccagcaacaattaaatcctaaaaagacccagagtacttttcattcaattcctatgctgtccaatttctgggactgacagctgtcaaaattttggctcctttaaccatatcccgtattcttgtagtcttagatctttggcccagatatatgactataaattatatatcctctcatattgttcctgttcccatattttctggacttcctctttccaagtccaacttccttcagttccctttcctcctaaaatttcccactgtgctctctcagaactatattcctcagttaacaaatttgaccatataatcattgctgaatatttcaattaaattttggctgttcctgagaacaaattatcttactgctaccctctcaatttaagggaaatttcctccacattcctcagtcattaggactgtgacatgaggatggcattccacatactctactcataattatccagaccatttccctctgatattatccaaaatacccttgctctttggtacttaaacttagtcacacacacctttttattcctttctacatcatctaccaacatcttcatcagtctttccctggcctcccattctttgcttctgcttctcagtttctcatcaaagataatggaaaaatctacttggattatccctctgacaaattggcatcccagtcccttaacttaaactctagtgacattttcatctattctattttagccactcaattctaaaacaaaaaataatgaccttattcttctctagaactgctcaacctctacaaactcctacatctgttatttgactcagttctcaattttcttagcaagttactcttttaagtgttttgacttcattgactccttaaaatatctccattagagtgtcgatttcttagtttttctttaatagcacctattctattgaaatattttctattatgggtttaaatgatcttgggaaatgttaactcaactaataggcctctgtgattacgtaatctacaccactattaaaataattataacaacttggatcatacaatgtcttgatgtaaacgatacattaggtcatgttatggaaatgtttactagccattgaatattttaatcttatttagaatctctaatcaaatctatagagtttaattatttcccagatttttctatttctatacttacctaccactgacattattcttatctctgaattttaacctaagttatttgacaaggtagttaattattgcctactcagtcatagaaatcaaaattcaaacataaaaagatatttgttgtaagttttactgttcttgagatcagagaagctattacaattaatagcataaaaattactagaaaagtagaatttttagataaaagaaaaatttagttctctaaactagtctgggttagaaaaatgcatgaaaattatatagtcatgtaatttcttaaaatattatatctattttgagcaaaatatctgaaagttttctttaagaattcctttttgtttctattataaattatttaggaaaaggttatatttttatgacaggttttttccccccatattataactttaacatgttttctttgatataaaaatataaatcaagtaccattatatttatatgtcattaaggtactgttcttgagcctatatcatgtatagcgtattgtgcattattttttctggcaaccataatctagaaatgggctatagaatgaaattcattaatgctatgttatactagaaggcacagaacataaagtaaataaatcttttgtaatatcataccaaccttataaattgctttaagggaataacaatctataggggtggtagatgattttctaatcagatattacacaatatacatcaaatattctcattctgtagtatttaaaataagcagttgtctacaacatacaatcaccagtcacaataaactattcatgcttttgtagacccccaatttgataactgcataaaacaaccaaatattttagaagaagaaatattataaggaatgtatatccaagcttctgtggttcgaccaggagctattgcctgaactacacctccttagttggactgaacaattatggaatgtgtcaaaataggcctaataatttatctcaaaaattaattaataatcaatgataaagctaaagagttttaaaattaatgcccagtaacattcttttacaatgtgaaacaaatgtaattcttatgtcatagtcatattcttagatgccatgtcttggctcactagtgttttaggccctttgcaaagaaatatgtttgtgttgataacagaaagtcaacatttgtagataatttcctttttaaaattagttgactaaacttgtcttagtttagttcaaatatgctttatttggtggcagagaaaaaggacagggtttaaaaacaaggaaattattcataacctgggtatctctaaatgaaagtattgtaatttcaaagacatatgtttcaaaattttattccagttaaaataaaactgtattatggtaagtcctatttaaaattgtaattttatttcagcacaaaagatatacacccatagataatgcaacactttctgcctttatgaatttgcactgcggaatcatttctaatagaaacaattccaaactattccaaaaatgcaagttctatgaagcattctgagtcccaaccaagcatgcaaccaacaaacttttagcattgcactgagagggtttttttaaatattgctatttttttgtttgtatttttaatagtgagaacatgccacaatattcctggaaaaattctgagcttcccttcttatcttgctcttttgggatctgtcttttatgttggaaatctgtctaaaacaacacataatttttgcccctctattcaagtttaagtataacagattaagaagccaattggaagaactctacatctgggcacaatgcattaattattgagatccattatagatagcttgtatagccaatattcttattacatgtgaacttctactggccaactctgtagaccccttctggttctatcatccagtgacctggcagtgggcattctaaacgttaatgtagaaagagtgctctaggtatgtcatactacctaatacttccgttttatctcctttgtgtttgcatttaataggccaatgacattttggcttaatttttgtatctattgtcttttatatgggtcagggagggacatcttttagactgtacaaagtcaggaggcccacagaatttaaatgtttttttgagcacacgttcaaaatagctcttcgttttcagttaccagtaacctctatcaattaccaagcttttcctgagttttcccagataagtcaaattacttcccattaatatctacttccgtaggttcttaattctgacctctctcagcactgctaagtcacttaacaactctccatctactctatactcactcatattaagttttggtattgtagatatcctggttttgtcaaagacagaattgtgtttcttttccttactttgtagctttgaaagaaaaaatggtgtaaatgtcattactccactatcatgaaatttgaaacaattagaaataacagttggagagagagaagagagggatgtaagtgtcattactgcataattttgaaatgaacaattagaaatgagagtaacgaagagtcaaagttttaacttcaaggtgattgatgggacatgggaaatgagttacaatgggacgtctagaatatttcccaccactgttaatatttctgccacaatttgattttttgtgccaaaatttttctcatatttgttgctctatatgtttttaaaaatcagtacagcgttttttttgtttgttttcttttgttttttaacctcagcatttatgaaagctaactatggtctactggatgtaaaatttggagagctgggtttgagttccaaggttgttattctctggtcatgtaactttcagtttttaacttttcctttctttatctcagttccagattactggtataggaaatgtattagagagacatttttaaatgtcctctctaaaatagtgactgttttgaatactttgcatattgtttttaattcttcatgaaacctttaatgtaactgctatattctattggttttgaccaaattatctgagacataacttacccaaggccataaagctatacaattatagatgaatatactgataaccttcaaattttcaaagttgggggcacttatcttttgtttgactacttggcattgttggcaaccaccccattgaattttatggccctaattcttggccatttcttctccacactttttgtagatgtctctgatgtttatccttatatttcaatattttccaagctctttactcagcctttcgttcatcccacgttaaagatggcatttgaataaattttttattttcccttaaaaattatatttccttaaaaattctagccaagaattctctgatatgcacaagatttgtatatgtaaattccatatacctgtggatatcacgagaaattcaaaccaaatgtctctataattatatttattatattttcccccaaaactacctatcctgttcctggttcccaatttactatttactgacatctgaggcctcaatttttggtctcattcatctatttatattcttatatctccctaccttctatctcttctcatctacactctttttctacatctacactgatttttctaagccacaaagttttcatggtataacctacttaaaatctatgtcttgacacaaattttggtgtatattttatactctttagattatcatgtaagtcttttcattttatcttcagtaagcaataaggagttggctactgcttaactttctggtcacttcctatgattcccccagtatacttgttaatctgtctaaagatattgttttactgtctaaatgtttcctgatccatttttctgccagcatgtaagtttctttctatgtgatattgctattattcatcttttaaaattcagctcaaatgtcatccatttcaggaagatttcccttaaatctcctctctactttccatggctcttttttgatattcccataggataatgtacaagcctctctcagagcatgagcctgaatttattgcaaaattatgcatttttgccttgcccatttcctccaattttatttatagaatcttcaatgctatgtttatagattcacttatagtctcagaataattcttatcatataataaacatacagtaagaaaatttcaaagaaagaaaaacaaaaggaaagataaagcatttgattcattgtctttctattaccaaattctaaattgtttccccttcacaatgctgccttacttatctcaaagagatgttctgacactgacaaaatttatgtgaaagcattttacaaatacagaactatattcatttacaaacaactaataagaatatgtattgtgaagcaatatgtagtaacagaaaaacttgaaatacttggaagtaaaagaatagagatcaaatctcagtatcctttatttatgcctgagtatacttgccaacaaaattaggtcaaacattctaaaatccagatggtttctgtataaattgaaatatttttagtttccccgcctcctcacatggtccataacctcaagtaatctatgtgaaaatttggttaaatagcaaagcattctacaaatataaggtcttacttatggttaactattaaacatctgaaacaggcaaaccattgcaaggaatacacagttacagaaaaaagtagtgtgttttaatggaaagagcatggactttggagtctggcaaactaaattctacttcagccagttaccaagtgtatttgactacaacacttggtctttaatctcagtttctccatgtataaatggagataacaccagttctgtccatttctcaggattctatgagacaagtgacataatccatgggtcagcttttgaaagcaatgattctgaatgcagataaaataaaatattgttattttcttgagcttgaaatacaagaaataattagaatgcgtgagatagagaggaaaatcctcggtaacactacctgacaatgagcagttctaagtttttattttattttgggaaggtaattctcaattcacatcagtcatcagctttaggcctgtgactgtaagtctacattttgatattttaatattagacacatatagtacattacatacaacaaaaagaatataatgttataaatttccatttttcaattaactaattctgattaccactttatggctattttattttattttatttttttggctactttaaaactattacataaatatatttccatgtcctgatagtttttcttatattattaagaaaaacagtcctgataatcctgataatttttcttatattattctcattggtgtttaggtgctctgtgccctaaaactaaaaattaaaatgagacatttctttttgaggacaagccaggacttgaaaatgttttgttttgtgacaatctccatcatccttggcctatccagtgaaaatcacacgtgacttctcttgtcactgcaacaaggcctcctgttctgtttgtgtgtgtgtgtgtgtgtgtgtgtctgtgtgttcccaaccaaacacatatttttcatgctcttgtttttttccaaaatacattcatgttatcagaaatctaatcccttcagtactaaattgccaaaatttaggggtcaggagtctgtgtcactgcagaaataatttgtggttctaaagttctcatagccatgtcccaaatctgattttcaaaatctctttatgcacctcttgagttctccattattttagagctttttcaaatgtttatttactttttaggtaactttaactacttttattctctcctatgtattttaaaattcattttcataacagatacaaaactttagttttgaaaacacagttcgtaaggtttaagaaaatttccatccaacataacatgttgtaactataaaagagagttaaaatagagctgaattaccattttttcaaagattaaagactctagaatgaaattaaacactgcattaaaattgtccatatgtttcttacatgaaatatgttaaaatttaattttcttgttttacaattctaaaattggaaatgtctttgtcactcttaaagaaggacattctgggccagtgtactagatcaatggtgaggggacgagcgggtgggtaaagaagtgagtgtaaaaggcatgtctttattgacaaagaaggattgccaatatagttattctacttcaggtatgtagagcaaggataaagcatatgggccaaagctcatccgattcctgcttttatattatccatgaattaaaaattatttttacatttttttaactattgaagaaaaattgaaaagtagaataatatttctgacacatgaaagctatataaagttcaaatgacatggtccacaaattttcattgaaacccagccaggctcatttgtttatgcattgtccatgacagttttcacactataatggcaaatttgaatagttgtggtagataccagatggctccaaagcttaaggtatcaattagctggcactctgcacaagtttgcctggttcttatcagatgcatccctgagactaaaacaagtgttttctccatttccccatattattataatacagacagcagcccctcctgactctagcttaatcatacatgagcagataactgaggaaaaatgaatattacaatattaactgaaataattgtgagttgtttttaaaaaagattctcaggggaaaaagtatacatttatacatttgtaaactgcatatttgcaagactacaatcatttaaatatgttaactttgttttatggcttggagtatgatatatttcggcaaatgttcacatgcacttggaaatcatgcgtatgttatataaattaatttaggtcaagttatttaaatgtgttgttccggccttctgtatttttaatgattttcaggtctattgatctattgattgctaagagaagactgcttaattctacgattatacttttactgcatttgttatttttttcctttcagtttcattactgtacactttccttttcttactatatgctttccattttctctgcttctttttttatcacctctcttgacttctgatttatgaaatattgttttatcattacacatttatgtgaatgtagacagatctagatctatctatctttattatcttgaaacatatatactatttacactgttttagaaaatctgtattagatctctagggctgtcataacaaaacattacaaactgggtggctaagcaacagaaatcaattgcctcatagttccagagaccaaggtgccagcgatgttggttacttcggagtgctgtgaaaaagagtcggtttcacggttctcctagcttctggtgatttgctggcaatattcatcactcattgaattctcgatgtacaaccccagtctctgccttcatcttcataatgtgttctgtcttgtgtgcttgtatctgtgttccccttcttataaggacaccactcatttcaattaggggccaccataatgatctcattttaacttaattagtgctatgaagattgtgcttccaaataaggccaaattcttaggcaatggggtttaggaattgaacatataactttaggggtacacggttaaacctataacagtagctatcctagtatacacaaaacaaaatgcttggcaaataaattctaacattaattggtactttttttttctaacacagttcatgcaagtatgtcaaaataccataactccattaagctaactcttgacaaatgatgtttttgtaaatgtttatctatattttaaatctcacaggggttattttttatcccttagctttgcatatatttaagttttctttgttttttttttttaatttatttgcacatcttcaagctttcatctcaaattatctcctgtttgctcaaacaatatactttaaattttattttagagtgtgtctacttgtaataaattcagaaaatatatcatatggttatccttgaaagatatttttcttaaaacagaatcctatttttcagaaatcttctgtgacatattcaaaatattttatcatcttatgaattccatttcttcatatgaaaaattagttgcatttcttacttttattcattaacagttcactttttctctttttaccctttggcttcttgtgagattttatttccaagacctaccaaaagaaaatcctcagctacattatacttaatggtgaaagactgaagttctccccagaaagattaggaacagaccacaacattgtactgaatattttttccagggatattagggaaaaaaaagtaagacaacttatttggaaagggacattaaaactatctctatggcatatgacacaattttccatatagaaaattctaaggaatagacacacacacattcacacacaaacttagaaccaagagtgggtttagcaggttcacaggatgaataatcaatacatgaaaatcaataatatttctgtacacatgcaataaacaatccctaaatgaaatcaagtcccattagcaacatcttcaaaaataataaaggctaatatttataatggtaaaataaatataatcaaaagtaatataagagctatatactgtaaactacaaacttcactgaaaaaagttaaagaagatctaaacaaatggaatgatgtcccgtgttcatgaattggaaaattcattattaaggtggcaaaaattcccaaattattctatagtctcaaagtaagccctactgaaatccaagctgattttttttagacattaacaagctgatttgaaaatgtttgcagctatgacagagtcacaaaatcgtccaaataatcttgaaatagatgatcaaatttggaagacttgcactttgtatttttaaaacttaccacaagaaacactaataaagacaatctttactaacataaatgtagttataaaagatccatgatggaattgtgaatccagttatatttcctcacatttatggtcaagtaatttttaacaaggatgctaagatgattcaataagcatagaatatccttttggtattattttgtttatccacatacaaaatactaaagttggacccttatctcacattatacaaaacaaattactacaaatggaccaaatagttaaatataagagctaaacctataaaacttttagaagcaaatctatgaatacaccttcatgaccttggattaagcaatagttttttacatataacaaaatcataagtgacaaaaaatattaacatattttatgtttcaaaggacaccatcagaaaagtgtaaagacaacccatagaatggtagaaaatatttccaaattatatcttataaggaaccactaattcagtatatagaatgaactcataagataacaataaaaaggcaactgtctcaattaaaagtggacaaggaatttgaagatacagttcttccaaagaaatacataatataaacagtcaataagttcaaaaatatatgatcactatcattagctgttagagaaaatgcaaaacaaaaccataacgaaataccccttcacacccactaggatgacaacaattaaaaaaagatgtaacaactgttggtaaaatgtggagaaatggaaccttgcatataccattggtgggaaggtaaaatggtaatgcactttggaacacactttggcagtccttcacaatgtttaacatagaggtatcatacagcatagcaattttatcctaagaaaaatgacaacatatacccacacaaaaatatgtacatgtatgatgatagcccaaatgtatcaactgatgaatgaataaacaaatgtggtagatgcatacaagggaatatatccaacagttattttaaaagatgaatggattgtggatataggctacaacattaattaaccttgaaagtattatgttctggaattaaatagtggcaaggattgcacaactttgtgagttttctataaatgggtatattgtacacttttaaaaagtgaatttttatggtatgtgaattatgtctaaaaatacttttaaattaaagatcactttctctttggttttctgcaattttgctatgaaatgcccaggggactatataggtacatggatacacagatatatagatggattaaaagatagaaggataggaataaagatagataatttcaatcttgctcctgccttatagaacttctggaaactgacttgagagtacctgtttggggcaactattgattattatatctccgaatattgcttctgtgacattctttatcactgtgtcttttgggattccaagtgcctgtattttataccttcttcttttatgctctaacttgatctattttatatattttccaactgttcagttgcttgaggttcatttggtataattatcaattcccataccttcctttttagctgtgtttttttggtgttatgtttctatattttgtttgtgatttgtttattgctttgtttcgattttagaattttcacttgatatttttacagcttgtcaatcttaccatttcttcttgaacagagagaacagttattttaaagtctacctcaaatgcttgcagcccttggggactgctgtattctctatttttttctactagtttttgttcaaattgtcctttttccttaaatctatggttatttctcaatctgttagtgacatgacattttttaagttgctgatggaaagcatgtgaggcagggaatgaaattatcttttcttatataaaaagtaaatatttttacatttggcaggcctggaagttcagtagcagtccagtaccaccaaaatctaattgcaaaaaataagatggcttgaaatggtcctgtagttcatgagtcttagtcgatttagggctgccataacagaataccataagctggtggcttacaaataatagaaatttatttctatttcattctggaaattgagacttccaagatcaaggcaccagcagactcaaggtgtggtataggcctccttcctatctcttcactgtctcttccctgtaacatcaaatgacagaagaggcaagctatctctcttgggtctgttttgtaaggacactaatcctattcatgagggctacactctcatgacctaatattgccttaaaggctccacccaccctccaataccatcatcttgggggttaggatttcaacacagaaatgtagagggtacacaaacattcaggtcatagtaccatgtaaggatatatttatgttcaagtcattcttccttttaaattgtggccactttgaggttttcaacttctttcaagacgggattttactaggcaaactttttaaaattttgtaccagatagaaaatatcccctctcttcctcaattttttaaagctattgagtttttaatctcacaagcaactttttcaaaattggccaaagagatcatggctgatatctctggatatccatcttcttacattgctttggtgaaaattacaaccattttacctttaccatgttttaagacatatcaaaacaattgttcagcatttttaattgttctaagcaggaaaagtgatctatgagaaatcattccctattcctgaacatttactttatgtactaatgtacttgtattgttatgtgactgagtccaagaagaaaggtttttgggataattcatatatatgttttcaattattttccataatgaatctgttttcatgtagagaaaaatgtattctattatttttaactagttgattatctttcatgaaattagattggaaaaggccaagagctgagttggtgcactatattagtaccacagggaatacccaatgtccacataaatcacacctaagctgtacataattgtgcaagataacacaagcaaatatgataatttgtggcattgataaatagtttgcataaatatttaattgctatatctaaaatgtttaaaaataaaaatacaaatatatgtattacgttctatttttaaatgtttacattttaattagagatatcagaaaacacagtataacctctaatttccttggatattccattttccagataaagccaaaataaatcagccaatacaacacatgctttttcaattatggtactttttacaagagttaaaacaattatttaaatgtaaaaaattaaacataagactgtgtggaaacttttaaaggcaaaatttttttttgggtgagagcaagtctatatatactgacttctacctaactacagtatccaaacttatgctaaataaattattttacattctataatgatcctcaaattttgagtgcacttacactcttctttctaatatatgtaagtcttttaaggatgttttactaaattgttacactaaacagttggaacaacttcctttggtactatacacattgagaagagattcaatgaaacacactaagctctagcactgaaaacaaaaattttaatgtgtattgccttgaattgtatgcaataaaacagaagagaataagcacagattattgtagtgcaatcttctaaaaatgggaaacttactttcacctgcaagaactatttttgtgataaggtaatgatggtgctataaaataattatagggacactttcctgagtgagtcaatttagagaacagctaaataagtcaattaccaaagaaccccatggtgaagatgttggatttttacaggttttagaacacacatacacacatacaaatacagatgcacacacgcgcgcgtgcacgcacacacacacacacacagagagaggagagaaagaaagaacccattgaatgatagaaaagaacatccctgaaatgaaaggtacatggagttttttgtcatatagaaaaaagaggttgattttaaaatgaactgacatttttgaggcgaatatattatactataaaccattttcttgaccacaaaaagacgtactaaagtgggaatgaaaatgaaagcatggccaaatgatctagctctgttgacatcctatgagtctaagtggtgatctaaatttcaaagaatttattacaatttctggaaataggccagttttctgccaacttaaaaggtcagaaaataactactaaacttattggtacaaggtttccaaaatgtctaagccaaaaatggtttcaatagcataaatactaaaagtagcttatttcatcttatttaaatattattaaaatacttgaaacctgaggaagcacagttacattttaatacatcagccaaatactatggcattaagaattgaattactactaaggatcaaggaaatagaaatcaatgacatctaagatgaaaaattaacaacaaaaatcatcataaattttctcacttatttttaaagttatttagaaatctttgaatatccaataacaaaaatgagaaatttgtaagacacaataagattctccaaatgataacagttttcaccacatttttctcaataattttatattttaagtggcaactctctcccttgacttatgaaaccgtcaactactttctctcctccaggcaactccaacagacaatgaataatttactcataattctaattaaaaactgaatagaagctgcacagcctgtgtaagttataaggcagtgtactaattatctgttacttgaattttaaatagttataggcagctttaggaaagcatgtatagaattagcaatccaaaccaaaccagtttcctgaaaacactgttgagatattactgatttcctaattattgggtcttacatgccttctaattacccttacaatttatatcctttctttttccatgaaaatacataaactatagtcatctactatgaacaggtaacacattaaataatccccatgatatccatgcaagacaatgattcttgtattaattgctgatcttcttcagaggctaaacctttacttaacttttcaatgcttacatttcaacttttatgtcacaaagtccagtatgctattcatacttatgaagttaaacagaaacaaagaatttcaaatgtaagacccaaaatgccagatgcatatttgtgtatatgtggtaaaacccaacactgaagtatatttctttagttgtgcgaggtcgtttctggtgctaaaatggaactggtgatgacaacagttcacaccaagaaaaaacaatcaaaactctgccacccaccctaccaagcaaacactgctcacaggatcatttgacctcatttttatatgcattgttcattctacaggaaagataaagctggcaaattccaccagaggaaggtaaactattttttaaaatgtttcttgacactgtaattctatacatgactgaaagtatttttaaggactgagaagaaagttattcaatataatttttgttgtattttatttaattaaaaacagttgttttaacttacttttaattttaccaagtattatataccatgaatattatgagttaacagaattttattaatttagaaagtagccaatagtgccatgttaggaaaatatatgatcatggaaatttcccagaactccaaatgtttagtttaactttggcataaattttagaggaagaacaaatagtaaactgaatttaagcagggtctccctcttatagagaactgcaatactcattgaattattccttaatatcacaattaagttgataatttatttttatgaaagtttgtacttttgattaaaataatcataggataaatcagtctatgatttcatagaaggtaaactgagttacagaaaatctttgtctagccttagccttttaagtatattagtaccttggaaatcctacttgaaagtcagctgatatggaaaatatgcccatgcaaacatcatctaaatttctttctcaagtgaaattttgacaaaggggcatacatacaccaataagaatgctgacaaatagcatatgcaggttcccaaagcctatgatattggccattctgcttcctgaagagggaaagataaattcaaagaatatatttacctatttatgtttaatttattgaatatagatgctgttactgtttttcttaaatgtaaaacatgtaccaaatttatattaaaaattcattattttatatttctaatatggcaatcagctattcaagtagaaaacaggaaggaggatacagctgaacagttcataaggacataaaacagatttgtattttgttaacagtttccaattttggtccttgcaaacttgtttaggaaaaatgagagaacactttgataacatggtcttgagaggtctatattaatatcacgtcaaataatacttattgagagtatttttatgttgatcttagataagagaatagtatcttgagctctgtaattaaaacatagaagacatagtatgcttgacatgtattatcagaacatgaaggaacccagtgtggtcaagggatcaaatttgtgttgcactggtttggaaagcaatatgagccctaaagcctggaaatttaaaaaaaaaaaaacttagagccttatataagaaacatgaattttaattgaaattctctactttagaatgtacagctttatcaagaagataataaagaagagattaattagcttgtctggattctggcagcagattccatcatgttggcctaagagttgcaatggataaccttatcccatcttaaattacggtggtgctgtgatagccttacatttgttatgctataaaaaatattaaacttcagtggtttttcatgtctgtagttcttttggaacatgcttcccgaaaatgatgatggtttatagatcacgttctgtagaactgtaaaatatttagcaggagtgaatgagacagaacttcttgctacttcactgtaaatctactaacctctctaaaatatgaatcagaagaataaaatataaatcaaaatagaacgggggactcaccaagtattacaaaaaataatatgtattatcaaacaccaataaattttccctgacatctaatgttggtcttacatttattaaaaaatgtaacctttgaagtacaactttacatgaaaacctattttaaggaatcataaagagaaggcaatgatgggattatataacaatttttcatttccatatgagaatataaattattaagcttatcatttttctttttattttagtaacaaagacattactgaatgttgccaacagatttaacattggcaaatcatctgacatacagcttaatctcctatgatacaatatatgaatatatagatgtaattctgttgtatgaacaaaattgttatagcacattctggaattgattaccttgaaactaaagtaatagattagagttacttgaaatttagttgcatagtaaggctaaatcttaaataaatatgctacaattacattgacagaataaaagatttttactaaaatttcatacatagccttaagtgtatgcttgagtaatcacaacgtatatatagcttttttcttaaagataacataaggactctgacttcataaagattgaataaaatgagaaataggacacaccaacccacatgatacaaaataataaaagctacaagaaaaaaatgctataacagggacacagtttgggaaatttttaaagcaaacttcacccacaaacccaacagatggtaaatctacatctgtttacacagcttataatgaccactttcttatgtagaaaaaaggctgtgaaagagaacataattttatataaagcacactccacattacatttatatggctgtaaatatggcctagaactttccattgctcatcattgtccacaaatatttctcactcttttccattaaactaagcacaagatacatcagttgatagcactgatttctaaatacaaatttcaaaaatatttgtaatttctctgtccacctttgaaaaaggaaattgccattagactttaacattctacaaattccaaaactctttatgaccagaatagagtccccaacatttgcttaagccaatcactgatgatttatgataatttaaagtcaattgatatgtcaacagtagttggaaaaagtttgtgaataataccaagaacaaaatgtcttaaaagattttagaagataattcgatcttctaaagtttcatctgacaatgaattttaaaaccagaaaaaaatagctgacattcatgttagcaagcattttttattccacattctctatgcttgactgatccataaattgttgcaaatcatctaagtgaagcactaaatataaaaagatgagcactggaaattttcataagaaattacatttgtatgtattataatatgataatacatatcacatttaactcatattgcaactaaatattaacagaaattttggcagctgttaaaaagttcaaatattcactcatgtaaaaatatgacatctatttttttcttaaactaagattattttttgttcatggatacagatacaaataacctctctctaaagtcactccttatatagtatcattcatttcacaaaagccagcctgaacatgtcacacactgaaattcaaaaggttttaatgaaaaagtctcttttattttttgaaacagtaccattgggatatctgaaaagggtaatacagttagagagactgtgaaaatggttctatcacaaacaaaaatagtaggtcaagaaaaggaaaggatgttttaaggtaagataatatcattcattgaatttggatctactgagtttgaagcattgatagaatgttcaactggaaacagttttcagacatttggaatataatagtaaggcaagcacaggagatgtgcttaagctatagtaaaaacttttagatactataccagtcatagttaaagttacaaactatgcaggatatccaaggtaaataatgaagacagagaagcacaagaaaagattatttgagcaaagcatatcatttgagtggtatgagaaagaagagataaggaaaccttactggaataagtggtgctctcaaaaaaattaaaatgaagaaaaataaagaacaagaaaagagtgttgtttgtggtcataagtgaccagacaggaaattattcataaagcatttctcactggttttataaatgagtaacaaatatgaataaacaggtataagatcctgaagtgtaagtttatatatgaaggtgaagattttaacaagtggacttgagatcatggatcatgatgaaataatatcaataatggtgaatgacactgagtcaaaagttttgtgtgataaaatattctaatttaataaaatcaacaaacaactgactcaatgaatatacaagaaccataacctttgtagaacttactaatttacacacaaggcataggtatgcttagttagttgtgcttgttaccaaaatgccaatgagatgtttattttcccccaaatctttactgcattatcattaacaaataaaaattgcatatatttcatatatgctttgatgttttgatatatgtaatacattgtggaataattgccacaatcaagataattaacattcttcacctcacataattaagtgtgtgtttgtatgtgtgtgtgtgagagagagcacttatgatctattttcttaggacattttaaatccacaatacagaattgttaactatattctcattgctgtacattagattttcagaaattattcctcttacataactaaaactttttatcccttgaccaagatcttgccatttcctgatcctctcagcttctgggaactaaaattctactcttcatcagttgtccttgttatgcatagctaaatgtatacttaaaaccaacattgtaaagcaatgtagaagtcaggaaggagctctggtccctgtatgttgacttcccagacgaaaattagaaattgacacagaaatagcaagataatttagtgaatagtaaagattcacaacacaaaacttaggttataattttacttttatataatgacattttatttaaaaaaaactataacaatagtaaactatattgaaataataactttctatatacttttcacttaaatcaaaggccttacttgtctatatcaacttccattcttcatccacataaaatcctgggatttaagtttctccaccacttaaagtctatgtgaaaagtgaggaagtattttcaacaatccaaatttcagttccttgtctataaattagagatagtaatgtctatgcaaagattttaagaattaaatgattatataattttgcaattatttttttaaaatttgaaagcttacctaaatggtgggtaacatcatttgaaattatttgcattaagttgcagtaaaatacatgctaattataaataactagaacatgttaattttaagaaaattaaaatccttcataattgtgaaataatggaatttttaggtatatgtttttcatatgtcagttcatatcattatcatatacctttgtattctggtttttaacttagcactatgataatttaagtgttttccaaatcattacttattttaaaaagtgtcttaatgcctgtataaacataacattaatttgtgagtgtttcaattaactaagggaatttgtaatttttaacttagcattttgagtactttcagaattttttataaacaagactatattcaaaaatctttgctggcaactaatttgtctgccaagatttcattagaaaaaaatgtcaagaagtaatttagccaggttaaaaagcaatcacatttcaaagactttgatgtaaattatcaaattggccactagaaataatttgcgattattcatccatttgcaatttgaggaatagttcatggcatataccctccgaaataaaatgggcattatgttaatatctttctaatgtgttagaataaatattctattttattattatattaatttgccaattaagtgtttgtcatagcagttgagtcttttactatatttcaggattgtttgtagtttgtaaacacgtttagctatacgattatgctatatatattcttttgtatctgtctttttttagcaagtttgttctctttccaattcagtatctgtgtatgtgcatataggtacatataccctcacatatacatacataattattttaagtctgaattgcattcagagatggctttaaccagtttctctaaatggacaaatgaacaatttttttttcatgttggcaaattttatacataatctacatagatcactgtctttttttgttaatgatataattatttggagtcatttccatgaagagtaattagtgagtttaaaacatgtacctatgttacttgatgttactcattgtaaaaatgccttccagagacgttttagcaatgtatagcaccagcaacaatgcatcatgtatgagaatgattttttttctccacagatcattcccagaattagatttcagtttgttagtccctttcacttttgtggggcactaaggagttaaaataaaattgacaaataggtttagcttgcagaaacagacaaatgggtaggtgggagtgaatgttccaagaaatggggtcaactgcaaacagcttactggcaccccccgagtatcctgccacaggccctgagctcaccagctcacatgcacccaagcatcttgtctgtaagcattcagactaagcagcatgaccttataaaatttccctctagctcctgcctctttgcagacagcagagagccttctttttactatcttgcctgttgctcccttgcaacgtactgttcccttttctctaataaatctgtctttctaaacttgttactgtcttgggtaaattcctttactacccaggcgccagcctctgacagttgaccatgacaactttgtctaattttgactgaagtaaagagaatggggggtggagacaagatggacgaataggaacagcttcagacgaagaaggccattacataatggtaaagggatcaattcaacaagaagagctaactatcctaaatatatatgcacccaatacaggagcacccagattcataaagcaagtcctgagtgacctacaaagagacttagactcccacacattaatagtgggagactttaacaccccactgtcaacattagacagatcaaagagacagaaagttaacaaggatatccaggaattgaactcagctctgcaccaagcagacataatagacatctacagaactctccacccgaaatcaacagaatatacattcttctcagcaccacaccacacctattccaaaattgaccgtatagttggaagtaaagcactcctcagcaaatgtaaaagaacagaaattataacaaactgtctctcagaccacagtgcaatcaaactagaactcaggattaacaaactcactcaaaaccgctcaactacatggaaactgaacaacctgctcctgaatgactactgggtacataacaaaatgaaggcagaaataaagatgtcctttgaaaccaatgagaacaaagacacaacataccagaatctctgggacacattcaaagcaatgtgtagagggaaatttatagcactaaatgcccgcaagagaaagcaggaaagatctaaaattgacaccctaacatcacaactaaaagaactagagaagcaagagcaaacaccttcaaaagctagcagaaggcaagaaataactaagatcatagcagaactgaaggaaatagagacacaaaaaaaaacccttaaaaaaatcaatgaatccaggagctggttttttgaaaagatcaacaaaattgatagacctctagcaagactaataaagaagagagaagaatcaaatagatgtaataaaaaatgataaaggggataccaccaccaatcccacagaaatacaaactaccatcagagaatactataaacacctctgcgcaaataaactagaaaatctagaagaaatggataaattcctcgacacatacatcctctcaagactaaaccaggaagaagttgaatctctgaatagactgataacaggctctgaaattgaggcaataacagcttagcaaccaaaaaaagtccaggaccagatggattcacagccgaattctaccagaggtacaaggaggagctgttaccattccttctgaaactattccaatcattagaaaaagagggaatcctccctaactcattttatgaggccagtatcatcctgataccaaagcctggcagagacacaacataaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaaagacaaaaaccgtatgattatctcaatagatgcataaaaggcctttgacaaaattcaacaaccttcatgctaaaaaatctcaataaactacgtattgatgggacgtatctcaaaataataagagctatctacgacaaacccacagccaatatcatactgaatgggcaaaaactggaagcattccctttgaaaacgggcacaagacagggctgccctctctcaccactcctattcaacatactgttggaagttctggccagggaagtcaggcaggagaaggaaataaagggtattcaattaggaaaagagaaagtcaaattgtccctgtttgcagatgacatgattgtatatctagaaaaccccatggtctcagcccaaagtctccttaagctgataaacaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaacgaaataaaagaagatacaaacaagtggaagaacattctatgctcatgggtaggaagaatcaatatcgtgaaaatggccatactgaccaaggtaatttatagatacaatgccatccccatcaagctaccaatgactttcttcacagaattggaaaaaactgctttaaagttcatatggaaccaaaaaagagcctgcattgccaagtcaatcctaagccaaaagaacaaagctggaggcatcaccctacctgacttcaaactatactacaaggctacagtaaccaaaacagcatggtactggtaccaaaacagagatatagaccaatggaacagaacagagccctcataaataatgctgcatatctacaaccatgtgatctttgacaaacctgagaaaaacaagcaatggggaaaggattccctatttaataaatggtgccgggaaaactggctagccatatgtagaaagctgaaactggatcccttccttacacctcatacaaaaattaattcaagatgtattagagacttaaatgttagacctgaaaccataaaaaccctagaagaaaacctaggcagtaccattcaggacataggcatcggcaaggacttcatgtccaaaacaccaaaagcaatggcaacaaaagccaaaattgacaaatgggatctaattaaactaaggagcttctgcacagcaaaagaaactaccatcagagtgaacaggcaacctacagagtgggagaaaatttttgcaatctactcatctgacaaagggctaatatccagaatctacaatggactcaaacaaatttacaagaaaaaaacaaacaaccctatcaaaaaatgggtgaaggatatgaacagacacttttcaaaagaagacatttatgcagccaaaagacacatgaaaaaatgctcaccatcactggccatcagggaaatgcaaatcaaaaccataatgagatatcatctcacaccagttagaatggcaatcattaaaaagtcaggaaacaacaggtgctggagaggatatggagaaataggaacactttcacactgttggtgggactgtaaactagttcaaccgttgtggaaatcagtgtggcgattccttagggatctagaactagaaataccatttgacccagccatcccattactgggtatatacccaaaggaatataaatcatgctgctataaagacacatgcacacgtatgtttattgcggcactattcacaatagcaaagacttggaaccaacccaaatgtccaacaaggatagactggattaagaaaatgtgtcacatatacaccatggaatactatgcagccataaaaaatgatgagttcatgtcctttgtagggacatggatgaagctggaaaccatcattctcagcaaactatagcaaggacaaaaaaacaaacaccacatgttctcactcataggtgggaattgaacaatgagaacacatggacacaggaaggggaacatcacacaccggggcctgttttgggtaggggtaggggggagggatagcattaggagatatacctaatgttaaatgacgagttaatgggtgcagcacaccaacatggcatatgtatacatatgtaactaacctgtaggttgtgcacatgtaccctaaaactaaagtataataaaaatatatataataataaaataaaaaaacaaatccaactttaaataaagggggtgttaaatgttaaaagaaaaaagagaatgaaacttatttttaaaatttgaacacaataggctattaatgaaactttatttaaatctttatatttttccaggccaattttaaagcttttaaaagttttgtttttttaattctgtgcccatttttagtaaatatagtatatttttcttaatggttcttaaggttttacatcataataatgcaaacatttctccaaatacttgatgtttagtatttccacgtcactgcatttagtgcattttcatgattttttaaatttccttgacatgttttgtatttccttgacatatataatattattaaaacacacactcaatcataatttaaatgctaatcctcacaaatctattagtctcaattttgtttaattggttttttttgtagtagatatataattttttatagtgaattacatcagtcttttctgtttacttcttttatactttgtaaggaattggataagtctcaaacaagacagttactcatcattctgggttttttgttttgttttgttttttgagacaaggtctcactctatcacccaggctggagtgcagaggcacaatcttgactcaccgcatccttgacctctctggctcaagtgatcctcccaccccagcctcttaagtagctgggaatacagtcacacaccaccacgcctggctgattttttgtatttttttgtagagacaggatttcctcatgttgcccatgctggtctcaaactcctgagctcaagcaatcttcctgctgtggccttgaaaactgctgggattacaagcaagtggcactgtgcccagcctctattctgttcttctttcatctgcatttatgtttaaaatttcaacttttaaaatttaatttttaaatgttgagaaataaaggacagtattttttcgtatagttattacctgaacatttattaaatgattatttagcataatgccatatgttctcattcttaatgtgtttgtaatctctcaattggttgcattttccatctgtcaaaaggtctcacttaaacattttaagctttgctgagtaccttttaaaaagtgtaaaaagggtgatacaccacaaatttcaccagaatttttaaagtatatattcctatttataattccaaatacaatttcggagttattttgagtttctaaaggatcttctttaaattttatatggaattttgatgatgtgataaaagtgaaaatacatatcttatagtactaaaaagtttatttggaaatacagtatgttctccactcatatccttcttccttaattactttatcaaattttgtgtttgtgttaccagttatgatatatttcttgtttaatattttttcttctaattttatatgcttttaaactattataagtgtactgattttattatactttctacccagttagtattttatattttctatttttgattctcttgaaacaaatgtgtcatatagatggagacactgaagaaaaaaataggaagattaggattagggaaaggttagggaaaaaaagtgtagttggtattttcttccataatcaatgagtgaaataaaattttctcaagcaatgactgcattgttacctcatcctcctccccaaacaaacattttaagctgaaatacagtgtgtctatactgcacttcaagaaatactttagctggattaatatctcaatggaatcggaattccatggaacataattatatcatttgactaaagtaaattcatagtcttttgttgcactgacttgtccttagtttagggttagttataaatactttcagaatatgttatgaatgactttaaataaattgataaagtaaagtcgcataaaacatcgtgatgtgttttaatctgtttgtgctgctttaacagaataccacagactaggtaatttataaggagcagaaatgtataggctcttagttctggaggctgggaactccaagatcaagcggccagcatttgattagagccttcttgctatgccataacatggcagaagtcatcacatggcagaaaggcaaacagtaggagagagagcaacaggagtcaaacttacaaccatgataatgataacagcattaatctattcatgagagccaggacctcatgactagccatcttttaaaagtcccttctcccaatactataaaaatggcaattaaatttcaacaagagttttggagaaaacaaacattcaaaccatagcatgattcaaacaaataaacagcaacaaaccgagaacaaatatataaatcctgattttaaatttaaaaatcaacaaaaggctaatgcataaaaataatcattgtaattccaaataaatacagattcaaatataaaataataacattaataataacatatttttaaaactgaatttaaaaataattaagaaaaataacacctaatgctgtaagggttttgttattcagtctctggaaaaaagtctaaaaaccttctggaaagcaatttggcttcacaaatataaaacctcaaataaatttatatattttgacttatcaataaaatctaccccatttctaggaaatgtattattaaaatatgataaaacgtttggataaagatgtgaagacactaatgtctggcacaacactatggaatgtttattttggatagatgcatagctacaataaaatattttgttctagtatgtaataaaaataaatttgaagtgggaaattttcatacatattgtatgtaaaaaagaaagaaaaaaaaaactatatgtgtgattgatctgaattgctcataatttcaaatgttatatattgatataacatttcatttttatcatgaagaaagatgcacatagatccactaaaatattaacagtctctagattttcagattctagatatttataaatcattttgatatacttattacatatcttatgaagactagagagtagagtacaccaactttgtgacatcatgtcccacccaaactagaactttttcaatacaagtgttgaccgaatttatgcaagtagaattcacattcagaacactcagactcacatattcagaaatatctatggcagccattgccaccagctctgaaatcttagtttcagagcagcatccagttttagagagctgagctgaaagacatttagaaaacatctattgcatcacatttgttctacagatttgaaaatatggatcactggagtttaatcaatttattctaaacacaaaatattgtaaccaatggtagaattacgatcataaataaagcagcataatttttcttggctgtttccagcgtgtaacctaccttactttaatttcaaagaagccatgaagactatgacatgagtgctaggctctgttatatttctaagctatgtgttcgttctttttgttttttcttaggagaatggcactgtattttgggcacagttcatcaaggaaaaacagttgtcttaagcaatggattttagtgacggctagttgattgttacctggctactatttatagtatgttcttggttttattatgtgattttatttaaaagttacatagaaaataagaatttaaagtagaagtcccagttttactatgtccatgatatacactcagaacattgatattctctttagaaatgaatatttaatctccacatccacttttgtcagaagtaagttatttaattgccaagcactttacaaattacttctcttcacgtattagttccctacaattcccgaactataaacacaggtataatactaacttgctttctgatattgcagataagaaattaagtagataatctgtcttagatattatctattagctaacattttcactgattattggggatatattagataacttaactttgttcctgaaattatttgagagaactttacctcaacaaaaattgaagatgggaatgagaatttaatgttctttaagaaaatattttgtgctcctgccaatttgtgagagttaaaatataggaaagatcacgtttcatacgaaaaatcacaattcactacttcctcttgatatgggatatatggacaaaaattactctttaggcatgtagaggtctagtgcaatggtaatgaaataagtgggatgatagagtgtgtctgagtctattggttttaaactactcctgggttactggtaactacatatttgtcactaagcctatttaatacagttccttaccttggggattgaactatacaacacatgagtgagaaatacagactgaaatgacaacaaagatgaaatgatggagataaaagtactttggaaatgagatgatagaattcactaagaattatggatcatttcaaattcataaacataaatatctactttaaaacattacaattcatggaaagcacttatgtcacttaaaagattgggcttcagaacggtgtcgcctcttaggttaaggtggcaagtgtaaaaagtcaccatagcatcacagtacttgaagacatttaaatggaagtattagttgataccatgagacttttaattttgacatactattgtctttgatgatattggatatatttcttccataaataaacaggttttgtttaaatggaaaatatgctgaggcaagtagaaccccttttttatatttcctcaatgagaaactgtcttagcagccaaagtaacagcgttcactattattgcctcaagggttgggcagattccaataggctgggaacacaggcactatttggggttgtatactcaagtttagacagaagcagtctggtcacatgaaacttaatcttttaaagtgttatttaaacacattctttatagtttaaattgtaccaaatttattctaggcacacacaacatttattcaatattcaatttacaaatagaacttatgtgatttcttagtatagttttttggttttatattttgagtaaattttaagaccttcaaacaagagaaaaagccatcagaaatagattactcagggtagggaggacatcaaagaatagaggttaatttaacaatttctagatttcttcttacagttttttaatgtcaagtattaaaatagcacgcattttttcaacatattctagcctcaactgattttagaaagtcaaactcatgtcaacatgtcattttatagacatagaatgggaaagaaaataatagtacagccagagtggcaggtatttcctgcaagaatatgaataattccaactttttcatgcagttttcacttctatttgagaatcagggcttattctgttattattttgtgtttgctatgtattttatatagtgttgtcagttaagcaagttaaataaatgcaactggtcaaactgtgaagactcagtaataagcatcaaaaataatttagtttccaagaaaaagcaaactcttctttgtcaactgagagacatgtctattgagaaagcgtttcattcaaacttgagaaaaagtttggtaattatggctaccatttactctgaaaacttattggaattggtatattcatataaaaatattgctaattttatttttcccaaattaatttttgcctttgagattcacttgaaattaaagtaacttgaaactaaactatgttctttttccttctaatttcactgtccctatatataacaatggcttttcttaagacattagagtagcattccttcgtaactgatgacttttacattaaactttcatgtaaaattatattcaaatttgctttcaagtctctttttaaaataactgtttttactattcaaaaaataaatcatagtgaaaggttaataaagtatatatactcatatcaatcttattagaaacacaatggaagttatatcaaatattttacaagtttctcaattcacattaacctagctctagaagtttcttctgttctcaattcaactggaagataattgtcttgactaggaaaaaatgctaataatgagactgtcaatatataaactataaaagttaatggaaataaaaaataatcttaaatgcataaaatactaatgaatacaatgttcacaatattagcattaaaagtggtcttattttcttaaaaacaggtttgtgttgtaaacaaaatacaaggaaatcttctattaaaaatatatgcttgagattcatggtagcttaaatttatccagggaaaatattttacaatatgtctcagtggtagtcagaataatcacctccaaagatatttatatcttaatcctcagaacttgtgaatgcgcatgaatgcacacagcaaaggagaattaaggttgcagatggaattaatgttctaatcagctgactttaaaatacagatattattctgaattatctggcaggtcccaatgtaatcacacgggtctttaaaagtggaagaggaaagcagggaagaagttagagtgatgcagtgtgaaaacttgatcctttattgcatgcaaaaaaaaaaaaaaaaaaagatgaaggaagagggccaggagccaagaaatggggacagcttctagaagatggaagaggcaagaaaacaaattgtttcttaggggcttcagagggaatgcagccttgccagtatcatgactagcccagtgagacccattttaatcttctgaggtacagaactataaaataaggaatttgtgtagttttaagccataaaattgtgtaatttgtaaaggtaaccatataaaattaatatagcttctatgaatacctctatcttaattatatagttacagttttaattttttttataatgcatatcccttgaaaagttgtaagcaatatagcatgtgcttaagaggcaaaaaggtaatgtgaaaattttttaaagtataatttattatatatttatgatagtaatttgcaataatgtattatatgtattataaatcagtgttaatgtaccagtctatataaatatctatatgattaaactattccttattcaatatcaacttgcccactgtaaatcacactagtatgctgttgattattttgcaaagtttcgttcatgatgttttcaggtggataattcatgcttacgtgtcatatcctcctgtactctataaaagaaataagagcagccacagcacatgtatcactctatggaacatattaataaagttctcaagatcaatgctgctgagtgcttttttgcaggagcagtttaatgttagtataaaatattgccccattaaagcacagaagacaataaaataaagcaaaatcagcataaataaaatttattaattatgtctcagtgattggaccttttcttttacgttaaagaaggtttacaatgacagcagcgtatactagaaatgatggagtccctatttatccctggtaatgcaccttcttagatcacagttggttagttgtcatcacttaatgtttataaagagctctaaaattgaaattactccctaagtgtcgagtagcctcatcattcctgaacaatcctaatgaagaaaagcatatgtgaccattttgcaagcctcttcagaggaaagtgaatatttaccattgaataaaacaaaacaggaaaacaaacagataaacataagagcaaaagaacaaagtcaaaacaagttgcagaccaatgtagaaagaaacaaaagtctgtgcttcttccgttcaggttcctcgggccagagacagcatgtaggtcatgctgtggttgatcacaagggccacagatgatattccctagtgtttgcaagaacttcctttaaagtactattaataatatagagaaaaatgagaaataagtttagcatgatcattagtatgcagtgtatgtgagtgatgcaaccatcatatacaagcattataactttcgtgggcctattttcttatgctctatctctctgtgtataaaacataaaatatataaatatgtttatattttatgtaaatttatatttatgtttaatttatatatttatatgttatataaagtattttcatgtataaatatatttcctataaaatatttatatattatattttatatgaaatatatgtaatattacctaggctatgttcactattttacattcatcgttattcattgttatactcattttttctttggtttctaagatacattaaaatttgaaaatataatgggcctataaaattttcatgacccctaagtgccgtacctactgtgtctgacgaataagttgtctctggtctttataaccatttgctatctaaaagtgtataccttcagatgtccccaattttatatttgtgataaattcatgttgataagaatatgggcatgctgattacctaaaattcaaaatatgaataggcccagtataaattgtttatgtatatgcattcaagcactagtgtgtttgttagagctttcaaatctgtttccctcttttaatccaaagtgttccaaaacatatttgaatataatgtgtattttctaaaaatattccataatctgcatgtatcacatcttaacccaacaagtaaacactggaaatgactactaatcagggcaagacatgcatgataacatgtaggtgtgggttattactaatacaaaaattctaggaactttcctatgtactctgtaggatgcgaatgagggactgtaaaagtggagaatgacaatctgtatgctaattctgaaacatttgcattgagaagaatggcctgggaaaattgagctaaatctattcccgccttagcaaaattcttcatgaatgtgaaatgctataggttagttaggtaaactagaagcttctacaatcttgtctacattccaagataatgcagtatgctaaatatttttctctagactgaaaatatttctttaaaatgatctgtaattttagcttcctacaaagtcagccttactttctctgaattagaatgattatgtgaggatctgttaaatttatatgtttagttttgacaaaataacacctacctgctaaagaaaattgtaaaaagcgataagaatagtgaatatgttaaatatcatttgacctaatgaatattggttttgttgtggcaaaagaacaaaaaatggaatgggtattttagaccacagtaacagccactcctacaacagataaattactattatttgattttcagcctttgattgtcttttttcccaaagaactcagaaaaatatgctcatatatcacctgtgtaaaataggaacaaattatgttctttcaactgtgaatgccaatcacacacagacatttgcaaatttacatgagatgaaaagcaatttcacggcaatcagctaaaccacaataaaaattacgcatgcatcacagcattgggagagagagaaaactgtgacttgccaaaagaaaatcagcttgtacattactctggccaaccagtgccaataccctgaacaaggagctatctctaggcaaatgacactgtagattgatatgctaacttacccttcaatacagcatgtatgtatctggggatgcagagctacaaagaaaggttctgaccctgtgaaaacaggtgatcaccatgctgccttgtgccatttacaactgctaactagaaataatttggtctattttcagtggttaacttaagggtaatgcattgtattcatttgtacttttttttttttcaaattttaaagacttccaaaatatctattgcttttgaaatctactcagtggccattcagctgtttaaattgaaatggccaatgtaaggaaagaaaaagattaaatatattcaactggccatgataaatacaatccaggtcctttggtgttagaagctcagtatgattaaactgtttttaatgattaggcttttgatttttacacataaagaattcttaatcatgattttttatcataaaaaacaaaaacactcaattagaaaaaatatggatagcatttcccaggatagggcacgttaacaactatttctttccctatagctttttctactctgtgtgtgtgtgtgtgtgtgtgtgtgtgtgtgtgtataatgtgtggtattctcttaaaatttgcctttctatacaagttcacataaaaaattttatgcaccaaattttatatctttttcaagaaaaattgtaacttcagcaaaacaaagattaaaaaatgttaataaaggactataattttttacaaaaaaggctaagttcatactgtactaaacatatctttatcagaagatgtaaacatactgaatttgatgcaaatgtgaattttagaaacccgagctcttactatttttagagtccttaataaatatctaacagtctactatggtttgaatgtagtttgtccccactaaaactaatgttgaaattaattgccattatattggtgttaagagatagggcctttatgagatgactaggtcattaaaatctcaagagagactgggttagctcttgcaataatgaatttgttctcataagagtgatttttggcttattgatccataatatttatatatatttggggtacataaaatattttctcacatgcttaggaagtgtaatgatcaagtgaaggtacttaggatgtccatcaccttatgtatcatttctgtgggttgggaacatgttaactccactcttcaagctattttaatatataaaatgcattgttaactatagtcaccccactatgctattgaatattagataaaaatcctttcatttgcaacaacatggatagaactggaggtcattaagtgaagttagtgaggtgcagaaagacaaacatttacgttctcactcatctgtgggagctaaggaattgatctcatgggggtaggaagtagaataaatccttaacaggttaatttcattattacaacaattcaatgaggtagttatatttttattctattttgcagatgagaaagctaaagtagataaattttaagtaaatgctcaggttcacagtgctagtaattaacctattcagcatctgtacctagaaagtctactgccagagtccacatttatcaccagtttactgtaatgcctcttcctttgtaaccctgaaaattacttatgagaaaacttggctagttttcacccatatacctatataagggacagacatcgatgcgccttttcaaaaaggtgaagtgggagtacagggccagagaaagataaatggaatcatggagtataagtgatgatgccatttttttttctactggaagtttgaagtaatcttggaaataagaacaagttctgtatataagctaggtgagagcttccccaaattcccatccattcatttattgttcaacaaatatttattgagtgcctacatcaggcactgtttcagaaatttagagcttcgtaaggaacaaaaatctctgcctctatctagtatatttactagttgggaagagagttaagtaaacaatataatacaaaagagataataacagtaaagaaaacaataacaattgccaccctgaggtaaaatttgggggatgctcagagcctgagtacaaaggtgtcaaccaaaccacccgaggaccaatgggatcagtgtctcaggacaccagtaagtggatccaattgaaatgcctgcaataataacatcgttttaacttcttggtaaaccaaggttttcaattaaaggttggtttggggaaaaaattgcctttccttatgaataattcaaatggatttcctttgaatttaccaaaattcttcatctgatgagataggattttttctcttttcgcccataaactttgctttatagattgcttagggctactgcctaaataaaaataaattcctgttgcagtatggttttaatatgttgaaatgtattctttaagttgaagatctctgtagttcatttgtcaatgcaacttttctgttcaataggagtttttaaaaaagaaaacaatcaaacaaacaagaaagaagtttacttccttttgctagtgtattccattactacagtttgatatttcaagtggctcatgaattagaaaaacggtctataaaatcaacttataactatctacctgaaagaaacaacagaatattcatagtcacattctttttatgttaaatttaagttttaaaaattaaaatactaatgtattatttataatatgtataaaatgtgatataataaattccagcaactaacttatacttttttgcctagccattccaccccttgtgttttcctccatttatgctggaagcaggcttcatgttcctttgcacaacagcaaagttgtgtcaggacctccagcagaaatcacgttcatttaaacaagtttctcactttgtgttaaggcctttgtccattgaagggcctgtatcccaagtgtgaggagggagaattccttgagaacagcgaagcaagcagaaggggtcctcccgaccctagagaaaagatccagacccagggaattgaggagaacaagtgacccgggtccaatctcctcaaaatagtttcggttgttgttacagtttaaaataccagggagaatctcatgtttgccagttgtttttttttttttagacctggattaccagtagaacactatattaaacctagttggtttatattctcaaagaagagaataggaatatagtctatgggtttctattttttcctactcatttaattttattacaaaggctgtatgttagttgatatgagggatagtgaaacaatttttaaaacttctaattgtaatcattcacatttcaatgtgatattgtgttaagtatgactttatgttagctataagtttgacctggacctttttgtcttatattaaggatttgtgctcctgctctaaaataattggaatggattttaaaatttcttgactttcatatacttttagaaattactacatatccttttgcttatttgacctattggcatgatgtattagtagagttgtttttacaattccatcatcaacttgtaagttattcttctggatatagcgtatcaatatatttcatataagaatgatgcatgtctattcataaaacatcagcctggatttttcattcttaatgctgtggttttacttttgtagttgcttgtgaatctctcttgataaggttaaatactgttttaacttaaaaacaatcaagttaacatacaatttcattgtcatattgcatacttccttttcccttctttaaaaagaactcacagtgatgttatagccatgtctgctgaatgtgttaaatggaaagtagattgagaaattttgaggtagttgaacatcagaacattattcttactagatgcattgaacagagagctaagtatattgctatcttctctagcacttggctgagagcaaccaagcaatttttcattttacttgtgagcacaccatgaacacaccacctccatgtatcactaaaccatgcaaaagcctctgttattcatgcccaagctggcatagagataaatttgaaagaatattagtgaaaaatgctgcttcataccaaacagtattctgtctctgtgtttaaaatgactttaaaaaaataaatcatgcaacaggaatgtctccaaacacagacttctggaataaaaattgccaatctcagagacctagctccaaggaatatcaaccagccagtcatccacctagcatgaaatggaaaggacattatttcaaccttcagtggataatgaatgccttgacacaacctgttttgaaagataattggatatgtaatttgctaaacatactatctacaaggcaataaaacaagttatcccatttatattttttgctatttttctttgtcagtttgccataattttgttcacccataaagctattatttcccaaacgagtgctactagatctagagatggtttctaagcaagtgaaattatctgaaatgtgactaactgaacttcactctttaataggattcacttaaggaatacattatacttttcatgtactcaagctcaaataacctttaccattcccatggttttttatatgttcttccagttaccacatattatttatagtatcatattaagaaaatataaattttcttacacatgcaattgaatatgccccgtccccctttgggattgtttgattcacttatttactcaacaaatcttcatcaaactcttaattttcactcattcaatcacctgcatagggcaatcattcaatcaacattcttgagcacttatcttgtaccaagcattattaagcccttgggactacagcagtgaagaaaacatacaaattcactgcttttatgagacttaaattctggtgtagagagacagaaaacacacacataaatgtatttgatgtgctgagaagtactataaagaaaactaaagcagtaagagcacagcgaatgaaggacttttagtgatggtggtattattgtcgtttgaatagactcattacaaattatctctctgtcaatgttacattggaggaagcacccaaaggaaacaagggagtaataattgcgaacgttttccattaagagggagtggtagggaatttataggtgtgctggaggatagcagaggccagcagcctcaccaaactggagtcaacaagagtggctgcaatggggtgccagcagtgagttagtcaaagaaagataacatcatcaggctctgtagaacactttttggaaggactttgaatttaattccatgtaaattgcattttaaacaaggcttttccaaaggtcattctgtagctttgtggagagtaacaacagtagatgcagttgtaggcactgttagaggtacatgagaggcagaatacaggacggtattgaagaaaatagactctcctttcatggagtttactctctgatgtgggggcatataataacgacgctaaaataaatatgtagaaaggatatacaggttagtgataaataccaggatggacataaaacggattggtgtgattagacaaaaggtggaagctattacttctttttgcttgattaaggatctaataaagacttatactcaatctgagaccagagtaactaaaaagagacagccatggaaagcccattaaaaaagggagttctggaaagaggaatagcatgtgaaatatcacttatgtgagagcagaaaggtggtcagtggttttgaagaggaagttcaatattatgcgaactggagaggtggaggcaagatcatgttgggccttatcagccacattgatgacattagatatatagtcatatgtcacttaacaagggggtatgttctgagaagtgcatcctttagtgatttcatcactgtgcaaacattatagagtgtacttccacaaactgagatggtagagtctgtaggttactgtactgaaaactatagttaagtgtttgtatatctaaacatacctaaacagaaaacatacagtaaaaattcagtatagaagattaaaaactgctatacctgtataaaggacttaacataaatggagcttgcaagactggaagttgctctgggtaagtcactgagtgagtggtgagtaaatgtgaaggcccaggacattattggttttataaacactacatttaggctacattaattttttttctttcttctataataaattcatcttagctaacagcaacatttttactttataaacttttatatatgttttacaatttttggactcttttgtaatgtcagcttaaaacacaagcacattgtacagctctccaaaaatatttaatttatttatataggcttttttctatttgtagtaattataactttttagtacgttttgttgataactaagacagaaacacacacattagcttagacctacacacaataaggatcatcaatatcactgtcttctaccgccacatcttgtcccactggaaggtgtgcaggggcagtaacatgtatggagttatcatctccttgatagcaaggctgccttctggaataccctcgaaagatctgcctgaggttgttttatggtgaactttttgttataaataactagaaagaatatactctaaagtaacaataaaatgtatagtatactaaatacataagccagtctcacagtagtttattatcattgggaagtattgtgtactttgcagaatggtatgtgttacaattttgtaagattggcagtgcagcagggatttttttttacacctgcatcaccacaaacacacaaataatgcattttcctaggacattaagattgatacaatttcactatgcaatacatgggaccaccactgtatatgtggcatatcattgactacagaaagaagtgagaagcccctggaaactttaatgttaagagagcaacataatctgacttatgtatttcgattgactactctttgaaaaatgtattttcatggaagtgagtagcaagaatgacattttggaaagctattaatccaaaagggggatttggttgttcagattaggtggtaaccttgaagatgaaaataaatgaacaaaattgggatatcttttggcagcagagacattaggactattttatggatttgattggggggtgctgaggcaagagacatcagagatgtctcctaagtatttggcttgagagaatgtgtgaatagggaaacatgttatgatgtagaatggcctagcgtagcacatgagcatggtgttaaggaagcattatttctccttggggtatggcaaattagagatacaaattagacatccagtagtcccgtcaagtaaacaattaggttgcttttctaatctgatttagtttaaaggagcatctgagatctaccccaatgagatgctttcatgttactgctgttaaaacaattttatcagaatcctcagtttttataaattatccttttagcatataatataaatatttgtgtaaccatggacttggatgatgcttgttttacttgagtgggcttccactgcaaagtcaaaacctttagccaaaacttcaaaacaggaggtgagtcaaattggccattctccaatgacctgtcagaagtttaagaaattctttgagaagaatgcaaagttttcctactcaattgttatgacatatttttgaggcttctaatatttcattcatatttaaccgacagcagcgaagtactcagtgtatttaaaaataaaacccaaactgaccgaggtctcagactttaaagcagcgtataatttatttagaaaccagacagtgccatgaaaccactagatgctatagagtgtctatcatagcaaatattatataagtgatatgtacatgagatgaaagatgtagataacattattctgttcaagaaagttaaattgacttaaaaatactgaatcatctgagttccatcttggagagatagtaggattttctaagaaaggagaaacaggagtggtaagctgaatagcagaaacaagagcataagcaaaacaaggaaatgaaaataaatagatatttgcattacacctagtcatcatttgaaaggcaccaaggatgcatggaggagagtgactggagatgaggttgaaacaggaaacgtcctagattgcgaaaacatgttggagcattctacagagtttacattgaggatagtataaatcatggatgagtataaacagattatattggggttttagagagaatactctgttatcttattttgaatatgatgaagtaaaggacaagatttcaagaagtgaatgaaatggctcaagacgataacagtgagatttaaaaagacaggaaagaattgtgagaaagatcaaaactagagttattacaacttcctaagtgaatgttttgagtgaaggaaagttaagtgtcaaagataattctgaagctctcagcctgtgtgactgagtgaattgtggtgttcctcaaatgaagatggaaattctatttgatgagggagtagtgataaggcaagaaaagttctgttttgaaaatccaggtggagatgactagtaactagatagaaatgcaatctgttgggcaggagatcaatatttaagccagagaattaagagtcattagcatattcaagaaagtggtaattgctggactccatgaagtccctatgaataggttaaattgagaaaagatctttcagcataaaactctgaggggtgggggctttccaaggagaggcagcagaagccagagtaaattaaaagaaagggacttgtcagagagacaaaagagaaaagaagagatgctaaactaagaggaaggtgatttttaaaaagaaagctaagaattgacacgaagtacagttattgtatataaatgtgtatataccatgacccatatttcttcattattgaacactttttactttcatttgagtattgtcatccctctgttctttaaattgctctaacatctttcatatttctcgaaattctaaatattaaaaaattgcttagccacaaaattttctcaagcttcctgttcatatctgcatttaagaaaaaattaaatagtaataaaatcaaataaactgaacaaatagaagaaaaattagggaatagaaacagaagaaaaactgtaattcattttgcctgaaaatgagaataaaaatgtattctaaagactgtttttcatgttttatgtaaaaatgacagtttttaaagttttctaggggctgtctcttttaagatattagaacatagtgatactttattttgaatagatgtattatggatgatacataaaaattagttataactatctattgacgatatattgtttactacaatagaataagaccacacctgagcctaaagaaagttctcagtttactataggtaaaatcttgctatgaaaggtgcacataaagattagaggctttctgtggtggaggggaaacactgctggctgcagaaaaaaatatctgacataacatttaaatttaaaagcacaaattattgacttagtatgttaacataaatgaataaatgtcttctaaatgctttgtcttttactaaattccagcattttattactaaaaggacacatatacaataagtagtaaatatgcctgatatattttaataatgtaactaatttcctttataaattagttatagttttaatactcttctttatgtgctctaagtggctccattggctaggttaatcattagaggatgactaaattgaaaaatctttctacaaataacgtggtgaataat

SEQ ID NO: 1074 - DNA, 1210248 bp, Homo sapiens
agcccaaacatcttacataatactgtgcaaatgacactattcagtttctcatcgacttgatgttgtttagggaagttatagttttatgaaatgcacatgttacatctacctagtagccatattttactattataaaatacagaggaattcatttagtggaatgtaggaatataattctctaatatgacaaaaagaaagaagattatcttccctgtcattttcaaccaattttcaagaaagtccccaaccaatgactcaccaaggccctcacaccagcccccacagttttttcaatgtgaattatgctttcccttcaagggttctacacgtcgtttctcttcagtgactttgtttttgattcttcaatgaaaaataatgttttcttctcttgccaccacctacagatttaatgctgcacttgcatcctctattttgctaataccaatacatatgtactgtttaacctgttggagaataagctacttgagcatagggacataactcatattttatttaaaatcccctccccatcaccttgtagtgttatttattttggaagccttaactttatataattttataattagaagacagcttttgatatactcacttcaaactcatgttttgtgctgtggtcagtaaataatttgccctctgcctcatcctgtctgacgtctgatgtataaatggaattggaagtatgcttccttttctttccacatggcccgttgctgatcacctcctgacccacggccacccttttattcactgctgttgtgtcaaaggagatgtatcttcaatcttctgcttataatttatccatacttttcactagaaatgatggtaaaccatggtattattcataagtgttttggaaatgttacaagataaataggggccaatgagccagctgagaaacactactctactgagatattgcttcaaaaggaaacatgtgtttcatgtttaaaaatacgtggtttgaaaaaaaatctttcaaaattaaagcaatgcagaacatcaaaaatatttcagaaaatatttgtgttgaaatcagtaccctcctatttgttggctcaatgggtcaaacaatccatagtctttccatctcagttttgttatctgtaaaatagacctctgatttttattcctgtcattaccattcatctcactcccagcaaaagcactatgtaccattattatgaacttgctgttatgtgcttgtgtgcatcccttctacttctgtagaaagttttccaccattgtgtccttaatatactgagttttacatcaaaattcaacacagatactgaatttctctgtaaaaccctaccatctattaaaaaaggtgtttaagtgctctgattagctatattcttattaccttttgcatgcaattttattaatatattatgttttcaatcatatttacttttaaaaatgccttttcccccatttgaatgtaaaattttaggggctagaactgtgtttttatgtctttccagctcagaaacttgaataatgtacataatagatgcttactaaaatcagttgaatggatggaaaaaataatttagacaattttaatatttaaatgtttttaaatattaaaattatttctatatttaaaagctctgcaaaaggaaatacattattgccagtatttgtcataattttttcataatattaaatgatccatttgtcacttcatttttttaacttctatttttgtctgttacttctatttgatgactgatatagtaaaaatattaataatactaatatttatatagtctacactgtgtcagataattcaagtgctttataaatattattttatttaatacccataataatcttatgaagtaggcaacattacaatcccaatttaatatgggtaaactatggccttgagaatatatgtattttatctgtttaactctattatttaaaaataatctatagtataataatagtaattgattttatcttaatttaaaaataattttcttatgaatttataaggacagaaaggtatcaaagtaatttcattgaaatagtctattttattttttcagggttttagataaataaaagaatatacagtttatcctctttatatgtaaactagctgaaggcaaccttgttagatagtaatgtaattgtcaagataaggtattcccagaagtttattcaatgtcatatattgtgtagagaaatcacaatgtttaacatttttcttatactatcaaaatcaccaatatagtaaaaaatgtaatgaaagttaatctttaggtaacgtggtatagtaaaaagtgctttgaattaattatcaagagattagcattacagttctttatgtctttctaataacattatggctctcataagctgttgtctgaactatggcaaaaacctgttaaccaacctcaagacccagtcctctcctaggattcttcacactgcagaattactttccccttaacagttttgattacgtcactttactgctccatgatattgcctgctccataaaattcaaactatttagcagaacattcaagacctttcaaagaatgtcactttctaattttgccatttactttacattactgcccattattaccaactcccaccaatctcttactgtaaatgccaactgcactggacaattgactcttgtctgtcacactgggcaatgcatcattccctgaactataaatgcttggctgtttgttttaaatccttttttctccaaatatgaggccactttttttgttcctgaagtttaaccttgccttagtctacagtactattcctatatttagagataatttaaagcattttaaaccagaagattaaactacttctcaacacttttaaacagctgtactgacatgctattagatactgaattatttctgtagatgctgaatttatcaggataggctaggttaaactggagtagcaaaaaacacccaaatctgcatggcataatacaataaagtttatttttttcattttcttatattgcacaaagtgaatgaactgactgttgagagccttagagagttctgaaaatattggagcaacaacaataaaaatagagcaagtctgttgtcaccaaagtgggagtttgaaatgcagcttccaaatgagcattcagattggtgtgaaaatcagtctcatgagtccgttgctatgcctcacatatacacatgcggaaatcatgggcaagctttttcaagcgagtagtaattgttctaaccctatataaaaatgttatttcattcactctctccagttgtagtggtctgctaaataccactagtaactcatgtaatactcattgaagattttttgaagtctgatatcttatacatggaagctggaaattttatttcttatgggtgtgaaccattcatatgtacacctccaggagttatagtaaatatcaattctttatctttaaatttgtcattaaacaactctattaccatatattagtcataccaatggatagctaatatgatttaaaagatgtgctaccaaattttatctcaacttgcaaacaatttaattgtggatattcttgtaaactttaaaatatattttccccacagtaattctcatccttaaaaatgggaagagtgaagaaaaagttaatctttgtgcgatgttagagttcagctaacgttgataagactaaatgaaagtttgcagcctaaggggtgacaaaacataaaatatattccagaattaagcattgattagtaagaagcaaactaaaatgtgcagattaaatgtcagatattgaaattctctgctgtttcattattgttgatagcagtaaacgttataaatctcaaatttaccaggcagaatgtcatgtaatttgtcaaatgcagtttagctaaaatgaggtttgtcgcttacacaatcaacttgttaatttggctggcacttattctactgctgttacataaattctcaactataagctacaacatacattttaatttgctggacatcaggttaaacaaaaaaatatgtattcattcaagttatgttgtagttacactgattattgtcatcagacttttccaagacttttttttcaggtattgattcaaattaaagtcagaatataccacattttcacaaataaccttgatgtctattatcctttactcttttcacaattatagtttttgaaaaagtccaatatttcaggtgaacagttttccttaaatatgacttattttggttctgaatgtatttaatgtgctgtttatttttgccattattataaaaagccactgaaaactcacagctttctctttattcagaatgcaaacagccaaaaaatcatatatatgatatatatatgattacatataatcatatgtgtttgtatatatacatctcttatgtgtatggtgtgtgtgtgtatatatatatatatatatatataattagagagcatagaaaaagcattttcagaatgataaaatagtacaaactcttcccagaatatctctgggtgtatccaaggtgatacagttaactctgttgcagagtgaaaaaaatacagaatttttttttctttttcaaaaagcctctattaattgaagaaaggtgatcattttgaatttctctgaaattcaaagcaaaaaaaattatttttgttttctcacacacacacatacacatatatacatacttaaagaaaacctcttttagagattaatacgaaatttagtataaattcagctcgaattcatgtcatagaatgttagtcctgaaacaaactcagagaacatatttaaatttctcatcttcaaagagaaaacggcctgagaggcctgaattaatgtgatcaaagaatctcggtgttacatagaagatcaaaataagaacccagatctactcaagccaagtgttcattccagtgtatcttcagtgtatgagctcaaaattccaagctattttaaaatacctactttgtgcaaataaaagttagacaaagtgcttaatatctgttctctatatttaaggatttaagtgtgatttaatgttttattagtcaggacatttcagctactaataccaaaaaagaaactcaaacagcatgttaaaagtaagttaatgcatatattcacctgggacaacggaggtgaggtgagctcaggtttggttaactcagccctattctaatgttaccaagtctctttccatagcacatttatcctgaggttaactcaatcagtgactgctagaaacaatcagaattatattttttagctcttactcaatgaaacaaaaaataaattgctttttttcttagaaggtactagcaatggggatttttctacttcattggtctaaggtaacttagcctgtccattcctgatccactcacttacaaggggaatagggtcaatattttggcttatgcagccactggggagtggatgttggggactcaaatgtccattatctatatatcagtttatttataattaggtagcattggccaccatatatgattcatttcaaaatactttgcctatatatgtgtaagttagccagggatttaactttttaagaagatagcttatttttttcaaatatggctctgccatttttattgatatgacaaaagtacttaagttctatgtgcctcagtttactcatcagtttaatggacatagtagtttctatctcacagatttttgaagaaagaatgaatacagtaaatagcttacaatgttgtatgacatatagcaaatgttttatcagtgtaatgtagaacgattattgtattatggttgttgatattgttatcattgtcttattattgatatgacaacacagaaattgtattttagcacaaagatttaagaaaaattctttttgcttacaatttgcatctggtgggaactaacatcttacaaaaagtgttgcaaacagtagctaacaatttttttacctgcagatgactaagtatattttttctatgttacttcctcaatgaacttcttgctacttcctcaaataaagtattttcataggttccaaattagaaataaaagccatagcagtggcagcgtccactgacctcctttattaaacagtgagtgggatcactgaactattctatcaacaaatttatcaagatctactctgttggccactagagctgacctgaatatgatcaagttatgtttcctgtgtctaggacagagaataacaatttttttttctgcaaagggccagatagtaaatatttcaggctttgtgggttatggggttctaacacaaatattaagctctacctctatagtgtgaaaagccatggacaatatgtaaatataataaataggcataaccatgttccaataaaattttacttaccaaaaagtatgtggaacgttctatgaaatgagggtaagacttccctgctgtctccccttcaaggagtaaaacacttaaaccctatggttaaacaaaaatgtggctgaggatatcaggtcaagagtattaaaaactgggaaacgttggaggtgctgaagaattctacattcccaacatcagtggcttctttcatgtgaaaggagttcttttaaattcttccttagctcaagcttctctctcacttctcactagggaagaggaaattatttaactgatttgtaatttcagaattagaatacacctccttttcctacctccttctctctggtgacccccaggaattaaattactctctgcttcttcatagttttgaagaggcaggctctgtttctgaatagggaagcctgccccaatctagtgccaataaccaggtaagtctgattccctgaatagatatttagcaagtcacttgccctcagatgcaagctacattctagtgttagcttcattaataataaaggtgatattttgatctctcatatttctaagccataaatcactacttatctatgatttattttatttcagactttaatagggaagggaggtgctgtttattgtgtgctttctaaaattctaacatgtattgtcttattcatgacacatagacatagattacaatttttcagaggctttttacgaactcagctagtgtttgcaacacttttgtaggtgggcattaagttttaatatggggaaaataactttgatcttggcagtcggcagaggctaaattgagcaattagatgttcttcaattgactttttaaatgtgtctttagactgagtgaaaatcacacaggattttcagcatgttaggacacatcagtttatggtgttcctgtttatagataggccaccttcctgtgtatcttaagggagtggcatgaaggccttacctactttaagcaaaagagattgcctctaatttcagtcagaccatgaataccttcacccaatactggctgtgtacaagcctactaaacaaagtcagattatgttgattcagcaaagttatggggttctgcagagactgcacctcagcaaagggcataagagcaaaaaaaaaaaagtagctgttgcaagctttagtaaaaatgctgctcatgcatgtcagaaagcacaatcatgggcttgcaagtttgaatgaagggcccactccaacgctttaactggcttggttggccttaggtataggcagctatggcttgacattgaactacttaggtttttcttacacagtcatggctgaggctaacatatgatataggaaaaggatggtattcatactggcattaagcatttgtgagtagcataacatttgttactttaaattataagatgaattattcctgtggatgctctagttaagatttacttttaaatcatctgtgcttagaccaaggcagtgttatattaagtaccccaaattccagtgggtacttaggaccgaggaaaattcaaatccttgtcctcaggattaagggccataaaactctccagagactaaatgagttgcaaagataacaaaggtaagaaatacaacacatcttcaaggacatttacggaattagggctctgaggaaaggaaagagagccaggcaagacaagccaaggcctggcctgagttaaatgctattctaataagaggtatccactagatatgattttcaaacaaaaatgtgaagggaataaatacttgattgaacagtagatgcttgtgtcagactcagagcttactgatttaggaatatgaaagaaaaaacaaatatttgggccacaaagtggcccccaaaaaaggaaagaaagggttgagaccaaggaaagaaagtgctgcctctactgtgttagaaataagggtccagcttaaggagcaggttaaattgctaagcacttgctgaattggcctgtaggaaggaagagaagaacagggaaatgttagagaaccctttaggattaagaaaagacaatgtatttagtagcccatgacagaagattgggttttctctaagccattaggaggccaaaacttgaaaaacaacagaagcttcagtttaagactgcattgaggataattctccaactgaaagaaacctaaggatgttaagagaagtttccataggcagtatgtgacagtggactgactatgtatttatttatgtttttgctcaataggcaacaactccttgtttaactattcattgatccaaaccaaggtggtgaaaaaatcactgttcagtgtgtcttttccctttccaaacctaacacccactcaatgtcctgattactaggctctagcagaaatccagagaacatttcctagttttctataatcatttcacttagaaaatcctctcaatgattatagaagattagttctgagccccaagattgctaaccaccaaatgaagcatgtcatatactcagttgaggatgctattagtaaattcctccaaaataaagcacttcagatggactgaatttcatataatgaatccaaaggcaaatatgtattaattattgggcctaagggttattgaagtagactagtgccaatgtttactattcattaatttattagtcaacaaatattcatatttctatattatgattatataaatactgaggatttatatttaaagataatagcagactcagaaagaacccaagagaaaatagacaaaggaaattatatgctggttttaaagaagtaatagctatttaaaaagtattgtttttccactgtaaccttttattgtaatcaaatgtgattaaacctagttacagagaatctcaaaattctgtgaatacagggtttgtaatattagaaataaaaaggttaaatacttaattcctgggacttagactgttttgtgacatggaaagttatgcttaaattggctcaaagtaaagcgagaatacagttatttctgtggctttgcaaaatgacatatcacaatcaattccataatattttagttttaaaaaatatcctctgtgagaaacaaagtatcttacagtatcttgcattgtcttacaactcgctccagagtatctgtcagataacaagagatcaacagctatgatgcaccaacaaaatccaaaagaattcaagggattttgaataataggttatttttaaagaggtagcattttgttagttttacaatcatcatggtgtatataactcattgtcaaattattgatttaacatatttactgctaagtagacacgggcacaattattacagttgatgaattgcttgcacattggcagagcagcaggcatgcggtctgtatgttaaaaatataaacttcaattagaagctatccctggatctgtttctaaggaaaactatccatgtgttccacatgatcaattctggaataaaccaaaagtcaacgtagaataatatagaatcatgaatccccaaggaaccctaaagggtcatctaattcagcctgtggctgccttcacataaatcatccaggcttaatgaactttggaaggcttttaagagagataactagggaaggaggtgaccatattcctagaagtggaatcttctcctgcaaagagcctacagccattctgttacaatttacactaatttattattttttacagttaatacactagaaaatacaggtcactataataaatgacatagctaggataattattctagttcagaatttcagaatattggtccaagcttttttcctcatacaccatcattatagtacaggtaaaaaggaatgcaaagataaggttttctaaacattggctcattaaaaaaatcatttagcatttgtgtgtaaactgatctatagagatttattggcacttaatcaagagagacagtttggagtgctttttcatgctaagcagacataacatttttgaagaaaatcttagaaagagagaatcttattacagccgccactttatatgacagtttattattgccaaaatgtttgttaatgtataaactgcttatacattattcttaacctgaaatcatatagagagagcaaaaagagaaagaaacaaaaaacagctgaaaaatggtaatgatatatgcacttttcagaaatataataccatagaaaactaaaaccatatctaatctatttaggtcatttccttagtacagcaacaataaaataagcataattgggaattaatatccatttaaaatgtatattaaaatattgcttatgtcctaacaaaattatcagtgaagtgtcaatataaatattttagaactaaaagaagataaaaagctgatattaatccttatcttttttcatttattttaaaactataaggatatattaaatgtgggatactatcaataatttcacagttttataatttttatgtgtactttctagtgagtatttacatatgttattttttaaactgtacaatatgcctctgtactagattgtaaaggtgtacctacagcataatattttttaatttatatcaatacctattatttgagtatttactatgtgttagtgctagaagtcaaaaccaatagaaatataaaagtagttctaggcctcaagggatatgaacaattagtcatacctttgtttttctagaataaattttacagaacttaaatctaatgtaatatatgaacccagatcccagttgaacaaaatgtctcaaaccactggatggcaacatgagattttctacatttaattacctatgttatctgtaagttcaacccaattatttgtatagttcatacttgattaaatttggttttaaatacatgaaactgttaagttgttttgacctattttcaaaaaaggatggaagatttttaggtaatacaatttaaaaaaataatctcttctgataattcaatattaataaattcaccagaagaattttcaaatacccttaatttggccaaattctaagctagaagtaggaagtcaagcaaatataatagcaagtataattgcttggctcagccaaacttggacttcagaatcactccagatataacaatcatacaattgcatgctcactggcagattctctccttttacctggaaagtgctcataaaatcaaaaagagatgtaattgtttacaaagtgctattgtggttggcaccatgggacacccagtttactgtgttgtaatagactattgttaaaatgaaattaaacagatgagtattcactatttattatttataagacactctgccatatgcaaatgcaaatagataattggccaagaaattatttcaaaacaaagtctgggaaaattctcatgtataaataactttagaacaaagaagactaactatgtttataataaaaataaaatagagtacacatgaattaattaaaacaaattatctgcttaaatattcttcagtgaaaagtaaacgtagcagaggcaacatgtagatagcatgctaaagttacaagactttgtcatcgtatccatggaaaagtatataggctttggaaatatgcttctaatattcaacctttctgtgcttctttgtaataggagaataaaatccagagttgttaggagaagtaacaagttaatactcgtaaagtgatttgtatggtgccaggcacatagtaaacctttaggaattatttgatattatttaatctatttctatatgatctgatactttgtttcttacttagcacagtagagcacatttttcattatgttatggtaatgctttagttggagaagaatgatgaaaaaatgctgtctcatagaaagacaaaagaactatgaagaacccagctttctgttctttagttttcagtgctcacatactgcttttttatggagagatttattagagattagagaacttgcaatgtaagaaaatatgttcacaggttttactgaaatttataatatatcattgtacatagaccatagaaatataaaatctaacttcaaaatactttttgctaagtggattttaactgtggttaaggggctttcaaattcaaatttgtaaaacactagtctctagtggtcagacaattgagcttttcttttttgtatacacatgtgtacttgtggtgtgttaagtgtacatatcaatatgcataatattttcacgatgtaaataaatccatttactagttattcaaaatagaaaaaagtatgccaatattggaaatataaaaatttactatagattttatattaaaatatcaatataaatattttaattaatataaaaattttaatataaaaatattttatgttaaaatattaaattttaatataaaatattcagttttaatataaaatctactaatttcttatttttgttttaggtacttgttaatgcaatgtttcttctatcagcttagactgatagaatattgacattagataaattgaaattctgatttttttaaaataacgtacttcatcaaaaggcataacatgaaccatttgtttcctcattaaaatgttaaggagttggcatctaacattacatatttttatatacttctggttacatattgtggagccctttacaaaggttgtcttctttctgaattcatgattaatctttagaggacacatgcttcatgaagaggcctcacaaatgaataacgtaatgatagtgactcaagcacactttggcacagtctgaaaaggcagtcacccagcaaagcaattaatgtcagaactaatttagttctcagcgaattttattaatgattagaatgtttattcatttaaaaaactctgtctctctatagcatgaattgaaactgtgaattaagaagtgaacaataggtatccttccttttcatgaaagtggaaatctagggttcagaccgaattgcaatgtagggaacctgggccatataagactattgccccgaataacaatataatacactaaaactgaaaatgaatggtcaacagttaataaatattgagcatctaccatataccaagcacaataccatatgttttataagatttcctcaagtaaaatattttcttttagtgactagttataaaatatgtcatggtagttaaaagatagaaggtaatgtctaactgtttaattttgtcatacaaatcaatattttacaatacacattaaaagcaatttttatcatcaataacagaggcaaactcttataactcagagtccaaatatttatgcttttaatttatttgtaattaatgatgacagaaacctctggtttgtggtatgtgtatctctccagcattcaaattaagatgtgaatgcttcaagtcagattacaaggaataataatataaggccttttaaaattcaacgcagtgcaataaaatgtgtagtattacaagaaatgaagtaactagacagacgaaagattcataaatattgaaaaagcaaaggaactttttaaatttttttcagtatattaatgactaaaatgttgggaactgagattagcattaaccacagacaaatggacagtgcttggaagaataaaaatgtattttaaaacttctatataaagcatcagtttttactatgcataaaaccacacttttttgttttaatcatgcatattatgtggtagaactattaaaagagaggaaacctttaaatacatcaacaccacagacactaaaatcaacagaaaattttaagttttaaaaattgcacaaagtctacagaaacccagtaatttatcctaccaatgaactaattatttattaggttgaaatgaccaacattaactaatatttggaggaaaaggatggggtggataataataagaagaagaatatcatccaatatgaagagcttttaatgggatctatgtaattgtttggagacaactatatccacaagcttataaagcaatttaaatgttaaacctaaatttagaaaaaatattatgtttgcacataaagctttgttaccctaaaatgaaaagtaacaaaataaaccacaactccttatttaactatggaatatttctgaccatcttatcttagaaaaaaaaatctttaaactcctcaaaatatatatttacttgatagaaattagatttttcaaattattatctccttgagtatcaggcaagtttcaattctaatagacattttcaaattttcagaaatatttttactgaacccagagaatactaagaaaatatttgaaatttttatttaaactttatgcaaataatagctaacaaaaaatatttatttacatttctttgtgccagtactggtctagacactttttacggtctcaactttaacggctaatgtaatattcataaactatcttataaaataagtaccattatcctctctttgcagatgagtaaactgaggcacagagagtgctaaaatatattgcctgagataacacatatagtgtttcaaagacataactcacaagcagagcttatacccttaaactcttataagctatgttataaaggtgactttgtactgcaggtttcttataaaagtaaattattcttctctctgttaatgtcataatgcaagaaaataagataaacattaataatcattaagcatacacttaaatagcatgtgctattccttgttctaaacactttacatatattaatccctttaatgccaagagattttaatcatagaacttcaagcctggaatgtacagcacccttattttatgagaatgctatagccaagagaaaacaagcaacacccagaaaattgttaactttgacaattgaagaaatttgaagtaatttttgtattacttattgtactatgcatataacctatatcttttttcaataataaatcaatttattagttacataaaagagtatgtaattgctacatcagaaatgagaaagtgggaaatgtgaaaggtaaattgtcaaaagttcataaatataattaaataggatcaatgtctgaagtccatgtattcataaccaaattctaatgatttctgctgagtattattcaatacttaacatacatttgtagacatttttgtttcacagtcatttttaagaacgtgttgtatgtctaaaactatgctaggcaattttgacacagattaaaatatgcccctttgcttacatatggagccatctgaagtcccagttcatgctggtcctgtttttttgttgttgttgttgttgttgttttctatttagcctttgtcttgaatgagagtgtcctaatttggatgttgcccccacacacaccaaaagattctggattttagtcatgacgaagacaaggaattatgtaattaaccttcttaaatattagtttgaagaatatacaagatgctgggtgtgtggagaagaacaattaactctacccagggagttacttcggagatctacagctggaatggaggattaaaaatggaatgggaatccatcaggtggttaaagtgatgatagacatgaggaagtaatgtagagagaagcaaataaattagtacagatagcatttagcagagatacagtaaaaggagagactagtctgggtcaaactgaatgtttcagtcagtgccttctctgctttaagcacagttctagaggctaaagatacaatggtgaaatggagagaatttcttcttccttctgctaatgtcataatgcaagtaaattcgaaagcattgaaaggagactgaacacaaaatatgaataaactagaatagaacacctggagcaatcttaagttgtaattcctattaaaaatattttgccatgttaattcatctatgtctagagaaataactggagcattgaggaaaaaaagtaggagaggcatttctttcttttcatttataatttttatttctgattcagaagcctttattatctaataataaacagctaataaagtagcaaactacagcagacatgactctaaacaagaaggaatataaaaaccaaatagcagagctgcaaatcaaaatgattaaatataagaaatcatctagcaagactttccagagcccataaaaagggaaaatctgctcacatctagaaaagggaggcaggattataaataagaacaggcaaaagccaaactattgactaaattgcaagtaaacaaaaagaaacagtcactttatgatagaaatgtagaacatttggctaaatggaacaatgaatgcttcgttaaaaggaaatgttattaagtactttacatatagatgatcaattttcagaatttttctaacctcctgcagtctttctatatcagtaggtccccttcagtttctaagaatgttctcctcccttttgtaaaatgatttacaaggccaagttctgtattccattgtattctttttttttaattatactttaagttctagcgtacatgtgcacaacgtgcaggtttgttacacatgtatacatgcgcctatcttaactgagttagttctcaacattcagactggactcaacatcacaacatgggtgactggaataactccccttctccttacacttaagtttactatttctcctcaattaagaactgccaagaggtactgggatgaaagtagatttttccttcttttcagaaccatcttctccccaatacatgggtcccatacttgggaccaggatatacaggaactccaattgtcaaagggactaaggggtcctgaaggaaggtattatttcagcttattttgtgagctgcatggccaacagtatcttcactagaacatagtagagttggataattgtcttattcacacagtgctagaaaaactcacatcacaaggatgatttcctgcattatatgtgtaaaattcaacttctgaactgaatatatttctgtccatgctatcctcattgtctcaagaggggaaattgcctctcatctggtctcttgggtctgatttcatttatcctcaaaccattctccacagagcagctaaagttatttttaatgcaatctgattatggcacttggattattaaaatttaatgagttcattactttctatagaataaagtccaaataccttagatatattctcagactttcaccacctactttctctgaggcatctttcctgattttccaggcaaaatgtattgcacccaggactgtacccttcatatactgtgtacagttgtttgtttctctcactattctttatttctgccattctacaagttcctaatatctactcctttctctcacacttagcacgtaatgacatccaaataaactgttattagttcaatggattaatgagtgagtgagtgagtaaatgcacacacctgtctcggacaatggcttggttctgcatggaacttttggtcttttcatatttgtagttccacttggtgtaacagtggattgaaaaaaccactactcttaacattggaatatgtgaccttaaattctggtaccattttatacctcatgaatgttatattctttggcttctctgggcccattttccagtctatgaaatacagtttcttacagaagagttataagcatcaaatatgattaatgtatgcagaagcttctcaatagcttaggtaaatgtgtaaatatctaaggtaccactgttaattgttataaatatctatatgataatacaataatcaccactattgattattataaataggtaccactcttgattattctgttactacttaaaaactgataaattcctgtgatttataattactgtgatatgtaagattattattatcacatgtaaggtagcagaagtagccaagcctacttctctcagtagactgaataaatgtttatattattttaatgctaagataataaagaacagattgccctactcaccctggttggggctagagttggccatatgtgatacatacatgttggtgggaatgtaatatccatggatattactacatacatgttggtgggaatgtaatatccatggagccaggagtcaggtcagacaacaactcggcaactagcttcttgttatatacgctttttagtcacatatcctaaagtcatatcctaagtgaggatctcaacttggacttggaagatgacaataacttggaatcacctgtccttcaatagccaggaaagttggttcttgaattagggcttaaagaatcaaaatgatttggatagaatgaaatggaagctaaagggcattccagaccagaataactcttaaatgagtgagaccaatagaaaaaaacttaatgagaaatcgagcaaattagacgtgtgctgtgcttggtggcttcagcattcctttcttactttgtgtaactgatggcttttgttgtggaaacagtgtaacagatggagtcaatttgaacaaatcaaaatgagcaatgtagacaagacatagagtaagacgttaaaccttttatttcccttaactatcttttgttatttgtatttttctttttattttgtatgctatgaatcactaatgattctctagttttaattaataaacaattctaaatacatctgtcatttcaatgaacttaattaaatttccattggaagatttaataatatattttctgagtattaaatgatatcagatttttattttctcttcaatcattgttttgaaaacatattaccctgaaaaacacatacaaaagtgctgtattttaaaaatttactcttcttaacatatttttcctactagaagaggcaacatttactttcattatttaatatgaattcatgtactcatttatttaacactcattttaatcaagatatgcaaaggtgagtaaaatatgggctttgaggctagggtgtccacagctaggaaaatatatattatttaaataaagaggaaatttctgattaattctttgctttcttaacctgataccatggaatatttataaatactgaatattaagtaggaaactttgatttgcttaatattgagaaagtagcacaattagcaagttatctcttttgaattaaaaattacaactggattatagtttagtgatgaaaaatccaacaaaactaccatgtttctcttgactttcatttagttgtctgaaatgaatagtggccttgcttgtttatactgtaaacctagtagttaatttttaaggcacaagggctctgacttaattttctttgcttcattccactgataagaagaatgtctctgtgtcaaagtcattttatattttttattgtcattgtctcattctattatataagcagatattaattctaagtatatctttcttcttaagtagagttcagtcttgtttctgcctccactttgccatccattacatattttcttttggtattatctttgaaaattattcagaaaccattttagatatctattattctttttgttactgttttgagataaattataatgttaaatgttataattataagctttcatgtcaaacacattctttaaactttgcggatgctaatcattttcttttaaaattatgccacatgattattagtttcaaatttttagtttcaaaagcaacaagtttatatttttgtcttggattggattctctattttacaaattataaagttgtccacataatttagttgtctcctgtttgttgtatattgtaaaggatttatgccatagtataaaaataatgaattatggaagtgaattattttattatcctaatattgtgattttatcattcttcttcacttccactaaattctgagtaatgcctcaaatcccagtttaattaaatatatattgaagacctactactatttgccagaaaccataggagatgtagtaacagacacaatgcaagtataaaagacttcaaaatactatttgttttgggagcacacattctacaaagttattctacttgcacatagtgtacaacagaagacaaaattttatctgtgactgctttgcaaactcagaaggctgaggccttgcatagtcaagaagggctctgactgtaatctttgctcaagccaatttaaaagaagcattctgcattcaaaatacataattatccttaaacatttagttgatgatctgactctagaagaatagatagaatttggatatcttacatggttgaagaatttcataatgcattccaggcaagtaaatgaacatgagcccagaagcagatgggcacagtgtgattgcaagaacaagaaacccactgacaagagcaggattagcaaaagggcaggggacataattgataaaatagaagaaaagtataggggaagaggtattagaattagattatactgaaaagtgtaggtagaggggtgatatactaaactgatgtgtatgtaaaatctcatgggtgagtgtgacagactcacgggcaaaccagttcggaaggtatcccattaacccaggcatgttacaataacaacccagattgagatttggaaatgtggatataaaagagtgattaatgatgctgttttgattatttgttttcagaaataataaatcttggtaactatcttgacaaaaggaaggaagaagaaagatgaatcagagccattgtacatttttgagcctgggtgaacaaaaataatggtaatgacatgcatacaggcaagggcactgggaagtgagcttattaagagtctgggtatagatggagtgaaaggtaaggaaaaccaaacacaccaagttttcaaacttccatcttgggtatagttagagttaatgataaagtatattaaaaccagactcactttatttagacactttcattctctattttgatttgtggaagttttctacaatctctgttctctaagagcatcaatcagtatatttcatataaatagctattgttagtatcctttaagttatttattgctctaagtgattcatatatttaacttgtttaatgctcacaataccctatagagagttactaaattattattatacaattttatagatgagaacagggaagtacagaaaatcaaatagcttagcgaaggtaacaaagctaataggtcctgaaaacaatttttggaacccaagaatcttctgctcttatctactggtatgtagattgattccttcatgccaaatagtcggtttagtataaacaagtcacatcttctctacctcttttagctcttatatactcatttttttttttaatttaagttctgggatacatgtgcagaacatgcaggtttgttacataggtaaacatgtgccatggtagtttgctgcacccatcaacccatcatctaggttttaggccccacatgcgttaggtatttgccctaatgccctccctcccctttccccccacccaccaacaggccctggtgtgtgatgttcccctccctgtgtccatgtgttctcattgttcaactcccacttataagtgagaatatgtggtgtttggttcctgtgttagtttgctgaggatgatggtttccagcttcatccatgtccctgcaaaggacataaactcatccttttttatggttgcatagtattccatgtgtatatgtgccacattttctttatccagtctatcattagtgggcactgggttggttccaagtcttgcaatcataaatcatgctgcaataaacacgtgtgcatgtgtatttatagtagaatgatttataatcctttgggtatatacccagtaataagattgttgggcgaaatggtatttctggttctagatccttgaggaatcgccacactgtcttccacattggttgaactaatttacactcccaccaacaatgtaaaaacattcgtatttctccacatctttgccagcatctgttatttccggacattttaatggtcaccattctaactggcgtgagatggtatctcattatgaaccatcaaaataagcatagaagataaggacatttaaaatctggtgattatatgtatagctaactttatttcccaaaactcctcccaccaaatctgctctccaaacacggagactgtgtcatgttattttatgtctcttggcttttcacatattaattcaaccgaacagaaaattcccctggctaactagaaactgctaatcagcttttatgcttgtaaagcatactgtggttgtcaacaactgtctgggcctgattttgttttcatttgttttaaatctagacttttggagtcttgctgctatggcatgcctgtgcaattgagtgtactaaagaaattcaggagtgagacttttgcactgttttagtgtgtcctggcttaattatttttttatttttattttttggacaagccagaatgatctgctcatatcctacctcttatctgtcttttttttaggctgctttcttctttgtacttaaagctcttagtacctcctgcaaatccacctggcctcagagtgctttatagttccttagttgcttccccttatcaaaatgttcatgtctctgattttgagaactgtaacataacaataagttatgttaataagataaacaaatccctgctcctgagtaaatgagataatgtgctatttcttatagtttgatcatttctgcttaactctgaaatgccgtgctcattgaagaggcctttggaaagttataatgataccagaaatagtcattttggtctactgcaaggtaacttttgatggggacattactacaagtagacaagtaacactctgtttttgataaagagggcttaaaaatcaagtaaaggaaacaaatttatatggggtataaaaatttgttatgatgaaaatacattgaataaaatgataaaaaataagtacatagaactgttagctaaatgtaatcatttttttcagattccctcccctgccccagaatatcctgtatacagatccagttattttttaaaaatcttttcaggtatctttattttagtatttaacagctcaaaataccacaaggtaaatggaatagacatccattctcttgttttacttatgttgaatacagtttatagaaaaggcaatattttattaattttaaaggaccataattttcctgcttcatggtacgtatctgtttgctcttagacaagttcctaggaacaacaattttatgtttgctccaggtacacaacatctataatataaatataaagctgcatttaagctgacattcagtcatcaaatttcctcattttaaaaggctaaatcacacattcaaacaatgtgcatttctgagaaaaaaaaattgtgtaggtatggcaaaatttttttgtgtcaattaaataccaatggtgttcaaaatgtctccaacatgcatatcaaaaggaaattgtgttaattatactgattaaccctagtttattatgtttcaccaagtaagtcctcctagaaaggaattagtggaagatgcataaacattttaaattcaaatgcagagtgtggtaaattgttaccacagagacttaaatggattattttatgttctcagagcatccatcaggaaaaaaactgttttagaaaaccaatgtgattgtgtcaagatgatgggactaaattgaccatggcaaggtttagtcagtgtttttcctgttttcattattgattgcataacattgattatgttaactgtgcagagctccaatttacttattacgtttgctaaaataacagattggcattggcacaatttctttttatttgaggtttttaggtacattctacttgtcattattttgggagagttttttttttttttttttaagaaacctagaattcctcttccccatcttaaattctagggtttttttttaactttttatttactaatttcattgcttgggaatttagaaaaacccagtcattgatatcctctgattaagtaccttatttcctaagaaaaaaaaggaatagcatagggcgtattgtcttttctataaacagtattcagcataagtgaaacaagagaacaaatgtctattccatttaccttgtggtattttgagctgtcaaatactaaaataagtaatgatatctgaaaatatttaaaaaaataacaaatcattaggatagattcaacataaaaagcagaaacaaaaaacgttatggcttctttctgtgatgcagttccatattttatactattttaaatatgtatgtatgtatatacatacacatatatatgtatctatatatctctgatcattgaaaataaaacaaggttctgagaacatcctcattaaaaaaagattaaactattaatcagggatagtgagtacctattaactgaagatgccattttgggaaagaaggcatagcccatgatctagggtttcttgcttcaagctgctactcggaaatacccaaactttggataaaagaagttttgacaaattttaaggacgtaaaaccagataagtatcattagtcactaatgagaagattatgaggataaatgcaaaggcctgggttttccaggagtgtgtatgcagtgacttaacattatcaaaaatgggcaagtgagcttccctggcataaatggataagaaagcaaaagtctaacagggacctcacctctaccatgtatgaccatgtatgaccatgaggacattagcaccagactgtcagggtgccagagtggctcctgcatgtactagttctggaacttgggcaaattacttaatcattgtgcctcaattgcctcatttacagagtagtgataatataacaccgatctcatagggctgtcataaatgtcaaatgagtaaatgcatgctaagtacttatagcagtgccatacaagcagtagctgtaattattacatttgtgtttcttttatatttgggttaatggctcccttatagtgagggtgggtatacaagaaagagtgacaagactaaaggtttaaaagaaatggcagaaccagacagcaggctggttttttttttgttttgttttgttttgttttgttttttttgccggagtctccctctgtcgcccaggctggagctcagtggcgcgatctcgactcactgcaagctccgcctccggggttctcgtcattctcctgcctcagcctcccgagtagctaggactcccggctaattttttgtacttttagtagagacggggtttcaccgtattagccaggatggtctcgatctcctgacctcgtgatccgcccgcctcggcctcccaaaagtgctgggattacaggcgtgagccactgcgctcggccggaggctggtgtttttttaaggttaatcatcaatttattctatgttagcaatgcactcattttcaaaacaatatttttctatttatgtatctatcttccttttaaacagtacacatttaagttttatataaggaataaattcattttatttgtttttctctgctattgacagttttgttttttttttaatcttgtgctggactcctgcaggaaaactaacataaatccatccatcaacagtatttgaaacaattaaaaattatattgtttaaaattaaatctgtttaaaatagatgtctgatatttgtacatcataggaatttaaaattatttcaagaacaatggtagccaggaatactcttatagcacatcaaagcatagtttctcatggcataagtctgagctattttagccccttatcagcaatgcaagttcttaacgaactgatagtttttagatgagcttaacttccttcctcttgccaaatatgttgttgccatagctatctcctttacagcagtgatgttattttattagcatgagcttaaaaaattcagttatttctgtctgtcaagacacaacatacacattctctcaaaatttgcaattttctttttttacatgctttacttaatttaatagtcaatatgaaatcgttttacaaagtaagccagtttcttcacatatctatggaaacatttggcagttaaattctcctggcaggtacactagccagttcaaagacagagagtccttgggatgtattttctattgctgaggaagctggcttgatttgaaggaaaaaaaaatccaagtcaaatcatcctttcagagttttatgttataaaattctgggggatctgaatcaaaggttacttattcttaggtaaatgtgatgatgctttttgagaaaaatcttgtttttaagcttttttaaaactgcttccgtggaattaaagtgttctggtgattgttaacgataatttctcaggaagggtttcatgggtttataggtaactcccctaggcaggtatctgagatcaaatctacagattcagctccctaactcttgtaatgcagtgtccaaactgatagtttggctacccaaacatttgtcctgaaacagcagcatggggcactaatgccagaaagtcccacaaccaagagaatggccttgactccgaaccatcaaaaactcagtaatatttaagagaggaagttgagggctgataaggtttggctctgtgtccacacctaaatatcatcaaattgtaatccctacatatcaggggaggggcctggtgggaggtaattggaccctgggggaggatttctcccttgctgtactcatgatagtcagtgagttctcacaagatctgatggtttaaaagtgtgtggcacatcccccttggctctctctctctcctgctccaccacggtaagatgtgacttgcttcaccttcaccttccacaatgattgtatgtttcctgagggctcccagtgatgcttctgtacagcctgtggatctgtgagtcaactaaacctattttcttcataaattacacagtctcaagtagttccctataacagtgtgagaggagactaaaagaagggccttgacatccatcccttcctcctgatacattgagttctagccttatagctgattagatctctgaaatggtacattcttgaaattcattatctcagccctcagaatgatcatcatccttgcttttataattattccctcaagttttagaggacttttataaaattaggatatttgaaaatcaccctaacattttaggaaaacttaccaatgacacttctgttatgatgatgaatggcccaaatataagaacccatctgacaatgttttgctagaatttagcatgaagaaaaaatacttttgttgaagagtcactgctcattctttgttcatttatttatcaaagaaatattggccgactaccatgggggccagagtctgttctggatgctggacattcactactgctgtcagaaaactcactgtcaagtcacagaaagatataggaaaagctgacgctatgaggagccagggaagactggagactcaggaagaagtctatagcaagaagtggcatttggcaaggtgtttcatcataagtaaatatttgtatgtagaagaacaggaaagggccttagggacagatattagagctttggcaacagcacagatgtgaaaagtaaacagtgagaaaagttatgtgcagttgagagagagaagttccatgtggctagtaagaaacactagcaggagctgaggttgaaaaggatctctcagggtaggtcgtaaaaaacttgggatgctaagctccacagtaagttttactctgtggatgaggaagggtccataatgaacttaaatttaaggcgaacaacatggtcagatttatgagatgaactgtttgtgaattttataatggaatagactgttattgtgctttgaaaattcctgtattaccaggatgtagaacagattcaaacaaatagcatatgcttaattactatctgttgagtcgaatgcttagttatgaggctgcaagagtctaagggtagagatacagaataatgttggagttcagatatattttaccattgattcctcttttggatattgacattcccataactttttccttttcctgaaggctaggcaattcagagctatgcaataattatatgtgttcctcacagttggcatgcatgcttcttcctttttgtggcttttattttctgtttccattatattgatgttaactcttttgtagcttttatcataggccacctcaaatatgttttggaaatatgttgagtgtaaatgaacccatatttatttggaaacttttaggttaacactgctttcgtatttcaggcctattcacatggaaatgaccttaaaagatgctcacagccaccggctcaccctcaatgatgcgccccctagaggaggcctgcagcccactcaggcaggctgccagtcttattttggaagacggcaatggcaaaatgcattctccttgttatgtccacttgtctttttatttttttgtggtttcagaaatatacaagcattgagttgtcatgtacagggaaattgtctaaatgcagctttaaaaaaatgatatacatatcaattaaactctttaaccttctgggatttcttcccaactttaagaatctaaatattaaaggtaatctatggacaattcagtctgcaccatgaactataatcacataaaaacttcaattatcaacacttatgatctgaacttgctttttggtacaatagaaataataataacctaaagtgttatttggcattgttgaaggcacctcagtatgctgatatgcttgagaatcacagctatgcaggagcctacggcaggttgaaataagtgacagctttgaaatcaggaaatgtggtcctttcaacatcaccttcgcacctcattcacagtataattgggaaagtcatgcaatctcctgaaaatcttacttcctcatctgttagacagaaattattctttcatagaattatgaaaattgaaaaaatgtgtataaaagtatcccaatacagtatactgtataaaattgtattttaaaactgatgtaagtgaattatagaaattctggttatgggacattgcatttaacatagtcagtaaatttactgtaaaattaatattttcattatgaaagagacatatattttaccactctatgcccactattcatctatcctgaattaaacttggctgaaaaagttaaatttaaaaaaaagtttggtttgaagagcaagtatttcctaaatgtgatagcttaatgataacactgagttagttctaatctaacattaaaggaagaaacatgtacacttacgctttggatgggacaaatttttgttattcacatttgaaattcactttagttttagcacaataaaatttaataatttattagtccctcatagcactctgctgagaagtgaatgtcttgtcaaaggatcagttcaaagtagctttacttcctacgtttaactaatttaaaactgccttacctaggccgggcatggtggcccacgcatgcaatcccagcacgttgggaggccgaggcaggcgtatcacgaggtcaggagatggagaccatcctggctaacacggtgaaaccccgtctctactaaaaatacaaattagtcggctgtggtggcaagcggctgtagtcccagctactggggaggctgaggcaggaaaatggcgggaacccgggaggcggagcttgtagtgagctaagatcgcgccgctgcactccaacctgggcgataaagcgaggctgtgtcttaaaaaaaaaaaaaaaaactgacttacctaataaatactaaagtagtcctccctccagtttcagttttttttttttttttgagatggagtctcgctctggaatatgaaaaatctttagaattttataaaaatctgatactgcaaatattattacaaaaagttcaattaaattaaacatttttgtggtaacatggtactgacaaccatcatcttgttatcaaaatatatttgaaaataaatcaacctctaaaggattttttaatagtagaaataatataaattttttttattgttatactttaaattctagggtacatgtgcacaacttcatgtcctttgtagggacatggatgaagctggaaaccaacattctcagcaaactattgcaaggatataaaattgttgtttaagcagactacctgtttaaaagaggatgagagaagaaaatgaagtcttcatggctctgttatataatcagggtgaagcaataatttaaataactcaacaacatttataaaaactcaggtagttttaaaaattgtccattccctatatatgcataatgtaacatagaaggggctattcatcatataaggcatcttttgaaagctgaagagggaatgaagtgcatttttatttcaaatgacaaccataataagagactgcatcatattgttgttttttaaatgaatacaacttggttcctagatatataataagaatcaactgggtaaagctagaactaaacaattttaaaggcataagaatctctcaagtcgggaaaaacaaatatttggaaacttggagggaggaagagatcccactctttcttcatccccacatttatttaaaaattccactggttaattctctaaggaattctcttagggtttggcttccatgacaataagctctctttgtttagttttagtttctttcaaaaaatgacaagctaataccacagataaagaggtcagaaagaatggactcacaggcaagtacactttttaagtaaagtgacaaagcaataccaagggctttgacacttgagacggttcctgagtggaacgacaaggtgttctgtaattttactgaagttgatgagattatgctttctactactttggtagtttgggtgtctgacattgtgaatgtttgcatattttcacgttagcagagatacaagtattaggaaacaatgaaactggaatataataacaatcaagtgttctattgcctcttctaaaacatttgtttaaatgaagaaagtagcaggcatgtggccaaaaaactatacatgtatacactaaagaaatgttccaacaaataagaaaattggtcttgttgctttcagttattctgtgttgatcaaaacggggaaataatgtccgtttaaagctaaataaaatataaattccaaataaagccatgcagagtaactcaaacagtatttccctagggtcaagaattatgggttcttttcacaatgttaaatatgcagttgtttgtattctgggtctgtttctccaaccttaaaatgaattgtttaagaacgagctctaatttttcttcaagccctaagatcatatgactaaggagaaatgatatccgcatgcctggcatgagttctgcttttctaagtatttattattattattattattattattattattattattattgggcttggactcaagtgcctgttgcatttgttatcttaggcttatagtggttttcaatcttgttggtctcaggactctcctatgctcttaaaaattattgaggactccgaagagctttggtttatgtgaattacattacagtacattaaagcttaagtgatcaccaatgttaagtatcacttgccagttgctacctaagctctccagtaacctttggtctcatcagttttagcatgattcaaactgatcttcgaagaaagggagctaatttccttactgtatcattaggttaaagactgtgacttcagctgcttatgtttatgcttttagccagatctagtatctttctctgggttattctttaggcaggtttttgctaacttcgttaaacagatcaacaaaatattatttctcctgtgtctactatgtaaattatctctacctcctcttactaaaagaggatggaactttttgttcacatattttgaaagaagaaaaatgttagttttaaattttaattttaaattacaaaaattacaattttacaaacacagagctgtgacaagtccctattttaatacttttaaaaggcattatagttattccttcatctttaaattttatatttaaaaatgttttccaggctgtgtaaagtttgaaggcactgtatttgctgaaacagtcaaattttatcttggcagtaattgcttctttacgacttgtctgcctgacagtgtagtagatgatctcttgatatgtagtctgaggttgcagactcctaaagctgtctgtggctactcacagaattcctcgcacctactccaccactgcttctgtgaaattatatgttccttaaagtgtgtcatgtaattgtccttagttcttcctttgctcatggtctttgtgagaacaaacttcaaatgtattcaatggaattgatgtggctaggaaaatgtatagactgccgtcattgctacattaaaataataatcaatttcaattctacggggtacacattaatggatatggtttggtgtgcggtaatttccctgtagtgaaagagtatttttctattatgtatatcaaggggcctgagtctttcttaggagcaactctctatcatacaaaataatcatgaacagatggcttttgttctgttttagaatggcaacaattatgtgtgtgatattttcaatagcgtgcagtatagaaaggaaaagaaaaatataattgcaaacttttgttagtgctacttttggagcaatataggcaagaactaagccaattcatgaagatggttgtatgttaattcctctctcccacacaaattttagtgagggcattatttcttacaataaatattgggaatcaatctctttcatattgattttattattttgttctcccaaatgccataatgcatattcaaatctactcagtaggcaatttagtctagcagcaaatggttgcatattggtagtgataatttaaaggctgctttaagaaaaagtggagaagacaaactcaaattatttagatctaaaaaaacacaaaaggtagaatatcataaaatgatacaacatctgaatgaaatttcatggacaggctatttttggtgtaaatgttcataattaattttcagcagctatattgcttttggaaataatgaatatgtactttatcatgaatatttatgaagtgatatgaaagattaaaattattagcaaaaatgttgaaaatatttttaattccttttttctaaaaacttttaatactatcgcacattgtttttttaatgtcatgctaaaaattttgtttcttatatgatatatgcagctctttaaaattgtaagaaattattcatgaatgcatttaacttctgccttaagaagataaaggtacgtcaagagattgtacaatacttaaaaatgcagactttattaaaaacacaactatctctaaaaaatcaaaaatacctctgtataaaacgtgatttaaaggttgactattagtgcgctgcacaaaaaatgaattgctgtaaattgttttaaaatcataaattatatttaaaatttaaatatgtacacttgcataatcccaaaatattggtcaactacttggtaaaatcaggtggaaaattaatcagattttcaatttttccttagtcatgtagttagagaatctgtgcatctctcacatatgtgttagcggaaagaaaccagtaaagattatctctagaatatgttagaacctgcactgtttctctccggcaatgcctgagacaattccacggagttgatagtctttgtatcccaacagccacttggcttcccacctggggccacgcttaagagatccagaccccatccttccttgggtggagcttcagcttcatctgttctgtccttctctcctcctatgccctttcctaattctgaatagcaaagatgggagaaattggtggttgatttcaaagatctgaactatattatatagtaggcaaagatttctttataaataaaaaaaatcactaaaatcaatgataattgtttatataacactatttgcttcatccagttaaggttgcagtgtagttgaccctgaagagaaggccaccacaactctctctctacatatatatatatcatatatatatatgatatatatatcatatgtatcatatatatgatatatatgtttatatttacatttatataagttgaatatatgatccaaatggaggaattcttcatattaaaaatagtttgtttgcttccttacttatctgttaatatgtcccttaggaggaaatcgcaagatgatttaggacaaagagcagtatacaatcaaaaagatctgggaaataaactgtgttcttgaggcttcaatttaatgcatttagtgtggtacctaataaatgaatatccattatgatactatcactgtgtggtttggccacatttatgttgtgccactgagtagagatggaaggatgtacgcaactctgcatcccagtgactccagaacacgaacactgctttagttagtctccctgactttgctccttctgtacatcctctcagagatagggtgttttctgagagaacaaagaaaggcatataccgtggatggctgctattcctgcctatccagtgtctatttctccttttctcttaaaaacatctgaattttgtttgtgtgatttagccattagatactaaattttgggggggggtgttaaaatgtgtcacttctcctgaacttagttttgaaaatcagatgctagcttcctaaaatgtgcatctttaggtaaagaacatataaattaagaaatatttggaagagactcatgggaatggcagtatctgaagagaccatcaatagttcctgctaattgttctcaacttttctataccttgtcctttctgaaacctcttcagctttttccctcaatatccttctgataaatactccttttaattatatgtgcatgtgtatatatacacatttatgcacacatacatacatgcatatatacacacatatacacatacatatgtgtgtacatgtgatatgtttgtacatttaataaattacccagagttgggttccactggttaatgaagacctgtatttataataaaattctgaagagttagaatatatttcattatgtaggagaagcgtcactgcaaagcatcaccaacaaatcatgttgaaagagacaggaggagatgtggaaagaatagtaccagccaaaatacgcaatctatttcataggtaggcaataaatactgcagtagggttaagcaaaattaggctgaggaaagagcacttattttgacaatgaagacggtaatcatcagagaaaatcctgtaccctgatggcccaggggaagggggagggggccatctatactgccatggattaaggtgaggaaggaagaggttaataaagagagaagagaaaatcagccttgggaaagagagttgaagattacaatatgattaatctgtgttatttgaggaaagtgggaaaaaaaggcaaagaaagaaatgaaagatttgacacctcataataggaagaataaataataaaagagattaaaagagaagaaaacaaagcacaggtgattttcctagaggaaatagtaaacacagaagtaaggaaatgcaaagagcttaaatttacagcctgtacaattttttagaacacaatggtttttagtgttcagcattttccaaagtcaggcataagatgattctaaaaaagcaataaaacactctgttttatgtactctccatctttatacttgcacattgttttatttttaatttttttctgaaaaataaagagagtttgaaaaagcaatgaatatataattcctagtactgtgttgcattgattttacttaaaggaaaaaaaaaagaaacttaagtaggattgacccaagtatccaaacatagtacattttttctacttatacttctatataaacagtttgatacagatttgcgatcaggttcttataaatctaaaattgatcaggtaattcaatttaatttaattataaaatagctaggtagacattttcataatagataattaaaaattcataaaagagtacataattgaattaaaaatggattagctatatttgagatgctgtgtcctatactcacaaaatttataaattggcaaaagtgtcattgttaaacgtactgtttttcttttatcaaaaaaccctgttgctgttcattggacagtttacttttatactttaaactgacattctatgaaaaaatatgaaatgataaactagtatgttaagcagagagaaaagtattaatttacttttgaattctgagacctataaacttgtagtatctattaactgcatgagatcttgaacaggaaatagaaaatattttactgtccctacaacaaatgattaagtgctaaatgggtaatggataatgggcagctaatggataacactaagaaaattcctcatgccaaggcaagaaagaacgactttaaatcatcaggaacatttgaagtatcaatatttatagaatttttacaggaacaattaagagagatatagagtgcaaaatgtgagtaaatgtattaactcagtgaatattataattagtgtaaaattttggtgtgcctggactggaggaaaacaattttgattaacatgaagaaaaattataattgtcaatggcggcccaatcttgtggaactttagatctaatgagaaagactatagatttcattctatctttgtaaaagaggaagaattaagatcttagaacagaaagcagtatgaccactgctgtactatggaaagaacattcttacaagaaagtgtagcatgaatggaccagaggcagtgaggtcaaggagggggtcaataatgtagaaataattacgatgccttttaatatatccttcattgaatcattcttcatctgcattgatatcacactatgtctctgattagacatagtgtgtctaatgagaatggctcattgtctgagctcccctattgattgtgatcttctctccggccaggacataatttatgtaattatgatttatgattatgtgccctagacctacctcaggtaaaggttaattaaatatgtaaaaccaagtgtgagtgaatatcaagatgtcagaagatagaaatcattaggatattagttatcagtgtaggataatgaatttcagtgctaattaggaattgcaggagaaaacaataacagacagattgaaaattaggagactacatggttccatcgatcttaaaagaacaaacacttgccttttatttattcaggacagccgggccatggccttgtgacctaagcatggtcatttgaataatccagcagaagactttatattttaatggaacactacaaaggcataaggtttgagaaattattaatagcaactacaatgtccacctgtgtccagctgttataaggggagtaatgacatccccagttaattttctcttgtcaaagttttgcctttatctgggtattcttgaaaaaaacagattcttcaggactcctcctgtgagcagtattctgtgagcaactgtttaccaagtcaggttcaacctaaccctgtctaatatagcatcataattgtcaaaggaagggctacagagagaggagaatttgaaattcaaactccggatatgttgacagcattaaagaggtgggaggaccagaaaagtagaaaagggaacaaagatgagtaagaaaagcataagggtggaaatttttattcacaaaagcaaagcagtatcaaaaattttgccttgcacattataaacgtgtaagactcttctgtcttataattatatttatgcaatttttctctattgtcataatttttttgttgaatttattttccacacaggtctatagaatttatagctcaactgtgacttccactgttgattttctactagtagttcagttacttgtaccttgaaaataaaatttgatagcaaatttgtgtaaactagtgattagtgagcataatgtattttgactgtacattttgtaataatataggcaaaatacactattttttacattttatatggattaagaataattttatgcttctcaattgattagtaaaatataaccttactttctgtaagaataagaaaatatcttgactaagcctacagatttatttgtaaaagtaagtaaaagggaaggttttaagtatcataatgattatgtatttaatttgtaaatatctatttaattttaagtaagttatttattttttcttattttttgctaaaaaaattgttatggacacctgtcattaaatgttagtactattaaaaccttatgatctcaatttttctattttagtcattttggtattttcaaatggaaatagaccctaatttatgtgattatcaagtggcaaaaagtttaaaagttgatattaatatattgatcaatttttattggtatgtacatgttgcatgagatacatatatatatttgtatatgtgtacctacaaatgtcattatgtttgtgacaaaatctttaggcaatgctgataatgttaattactaaatttccacttaatataattttttaaagaaattaatacatttttaaaatgaaggcataaaataatcctgttgttatttaaataaaaaaaaaccttaactctggctgtaactatgctttatggcaatacccaaatatcttgagaacagcaatattgaaagttttatatgctaataagaatgtaatttacatttatagccgaactttaagtaattcccatataattttattgtatattaactaggttttcccattcatatatgtgcattaaattccagcttttaaaagtcacctaagatgtaattaatttataataattacatcaaacattctgaatttatactttccatgttgctaaatgaatctctaaacattaaatcaagtattgaagatcaaagacaactcatggacacatagagggggaacaacacacactggaccttttttggagggtggaaggtgagaggagggagagaaccaggaaaaagtaactaacagataccaggcttaatacctgtaggatgaaataatctctacaaaaaacagctatgggggaacaacacacactggaccttttttggagagtggaaggtggaaggagggagaggaccaggaaaagtaactaatgggtaccaggcttaatacctggaggatgaaataatctctacaaaaaacagctatgacacaagtttacccgtgtaacaaatctgcacctgtacccctgaacttaaaataaaagttaaataaatttttcaaaataatattttttttaaatcacaaaattgattgagctgtctacctacaaacagaactgtgtaatgggtaaacaaataatgaatcatcttaaaattacatacttcacttgaagttgagtctgaagttgagtcagtcctagaatggcagacctccacagtcctaaacccttttctctgcacagttacagtcctagattctgttacagtagagcactgagggaaataaacatcttcacatttgtacttggttaaatggaattaaaatggtttcatagatgtttagtctaataaaatttgtttttttctatgaactatttaatttcattaattttatattttactttgatatcagatctagctccaaagtaatgtagaaaaacgtttttaatttaattgtagaaaaaatatagggttaaatatcaaaacttatttggaactctatacaaaacatattatataaatatatgtaattgcattatcaatttatgttgatggcaaagtcatgctttgttaaagatatctcttaatactagcacagcataaatatctgtgaaaagaatactctttcaggtttattggagaaacgttaaaaatattcactttttcatttataagattatatactgtcatatcttgaaagtcattaatttggagttatcctggtctaagtaatatagtacaagaatagtttttctgggtttagtaatgagcagatagggccaaataattatgaatagaacctcacaaattagatacccaaaataaggcacccagatttctagtgagtaccagaacaaagatgtctgtgttggcacagaggcagacagcttgagggatgtctaactgtacactgtaggataatttgccaggagagaattttgggaagattttggtaaataagcaataggcagtgggtagtaaagccatacctgtgggaagtaaaaatgtatggcaataactgggtagggtagaaaataaaaaatggtttggcagtaattgaaacttcagtaaccaaactacaagcatatcaatcagcacaattttccagttggtaaaaaagattaaaaacatcaagagttgttggagaacaagcggacaagagcctaggtagcagaacaagggcaaagtggagagctcagttaggaatgcttccttccatttatcttgccaagggaaaggatcttcatgttcatgtgaggcatgtgaaagcctctgattaattacttctcatattgaaacttaaagggctctcagaatagaaaataaaaaaattacttttactagtatactctagcacacatgttcttctaataatagaactgtacatgtacacattattggagcacctcaaaacttccccagaaaagtatctacaagccaactcatattaaatctttgtttctttttacgtggcaaacatgaaaataacttacttggcaaagcacatttagccctttgctcttttccagctgatgttgcctatgtttcattcaggtgtcctccaaaggttacttgccttttctttgtaatctagccatttcattaacagaagcaaagatgcaaaagtgccctacaaggctggcctcatttcaaacgtttacatgctatttacaatctcccatatgtgctggaaagctgatgtttaacagcttaaaaacattatccaaatttttgatgctgtcagtgtaacaaagtgacaaattcctaaagaaattattaaacctctctctcattctctatgcagtctaagaaatagacccaattgattttggatgtaaaaaacaaaaacaaaacataacaccttacctgctaataaaaccttcagactagttcagactccttctgtacccttttatcctatggctggtctccgtcatgtaatctagcccgggctggatcttagtggatgctgctcatgacattttctgctttctcatgcatactctgagtctatgtctgatttcataccgtaagttgaaatgtatggtatgtatatgtactgctgaagaactctcttgtaagctaagtttccccctttaccatataattataaacaaagtatattttatccttaaaaatagtctttagttgataatcacatttaaatgtgacctaaagtcgctattgacccgacgggaatgatatggtttggctgcgtccccaccgaaatctcatcttgaattgtagctcccataatctccgtgtgtcatgggaggaaagaagtagagataattgaatcatgtgagcagtttcccccatcctgttcttgtgatagtaaactctaatgagctctgacgggtttataaggggccccccccttctcagggaactcattcttcgccttgctgctgccatgtgaagaaagacgtgtttgcttccctttttgccataattgtaagtttcctgaggcctccccaggcatgctgaactgtgaatcaattaaacctctttcctttataaatcacccagtctccagtatgtcttttttagcagtgtgagaacggactactacagggaataagaacaaattttactgtggagaaaataaaaccagaagcagctagagaactgaagcacatgtactttagttattaaatcctgaatgcagagcctccaggaaggttgctgtggaagaggctatgatactgggtaggtgtttgagtgagcaatagtagtagtaggacaaggctaaggaaaatgctctcatcctccaggagatgagaaagagtggctcacctttagaagagtagaaaagaccaggagaacggcacctgcgagggattatgagtggccaacatccatcaataaaatgctttgacatgagtggtgctgggagtttcttgaggaaaaaaaggacaggggactttagattgttttgtgtaagtcgttgtaagtctttgatatagagatttgcctgctcctaatttgaggatacacaaaacacgcagaagcataaatgttgaatgaagaggagaaaacacattttcctcggtaaagagataaagaggaaagaaatcctagtgggcttttaaatgcctttatgtgtacctgtgactttgtgtacctcacttttagctgagatgcctcaaaatagctgtcaattatctttaaaaaacagaggaaggcactcaatgacttttgaaggctttggaaaaacggtggctataaacaagttttgtgccccttgtccacccaccaattggaggatgtgaaaaggttaacatcagagagaccacaggagtttgaaacttgaagaatatctttagagagtattgtctgtgttctgtgagtaccttaaactatggaagagggatagtgttccatccccatagcaaaccaaactggggaggaagggatgtcaaaaaaccattcactgtgtttcctgtatctgttggaatttttataaaagggtggataaatgtctaactcacatctagaaatataaagggtaagaaacagtgactgaaactactaccatatgcaaaatgaaaagagggttgaatttagcaagaaaccgtacttctaccagaagcatggtccaacattatgtgattcttctggacccaataggaaactctaaaacagagagaaaggaggagaaacaggtttgtgctgtcctagatcctggctaagaggttcactggttcacttgcagggttaatgagaccctatcaaagagtttctgtaaacttctgtgtggaggttgtcagctggctagggtgttctcaacccattttgagaactgctggtgagactcactaatggaggagggaatgttccttaagaaaccacaaaaatgctcctatgagtcagctttgtctcatcacaaatgagtcagaaacacactttagagttatgtctgtaaagtaagactttttttctgtcatattaattgtttttctactattaccaactatagaagggccagagatcaggtaacactaggtaaacaaaaataaaataatccagccaagcattttttcccattatagacttcttctctgtagggggcctgagctacagaagggggaacttgattttgagtggggtttgcattttgattataatattgagttgtatataaatattaatgaattaatactgtagaggataaatttacttcagaacatttttatgacttgagaatgacaaaaaaaaattctgtttcattctagtgggtgagagactggatatgcacattgagtcaggagaaaagatttagtacaacattttaaaatttttttccctgaaatttttacttgtccagtgaaccacttagctttgctacggggtactgtaaacttcatagcacatacaaaattatttacttcaatatcatttcttggaacttaaaactctcagaactctggtgtatcagttaggatttgatcaggaaaagagaagccacgaggtaagaaagagtccaatcccagaaattatgggtattaaaagaaaaactttaacaaattaacttagccaagttatttgagcagagatacaattcatgaatcagaaagttccctaaaccattaaaggatcagagaccctcatccagcaatgcggacaggcaatatttattgacagaaaacgaagtgacatacaggaatagcctgattagttacagctcaacatttgccttatctgaacatgtctgagtagttttcagcctgtgactgacttaaagctaagttgctatggttggcctagactttgttacttgttacaagaatacactctcaagttgcagtttgcttacatattaggttaggttacagtttgctatgtacagaggcagatttaagccaaatttaatttagtttatcagaaaaattgaatgtcatggaagtgatggagaagtgaaagtcaggtatctcagctgcatctggtgggtttcaaaagcttgcccagaagtcactgggaattttttgactcatgaggggctaccacagattatttcagtctgcaacaccaacagaagtaattcttaagaagcaccatcttgctatctcagctacttagagtactaaagtggatgattcaaggagcttgcccatagatatgcttgaagctgcaagaattacggctgctccttctattctgccttccaaactgcacaagtgcctcattgacagactctaacacagaactacaaagggcagaaaactcaaagaaaggttcttcttgaaaagggtgacaatgattccaagttcccaaccaataatgcagcacatctaatttggcacttcttattttgtcccttttcccttatgactttttttgtagtaacatattttactattttactgctattatgttgctcttgaagtcaggagtcatagtgattcaatcacttgttcacttatccatgcagcatataatgagagctttgactatttttcagtctctcaggctctgagcacaaggagtgataagatgcaactacccagaagtatagtcgtatcattcacacttatttgcaatgagaaacagtcaagtgtttactgagagtccatgaatgaataaacatataaatacacatttttcatatgtggacagtaagcagtcctttatctctaggacaacagaatgttgtatctaaaggaagactttaagaagatatttgaagacgaggtgctgccattgatgtgttaaatgtacaaactaaaaaattgggaacataaattgaagtatgcggtgcttttcttgtgctacacaaaaacgagtgttcaatttcagttggtaatgcttattatatgaagttttgaaacatagtttcattttatgtattttttagggcagatatcaccatatatcacacatagaagcatatatgaaacatgcttatcactcagggaattatgaattgaataagccataccaagttcttaccacctctaactagtgttagaatgtagaaaagaacataaactgagacttaaaggggcagtggagtggggtgggaagaaattctcaaagtccaacctgcatccagagtaagtaagtttgttagatgaagggaatcctaggtggtgttcgaagacaaattgaatgtatctgtatggtcttttgtgaaaccagtttgataaacaatttcctgataatcccaaggcctcctgaaatctctcaagcatatgaaattggggaatccgggggcaagactgagcaggaggtgtatggcccccagtaatagctctcatctacattatgtagctctgactgactctgagctgaattactgttttcttcacatattcaggtctttttgttttcaaatatactcgatcgctgaaggttaaaaatgtaaagcacaatttgtaaataaaacagatgtcaaaggaaagtacaaaatatcattaagtgtatctgaatgccaagttctccaggtgacagcaatgtgaagtgcacagttaaagatgaaaagaaaatagctcagttatttgggtgatcaaaagaatatctggatgattaattacatatttgaaacttgaagacatttcttttgtttcattttcttttgtcttttcaaaagaaaaaaatgtcaagggttgatatgtcattttagttaaggtttatgagctgttttttttttccccctacaggtgaaatcattaacagttttagcatttaaacagagctatttgagcttacaactaaatcctcttggcatgaaagctcttgttttgctactcatggttttagtcttcctagaagctgattgattaaaaccaatgtgctcagagaattcaaaataagaaagaatacaagtaagaataacttttgacaatgtaggctaagtcagccagtttgtttcatttatgtcgcctttcttcttcacactttttacctgattaaatcccattttcactttgtgtttatttgtttcaatttgattagagtttctgaaatgaatacttagattcaaataactatccataaagccatgtgactgtaggattttaattcatatattagtactcgcatacacaattattaacaaatcaggaaatttctacatttcccttgaagcaagatactgtatatttagtaaaattccttgataaatacttggaatggaagacacaacacccatgtggtaaaagttttctggttccaaggttttagcaaggaggacataaactattctgtgtaaaaagaggaggatgaaaatttgtttgcttcttgagagaggaatgggtgtgataaaagataataaagaaagaaaggactcaggaaaatgaagagatgatttgaataggccaagtggaactccctgaatgatgaatatccaaaattcagatttagaatggtggtaagattcttctacttgatatttgtcatgttcaatcaaagcacttcctccttcctccctcccatctgaaatctttagaaaaaccatccatttaaaaagtttagccaaaatactgaaattgaaattttatctatataaataagagattttgatgattgaataattgtttggttatttctccttttagtatttataacttctgattttccagtctatggttttacattttgtatttttgtactttttacttatcatccaggaaacatgctgaaataaatatggagctaaagatcacacatattaacagcttaactctctgagatatcaccataaccaatgctaataacttatcttctttcaatttgtagataagaaatacatgcttttgtccatatacacacagaacaaatattctttgatatatagatatatttttttgccatgatgatcttaatttttacatataaaatgtttgtaaaataattccacatgtttgaactcagctataaatttaaaatccattcaaagttaaaaactttaagataaaaattaaaatgtcttataaatttgtttaaattccttatagatgctggatatgataactttgacaggggcatagtttgcaaatattttctttctgtaggttgtctatttcctctgtagatagtttcttttgctgtgcgtaagctcttaagtttaattagatcccatttgtcaatttttgcatttgttgcaattgcacttggcatctttgtcatgaaatctttgtctgttcctatgtccagaatagtattgcctaggttgtcttctagggtttttatagttttgggttttccatttaagttttactccatcttgtgttgatttttgtgtatggtaaggggtctagtttcaatcttctgcatatggctagccagttatcccatcaccatttattgtatagggagtcctttcctcattgcttgcttttgtcaactttgccaaagatcagatggttgcaagtgtgtggccttatttttgggctctctattctgttccattggtctatgggtctattatggtaccaccacttaaaagtgggcaaaacacataaacagacacttttcaaaagaagacatacacatggccaacaagcatatgaagaaaaactcaatacccccaattattagagaagtgcatatcaaaaccactatgagatatcgtctcacagcagtcagaatgctattaataaaaagtcaaaaaacaacagatgctggtgaggttgtgaagtaaagggaaactcatatactgttggtgggagtgtaaattagttcaactattgtggaaagcagtatggcaattcctcaaagagctaaaagcagaaccactattggatccagaaatttcattgctgggtatatacccaaaggaatctaaatcattccaccatgagggcacatgcacacaaatgttcattgcagcactattcacaagagcaagacatgaaatcaacctaaatgcccatcaatgacagaccggataaagaatacatggtacatatacacaatggaataccattcagccattaaaaagaatgaaatcatgtctttgtgggaacatggatggtgctggaggccattatccttagcaaactaacgcagggacagaaaaccaaataccacatgttctcacttataaatgggagctgaataatgagaactgatagacacaaaaggggggcaatagacactggggactacttgagggtggagggtgggaggaaggagaggatcagaaaaaataatacttggtactgggcttagtacctgggtgatgaaataatctgcatagcaatcccctgtgatatgagtttacctatacaacaaacctgcaagtatactcctgaacctaaattaaaagcttaaaaataaaaataaaaataaaaaacagtgacaacaccaaagactgatgaggatgcagggaaattaaatcagtcatacacttctggtaggcatgtaaacaggtacagtcactctgtaaaacagtttgccaatttcttaaaaaactaaccatgcaactaccatatgatccagaaattgtactcctgggcattcaaacccagagaaatgaaaatttgtgttcacacaaccacctgtacacaatctttatggtagttttatttgtaatagcaaaaaaatactggaaaaaaaacctctaatatcatctgtagactattactcaacaaataaatggaacaaactattaatagaagtgataacctagataaatattcagaaaattatgctaagtgaaaaaagcaaatcctaaaaggttacatattgtataattccatttatatactgtttttgaaattataaaattatagaaatcgagaacagaatagtgattgccagggtttaaggagagagctaggggtgggaggaaaatgattgtgactatgaaaggtcaacaggagggatcctcgtggtgataggaatgttttctttattagctttatcaatgtcaatatactggctgacattctactatagtactgcataacattaccacctggggaaattggttaaagactatgttgaatctctgtatcatctcttacaattgtgtgtgaatcacaattatctcaaagtaaaaaagtttaatttaaaacaatattttaaaattaaatagacctaatttattcatttaaaaaaattatatattttttccagacttaaaatatagattatgaccaaattgttacatattgaccatttaacataggttgtaccatctctgttacattattatgtatgtatacaatatgactacatttcaatagtttttaaattttgttttctgaatttcatcacttctgaaattttaccacactgcctgatcatctttggaaatagggaaaaagagaaagtagattaggagtgagatgtgaaggcaatggatattattgacatttctattcttctgtttaggtttctaaatcaattgaaggaattaaatgacatataatcaagtatttaatggcctgagacttggaggcatgtttcccaaaatccagacttatgtgccactatttattagtaaagattcttcttaaagcaaggctaatactgagttgcataattgtgttgacttacgtactgttaaattctaagtgatccaacaggttatatttcagactaccatctatacaaaacagagcacagagagcagattccatactgtggatcatagttttagaatatttagtaatcctttgagtaaagaaaaaaaattcttaaaacatttctttctggtgacattttgaagccttttgcaggagataaatagaaatatctagattaaaaggaaataactacaacaagttcaaagctaaatatagagatttactgaatatttccacagtcaacaaatgttttcacatttgaaacagaaacatatttaatgagagctcctgggcttaatatatggccaaagttctattgcctgttttaaataacaaccaaaacaggaatagaaaaatggaaatgagtaaagcaaaatggaagttgatatgccaggcctaagggccttcttctgttcctttatattcaatgcttttaataaaaagagaaaatgcctgcatgtcaacttttgcaaataaaaatatatgggtttttagcagtcctaccagtaggatttcagaggcattcttatttctctgaccatatacattctgaaacactttattgttcacacgactatccttgatatcttgatatcttaggtaaacaagctgtttttctttctctaaaacaaagcaatgtttttgaactatgggtacaattcaatgaaatatgaccgaaataaatgcttagggtaaattaagaaagaaacttttgtttattattttaatatttcctacatacaaaaataacatatagtaagcacatcttattttatatatgatatttaataaggaaccataaataaaaaataaaatttaaaggaaacccaaagtatatgttttttgttatacaacattttacctatagctccaatagaaaatatagaaatttttgaaaattttaaatgtaaagacaagggaaaaagagaaatcacaggagagtaccaatttacttaaaagttatcatttagagaaaaacattccgtttgcttaaaaattgagaattatttcatttggagcatcattacacaagacagacttctatatataagtatatcacatatatatggatgtaagtatacatagactcacagaaccactgtcccaggttctgtagaaaattaggtcatatggtgaaatatgaattcaattacaacatgtcagcaatttgaatgactctaagaaataatctggaatacatttttccaaagtttgaaaattgattgcggtatatttcatgttcctccaggttttcacttttaccactctctttcatgcattgacaggtattcttgttttattcctcccagaatctcctcccctatatcatttatctaccagggacttctcagtcctcttttcacttccgcatcactgcatgttcctttatctccttttctgttacaatctcttattacatagtctcctttatggctctcaattccagggttcttctattcttttttctccctcatgaccttacccacttctttagagccagtagcctagtagggggctctgtccagatgttccacgtggattcaaattcatatggtaacatttaaccattatttctctcctggaatgtgttttgctttgaatcttttatcttaatttatgtcaaacattgaactagtcattcatgtcaaaaatcttatttttctattcccattacttatttagtaccaagtgctttcactttgaacactgtcttaaaaatgtctcctcccaccaatctcagccaccttaatcagccctcagcaactctaattactcctgggtaatttaatgaggaaatagctgctaccagccactttttattttgtcttcttcagtccatttgtgtattgccactctacagagccttctagaataacagtctggtcatgttacagatttggtgaaaatcttacaacgctgctttatcaaatctgttctattgaaaaattgttctatcatcaaaaagatatggaaatttgtgttaaacaataaataattttcttatattacaatgtttctaagaaatggaatatgttttctctttcctagagcaagacatacaatggtatacagagttttttgaatctattagatcctaaaacggtttatatgtatcctcccataaaacactacacagaaccagtgttccctagggcacattttggaaaacttaggtcaggattaaatctgacatgctttgtatgtacaaagaaggctctgaacaaagtaatccatgcctaactctttgtgtcctactcatgtacatcattcaatggcctggcctcaacaaactttgtagttctccaagtatgccacaactctctttttcttctttggttaaaatgcttgacttcctattagcagtctgttgaatgtctgtgtattatgatataccaattcatacacaatcttcattcttgatcatatcttgatatattcctccctctagtgaaagtggtcattatcccatttgtaccattctcccagacttaattgtgaagatgagaacgagattaatcatctttttcatccatatactctagtggagtcccaagaacattgacattaaataaatgctttttcattaagtaaatgactgaagtctagttcaacatttaatggacatctcttatgtgtcaccaactataagaattgaatgatgcttttcttatgagtataattatagtacatattttatgagattgttttggtaattaaaatgaatgactgtaaaacatttagaacactgcttgatcagtgctatatgagtttttgttaaaataaaatttaagaaaaggaatactagagctcagctgtcaagtagcttataaatctaaagcagaaaataagtttgcagacttgctgattgtgccaagcagaacacgttaaaataaagttttgaaatgtatgaaatgaagatggagaaataaattccagcagaaagaattgagatggaaactcagaatccaatgttagtgaagaaaaagattctgtaagtagaaagccagcttcagagtggctggtcacttgaaatttgtgcatgggtatttctcctattgatgaggagaagcaagaagtattcaaccttaattgtcccagtcattttcatatgcagtccatgtttaatgttgaactaaattctagtatttattttacttaagtcatatgtaaaacagtctttttagtatagtgatttttagtaaagtggctgcttcagtataattatctaacactgataagtaaaataagtaaacaattatttttttaaactttaaccaaatgcttgtttcagacacttagataataatttaaaagtactaaaatatctagaattttcattaaatatttaatgaacaagagacttagtaagtgaaaagagtagatgttaatataacttaagtctaataaaatatctttatttctctattcctctttctagacagatactcttacatgtttatatctgcaggacatgtgttcctagagttatgaaatatattaaaattttgtttggtgataaatattttccagaaataataaaattagaaaataaacatatatgcaataattttaccaattttacaattataggattgatttaataacttggagatttataacatgatattactgtgaggttttctttatttttctaagttaaaaagcatcacttgatataaaaatattaactaatgacttcgtttttgtgtttggctgttttttacccttctagtgacaagctactagggatataacaactctttattgttaagcttctaataatcttgaaaaacatctcctggctagggaggaaggaatctaaaaatgtctcattaaaataatcatttggtaacttttttttaaattttcttcaaaatcaagcagaattacagcacacagactccaaaagctaaacgtgagtacatcctttccagatctaattaatccacaatttgtcacaagaaatttattctacttatattcattttctgaacaatctccgccactttcgggttcttctgacaccccacctctaacctttgatatgccggtaaaattggagagattgccacactattttgtgattaagggcaatttcaaaagaaattgagttctcatgctatagagcaagaacttacctaaagtagtcaagaaacaagagaaaccagaaattgttttacatgagacagatctcatatttttaaatatagtgtaccactttcttaataagtaaaattaaaagaaaaatgtaacttaggatacagaaagtcctaaaggaccattactccctcctaagaataacaacaaaatataaaagttaccagctcaaagaattagctaatggttgcttttatccctagcagagaaacaggagaggattttgtagtacgcctgggatatattgtgttatgtattaataaaattgatgaaaaattgagttttgttttttgttttttttttttgagatggagtctcgctctgttgcccacctggagtgcagtggcgtgatctcggctcactgcaagctccgcctcccggattcacgccattctcctgcctcagcctcccgaatatctgggactgcaagtgcccgccaccacgcctggtttattttattttattttattttattttattttattttattttattttattttttgtatttttagtagagacagggtttcaccgtgttagccaggatggtcttgatctcctgatctcgtgatccacccgcctcagcctcccaaagtactgggattacaggcgtgagccaccacgtctggccaataaaattaaattttaaactaacaattaaaattttaatacattcagaaatattcatgcagggactgtggtggattacaatatcaaggcacccttgctatggtgtaagtctacccattcgaaactctttcccatgggccttcattgagcacactgaaagtatagagtctgggagtcacaccagtgggttgaaaaaaattctttcaagtcctctgggcctttattgcatccattgctgcagtctcaaataggtggacataaagcatgagaggtaagacaattctaccaggcaaccagggtttttatgcaattgtctccagcagctgtccaaagtctagaaacaggcttcaggacaggcaaatatctcttgaggttcagaaagtctggcaggactagacagcaataaaattttccagtaacccacaaagtcatcacccaggctacaaagcagagaatgatgttctagagtttggaaagttgacagctatctgcaaaatatttaaaaaattgggattttaatcttgctcagatcccaagtcttgctgaagacgtcataatctcattctcaaaatacttgaaagctgtgatcaattaactcgaaaccaaactgagaaccagtctacctgcagattaggttaaatcaggctccctcagtttggcaaactaggaaaattacaggaaacatttaaaatattctaggccgggcgcggtggctcacgcctgtaatcccagcactttgggaggcggaggcgagcggatcacgaggtcaggagatcgagaccatcctggctaacatggtgaaaccccgtctctactaaaaatacaaaaaattagctgggcgtggtggcaggcgcccgtagtcccagctactcgggaggctgaggcaggagaaaggcgtgaacccgggaggtggagtttgcagtgagctgagattgcgccactgcattccagcctgggtgacggagtgagactccgtctcaaaaataaataaataaattaaattaaattaaatattctgaggagaaaattttatttactacaatgtttgtgattctttcccacacaacgttcaacatataataaaaaattatgagtctcttgaaggtacaataaaatatgacccatggtctaaagaagaaacagtcagttggagcaaccccctattttggattcagttgctggaatcatcttatagggattcttaaataactgtgagtactatgctaaaagatctaaagaaaaaaaggggacaatatgtgcaaagacaaggtatgtcaacagagattgaaactataaaattaattctgatagacaagctagaaacttaaaacaattcatattagaaatgaagaatgtatttgaagggttcaaagattaaaagccatggagaagataagtgaatctgaaggctttccatagtaatcgtctaaatcaacataaagagaaaacttatttaaaaagatcagagcatatgatgcctgtagaataatgacaaatagcttctcacacataattagagctagagatggagaagtaaaaaagagtggaacaaaagaactacttgaagaagtatgtagtaatcattttctaaaattgatgaaaagcataaatctatagttctgagaagccagcaaactacaaacaagataaagtcaaagaatcaattatctatgtacattaaaattaaactgcttagaagcaaagaaaaccagaaaaaataaaagcagcagggttgatatatcacatcatgacatcaatgataagaatgacaattgacttaagaaacactggggctaggagacactggaacgaaatctttaaaatgctggaaaaactctgttaaggattctttacctgtatctatgtttttcaaaaagaaagaagaaataacacttttaggcaaaataaaagctgagataatttgtcttcggcatatttataatataaaaattactaaaaatacttgtttaagctaatgtaaaattatatcagacaaaaatccagaactccagaaaaaactaagaacccaaaaaagtaaatatatcattaaacataaaggacatttttcataacacatatatacacaaacataactacatatgcacatgcatatgcatatgtatttaacataattttaaagatggttgattggttaaagcaaacataacaatgtattatagggtttatatcacatgcagaagtaaaatatgtgacaagaggacatagagagataagaatatacaaaactaatctatggtattagaaatcataaagttgttggggcaggggtgggttaattagaaaagtggacaagagaacttttgctataatgggaatattttctattttgctttttgtgtaaatgggcatataaaattgtcaaaaatcatcaaacctaaacccttagatctctacatttagagatctaaatttagatctctaaattataaaaataatattaaaaataaaaattgaatgcatacgaatttagcatgatgaccatatttattttcttctttcttgttttggtttcaaggcatttaaattagctactaaactttttttttaatttgaatttttacttttcttggttttctttaccaaattttctaaaatgagtctgtgttatcagagaacataaatataaatctgttctatgtgaaacgaacaaatgaataaaataatagcattgcctcagcaggaagaaatcttgtttctcaataagatctttcagtttacattaatcattcaataaataagccaaagtaagccaaaaatcttagatttcatttttttctgtatttttctttttcccttttgctttcattctgcttctctgatgattatgtactttcttgtcattgctcttctttcctctttctcttttcatttgacttctaatctttggcctgaaaatacttttttcatctggttttatcaactaatactaaaatttggctgttccaattaattattttgcaactttgttagccctaattctgaaacaacaacattttctctcaatacattgcttaattcaacacattctgaggaatttaacaccatctttttttttttttccaatggacaatcatcagggaattagccaataatgagctagtgatattggcaaactgacatacagtatgactgttcaggcctttgcagacatccaatttgcacacaaaggtgcatgcacacacacatacatacacatacacataacacctatatttttctcaatgaatctcctttttgggtgtatctactaaacttcctctttggtcttgcctgtccttgttcattgtcttagtttgagatgcagctcattctacttagttttatgcttgcatctgacctactgattatcttgccttcccaacctttatgtgagttggcatttttagtctccctttctttgcactctaaactcaccaactcccaaattctctgggaatgttctttgaccgatattgaacaaaaattctttttaagtctgagaataagaattttttaaatctgactttaaggccttagaatactactgtttctcttaccttctgattaatatactcctgaaataattatgaaatcataaatgaacaaatctcattatgtcaaaccaggcattaagtaactcaagttgaagaacagaataacatgtatttaggatactaagttgtcataccaaaattaccttgggtctacaatcacaaaattaaaatcagccaggcacagtggctcacgcctataatcacagcagtttgggaggctgaagcaggaggactgcttgagcccaggagtttgagaccatcttgggcaacatagtgagactttgtttctaccaaaaaaaaaaaaaaaatcagccagtgtggtggtgtgtgcctgtactcccagctacttgggaggctgaggtaggaggaatgttgagcctgggaggtcgaggctgcagtgagccatgattgtgcccgctgctcttcagcttgggcaacagagccagaccctgtctcaaaataaaaaaaaaagaaaaaaattcaattaaattcattaaaacattgacggattaaaatgatttttctgtagcttttaagggagtatgctatcttaagtagttaaccatttttttgtcattttaacttatttaaatgtcaatattaagttcaagaacattgatataaaatatcatcttaaccttagattaagacttgcattattatattaatcattttacaacttacttctttaaggcttagttttatttttaattcattgttttattagactctgatgagaatatgaatttttaaaaagtttgttttctaataccatatatcaactatatgttattaaacataattttagcatctatttttatataaatatgtcaaaaatcacatgaaaaagcaaattatagtgtgtattttcattcatatctttttgataaaaaaactatattaactaatgataaataatttattattctgtatgaataaacttcttttatctgaagtcctcttacctgcttcgggaaaacaaatgtaagggaaaaaacaagtaaaacaaatggaacaaaaggggaaaataaaaaagatcttcctaataaactatgtaacagagatcattcaccttaactgtcagcaggaattccagaataagtcatttattcagtgatggtaacttcacaacattatgacgacaattacaggtactctctattacatggtttaacattgaacctcaacttgagttgagtcagtgcactggagtagcaaaataaataactgtgacattttgaaatgtctgcatatcaccaatatatgcattgatttttcattttaaaagtctaccctttttccaaattaatctttatattttctccccaaaatttgggtaatgcatagggctacatcctacttgcttgaaaagtgaatggaaccattcatatagttataagaatctctacaaatagaaaagaaaatttagtaaaagagagataaatagcatttaccatttggcttataatgtaaatatcatgcaatgtccttagttgaagacctgtacttattaacaaaatatatatatataaaattatatttatttctttacatacataaaaatatctattttttaaataagtataaatctttagccaatcagattatatgatttttaatttaatagaccactttgtccaagaatcttttttccctcaattaatatacatttgtttatgtattagagctaaatttatgtgtctctttgtaaaatttatttattttgttttttttttattatactttaagttttagggtacatgtgcacaatgtgcaggttagttacatatgtatacatgtgccatgctggtgcgctgcacccactaactcgtcatctagcattaggtataactcccaatgctatccctcccccctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctaccattgttggacatttgggttggttccaagtcttgtaaaatttattttgttgaacacatggataaatcaatacattctgactttttaaaaagtccattttgttgattcctatttctttgacagtaaaacatatatttttattcatatggcttttctctcaaaatttatcgccctaatatttaactttgccttctatagctgctcaaagttacttattagacttccacttaacacataatctctcttgtagagtacacttaagtattttttagagacttcatgatgagtacttggttgtccctaagtttttctgacaattttgttattttaactttcatttcttgttcttaaccctcttaaatgaaacttcctatttgtgatagacttattcttttgttcttgactttccattgcaaccacctctggggtaatatttttaaaagaatgtttagaaatcaaataggagtttagctaactatgaatgagaacatattttcattacatgtttgaggaatagattttttactgggtaagagatctcaggcacaattctggctaactaaaatattggctttagctacataaggtaagacatttaataagtgtcaggtctataccatagatgtcatgattaaacaagctactaagtgtatagctaggatgcattaaaaaattgttcgggaaatttttggcagaagaatattatccagaatcagatttatgaggatgcagtaaaagattaagattttggctggtgctcatggtaatacggtctaagggaaccaaggttttatttaagcttgaggtatgttgatgtactacctaatggttatcaaatttttgtttccaggaataaatgatttagacaaattagttcataattcattaggagaaaaatatattgcttaaaatctattgataactaaagttgaataacttttaataactttgatttctgaattgatcattggtattttctttctggagccagaaataggcaaattctataattggtaaggtatgcatatttagtcttttataaagatggctttcaaggttattcaaaaccatatagtgtttttgcttttcataatatctatgcccttaaatcattttctgtatgcttatttgagattgttccttctattaggtcaagattttataaatttcaaggactattatcctgctatagtacagaatacatttgaaaggccagtggtgatagtgttttccacccagataacaatactaataaattatttactaagtgcacttattgtgtccaaggactgcaataaatgctcagcatgcatctcctttaactatcataaaaaaatctataatgggttttaattatgaccacattacagatctttttaaatgaggcttagacaacttaaattcccattatcaaatggctagtaagcgtagaactaggattataaaacagatccatttgaactcaaaatccatgttctttctactccaccaggaataacatatctagtaattgcgctgctaaccttttatgatgctcatccccgctgagcccagatgtgctctaaattagtgctcttatgttcaaatcaatcacccgagaatcttgttaaaacacagactgtcatataaatgtggaatcatacagtaattgtcttttgtgactggcttatttcacttagcataatgacctcaagttctgtgcatgttgcagttgttgtttaatgggtacagattttcacttttgcaagatgaagaagttttggagagtggctgcatgacaatgtgaatatacttaacactacagaacttcacacttaaaaattaagttagtaaattttgtgttatatgtattttaccacaggttttaaaagtagactcttagtggggtacagaggctcctgtctgtaatatgagtattttgggaggcccaggtaggaggatcgcttgagaacaggagtttatgccagcctgggaaacctagcaataccctgtctctagaaaaataaaaataaaataaaataatcatctgggtgtggcagtgcacatctgtaggcctagttactcgggaggctgaggtgggaggatagcctgagcccgggagattgaggctgcagagatgattataccactgcactccagcttgggcaactgagtgagaccctgtcttaaagaagccagaaaaacaaaacaaaaaatggaatcttatttgctgggtctgggatgagcccaaggtgatgctgatgccactggttcataagcaccctctgccatgcaagggtatagatatttttctccagggtgacctctaagaaaccactgccatttgatttgaattggcatgtaagatattaataaaacatattgagtttttgctatctactatactttctttccaactaacatgcatgtcctcattcacactagtaggacaggtgagcaaaaagtgcccattgcttctgatgcccttcaatttcctagacagttcagattctaagaatgtctttggccttggaagcatttttgtcttaaacttctgaaataattgtgtcctgaaataccttttgtgatatttgttgaaaagtttcctcctactctgagagctgagaagagaggaaccatttccaagctgctgctacatatcaaagagcctgtcttttcagcttcactgacaagtggaatgattttccggagtctgagaaaatatcaggcaaaatcttttccagataaaaaagctgctgtcagctgcctgcagctgaggaagcaactttaaatcctgtggggagaatttctattgcaacctcaatcccagattccagcttctgtcttacatccttttttggcttgactctgctcaaggagctcaccaaactaaggaaaagaaagttagcaggacctacgggtctcaccttcacactgccaatctcaaagttttctcttgaggaaaccatggtaacagacgcctgttcagagaagcaatgtaaggtgattatttacacataacctattgtgctttgtagccccaccctcacatgataaagccaatagaaattgatgctgaggtccaagtacagatttttttttttttttttttttttttgagatggagtctaggtctgtcacccaggctggagtgcagtgacacaatctcggctcactgcaacctctgcttcccaggttcaagcaattcaccagcctcagcctcctgagtagctgggatcacaggcatgcaccgccacacccaggtaattttttgtatttttagcagatacggggttttgccatgttggccaggctggtctcgaactccttacctcaggtgacccacacgcctcggcctcccaaagtgctgggattacaggcatgagccatcatgcccagcctacaggttcttctaatacctaattgaagtgtcctgacatgacaattttatattacatggcaatgtgctatggcaataatatcttctgatttgggaagtgaatatgatacaaagagaattaacaggaaagcagagaatcaagagatgccttctactatgaaaattattcccagagctgcactgaccttgaaactcacctgttgctccacggcggctgagttaatttttctttactttcccatgtgtcttcccaatatatttgcattcattggaataatcctgagttctcttgatttcttgcaaattgaaaatgcctaaacacagaattagttttgcccattgatcaagccttaataaatcttacagattctggccttgaccaaggctatgatctccactccatcagtgactggcctgagctggctctggaggggtccggccaggcctcttactaagttatctttatagttttcatggcacctgtactcaggggcagctctgttttgtatttagaaatacctcattttcaagaaagatatctgttttcattattcctattatagtcccagcagcctttaaaaaaatgtgcttagccagtcaaaatgataatcttgagatttttctaactttacctttttctcctacttatttgcttagagaaaagagtggtcatctacctctccaaactgtatgccaccactactgtgctcttaactaatatttctgatttgtcagttaggaattccttcctctctgtttcatttttttttcagaagcctccaacataccatgttttctattctttcttcacgtattactaaagtatattttcccttcccttccatatttgctattctttcaactttgccattcaccttcctaatccactgatatttcaggaaaggttctttttccatttctgctatttattaccatgtggcttacttcatcctactgagacatcatttctacatttgtaaatggggattaaaaatgcctgcatttcctactttgcaaggatttgtgagaatgaaagatggtaatacaatggaagtgttttgtagttataaagttttacatattatctagagaactatcttgctttcattttatacggtcagaaacaagatattaaataaggaagtgctctcagaaagaaagacctttgcatttaaaaatgtggttcatcatttatatttatttagtcacacaccattttaaaaagtgtcattacttttttatctgtatgatatatattatttttggacctgaactcacagtttgttaaaatgcaaagataaatagaaatcagaaagctctgaatattagttgtcaaaaataataaaatagttcacctctgaattttgatgagcaaatcaacaagttcagttttccatcaagaaagaaaaatagctgtctcattcaaatacattttttaatttatattatattaatattgctgtcacagtgaccattatgacttcaagtaatctatgtaaacatcatctaacaaaatgtacctgagaactgtgtttcatgcttaccaatttattattctgcctatttggaagttctattattactagcatacatagtttatatacttcttcccttagggaggaaaaacctctcaattatactgtttattagctaagacaagaactctagcatttacctgaatataaagcttttggatagaggagacatatagtttagtgggaattttgggcacctaagatttattgccagatattcttgttaacttatttggtctacagtgattgtgaaagtaggtttttgagccttgtcccctttgtcattccaaaactgagattaaagcaatgctcaattttacatttaagatgaataaagtatgattataaaataacacatataaaatgaccaaaaattaataattaattgtctgatgtggaccattcaagcacatcagacacctaacaattaggatagatgagcatctttcatgaaaggaaagttagcatctatatttttaaggaggcatatgataataaggactacagagcaattactttgagagtgcttctactgtcacattttagaagaggttctaatgcaagatttctgtttcatttcttatttttaattttaccaagaaactcttgaatttgcaattgtataccacaaataaatgcattaggtacaagtgcctcaatgtcctaggaaattgatgtcttagttcaaaaggaaatgctgttacagctttataattgagtcatataatttccatggttgagtagatgttggctttcaccggtccttgtcctttaaagtccaccacctgacacatcaccacaaagaacaggtaatttattattttttattgccattaatttatagctttaagtttcaaaggagaattataagttaccacaatatctggagctttttaagttttgtattcccctttgactgcttaggataatctaaatcaccagagattagaaaagaatcatgaaataatgttcaaattacggaaaaacagactttaaaaaacagtattaaaatggaggtaaattatcttagtggattatttatttctgacagatttgcctatattgtagttaaagaaattggcttttttccttgatttataatgattttatttatagaaaaaatataatgggacaaattttctttggatctaaaatttttcttaaaattcaaaattcaaatgatagttgtggtattataaatttggattctattttatttaaaatgttgccacctctgaaaatggcttaaaggctctatcacaaaatgtttgctagtaaaattaatacaatacaatctagctgtattaacacagagcaccaatcaactttaccaaacactatttgcaaataaacatttgtaatcaagaattttggagacttaaaatccatctcacttacacactagttattgaactttgaggtccagagaagaaaataatttatcagtttcctatcctgtgatgtgagaataataacaggcatatcatagaaacttgtgaggattatccctcttacattcatacgaaaactaaagtctagagaggctaagagatcttaaggtatcacaaagagaaacttgtaggtttagtattcaaactttatatgccctgctctaaaatgctacattttccttgataagcacataatcacatacagagtttcagattatttaatttcttattcatagaaagaatatgttggatgtataaaacatatttcttaggaattattatctacaaaacgggttttaaaatactgttaactccaatcacttaacagtttgagttgttttggatggttcaccagtccctataactcttgcagcttactgccatttgggtttctcagacaaaaccacagccttctactcgatttgagaatttttctttttaacctgtacactcgctaagagaatacaatttggaataagttgacagaaatagctataatagtatatgtagttgcacactgactgtttcagtcaaggcacaatcagggaaagaaagtgttgcaattaagtgaattcagatcaaagatttggttaagatggtaaagaaggagctgaggaccagtcagaacacagtaaaggaacatacatattaggaactgcaggaaaccatctagcactcctagactggagagagaaaggaaaattgtggtgtcacttgaagtagcaccagtccctgaacagaagctggagatggagacatggaggacatgtagtcactttaagaatacccttcaaaaaatcaatgaatccagcagctggttttttgaaaagatcaacaaaattgatagaccactaggaagactaataaagaagaaaagagagaagaatcaaatagacacaataaaaaatgataaaggggatatcaccaccaatcccacaaatatacaaactaccgtcagagaatactataaaaacctctatgcaaataaaccagaaaacctagaagaaatggacaaattcttcaacacatacaccctcccaagactaaaccaggaagaagttgaatctctgaatagaccaataacaggctctgaaattgaggccataattaatagcttaccaagaaaaaaagtccaggaccagatggattcacagccaaattctaccagaggtacaagtaggagctggtacgattccttctgaaactattccaatcaatagaaaaggagggattcctccctaactcattttatgaggccagcatcatcctgataccaaagcctagcagagacacaacaaagaaagagaattttagaccaatatccctgatgaacatcaatgcaaaaatcctcaataaaatactggtaaaccaaatccagcagcacatcaaaaagcttatccaccatgatcaagtgggcttcatccctgggatgcaaggctggttcaacatacgcaaatcaataaacataatccaggatataaacagaaccaacgacaaaaaccatacgattatctcaatagatgcagaaaaggcctttgacaaaattcaacgacccttcatgctaaaaactctcaataaattaggtattgatgggacgtatctcaaaataataagagctatctatgacaaacccacagccaatatcataccgaatgagcaaaaactggaggcattccctttgaaaactggcacaagacagggatgccctctctaaccactcctattcaacgtagtgttggaagttctggccagggcaatcagacaggagaaggaaataaagggtattcagttaggaaaagaggaaatcaaaatgttcttgtttgcagatgacatgactgtatatctagaaaaccccatcgtctcagcccaaaatctcctcaagctgataggcaacttcagcaaagtctcaggatacaaaatcaatgtgcaaaaatcacaagcattcttatacaccagtaacagacacacaaagagccaaatcatgagtgaactcccattcacaattgtttcaaagagaataaaatacctgggaatccaacttacaagggacgtgaaggacctcttcaaggagaactataaaccactgctcaatgaaataaaagaggatacaaacaaatggaagaacattccatgctcatgggtaggaaaaatcaatatcgtgaaaatggccatactgcccaaggtaatttatagattcaatgccatccccatcaagttaacaatgactttcttcacagaattggaaaaaactactttaaagttcatatggaaacaaaaatgagcccgcattgccaagtcaatcctaagccaaaagaacaaagctggaggcatcacgctacctgacttcaaactatactacaagggtacagtaaccaaaacagcatggtactggtaccaaaacagagatatagaccaatggaacagaacagagccctcagaaataaggccgcatatctacaaccatctgatctttgacaaacctgacaaaaacaagaaatggggaaatgattccctatttaataaatggtgctgggaaaactggctagccatatgtagaaagctgaaactggatccgttccttacaccttatacaaaaattaattcacgtggattaaagacttaaatgttagacctaaaaccataaaaaccctagaagaaaacctgggcaataccattcaggacataggcatgggcaaggacttcatgtctaaaacaccaaaagcaatgacaacaaaagccaaaattgacaaatgggatctaattaaactaaagagcttctgcccagcaaaagaaaccaccatcagaatgaacaggcaacctacagaatgggagaaagtttttgcaatctactcatctgacaaagggctaatatccagaacctacaatgaactccaacaaatttacaacaaaaaaacaaacaaccccatcaaaaagtgggcaaaggatatgaacagacacttctcaaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacatttttacactgttggtgctgtgtccagaattggtgggttcttggtctcactgacttcaagaatgaagccacggaacctcgcggtgagtgttacagttcttaaaggtggcatgtctggagtttgttccctctgatgttcggacgtattcggaatttcttccttctggtgggtttgtggtcttgctggctcaggagtgaagctgcagacctttgcggtgagtgttacagctcataaaggcagtgtggacccaaagagtgagcagcagcaagatttattgcaaagagtgaaagaacaaagcttccacagtgtggaaggggacccgagtgggttgccactgctggctctggcagactgcttttattctcttatctggccccacccacatcctgctgattggtccattttacagagagccgactgctccattttacagagagctgattggtccgttttgacagggtgctgactggtgcgtttgcaatccctgagctagacacaaaagttatccacctccccactagattaggtagatacagagtgttgacgcaaaggttctccaagtacccaccagagtagctagatacagagtgtcgattggtgcattcacaaaccctgagctagacacaggttgctgattggtgtgtttacaaaccttgagctagatacagagtgccaattggtgtatttacaatcccttagctagacataaaggttctccaagttgccaccaaactcaggagcccagctggcttcacccagtggatcccatactggggctgcaggtggagttgcctaccagtcctgcaccatgcaccctcactcctcagcccttgggtggtcgatgggactgggcgctgtggagcagggggcggcgttggtcggggcggctcgggctgcgcaggagcccatggcagtggggaggctcaggcatggcgggctacaggtcccaagccctgccctgcaaggaggcagctaaggcccggcaagaagtccagcacagcagctgctggcccaggtgctaagcccctcactgcccagtgccagcagggctggccggcagctccaagtgcgggaccagccaagcccatgcccacccagaactcgtgctgcagccctggttcccgcctgcgcctgtccctccacacctccctggaagctgatagagccggctccagcctcggccagcccaggaaggggctcccaccatgcagcagagggctgaagggctcctcaagtgctgccaaagtgggagccaaggcagaggaggcaccaagagcaagcgagggctgcgagggctgtcagcacgctgtcacctctcagtgggactgtaaactagttcaaccattgtggaagtcagtgtggcgattcctcagggatctagaactagaattaccatttgacccagcaattacattactgggtatatacccaaaggattataaatcatgctgctataaagacacatgaaaacgtatgtttattgcggcactattcacagtagcaaagacttagaaccaacccaaatgtccaacaatggtagactggattaagaaaatgtgacacatatacaccatggaatgctattcagtcataaaaaaggatgagttcatgtgcttcgtggggacatggatgaagcaggaaaccatcattctcagcaaacaatcacaaggacaaaaaaccaaacaccgcatgttctcactcataggtgggaattgaacaatgagaacacatggacacaggaaggggaacatcacacactggggcctgttgtggggtgtggggaggggggaggagtagcattaggagatatacctaatgttaaatgacgagttaatgggtgcagcacaccaacatggcacatgtatacatatgtaacaaacctgcacgttgtgcacatgtaccctaaaacttaaagtataataaaaaaaaaagaaagaatagctgctaaggcagagtaagaggagaaacatctgagctccttcctcccaactgttgcccatctctagaggctgactcagctggaattcaggtaatgtgggatccaaggaacagcgtctacagtgctcagccttcttaatatatgatcattactctacaagctatggcatgtttgatttgagaagcactcaaatcaccttattcattttatcaaattcggttctttcttctgactaagtactaggtactcaatagctacaaaaactatcctccaaaggcagaaacagcatcttacacttagttattggggataaccatgataatattccctcaaagcagattctcacacacagatactcatccactcagtacgtaaaacctgaccttcactctgcctcaccgtatcataagcaaaggatctcaagtgaagaaacaaaaactgacatgttcctggaagatgccaatggtactgctataattatttgtcaaagaatgcaactaatatttttagaatttgtccatgtcatgattctcaattttttagttgatttttgtgtcacgtttctttttctatcacaattttaataataagcagcccttccaaccacctccacaggaggaagattaactgtgagatggttaaggaaaggcaatgctaatcaatgatgtggccaattctttctgcaacagttatacacattgttatattccgggataaacttctcctgcccactcataaatttttatttccttctcctctggttttatggttaaattaatgaaaaataaaacttttcagaaggtagctgactcttcatgtgatttcaaacttaccaacaggaaatatccaatatacactccttacgccttcctacagcacatgaaatcttttttttttttttttttatactttaagttttacggtacatgtgcaaaacgtgcaggtttgttacatatgtatacatgtgccatgttggtgtgctgcacccattaactcgtcatttaacattaggtatatctcctaatgctatccctccctcctccccctaccccacaacaggccctggtgtgtgatgttccccttcctgtgtccatgtattctcattgttcagttcccacctatgagggagaacatgcggtgtttggttttttgtccttgcgatagtttgctgagaatgatggtttcccgcttcatccatgtccccacgaagcacatgaaatcatccttttttatggctgcatagtattccatggtgtatatgtgccacattttcttaatcgagtctatcattgttagacatttgggttggttccaagtctttgctattgtgaatagtggcgcaataaacatacatgtgcatgtgtctttatagcagcatgatttataatcctttgggtatatacccagtaatgggattgctgggtcaaatggtatttctacttctagatccctgaggaatcgccactctgacttccataatggttgaacttgtttacagacccaccaacagtgtaaaagtgttcctatttctccacatcctctccagcacctgttgtttcctgactttttaatgatcgccattctaactgatatgagatggtatctcattgtggttttgatatgcatttagctatcgatgacaaatccacagccaatatcatactgaatgagcaaaaactggaagcattccctttcaaaactggcacaagacagatgccctctctcaccactcttattcaacataatgttggaagttctggctagggcaatcaggcaggagaaggaaataaagggtattcaattaggaaaagaggaagtcaaattgtccctgttttcagatgacatgattgtatatctagaaaaccccatcgtctcagcccaaaatctccttaagctgataggcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggacgtgaaggatctcttcaaggagaaatctttgtttttaatattgcttttaattctaatagtaattacttgaactggccagaaacagaaattcctcaagtgcttagcagaaaagcctagctatagtagcttcacactttttctatttttaggcaattacaaatatattttgaatttggaaaataacatataatttaaatgatatacacacgcatatatacacacacatatatacacatatatgtatatacatatatgtgtatatacatatatacacacatatatacatatatacacacatatatatatatacatatatatatgcagtaacttcctaataagtttatttaaatttatctgattttaggtgaataaaaaataaaggtttggagagtacctttttaaatgtcagaggaatccaacaaccaattgtacaagtgaggggcagaaggagtctttgatttgaggatacctagtagctgttgttgcacatctgatcactttgcctattcttcttactacctgggtgtcaaatcaattcagaaaaataatctggaaactgtaaaccaaaaataaaattctaagcacccccaatcaactgaagagacccctcatctcagccaagtgcattcttttttttttttttttttgagatggagtcctgctgtgttgcccaggctagagtgcagtggtgcaatcttgactcactgcaacctctgcctcctgggttcaagctattctcctgactcagcctcctgagtaccaaggaccacaagcacccgccaccatgcccagctgatttttgtatttttagtagagacagggtttcgctaaaactagtgaaaagcattttcctttatagaaaaaattttcacacactaacttccacagtggttgaactagtttacagtcccaccaacagtgtaaaagtgttcctatttctccacatcctctccagcacctgttgtttcctgactttttaatgatcgccattctaactgatatgagatggtatctcattgtggttttgatatgcatttagctatcgatgacaaatccacagcgatattgggcaggctggtctcaaactcctgacttcacgtgattcacccaccttggcctcccaaagcactgagattacaggcatgagccactgcacatggccatcagccaagtgcattctaaagtaaaccagaaaccctagttcaggccatgataggaataggtggtcagacatgcctcattatacctccctcctgttggattaatttgggcacagctggccagcattaacactaaaacagaaaccttaagacggacagaacagactctttgtagcaataagatacctacatgacagcaggttctgaaagaaattgaagtattaatattttactcccaaacatatttatttgacatattttgaaatggccccgcaaagctgtctcttgtcggggaaaatctacattctgtagagaatccttttccctttccaggtgtttttactgatccggagtgaattaacaaagagtctggcacctgttaaagtttgacaagaaacatttacaatgtcttctctccgaagcctgctacctggagccttcatctgcataataagaacccgggtctctaaaacccctgatcttaacccagacagtcccttctgttgattcctgatctttagatgcactctttcaactaattgccaattagaaaatctttgaatttggcctggcaaggtggctcacacctgtagtcccaggactttgggaggccgaagctgacagatcatgaggtcaggagtttgaggccagcctggccaacatggtgaaccccccccaccatctctactaaacataaaaaaattagccaggcatggtggcgcatgcctgtaatcccagctacttgggaggctgagacaggaacatcacttgaactggggaggcagaggttgctgtgagcagagatcacgccattgcactccagcctgggcaacaagtgagactccattcccccccgccccctcccccccaaaaaaagaaaaagaaaatctttgaattcagctatgacccagaagttccctccctacccacttcaagttgtcccgactttctgtacagattcaatcaatgtacatcttgcatgtattgattgatgtcttatgtctccctaaaatgtataaaaccaagctgtagcccaaccaccttgggcacatgttctcaggatctcacggagctgtgtcatggggccaaggtcacttgtattttgctcagaataaatctccaaatattttacagagtttgactctttttgtcaacaaaatgtaaagcattaaaagaaattagccagcaatatacttaattatcatgagcatagtaagcgattttagttttcctttcatcacttattaatatcttacatcaaatttatttttacactgacaggattatatcccttctttaaagctttctatttatagtatgcaatgtaatatggaggttactacctacttcaagcatagaaggcccatcctttatactccacaggcttgtagcacatttatatctgagaattactagtgaaaagcttcctttaacagttttagaaatgaaaatcaagaacatctgtgacttttgtttgacccccccccccccataggcagttacaaggcaaatgtgcatactcctctagcaatcactatagcaacaagcaagtaattgctttaaatagcataaggtgcctttgctgaaatcatttcaagtatcctgagttaactctgtgtcaacaaagcactcataggtcttggattctttaatgggggttcttttaaaaaagaaaattacagctttgtaattggtcatttaaaatttcagaaaaatgtagatacaccaaagaaaatgtattctccaactatgaagaaataattggcaaaatagtatcattttcatattcctaataatttttcctatacatatactgtatgtgtttatttatatttcttatttcttactataagactttaagccagtgcttgtgttacctgttttcattgccttcttacaattatcttatacagatatattataaaataaactcacttttaaaatattttctgtgataagattatgaaatggcatccaaagggaatcacacacaggattttttattttatttctgaaaaatatttgtaggttcaatttaattatcatatattgaaaggtgcttagtgcttttttgcatcagacaaggtgaaaaattcaactttcaaatggctatagtccctggcttcttattttcatcttagcaaaataaaacaacaccctacttatgaattgaaattgtaatgccattccattttctgctataccatagaaataactctaaatactaaaatgtataaagtggaaaatgctgatagtattccaatttgtttcattttcaatttgaagaaaaaggatatgtgtctcctggggtgaagaaatgagtcaattaggtatagaagaaggggcatgactatatcaagcttacactaaaaatgctgaataacaatgacaaattagataattattaataagtagataattccaaccctaaaaaacaaaagaccttgcatggttaatatacaaatgacttttagaaacataaacataaatggaagccaaggaaacaatcaactgagtgaagaaacaacttgtggaataggaaaaaatatttgcaaatcatattttcaataagggattgttattgaaaatgcataagaaacttgaataatttaacaataaggaaacaaatgacccaatcaaaaaatgggaaagatctgaatagacatttctcaaaagaagacatacaaatggacaatatatgaaaaaatgtttaatgccactattcttcagaaaaatgaaaattaaaaccactcctcagctcctcacagctgttagaatggctactatcaaaaagacaaaaagtagcaagtgttggagagaatgtggagaacagggaatccttggacattattaatgagaatgtaaacaattataggcattataaaaatatggaaattcctcaaaaaattaaaaatagcactaccatatgctccagcaatccctctacaaagtatatatccaaaggaaaggaaatcagtacgtcaaaaagatatacttcctttcatgtttactgcaacactactcacaatagacaagatatggaatcaacctaggtgtccattaacagatgaatggataaacagtcatataaatatgtatatctagtataaacacacaccacttataaagaagggaaatcctattatttcctacaacatggatgaacctggaggacactatgttaagtgaaattaggcacagaaagacagatatcacacagttttacttatattttgaatctttgaaggggtagagaggagaaaggtggttatcagggaattaatgggggggtagagaagtgaggagatgttggacaaaggataccaaatttaattcatgtagaagaaataaagatacctaatgtatgacacagcgactatagttaatgcattgtattcttgaaaattgctaagagagattattttgagtgttattaccacaaaaaatgtgaggtaatgcatgtgttaattatcttgactaagccattccacaatgtagaaatatttcaaactacatcatgttgtacacaacaaaaataaacaatttgtaatataaaaaataaatttaaaaaatatatgtacaaaaaggaaatacagatggcaaatatgcatgtgaaaagatagtcaaagttattataataatgaaaatgatcaaatcagggtaattgggatatgctaggaacatttaaatcacacattacatgaatgtattaaattatcacatgtatattgaaaatatgtacacctattatatcatttcttctgaaagtgaaatctaaaatactgtacacaccacaaggatagcaaaaattaaaacaagaacaaaagcagacattaaaaactgctgaaaagtaaaatctaaaataatactgaaaacaccactagaatagcaaaaattaaaagaacaaaaacagacaataaaaagtgctgacaaggatgtagagaagccagaactctcacataatgctagtgagaatgcaatggtacagtcattttggaagacaatttaaaagtttcttttgtattcaaacatacacttaccaacaactgataaattttacttttgtatttactcatgataaataaaaatatttgtcttcacagagacgtatgcataaatgtttatagcaatgttattcaaaattgacgagaactgaaactaaatttttattatgtggagaatagattaaaaattaaggtatattcagacaatagaatattatttaacaatcaaaatgaatgaactatgggtacatgcagcagtaaagataattctcagaagcaatgtggtaagtgaaggaagctagacacagagggtctgtggtgtatcgtcccatgtacatgatatttgaggagagaaaagcctatcaggataaaaatactatcagtggtttctgagggtccagagtttgagtgggggttattgactacacaaaggcatgagggaactttttcagaaaatggacatattctatattttgattatatgtaaactatacatctatctaaattaatcaaattatatatatacaagggttgaattatactgtataaacttatatctcaataaacttaattttagaaaacttctcaggaagataaaggaggaaataatatccatgaaacaagaacaaggcactgaggaacaagaataggcagctgtgaaacagaggtgagggagaagaaatatttgaagtaaaatttacaaaaccttttcagaattggagacatagatcttcatattggcctgttatcactgaaaaccaaggacaattaaaactaaatagataaaaagaatcactgtagtaaaatagcagaacctgaagaataaaaatacatttttcaatatgactgttaacaaagagaggtaatattgacaattttacattaatgttacttagaaaaggaatattttctaagttaagagaaaaagtaactacaatatgcaattatttgttccactaagctgacaataagtagaaaaataacaatacctttttaagtacataaaacaattttactatcaaatggatttttctaaaacaactcctaaagaattcagtttgcctagaagagaaatacaaatagaagtagtgaagttgataccagaagcaagatttggaaaacacacacagatacacacacacacatacacacacacacacacacacacacacacacacacattttattaaataaatgaatatcaagatctcaggatgagtttaggaaagcttggaaaatttgtgattacaagtttggtgactgggcatatttgtatatttttaaactccattcaagatttatttggttcttttcaatgttaaaatatatgaaaactacttcattctccaaaacatgttatttttgatattctaagagaaaattactgaattgtcaatcttatttcccaagtaagattcttttttcttttctttaaagtaatggtgttggttattttcaattacaataatgttgtatggtctagtcattctagaaatatatttttaaaaaggttaaaaacagagcaaattataatcaccttcataaaataaaccacagtgatatatggacaaatataaaaatgtattaactattaactttattactaaaagtttaacggtaaattatataaatttgacattataggaaagaagcagtaatttattataggggtcagcaaacaatggcctatgggctaaatctagcctgcttccaatctcggtcaataaagttttgtcagaacacaatcagattcatttatttttgtattgtccatggctgctttcatactacaatgtatgtcagaactgagtagtttcaacagaaacattctggtttgcaaatcctaaaacatttactatctgttcttttacagacctgtcagcctctgcactgctcatataggcaccataggaacatttgtgatactacagacactttcaactaacttaaaaagagaaaggtgccctttctttttagtagtataggataaaaggaaagaattctctttaacttttgaactggcaatgatagaatttaagagatgcaaccctgaaaactaaaattgtacattggttgaataaaatattttctaaatatgtatttttatacttcaatttaagattgttgctctgactaaatatttttataatattttaatcatgagcattctgctttacaaaaccatttcttaaaaatactcttatacttttgctgtagagtaattttcagtcaggggaaatttggcaacatctgtagacattgttcattggcataattctagtggaggaagaaaaacatgctactggcatctagagcaaaaggtcagttgctctgctaaacattacaatgcataggacggaccacacaaccaagaactcttcaccccaaaatgtcaatagttctgaggttgataaattttcctatagagatatggtaaaacaaaagaaagcaaagtaaagcagaacagaacaacaacaacaaaaaaaacacaaactaattagatttcaagataaaaaagattatttcagaattcccatctccaggccagcttttattgtgtatacaccaattgcagcatctttctgaagaaaaataaggaggctctttacagcagacatcatgtaataaacagtatacactcacaaggatcataagtttgggaactttttaggaagttcctaaaaataatttccctgcaaggaaaatttgctgttagtatgttgatattgttttctgtagaattcagtgttaaggtgtcactttttcaaggactctttttttaacatggccttgttgctatttcatcttttttgaaaccactctatgatcacatgacaaggcagtttcaaagtttttgcatgttaatgcagtgtgtctttgactaaggaagaaagataagagtgtcccacaatataacttgttaactaatagttacatgcagtttttaaatatttttgtttgtttgatcttacaatttccagtaccaaaaattttcacaaaaattagaattatgacatggtctaatctccctaattctgttcatgttattcctcaatttttgcaaaccttttctctaaaaaataaatgtaataacatttcttcctaaagtcattattatttatctaccttaacatttgtaatgaccataaactatttaacattttcttttctttccttctttgtatgtgtgtgtgtgtgcatgtgtgtgtgtgtgtgtgtgtgtgtgtgtgtgtgcttttagagacctagtcttgctctgttgcccaggctggagtgcagtggaaggatcatagctcactgcagttttgaagtcctcgtctcaagggatccttccactttaacatgtcataacacttcttgattagcattaagtactgcagcatttcttgttgcaatgtcaattatttattcatatgttaaagagctgataaaaatcaatacaaagttacatttttttgtggcgattgttgatatatattcattaaacaaattcatatatttccctaaagttttcctatatgatgtatgtttgaacaggattttgcaactatcattaaaaagaatgcagtatttcaacagtaatattgattctttgttaaaaatttagacacaattgtattacataaagattaaacaacttagaatttttgaaaatgcatacacattttatatactactcttttttaaaaaaaaattttcattccattccaggggtacatgtgcaggtttgttatataggtaaactcgtgtcacaggggtttgttgtacagattatttcatcacccagatattaagcctagtacccaagagttatttttttctgctccccttcctccttgtaccctctaccctcaggtgggacccagtgtgtgttgttctcctctttgagtccacgtgttctcgtcatctagctcccacttataagtgagaacattcacgtaccactcataatctatccttttacttcaagaaaaattatgaaaagttagcataaaatttgtgtacatcattgttcttgtatttctgtatcttattccattattttcatttggcaagatatttttcatcatttttatagttcataccaaaatatactaattttttacatatatgttaaattatattttcctagttttactttatgttaaatttaactttatgactaatccttatgatgtgtagaaatttattttttatggtcaattgtagaaatcttaggctttataatttttacttgtgcatacaaaaattttcttctctgtcaagattatatatattggccttattttcttttgcatctattatagataatctgaattaattttcacaataattataagttaggtgtttttcttaaagaaaacactggctttaaagaaaagttccattatgtatgaattcaaatgattttctcaaatatacactttcaattcgcttattctctcaatttcccatggaaacagcaaggttcataaaatatagaaaaccatctcactattatgcctaattcatcagacttcaaaaacatacctgaaggtcagcgctctgaaatacataggtaggtacacagtgtcctacataatttcatgaaatgcctcattgtatttaccgataataaaaattttcctcaaaaaaatttaaaaaataaagtttgttatataaaaataggtgcagtgaggggagtgtctgatttctccaaactttgtctaaactagagataagagagtatttgtactaatgagataagtgcagacgataaagaatagcatagtctgagacgtataagaaataacaaaacctggcagagacacagcaaaaaaagaaaacttcaggccagtatttttgatgcacattgatgcaagtatccttaaaaaatacttgaaaaccaaatctagcagcacatcaaaaagttaattcaacatgatcaagcaggcttcatccctgggatgcaaggttggttcaacatacacaaatcaataaatgtgattcatcacgtaaacagaactaaagacaaaaaccacacgattatcttaacagatgcagaaatccaacatccctaaatgttaaaaactttcaataaatcaggtattgaaggaatatacttcaaaatagtaagagtcatctatgacaaacccacagccaacattatatatactgaatgggcaaaagctggaaacattccccttgaaagccagcacaaaaatgccctctcttaccacttctattcaacatagtattgaaagtcctagccagaaaaataaggcaagagaaagaaataaagggaatccaaatagtaaaagagaaagtcaaactatctctgtttgcagacaacatgattctatatctagaaaaccccatagtctccacccaaaagctcattgaactgataagcaacttcagaaaagtttcaggatacaaaatcgatgtacaaaagtcattagcattcctgtacaccaacaacagacaaaccaagaaccatatcagataggcaatcccattcacagttggcacaaaaggaataaaatacctgggaatacagcaaaccagggagatgaaagatctctgtttacaatgagaattacaaaaggctgttcaaataaatctgagaagacacaaatggaaaaacctcccatgctcatggatagtaagaatcaatatcattaaaatggttatactacccaaagcaatttacagatgtaatactatgactatcaaactaccaatggcattcttcccaaaactattaaattggctatagtacccaaagcaatttacagatttaatactatgactatcaaactaccaatggcattttttcacaaaactattataaaattcacatggaaccaaaaaaaaaaaaaaaaaaagagctccaatcctaagcaaaaagaacaaaactggaagcattctattacctgactttatactacaaggcaacagtaaccaaaacagcatggtactagtgcaaaaacaggcacatagaccaatggaaacacattcttatttgttcttttattcaaaacaatattaattgaatgacttcaaagtatcaggccttcttagagactacatttattagcagaattctattcatcatcaggatttttttttttaggattaagctcttcttcacttttgacatttatcattatcttattcttttccttattaattctggaatttctaaaatatattattagtcaaatctgatgtttcctagaagtctacaaaaatatttttaatggccaatattttgttcaatctacttagtaaaaatgttcatatctttaattcagtggaaagtacatttttaaatagaagcttagaggaaaaataatagactgagtctacagattatagaacctaaagtttaaaagtattcaagaatatgtggaaacccattaacttttaaatattcaataatactgctattatggaaaaaatttggttttctcatttaatgatggttgagtggaattatcctgtatctggcttagagtgaggaaagcaattatcccatttttactgtaatttttcctctgcccctaatttattagagagagaaagagatctgaactgggaagatttaagatttttcatctgaaaaaaatagaagattgttatagatgaattctaaactgttatctttaatattctatatgtttatgctatgtttaataattaatatcagtattaataatactggtaacacaatttttagtatataattcacattctttcatttaaaacaatacttactatgtctttctttctgccagatacttttctgagtagctattaactggattttcatagatgaatgattttcatttggttgcagacaaatgaattattctctataaattgcataactgtcaatggtaaaactcagtattctgacaataaattcatgcaatatgcaaatgcattaataattgacttaatggttgtgaataatgcaaatattttacctttaagtacattcattaatagtaaaacaatagtaaattggaaataggtattgaagtaggtacttagttttagagatgaaattaataatttatataatcaaaatgactaatttggttggctaggaaaggtcaatgaccacctaagttctcacattttctgggttattactggaacatattttctctggacttagagctcattaaagatgcatagtctaaagttctgacattcaatattttttctctgattcagagaactagtttacagcgttctttttattttttcttttttgaagcagatgaaaaaagaattcttggtctttaaagaacatcagagagccttttcaaacaaacacgagtataatcattaataattaagctgtatagagaaatctcatgtattcaaaattctgacaccaaatttgacttaagaatttaaagggattctcacaatcttattactataattgatgcacagagggtactcattatgtctactaaatctgaaccagatcctgatgtctaaaaatacttgtcaaattgcatgttatataagccatcattgtaattaactcatttattcaacaaatcttatgaaatatcgactatacacttttgctgagcatcaaggctaccatacttgggaataaaaaagacatagtctcttttctcaaggaattgacagtctaatgaaatattcatagactaatcaaacagtcacaagtaatgtcaaatattaactacatagattataaaatgaatgtacaaggtattatacatcagaataaaaaaaggaataaaatattctcaaagtaaatttaaagcttagaaaaccaaaaatatctaccagtttttatttttaaaatttataattttctatttatttcttataaatattttaaaattatcagaagtattacatttattatctcaatatggattcaacatttagttcatcctgctttcaaaaaaacaaatgtcatatcttagctattgtgaataatgttgcaatgagcatgggtaaatagctgtttaacacactgatttcatttcttttggacatatacccacgagtgggattgctggatcacatagtaatgctgtttttaagtttctgaggaacctccatactgttggtcataatggctgtaccaatttacatttctaccaacagtgtgcaagggtttccttttctccatatcctcatcaacacgtatcttttgtcctttttttttttttttttttttttttttgagacggagtttccctctgtcgccaggttggagtgcagtggcgtggatctcggctcactgcaacctctgcctcccgggttcaagcaattctcctgcctcagcctcccaagtagttgggactacaggtgcacaccaccacgcccagctatttttttattattatttttaatagagaaggggtttcaccatgttagccaggatggtctccctctcttgacctcgtgatccgtccacctccgcctcccaaagtgctgggattacaggcgtgagccaccatgcccagccttttttaaatcatactttagtctggaatatatgtgcagaatgtacaggtttgttacataggtatacatgtgctggaaaccatcattctcagcaaactgacacaggaacagaaaaccaaacaccgcatgttctcactcataagtgggaattgaaaaatgagaacacatggacacagggagggaaacatcacacactggggcctgtaggttggggtgggggtcgggggctaggggagggatagcattaggagaaatacctaatgtagatgacagattgtcgttttaataaccattcaaacaggtgtgtggtgataccttactttggttttgatgtatactacctgattttagtatgttgaacattttttatacacctgttgccatttgtgtgtcttcttttgagaaatgtgtattcagatcctttgcgtaaattttttttctgttgatttatttgactttcttatgtattttggatgttatcttcttatcagatgtgtggtttgcagttattttctcccattccctagattgtctctttattgaagccttccttttctgtgcagaaacgttttagttttatgtaatcccatttgtctattttcagtttcatttcatgcaatctcatctatttttgcttttgttgcttgtgttttttgatgccatatccgagaaatatcactatccagaccaaagtcagaagtgttttttttctgtttatttcttagtagtttcacagtttcagatcttacatttaagtcttaaattcattttgagttgatttttatacgatgtgaggtggtaatatcaatttatagatgaatgaagaaaatgtggtacataatggaatactagtttttttaaaaagagaaaatactgccattttgacaacatggattaacttggaggacattatacaaagtggaataatagacacagacaaaaccatatgatttcacttacatgtatagtataaaaaaattgaactcatagaaacagaaaatagaatggtggttgccacaagctgggaggtaggggaaaatggggagatgttggtcaaatgatataaagtttgagttgtgtagattaaataagttcaaaagatctaatacgtggcatgatggttatagttgataatactgtattgtatacttgaaatttgctaagagtatataacttacatgttgttaccacaaatatgcatataaaaggtaactatatacagtgatggatatattaatttgcttaattgtggtaatcattttattgtatatgtatatcaaaacataacattatataccttaaatagatacaatacaattctttaaaattatacctcaataaagttgggaagaaaagaaaaagaaatcatacaaattaaaaaaaaaaaaaacaccaagcattcaaagtacaaattagtgcaatatatatataactgtgtgtgtgcaagaaatctggtttcacaaatgtaagagaaatcctaaatacatggctttctatattatttcaaaaatttttatctcttttcaagctataggtggcttttcattatgatattctatataaggaggaaagaagacttatgcacaattattctctgatgagatagtggtttagtttaccttatctcactaataaactgtagacaaacaaatggaacaaagtatactatctctctgtattctttcttgtatacaggaaagaaaaattgacaccctgggagcagacatgtatttaaaacctgtatttgacagtgactaggtgcatgattctgagaaagtttacaaacagtgcctctgctggtaaaaattgcaaaataaatggtagttactcttattgtcatcattaaaattatcatcagtatcatcattgatgttaataataagcaatgtttacttcagcaaatctggataaaatgcagaattgataagaatgggcacttaattcgcatttcttactacaacagtgcaggggatatgtcctaggcactacacatttatctaatatttaacaatggaatatattatttaaattggctatttacacatattttatgctttacaccagtccacctaaggcttgaagttggtgagaagtatttaatactagattaaaatcatgtattaaaagaaaacatgtagggaaattacaaagcatttgatcctgtgcatgattaaggataacaccaatttgattctaatatatatatatttttaagacagagtctcactctattgcccaggctggaatgtagtgccatgattttggctcgctgaaacctccacctccacagttcacatgattctcctgcctcagcctcccaagcagctgggattacaggtgtccaccaccatgcccagctaatgttttgagtttttaatagagacagggtttcaccatgttggccaggctggtcttgaactcctgacctcaggtgatccacctgcctcagcatcccaaagtgctgggattacaggcatgagccactccacccggccttaattctaatctttcaagatatttttaaaaatacacttcagtgtaacccttatttttttaagctaggactaaaagaaaaaaaaaaattcctaccaaaaatgcaataacgcattttagaaaccagtatttgtcaacatctctcaatacggagtgagagtatacatcaaaacaaaatttagtataatacattttataaagtcaacacatgattcaataataaacatctatctgttaaactgacactctctaagtgtaaatttaattctctatattgaaaagaatgggtttcttgccattaatttatctatttgatgacttaatgtgtattaaacaaatagttgttgaagacattctaggtgtcaagcatggtattatatatcacacacacaaataaatataagaattgtatccttttgcaagaaattcactgtccagtgaaaggagagttaaataagaaaataaacataatgcaatactggaaagaatgaaggaatcacttggtagcacaatatgcttacacctaagaaaaatggaagtagaagaaaaagctgtctgaagagtgatatctgaaagaagtctcaagtgatttatttggaaaactatttctaaaaactagaatttagttaagaattataaagaaaattataacatatggtaagaattttgcataaaaatgtaatttacaaaagcggtatcttaagagcaataaaaaataaattatcttccttttccagccataatgttataatagagaccagatttaaccttctgctctaaacaactagaaaactgaccagtacaactaaaacaagggttttatgttttggacaacagactagaaatgacagtgaactctttgattaccccatcatactgtctggagaaagtctctggtcttctgcacagattgtgggaacacaaatggaacatggcattctccatgagtagagaagatagatttgagaattcaggaaggccaaaataaatagaattttctgtgtacagtaccagagaaaagtgagttgcagaggtctccagaaatctgcagaggattagccttaagtcttcaactgaacactgatcataataattatgtgaggaaactatggggtttggaaaaaaccaccagaaaagaacagacccaacagaaaactgataagaatggaaagcatatagctgagaaatgtgagcagaggaaagtaagacccatgatggacaagaaggcctaggaaacagagctagtgaaggaagatgaacatgaaaaagagaccagaaattaacatctaaagggaggagaaaaatcagtgagcatagtgccaagacctttccctagtcaaacgtaatagtttaaaatacagcttctctctctgggcagcgcatctctgaaagaaaggcagcagccccagtcagggacttacagataaaattcccatctccctgggacagagcacttaagggaaggggcagctgtgggcagcttcagcagacttaaatgttcctgcctgctgactctgaagagagaagcggatctcccagcacagcgcttgagctctgctaagggtcagactgcctgctcaagtgggtccctgaccccagtgactcctgactgggagacacctcccagcaggggtcgacagacacctcatacaagagagctccagctggcatctggcgggtgcctctttagacgaagcttccagaggaaggaacaggcaacaatctttgttgttctgcagcctccgctggtgatacctaggcgaagagggtctggagtggacctccagcaaactccagcagacatgcagcagaggagactgaatgtgagaaggaaaactaacaaacagaaaggaatagcatcaacatcaacaaaaaggacgcccacacagaaaccccatccaaaggtcaccagcatcaaagactaagggtagacaaatccacaaagatggaaaagaaaaaaaaaaaaaaaaaacagcaaaaaaaggctgaaaatccaaaaaccagaactcctgttctccaaaggatcagaactccttgccaggaaggtcacaaaactgacggagaatgacttagatgaactgacagaagtagccttcggaaggtgggtaataacaaattcttcagagctaaaggagcatattctaacccaatgaaaggaagctaagaaccttgaaaaaaggttagcgggattgctaattagaataaccagtttagagaagaacataaatgacctaatggagctgaaaaacacagcacaagaacttcatgaagcatacacaagtaccaatagctgaatcaatcaagcagaagaaaggatatcacagattgaagaacaacttaatgaaataaagcatgaagacaagattagagaaaaaagaatgaaaaggagccgggcgtggtggctcacgcctgtaatcccagcactttgggaggcggaggtgggggggtcacgaggtcaggagatcaagaccatcctggctaacacggtgaaaccccgtctccactaaaaatacaagaaattagccaggcgtggtggtgggaacctgtggtcccagctactcgtgaggctgaggcaggagaattgcgtgaacccgggaggcggagcttgcagtgagcagagatcctgccactgaactccagcctgggcgacagagtgagactccatttcaaaaaaaaaagaatgaaaaggaacagacaaagcctccaagaaatatggaactatgtggaaagaccaaaacttcgtttaactggtgtacctgaaagtgagggggagaatggaaccaagagaatggaaaacactcttcgggatattatccagaacttcccctggcaagacagtccaacattcaaattcaggaaatacggagaacagcacaaagatactccttgagaagagtaaccccaagtagaataatcctcaaatttcccaaggatgaaatgaaggaaaaaaatgttaagatcagccagagagaaaggttgggttaccccataagggaagcccatcagactaacaatggatgtctctgaagaaaccctacaagccagaagagagtgggggccaatattcaacattcttaaagaaaataatttcaacccagaatttcatatccagccaaactaagcttcacaagtgaaggagaaataaaatccttttcagacaagcaaatgctgagagattttgtcacccccaggcctgccttaccagagctcctgaaggaagcactaaatatagaaaggaacaaccgttaccagccactgcaaaaacataccaaattgtaaaaaccatcgacactatgaagaaactgcatcaactaacaggcaaaataaccagctagcatcataatgacaggatcaaattcacacataacaatattaaccttaaatgtaaatgggctaaatgcctcaattgaaagatacagactggaaaattggataaagagtgaagacccatgggtgtgcggtattcaggagaactgtctcacgtgtataggctcaaaataaagagatggagaaatatttaccgagcaaattgaaagcaaaaaaaagcagggattgcaatcctaatctctgataaaatagactttaaaccaacaaagatcaaaaaagacaaataagggcattatgtcatgctaaagggatcaatgcaactagaagagctaactatgctaaatatatgtatacacccaatacaggagcaccagatccataaagcaagttcttagagacctaaaaagagacttagactcccatacaataatggtgggagattttaacaccccaatggcaatattagatcaacaagacagaaaattaacaaggatattcatgacttgaactcagctctggaccaagcagacctaacagacatctacagaactctccaccccagatcaacagaatatacattcttctcactcccacatcacacttattctaaaattgaccatataattagaagtgaaacactcctcagcaagtggaaaacaacgaatatcacaacaaacagtctctcagaccacagtgcaatcaaattagaactcaggattaagaaactcactcaaaaccacacaactacatggaaactgaacaaattgctcctgaatgacacactagttaaataacaaaattaaggcagaaataaagaagttatttgaaaccaatgagaacaaagacacaatgtaccagcatctctgggacactccttagtgtttagagggaaatttataccactaaatggccacaggagaaagcagaaaagatctaaaatcaataccctaacatcacaattaaaagaactagaaagtaagagcaaacaaattcaaaaaccagcagaagacaagaaataactaagatcagagcagaactgaaggaatttgagacacgaaaaacctttcaaaaaatcaatgaatccaggagctgttgtttttgaaaatattaacaaaatagatatatcactagccagactaataaagaagaaaaaacagaagaatcaaatagacacaataaaaaatagtaaaggggatatcaccactgatcccacagaaatacaaactaccatcagagaatgctataaacgtctctatgcaaataaactataaaatctagaagaaagggataaatccaggacacatacaccctcccaagactaaaccaggaagaagtcaaatccctgaatagaccaataacaagttctgaaattgaggcagtaattaatagcctacaacgaaaaaatgcccaggatcagatcgattcacaggtaaattctaccagaggttcaaagaggagctggtgccattccttctgaaactattgcaaacaatagaaaaagagggactcctccctaactcatattatgaggccagcatcatcctgatatcaaaatctggcagacacaacaacaacaacaacaaaatttcatcaggccaatatccctgatgaacatcaatgcaaaaatcctcaagaaaataccggcaaactgaatccagcagcacatcaaaaagcttatccacccagttggcttcatccctgggatgcaaggctggttcaacatatgcaaatcaaaaaacataatccatcacataaacagaaccaataacaaaaactgcatgattatttaaatagatgaagaaaagacctacgataaaattcaacaccacttcatggtaaaaactctcaataaactaggtattgatggaacgtatctcaaaataataagagctatttatgacaaacccacagccaatatcatagtgaatgggcaaaagctggacgcattccctttgaaaaccagtaaaagacaaagatggtctctctcaccaagttctggccagggcaatcaggcaagagaaagaaataaagggcattcaaatagggagagaggaagtcaaattgtctgtgtcaaatttgcaaatcaagtcaaattgcagatgacatgattgtatatttagaaaaccccattgtctcagcccaaaatctccttaagctgattagcaaatttggcaaatactcaggatacaaaatcaatgtgcaaaaatcacaagcattcctataccccaataacagacagagagccaaatcatgagtgaactcccattcacaattgctacaaagataataaaatacctaggaatccaacttacaaggtatgtgaaggacctcttcaaggagaagtacaaaccactgctcaaggaaataagagaggatgtaaacaaatggaaaaacattccatgctcatagacagaaagaataaatattgtgaaaatggccataatgcccaaagtaatttatagattcaatgctgtccctgtaaagctactgttgactttctttacaaaattagaaaaaaaactactttaaatttcatatggaaccaaaatagagcctgtatagccaagacaatcctaagaaaaatgaacaaagatggaggcatcatgctacctgacttcaaactatgctacaaggctaccattaccaaaacagcatgggactggcaccaaaacagacatacagaccaatggaacagaatagaggcctcagcaataacaccacacatctacaaccatctgatctttgacaaacctggcaaaaacaagcaatggggaaaggattccctatttaataaatggtattgggaaaactggctaggcatatgcagaaagctgaaactggatcctttccttacaccttatacaaaaatttactccaaatggattaaagacttaaacgtaagtcctaaagccataaaaaccctagaagaaaacctaggcaatcaataccattcagcacataggtatgggcaaagacttcatgactaaaacaccaaaaacaatgacaacaaaagccaaaatttgcaaatgggatctaattaaactaaagagcttcagcacagcaaaagaaactatcatcagagtgaacaggtaacctacaaaatgggagaaaagttttccattcaatccatctgacaaaaggctaaaattcagagtctacaagaaacttaaacaaatttacaagaaaaaatcaatcccgtcaaaaagtgggcaaaggatatgagcagacacttctcaaaagaagacatttatgcaggcaacaaacatatgaaaaaaaagctcatcatcagtggtcattagaggaatgcaaatcaaaaccacaatgagatgccatctcacgccagttagaatggcgatcattaaaaagtcaggaaacaacagatgctggcgaagttgtggagaaacaggaatgcttttacactgttggtgggcgtgtaaattagttcaatcattgtggaagacagtgtggcaattcctcaaggatctagaaccagaaataccatttgacccagcaattccattactggttatatactcaaaggattataaataattctactataaagacacatacacatgtatgtttattgcaggactattcacaatagcaaagacttgaaaccaacccaaatgcccatcaatgatagactggacaaagaaaatgtggcacatatataccacggaatactatgcagccataaaaaaggatgagttcatgtcctttgcaggggcatggatgaagctggaaaccatcattctcagcaaactaacacaggaacggaaaatcaaacaccacatgttctcactcataagtgggagttgaacaatgggaacacagggacacagggagacgaacatcacacaccagggcctattggtgggtgggggcaaggggagggatatcattaggagaaatacctaatgtagatgacaggttgatggttgcagcaaaccaccacagcacttgtatacctatgtaataaaactgtacgttctgcacctgtatcctagaacttaaactattacaaaaatcaattagttaaaaaaatattttcagttaagctgtggttgaatacaagaaccaaccacttccccatgtaatattgataagcatggaatgcatgaatcatagagtctcagggtaagaagatttgctccaaagctaccttgagtcaattaatgggattcagctggaaacaaagaaaaacctcgagggagaagtaccagttctaataaaatgctcacagttaaaacaaaaataaacaaaaactgatatattcatttcttatgtttttaaagttcaaccaaacataaaattgggggcataattcctgtggggttaataaaataagtacatttcttcagccagttgatgaaaaatatgtaatttcatttacagcccctgttggttttaaaaacgaagtgtttttcaagtatacacaatgatacttatatgccttcaggtataaatattaaatgatctaaaagaacacaattttgctttattgatttcagctgtcaaaatgataaaatacaactttatttccttctattacagaaagctggtcaggctttttagagagtgatagaggcactagtatcaaaagaagagagaaagtacatagagaagataaaaatgcatccaatgtctaaccaaaatggtaaactacttagggaaacttcacccagaataagagtgtgattgaaaatcaaacagaaaagtatagcacctagtcataatcttaaatcaaaagagttattcttatcatctgatgtttccaaattatacacagaattttatccacatgaaaatatggattgaattttcatgtcttgtttcttcaggattaaaatcctttttagaaagtaaaacatgaaattttcaaagaaaagggaaaataaagagcatgttaaaaaaagaagacattattggaatacaaaagttaatgtggtttctacacttgaagtttcttagaattgaaaacatagaaaggaggggttagatattgcataacctcaagttgttaaagcaggatgaggagtaaggctcttaggaaggaagagacagcttcatggcagaagcaaggagtccagggaaggtggtaagaactgcctcagagcatcagcgagctagtgaaacattaaaacgtataaatagcaattaataagatctagagaagcattggaagcccctggctaaagtatggtcaggtacacagaaccacaacagaggcaagaatgtgaccatgtttagaaatcaaatgtcagaatatggtaaattagtcagcagtaagtgaagaagtcaaaggtatggtacatagtattaaaattcaggacaagcaccaagtttaggtttcaagtactctaagcttaaggaactagacaggtagtaaatgagttgtgacagcagtttataaactaaagagagtatatggaattaaatttaaaaactgaaaatttggggacaggctaacatttaggtggcactgtgacagcaatttatatagataaattcatataatcctcaaaatgactgcacaaaattagtggtagccctatattatagatgagcaaactgaggctatgtcatagaacttttctaaagacaaagagctagtaagttatagaatggaaattctgagatttattcaccttccaagcttctgtcatattaccaggcactgaaattgaacaactgaagacctttaaaaatcttggaaaatgcataaggactttgagctaacatttgctttagtgtggtagcatttacatcatccttgactagccagtgaaaaacctgtagtaagtgatctgagaacagtgagagttcgccaaaatcatgtaagcaacattgtgacttggcgatcagtgcgtttcctacttgttctttggaagtaacttccacaatccatctttttggagaatgagactcatttgtaatgaatatatgcccaaccccaggtttttagaacgttaaagaagtgaagtgactttaaaagtcctaagtattcttcagatgagaaaattgagattaagacaggttaatatacttaaaattttaaaaataacatctgtccagggccagagggggaaaaataccaaacgaacatgttgagagtgtctttgttcacttgttcccacttagatatttatggggaaaggtctttagaagactgaagaatatcaacacatctatggtgctatgtatatttattcatgaaatttttgtctgaatcacaaaaatcttgtatttcttttaagctttcaaacaaaataattttatttaaaaatagtttcttatttaagaaaattactaaattatgaagaatataagcaattgtttttcatgatgtatcagccttgtgcttaatttgccattaggaggaaacaataatctctaagaaagctaatttagtattgtagctttttaaaatggattggattatattcccccagtgacatgttaaagtctcaacttccaataactcagaatgtgatgttatttataaatagagttattagagatgtaattagttaaggtgagattgagactgaatccattatgactggtgttcttctaaaaaggtgatgtgaagacacacggggagaatacatgtaacgggaggcagacattggagtgatgcagctacaagtcaagaaacatcaaagcttgaccaccaccaaggaagctaggagggggcatggagggattctcccctgtaggtttctgaggaagcatgaccctgctgatactgttttttagtacagctagactccagaattgtgagacaataaatctctgctgttttgagacaatcagtttctggtattttattgtggcagacctagaagactaatatgttacattgttcatcaaaatatattcactattccagcattggtgtcacaattaagacttagagtaaatataatcaaatgtcatgtcttcaacatccaccatcctctttaaatattttattttatagttctgtattttctaatcattacctctgctctctctctcaatcgttcaaattatatttaagtctttccactccattttgactttgttacataaaaatgcaccctacacacacacactcacacacacacacagacatatgcatagagtatttcagttaaaaatcactatgatcagggcattcatagcttatgttattaaatattatagttaagtagagttcctcaattcaacgtgaagatacaaatcaatttccaagaatgagtatagatgcacaacactaaacatatattttagaatcaacacgacttatcaactcttggcagatgcagaaatcagaggttctttctgtgcctcagggttgtaataaggaatgtcattatacacttatcagagtttcgctttataatagagctgttgttagagacagttttatagctgataaaaatttctgataagcctacttgtagcgtgtctaaaaattggtttgcattattttcctttatttgtccttagagggtggcttaagatgcttctctctgcttcacaaaattgattatcaaaataaaaataatccaatgcatcagaaaattacattgactcaaccttcaaaacatatccagaatctgaccatttctcaagctttcatgctgacagactagactgagccatggccatttctagcctggattagggcattagcctcttaactattctccctttgtgtattcctgcccaaacctcacacacactgatctgttctccatagtatagccagagtggtcactcaaataatttcacttctctgcttaaacccctggaataagtctttatttccactcagaatacaaaacaaggtcttaaaattgcctaaaattatcagaatctcctctcccccattatatatgtgacttcatcctccacaagtctctaccttgcttgcctgctcttccacactgtcgcccctgatgatcccagaaaatgtcaatacatgcctacattaacacagtactggctttttgctctgtgggcttttcttctcccctatagctacacagctagctctcatcctcttcaagttgtcttcgtcaaagagatcaatcctgatggtagaatgtaacagtgttgtcactcactcttcaacccagaacttgtgacaccccacacttgttctacttctactttttcttttatcacattctctttctctctctctttgtgtgtgtgtgtgtgtgtgtgtggtgtgtgtgtgtgttttatgcttagtgtttattatctgtctctctccactagaagttaagctccagagggcataaaatttctgtcttgttttcttgtttagcaatgtatcactaactatggagtccaggacatggtgtattcacaataaaatatgctgctagtgaaacatggttattatggaagaacacattttatgataatcactattacacttaggcgataacactgttgaggggtttaagtaatatcttaattactgacattaaataccatttcaaaatattgctgattgatgcctattaaagtgacaacttgtcatactgcaccacatgcttcaagtataaatagatttgggaggcaacagaaatatcttttcattaattttctatgtacaagtgacttacattagtaaacagaatttaaaaagtctctggagaagcaagttcttctcctcattcgcagaattaggtatgttggtcctacccatgggcgaaagaatgtgtctcaggtctttattcctgttttgatccctgctcccttgctttaatcaattctgccctggcctttctcaatacctggagtgagagatgctcttcactagaagacccagctaagatctgccctagcaggaaagtcactgaaggcctgaaggacaaaaatgataagcagaacttcacttccttcctcaaacagtatattggaaggaaaaatccatgatatctggatttcacacactcaaattccaatgccaactcactggaacctgagccaagatagtctttgcctttatatcatctggaaagttgtatagagaccaaatcttcaaccccagatcattctcatgtatgaagcaggtattaaataaatgccagttactattataattatccttgaaaccaggaatttttgtcctcatttcaatgatttctaaagatgcccactgagtatctgtgttgtttcttggtcaaaccatttcctccttataaatgtcctccacaagccttattatcactggaccaggtcacagacagggttattggcttaggtcctctgcttagaacatgaaaatgcccattctcattcatattctcagtgtagaactgatattaagtcctgaaattctgctgtactgaatctttgctcaagaacagacagctctttcctacgtgaatcctgctttctggacatctggaatcaagcactatactggccggttactttgaaataagctatgatctcttacctttacatctctcactagctgcctggagtcttgtggtatcaaatcattgacctgttcaaagtcactcttagccatcattaagttgataatttattgggattactgtatattgagccacccaacttcttccttaggaaccaggcacattatatttatttatttttttaagtcccagggtgttttccattcctagacttcaacatttttatagcttatgttgctctgttcatagaagctttcatagctaagccttcttaacctatattaacttgataaatctttgtgacaatttttaagatagatgacatacagcctttctgggatctccattcttacagcaaagctttggataaagtattatgtctattaacatataactcctcctgaaaaagcccaaatactgctgagggaagctaacagaaacaacaaatgaccaaagtcaaggtgacattgagttatgcacaatattctataggagaaggataaagggaaaaattaaatcttcaaggtttttttcacagaagtcttccaataggcagtggcatttgaattgggccttaggacaggaattctgatagactgggcaataaagggcattcatgagaagggactatgagcactgaagtgcagagttgtgcaactgtatgacaggactgaggaatagtgaatcataaaacaggttagaaatgagtggtagagaatgactttagatgatgcaatcaaggttgaatatactagttggaatgcttaggattttaaaccttttctcataaaaaagaataactcttgtaaattttaaaatagaggaaagaaaataatatgtttatgtgtatattattttttaaacctctgaaaataatgtggaaggcggaatagaaagactagagactagaaattgtccatttagagagaactgcattatttcaagagagatcatacaagccaaaactggagttgtaataaacagacataaaaagctgaatgagagaattcctaaatataattcatagtatttttgataaagtttaccctgaagtttagaaatccagatggatgtaaatttcatatgagagatgaatcagggaaaaggaaatatgggtagggagagagatgaagatttttggtattgggaagattacaattttatctcaagtttaaagtattgagagacttacaggtgaaacacaataaatagtacaaaataagaaagtatatatctctgcagatatttgaagctatgagtgaaagtgcaaagacaaattgcggaataaaggaataagaattgactaaagaattaaagatgagtggaaagagaggaggaagagagaaagagagtgatgggaaacatctaagagcaaatgttggaggattctaacatttaagtggtcagcatgtgaagaggagtctgtgcataaaactggggtggtagagtagggaaggaaattacaaaatagtggcaccatggaccgagctacatacaaaatgttctgggctgagttgaaaatgaaaatcagaaccatttgttcaaaaaagtagagaaaatgtaccgttacaggtaattagatataaagtttttcctttgttttatggtctttatctaatcattttatggtattttatttgctgtttaatgtcattctatgtaagaaaaattttcaaatattggcataaatactaccatttatctttatgttgcataatgccagctttaatgacaaatataatttaagaattaaacatcaaaattacataattcatatttcatggttcatacgtgcatgttattcttatcacaacagtggaaacactgaagccagtggcttgtataatgcccttacgttgtactcgagtctcactgagctattacatactgtggctccaccaaaagtcaagtccttctgaggtcacacacccctgaagcccacactggatagatctaagggcttcacgaagggcagataatgagtgtctaccactgtctatgtctttatgatagggcgccatcagagtggtagagaagacagggacattgtaacttgagatagaacaataggattaagtaggtctgaaatctgaacttttctgagtccatttatggctgatactaaaaacttggccagaaaagtaaaataaaccaaactgagaattgtcaaaatttacccatatcgttatatcagatgctggcaagttttcctgtaaagaagaacatagtaagtattctgggcttgctatgtgtgacacaacctctgtcacaactattcaactttgttgtcattgtacaaaattagtcatagataatatgtaaaccagtggtctccaacccctgggccatggattggtacctgtctgtggcctgttaggaactgggctgcatagcaggaggtgagcctcctatcagatcaacagccacattagattctcattggaggtgaaccccgttgtgaactgcacatgtgagggatctaggttgcatgcttctgatgagaatctaactaatgcctggtgatctgaagtagagcagtttcatcccaaaaccatcccctagccccccatggaaaaactgtcttccacgaaactggtccctggtgccagaaattttggggactgctgatgtacatgaattggtatagttatagctgtgttccagtaaaattgtctttccaaaaacaaggaatgggtcagatttggcctgcaggctatagtttgccaatccttggtctttttttttttttttgcttgctatttttccaaggtcatgtaccactgagatgggtattcagcaatgaaaatgaaagtatttcaaaaccaaagaactgtagaatgcacaaaaaagtttgtattattaaactatcacaatcactctactgtattctctatagaatgtcaataacactattccatgcagtgactagtgggaatgaaatgcaaataatgaatgatctggaatagtacaaactagcacaacacaaaagcacggggctttcatttgttaggaaggtgctagcagatgtacaggaaagaaaatgccaggattttacttctgatcttattgctcctgtgtgttgggtttcagcagatacagttggccctgtaggaacaccagcagcattcattgctgggttagttccaaatgaggttaattgtatatattttaagtaagttagaacaaaagtgacattatatattgttacaaaagattctgtcttccatgcaaatacttccttggccacaggaaaagggttctgagtgacttttaatgtagtaaagtaacttggagaggtatggttggaagtgtctacatcttacttgtagggtggacatcttctttggtgtttaatagttttaatcagaaggaaaactttttccttatttgttggtttataaaatgtaaatataggaatgaggagtttgaaaaccctgggacataaacattattcaaaaaaaaccctaggatataaacatatgattcaaaatacgtagaaaagaaaaatgatgttattgtgttaaagagttacagctcatatttgaacacttcagggcccaaataagcaagcaggcaaacaaacaaacaatcatagtggtgactggtgcctgtcacaaagtagaccatcaatgaacacttgaatattgaataaaatgatgtgattaggccaggcacagtagctcacgcctgttatcccaacactttgggaggccaaggtgggcttatcacctgaggttaggagttcaagaccagcttgaccaacatggagaaaccccatctctactaaaaatacaaaattagccaggcgtggtgacagatgcctgttatcccagctactcaggaggctgaggcaggagaattgcttgaacctgggaggcagaggttgcagtgagtcgagattgcaccatcgcactccagcctgggcaacaagaatgagattctgcctcaaaaaaaaaaatgtgattaattccactcaatttttcttctaatttcactaaaacgtaaataatactgtagaaatgtgattaatgattttaacataaacataataatttcattaaaaatatgtagatggcatgtttggacataaaatatatctctgtgttccatgcaagatatatattatacttttttcaattgatttcctgtcaactattataatgctatgacttacaataattttctatatgaatatatttctcaaaattcttgtagtttattttaatctaacatgaataaaatgatcaaatatgctttttgaaatattcttaatatctcaataaaacacatatttgcaaaaacatattttgttctgataaaaagtatatagtaatatgtaaagcatgtaaaaaataaaagtaaatattaaaaacaacattaaggttctggaagaattaggttgcatatgtgtggtgtgcatgtatacatgtatttagaataggttgtatacatggttttacattttctcctataggaagagagaaacaattttccatgtcagtatttaataaagccaccatattatgataatagttgttttccaatttttaaaattttaatataatatttaatatatcagtaataattttctaaaattgaaattatattttaatgcttttaaattttttattaacaaataatcctccagaaagatggtgacaacttactctcccaccaatagagtgcctccactgtgactttcctaattcagaccactacaattggaaaaaaaaagactaacaaataggtagttaaaatttgtatcacattttgaatttgatactctgagttgctcttaataatttttgaatatattttactgcatatagtttttatttgcaaattgttttactgttctagtggtcagcattttgccatcaatttaaaagaacacttaataatcatatgtctgtcttgtaaggtaaaacatggctgcatatattttctttaacgatgcttaagatcattttttggcttagaaaggtattacttttagttaatgtactataaaatgtactcactatcaacatttaatttataattttctaattttgctttcacagttaaaaattttcaattttgagattaaataaatactattatttgacccagcaatatcgttactggatatatactcaaaataaaatagttttactaaaaagacacatacatttgcatgttcattactgcactattcataacagcaaagacacggaaccaacccaggtgtcagtcaatgatggactgtataaaaggtggtgcgtatacatcattgaatactacacagccataaaaagaacaaaatcatgtccttggcagcaatagggatacagattgaggcccttatcctaagtgaattaccacaggaataggaaaccaaatactagatgttctcatgtgtaagtaggagctaaacagtgagtacctatggacataaacataggaccagcagacactttggactagtagaagttggggagggagcaggtaggggttgaaatacctacctattggatactatgctcactacttggatgatgggatctgtaccttaaacctcagcatcacacaatacaccatgtaacgaacctgcacacatacccactgtatctaaaataaatgttgaaacttttattcagatcatttaatgttttgttttgcaattctatgtggttattcctaacacaatttattttggcctgaaacgtagagaacgagttttcaaaataaaacaatgcatcaacagaattcagtaaataatctttctctatggactcacaatcaccccttggatgtagttttatatatagcatgtatatctagactttctattctatttccttttatcagcattttctggagcaatataacattttaactacagtttttatgtgttacaaaaacatacacattctcttattgccctttctattcaacactttcttggttatacttttgcactttcaaataatataagttctaagtattatcttatttggccttgtttggaatttctttatacttttcaaatattgtatgtaacattaacagcctacatttctgagtgctcaaattaatatatcacatgtccatttatatacttttatggttagtaaattttaccttttaaattgttctgtatggttttaataagcagtagtttgaactttttgttgcttaatgctatgatttggatatttgtgtctactctaaaattcatgttgaagctcaatcaccagtgctgcagtattaaaaagtagggtcgttaggaggtgtttagaccatgaagtattctctcttctggatgtaattagtgtctgataacagtgcttgatggggtgagttcagcccttttggcatttcttccacatgaggacacctcattctggtgaagaatgaggaaacagacactcattgaacttgctggaaccttgatctagaacttaccagtctccaaaactgagaaataaatacccattctgtggtattttgtaatatcagcacaaatagactaagacacttaatgcattttttccatattttctaaattatatgtaagaaatacatgtacatgtatacataaggcattttgaactgttaatgagtttaatgaaactatctcttctgtttcagcattaagacactgaatattgttgtgagctatttctatattggtatgattaggaaatattaatagatgccaaaaagatttgaagatgtaaatcttttcagaaagaaaaaacaagagataaaatgaacacatttaataaaatatcaattgagtgttaaagtctttttatttaatgatgcagtaaattacgttattaaatatcttaccttgacttatcctttttattcttggaggaaatgcccctttgtcatttaatagaattttatctgcagtgtacatttttaaatttagaagttacaactaaaagtggaataaacataactcaaacactctatttttcctatccattgctatttgagaatatttggttcatgaagctctgattgctctttcttatatccttcccaaataaccagtagaaaaaatagagttatattgctgtaggaaaagaatgacaaattgctagaatatgttccctttttctcttacattttatttcctttgtatgttaaattaaatcacacaaagtcatgcagtttcaaagacgtcagagaaaaggactttgattcaatttaatagagctgtcaccgtaatacagggctagcaatcatgcacttcaaaaagtacacaaaactcaaagaatcatgctgatagaggtggctccacgatgcctcactttgttaatcgcaagaggttgctcagagtgtcatttttttttctagtggtccaatacaaagtgggaaagtcaccagcagcaagggactctaaaattataggcttgctaccttagctacttttctattatggaaataccacatatggtggaaatgatagcactcagtggtctactttggaagcagacaactcccttcatcatttacacatttgttctatattttggcagtgtcacggaaaccattatgtgtaagaaacaggtatatataatggttcaatctttcaagatttttgcattgtagaacattagactatggcctactatatcatttctctacatgaagagattagaccagagtttttataaagattatttccagtaatatgttttagtgactttatacaaccactattaagcagctattttaatgccatttagtgttagatgttaggtgtacaagagtgaacaacacagaaatcatatttatgtaatgcttagttgtttaacctggtgctggctatcattttaggtatctgcacgttcctggaacccaatctttcatggataccaaacaatgactactatggcaacatctgcatctaaattgtgtaaaacaattttaaaagaagaaaatactatagtaaccaagacagtttggaattgggtaaaagaaagacatatggattaattgaaaaaactaagactccagaagctgacccgcatgtataccattgattgatttttgacaaggtgtaaaagtaatttcatggataaggaataagcttttaaacacaaggctctggaacaattgtatcaccaagtttttctattttcctttccttcattgccagataattttaagatggagtctggaaagaagattaattagactagatggtatttgtcagttgagaagttagaaataagttaatttgctcaacaaataagatggttatcatattcatgctaagaaagatcagaaaaaaattcaaataatcactgtgatgaaaattttaggaagccaattcaaaattaactaggattgcctagaagaattaagagcctaggtgaggaattccataagaattttagtggaacaagccattattatgaattttgacaaaatacaagctggaaattgacaaatgtaggactctaatacatcaacatttgctcttcccgatcttctttccacccttgtttattctaccctctaaacactagagatcaattcaaaggactggctttagcctccagctactgaacagctttggttaataagaagcacctgcagaagactagaagacaacaggaaaggggttgtctagtattttctagtctcctccctgtctgttcttattggattacctgtgtcctacttccaaaggccacaccttctgtaacctagaagctttccattttaggttctggtccttctcttacctctgtctctttaggcccaatgctggttttgctgttattggtctcttgagaactgtaaggtccttagttttccttaaactctacccatattttaataagtaattaccatattaaactctccccaaatacccagttagactgtttattcgctgatgtgactctgatcaacacagtggatgaacatattggaaaatgtcaacaaatgccttgcaaatgatttattataatgactaaatgactagaaaggcaagaaaaactggaaggagattaggagatgtaggtgaggtcaaaataaagaatagttgcaatgggaatgaagaatgggaaaagtgaaaagcagcaagattatgtttaaaaagaccaaattttaggttttatttactaataatgaagaatttgtgccctgattatttccaagaggtggctatgggatgaattgtttgagagacgttttaactctgctacatttaccaagaaccttatatgtgagaaatgatgtattaggcattgtatgtgagttataacagataaaccacaagctatcagcctgtaaaagtacaaggacaataccacatttaaatttgtaattaattttatcatggttttaagaaattttgtagacaaaattatatcatattgaatatatgatataccaaatagaatgacttgttctttcatgttactgaattttcagccataaattacacacctaaaaccttttaaacgttggggtaatatatgaagcaaaaacacacaaccatacatacacagacacaaaccactataagtttattgtcaaaggaaaattaatttcactgccacaaagtaacacttgaaaattccacaagatagaatttcttaaaataatgaaaaatcttatctttctggtaaacacaattctttaacctttttccttttttacatccttaccaatttgatagcaattacaaggggagaatagtgatttaaaatacgctttaaagtaagaactgttatatgagaaaactggcttgtcattaatatatcaaggctctgaattcaaattcacagatattatctccttcaatttttgcatagtgcttttgttaaataaaatacttgaaattaacttatattctgaattatataaaatgaaacaaaaaactttaaatttaaaaatgatataccatgccatagaggataggaaatctcaagaaagttccagtgatttcctctttcccatattaaaaaaaatgctaccactgaagataccgttagaaagagtatgttatattgtgttcaacctgacaaagaagctatttcaagaaatgagaataataaaagttatttctaaactttgagagatctgtcataatgaattgaactagttcagtttctgattgcttgacagcagtatagctgtctccaacctactactgtattgatctggtagcctttgtggcagtgcataaagaataaccatctgtgtcaggtacaacagcaggtgccttctcaattgaactggctgctgccctgattacaatgaggctgttcagagcacccggtgaccatgacaggctctttcttctctgtagaaaagaaactcatttctaaaagtttactgaacagaaactgagaaactcaccagaaatcatcagccgttgaggtgccagaatggattccagtgaagacaaagtaagagatctagtgaagggaagatgccggcttgcagtgggaaattcctgatattgcacactaggctgaagttcccatttggaccattctgaagaagtcttgacctcttttttaagagaggtcatataatctgtaaaatatggccaatctggcctaattacagacatggaggaagacgtctgtattgaaagtgctggagttgctgaaactgtataaaatgcaacattggtggtgacttctgaaaaatcaggcactgagcctgtcaatggtggcagattatttttgaagtcatttgcatgtgtaatttctgaatatgtctttaaagtaacatccggataaatttgtaagtttaactcaaaatccagagaactatcacttgggtgaagtttgaacagtgtatgagatcctttacttttttccatgtccaataagctctcttgatttagtacctcagtgggtcccatagttatgccatattgtcttattttcaatagttttaaaatgttttctgatactgacagttcatcagtagtcatttttgaagtcaaatcagaattcatcaagtctgaagagatagtttgtgaagggacaatggataaacaagtcttatccaaacataaattaacatccaaattacttgatagggtaatggattcttccaaggatgaggataaaattgttctttttgcactctttttagaaggaaataaagatggcacttctgtgaatgccactgatggtgttatttcagtagcagaagaaaatgaatgcccagaagtgatagtttgagctcccattagtgcataccagctggctaatatcgctgagttcatccagaatgtctcataaaagtgggactgtttgctatgcaaaacttgatctgagaattcacgagaggattttatttcagtcatagaacatgttgcacatgtttggcttaattctcttaaagaatcagcagcctgtgatttgatgtttgtgagtctctggttgcttgaagcctcagtaatagcctgatattcactgggattgaaggcttttgtactgaaccggtgcagagctgatgagtttaagatggttacctgtttagatataattaccttagcaggaaaaatgggagacatcgaggggctgagcaatctccagtgctctcttcttgaaattaaagaatcagctgaatattcttcaatatcctcttgagcccccctagagacaactggagttgcacttatggaggcagctataagcaggaatccacgggagagtaatgactgcctgtttagctcaatatcagcccctggaatgcttctaattactgaagtcgttggggtagcagataaagcaacagtctgacagttctcaaataataaagattgtgtaggaaaaataaaatctgacattaaggaagacatgataaatggggtccttgctctcctatcaggaaaaaagaaacctagtgtggctgctgaagttcgaataggcatatgtgataccgatgttttgtcctggacaatttgtgctgggtcacgaataccaaaattcaggaatcgagaagaggaaacatctgcggaagaaagaagactgtgttttgctgaaagctctctagtgacaatcagttcttggagtaagtagctttccaagggtgtgctaattcttaatgttgccaaaccagtggttgggagaatgtcgtgcttgacaatgcctgtctgttttggacctacaaaaaggaaaaaagccaaaaaggttagaaaaatgaatcagaaacgaaccactttggcactgggataaatctcaggcaaattgcactggcaccttacatccattatatgtagacaaatatggttctgtaaatcatatttctaataaaagtacatgaggagtttaatgatttcacaaactgcataaatgcaaagattcctattatttacactccatgggagggctaaagttagaacaaatggcattacatagaattgacatattcccaactaaatgactcctttgaataagaacacatgaaaaattacaactctttgtcattgacacaaccaatgaatgtttgacccatcgggttagaaatgttagaaataccgttttacttcctcaataggcaaaatgttctgtttatattagataacaccatatttcaatttaattttttaaaagaatagaaattacatagatgaaaaatagacaaggtacatttctacttagaatacccaatagccttcaaaattattttttcttcaagaattccttgctaagggctacaattcttactctgattatccgaagtggcattggctacatgaagagtaaatttggaatttaatatacaatgtactgtttataatatgacatcacttgatttagaaagttaaagaattggacatgtaaaaaacagcctgaagttgttaaaataattcacaataggaaaataagcacatatcttttatctgagtgttagtcaaataatttgataggaatataaatttaccttaatgactcagagaatatgaagtaaagacacattgatgcaagtagcacaaggcccttttaaaacaaaatgtgctgggattgaggtccagttgtctattcgaatttacacagtggaataaaaactgttaatttacatttttttactgatccagaaatagtattagcaaacaacattgtttaaaacaaaacttaaaacaggagtcataaccaataatgcttaattttacacccctaaaaatcatgtatctcagaaaaaaaaaagattttaataatgcagaaaatatgcttttaccacacaactttttcaaactcaaacttcttaatatcttacccacttctacttaccttgatcaactgggtaagtgtccattatggctggtattctagtagcctttatagatggaaagctgctgaccaaagtctcagaagggggaattgtatatgtctgtgtggaaatgggatctgttctttgaaagatgggagttaaacaggtaattctccttatttcatcaccacaaagaagcccaatggagcaggtctgcaaatgacaattacagtaattaaattaagctcagtttctttgttcctaagagaaattgtaaagtttgttttgagatccatttgcatttccatagacatattggatagctcaaataaaatattttacttgaaaattaaatctccatagtaaattttacccatatttcaaaatggactcaatcctttcaatttgagatatgcacagttgcatgcccaaatttattcttaattcctttaattttaagtcaaaatactatttttacttttgagaatatagttttccaatgaagaatttgtactgtatggtaattaatgtggatataaaaaagaagtcacattacaaattataaaacttttctgctctaaaagtcaaatttagttggaagctaatgtaaaatgcagtatctgcaacagaaaatttgaaaacatattcttgtgatttgcaaattattttagtttgtattggcttgcagtaggaatgatctttatgtgttttagtttgacatgaaaaggctatttctaccatatcctataaaatagctttcacatgaagaaactgtgaatgaaaattgcgataatgtataaataagtataaatggaccagagagatacgtttataaatgtagagttaaaaacaagttatactatatgaatcatttttatttgtaagaaaataatatttcaaaatgattttaaaatactaatacatgtctatttcctaataataaagacatacctaataggcatccctgctttagtgttctaatatttgttaaatattacatctaatttgcagaacacttaagtcttctttcagatgtgggtggtggttgtttcacagttccatattctgtagtcactttcaactcacaccaaaaagttgtataaatgtcagatgattcctaatgttagataattcgcaacaaagaaaagcccaggaccaggtggctttactgctgaaattgatcatacttttaggaaagaactaacaccaagtctttgctattgtgaatagtgctgcaataaacatacgtgtgcatgtgtctttatagcagcatgatttataatcctttgggtatatactcagtaatgggatggctgggtcaaatggtatttctagttcgcaacccaaatgtccaacaatgatagactggattaagaaaatgtggcacatagacaccatggaatacaatgcagccataaaaaaggatgagttcatgtcctttgtagggacatggatgaagctggaaaccatcattctcagcaaactatcgcaaggacaaaaaaccaaacactgcatgttcttactcacaggtgggaattgaacgatgagaacacatggacacaggaaggggaacatcgcacaccggggactgttgtggggtggggggagggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaatttaaaaaattatataaaaaaaagaaaagaactaacaccaattcttctcaagctattacaaaacattgaagaggaggaaattcttccttactcattctatgaggccagcattaccctgacaccaaaactagacaagaacataaaaaaatccacaggcaactatcattgatgaacctagatgcaaaagttctccccaaaacactagcaaactgaatacaacaacatatcaaaaaataatacactatgatcaagtgggatttatcccaggcatgcaaggatgtttcaacatatgtaaatcaataaatgtgacatatcaatcaacaatatcaaggacaaaatccatataagtatctcaatagatgcagaaattaatttgataaaattgaatatcacttcataataaaaagtctcaacaaatttggcattaaaaaatactttaacataatgaaggtcataaatgacaaacccacacctgaaatcatattaaatgggcaaaagctgaaaccctttcctctaagaactgtaataagacaggatgcccactttcaccattgttattcaccattgtcccggaagtgccaacaagagcaattaggaatgagagagaaataaagagcattaaaattagaaaaaaggaagtcaaactgaccctctttgcagaagacataatcttatatatagaaaaacctaaagactccaccacaaaatctcttagagctgatgaacaaattcagtgaaattgtagaataaaaaaatcaacatacaaaatttagcattgtttccatacaccaataatgaactatttgaaaaagaaattaaaaatgcaatcccagtcacaatagcctcacaaaagaaatacataggaataaatttaaccaaggaggtgaaaaatctgcaaggaaaactacaaaacactgatgcaagacattgaagaggacagaaatgaagggaaagacatcccatggttatggagcagaagaattaatattatttcaatgactgtattaaaccattctgcattgctataaagaaatatctgagactgggtatttcataaagaaagtaggtttaattggctctcagttctgcaggctttagaggaagcatggtgctggcatctgcttggcttctaagaatgcctcagatagtttacagtcataacagaagacgaagagggaggaggcacatcacatgacaaaagcaggagcaacaaagagagagagagccagggaggggatgggtaggggacacacactttaaaataaccagatctcacaggaactcaccaactactgcaacaccagcagaaagtgatgagggatccacctccatgacccaaattcctccccccaggccacatctccagcactggggattgcaatttaacatgagatttgggcagggtcaaatattcaaactttatgaatgaccatgctattcaaagcaatctacagattcaaagaaatctctatcaaaagaccaatgatatttttcagagagataggaaaaacaattctgaatttatatggaatcacaaaagattctgaatagccaaagcaatcctaagtaaaaagaacaaagctggaagcatcatactctctgactttaaattatactatgtagctacagtaacttaaagcagcatggcattggtatgaaaacagacacatagaccaatggaacagaatagagaagaaagagatagattcacatattcacagctagctgatttttgatagagataccaaacgttagagaaagaatgctatcttcaataaatagcgcagggaaaactggatactcatatgaagaaaaataaaactagactcgtatctctcaccatatacaaaaatcaactcaaaattgattacagacttaagcataagaccccaagctataaaactactagaagaaaacagagtaaatgcctcaggacattggtataggcaaagatttttatgagtatgatctcaaaagcacaagaaacaaaaaacaaaaatagacaaatggaattgagttaaactaaggagcttctgcatagaaaaggaaacaattgacagagtgaacagataacctgcagaatgagaaaaaatgttttcacacaatgcatccaacagggaactaatatttaaaattttacaaggacctcaaacaactcaacaacaataaaaaatataaccccatcaaaaaaagtggacaaggggcatgaataggcatttttttcaaaagaagacatacaaatggccaagaaacgtatgaaaagctgctcaatgtcactaatcatcagagaaaggccaattaaaactgcaatgagatattatcttacattagttagaatggctaccattaaaaagacaaaaaataacagatattggcaaggatgcagagaaaagggaacccttatatgcttctggtaggaatgtaaactaggacaaactctatggaaaacagtatggagatttctcaaagaactaaaaatagaactacgattcaattcagcagtcccactactgggtatacagccaaaggaaaataaatcattatatcaaaaagatacatgtatttatatgtttatcacagcaccgttcacaatagcaaagatgtggaatccacctatcagtgaaggctggatcaagaaaatggtggtatatatacacaatggaatactagtcagccataaaaagaattaaatcaggtgttttgtagcaatgtggatggaactggaggtcattttccaacatgaaacaacccagacacagaaagacaaatacccacatgttctcagttacaagtgggagctaaataatgtgtacatatggacatagagtggagaaaaataaaaactggagacttaaaagggtgggggaggacatgggggggtaaataatgagaaattacttgtggttacaatgtctgttattggagtgatggatatactaaaatcccagatttcatcattatgccatatagacagtcacgtaacaaaattgcacttgtaacgcttaatttgatacaaattttttaaaagctaaaagagaattttaatgttcacaacacaaaaaagatatcttcaatattatgctaattaccctgattttatcactaacacaatgtatacatccattgaaatattactatgtattccataaatatgtacaattaatatgcgtcaactaaaaataaaagaacaaaagaactataaagtgtctgtgtataaaaacttaaacattaagtggaaaaatatccacagcaaacaaaaacacagggtcaacaggatcccttaccataatggatacagaatgcatgtaaattaagaaaaaagagaaggggccaggcgtggtggctcacgcctgtaatcccagcactttgggaggcccaggtgggcggatcacaaggtcaggagatcgagaccatccttgctaacacggtgaaaccccgtccctactaaaaatacaaaaaaattagccggccttggtggcgggcgtctgtagtcccagctactcgggaggctgaggcaggagaatggcgtgaacctgcgaggcggagcttgcagtgagccaagattgcgccactgcactccaggctgggcgacagtgcgagactccgtctcaaaaacaaacaaacaaacaaacaaaaacctaataggtaccaagatgatatagtaatttctatgaaacatcatgacttaaaaaattattttctttctgaatctatgtttgaggaaaaatatgcaaataagatcttctgaattagagctttatgagaatatggtcatctgctttcttgtggacattgtatagccctctatgtcttcactcaacaaatgtttattgatcaatatctaagtgccagtaactgttgtaattgttggaaatgagctggtcaacaagataggcaaagtttctccattatatactttgtattttaggaaagaaatttgaattaattaatatcaattagtgataagtgattttaagacaaaatatcccaaaatacataataaggaaaaacagcaagggctgttttggaggcagtggccagggaagtcttctctgaacagggatataaattaatgtgagtattttaggaaagagtatcaaaggcgaaaagaacagcagtgcaaaggcctgcgggcaggaaaatgcttaatatatttacacaaaagcaagatggacagttaaagagaataagggaaggccatgtaggtagaaatgaggtcacagaggtgattagaaaccagataatgtggcttctttacttgtttgttgttgaatttggaattgattctgagaattataggaagccattggaatatttgaaataagaaagttctaatcttattgatatcataaaaagcttactgtagataatatacactcaatggagcttggattcgggggaagaatggaagctaaggtatatttgggaagcagggactgatccaggaaagggaaataattagactgacctggagtggaaatggtgaatatactgagtaaagtttgtattcagggtatacgtggaaggcagagcctataatacatgctgatggactagatgtatggggtgagaataaaaagtttagtgaatgatttgtaaatttgtattcctatcaataaaatagaaataaaaattaaagaagacaagcaaatttactaaattatagaagaccagttacagattggaggatagatcacaatttctgtttaaatacattaaatttgagaagcttattggctaccagatatgtaacaagttgaaaatatgagtctctcttgaagcagaattattaatagtttcaataaaataaagtatggtttaaagaaaagcagtgttatcccatagtcctgtctaattttctggtaatagagctagaaaatggcagagcaaagatttttacctaagaagtgaggctccagaacccacacttcaaaccactatactatacttttgatatatgaaacatcgtcaagatttgttatcaatatttctaagctaaagttgattattttaggtaataaagctaaaacaatcttgtactctgacagtctacttaacaaacatcactgtcaattaaatttaatcatcacaaaccatgttttaagatctgggcaaaacagtttctattatctcaatgactttacaatccagtggactgttagtatatttcactctattgacagtaacatttgaagataaaatgttgtggcttatccttattttctacaagaaataaggagtacataatacagaaaaaacccagcatccttcaggtgacttgttcctctttcctgtgtctttccagcctactttgagtggtttcatgccattgctgacctctgtttacctcactaacctctggttattttcagctctcttttttttcaactgtatgtccaattctctctatggtttctgttttcctcattaagatattaacagattctgtgttctataaaagatacataggatatttctctatgtggttatctaacttgattgggagacaaaaggcaaagtaggtggcaaccagaaagtgagaataatattctgaagatatcatttacccataataataaaaaaactctagtaataatcaaatatcaaatgttaagaatactttgctccaaaacatgtaatattgagatatctttgtgctatgttactgggctagataaatattttagtttctaggtttttaaaaagatttttccacacaaaatcagtatgtagggttcatgataataattatagtttttaacagcattccttttgttatgccaaattgatttgtatgtcttttccagcatactaccagtgcccctaggaaggggactatgttacattttccactgaatggccggggctaatatgatggctggcacatactgatgtacttgatggtcagtaaacatttattggaaaaaactaagagaaacatattgaaaacacacgtttatctaagtacatacatatttctttttcccttttgtagataactgtattgaaatgaatattcattaaattatctaaacttttcattctttcctcaagccattctaatgtagctttcatgtcttcttgccactaggactgttatagtgaaattccagaaatcctattgtgctgttaaatacaaagcacagtttttgatcttcatcttattcaaatcatctacatacttaactaccaccttctaaaaaacttggtttctctctaaccttctacctctttctcctattcattatcaatctcctctgctggctccttctctttgtagcctctagtttggaatttatcatggcttagtattcaacttttttctttctccattctccccagaagcaatgtcatatattcaaaaaggctataaagatatcatatattgatgagtcccaaaatcatatctctacttcacacttctctgaaatacatttttatataaccaactgcttatttagaatcattatttaaatatctcatgggtaccttaaacataacatgtacagtactgaactgctgattcagtctctccattctaacatgttcctccaaccacctgtcccatcacaggaaatttattatcattactctattgctgaagtcctccctgatttttcattatcttctatctcacacatctactcaatacaatgtcttgctaatttttctttcataacacatttcaaatccagccttttctctgaatttgctttgccacaaatatcaaaccatcattatcttttacataataattgttagagcctagctggtttcttcactcccacttttaacctccttctagatctttctttatggaagaataggaatattttaagaacctgaataagatcacatcatttcccttttgaaaaaacttgttagtatatatgtcaattgcacttgaataaaattcaaactaattactatttttctgactctcaacctaacctgaccctgtttacttctacaggcacttctgtacttttgcccccaccatagttactgtgctcaactcccattatccactctttactgtcccatacaggacaagatcttttcctcctcatgacccttgtttatgctgatacatctgacagcacatccataccctcactcttcctttggattatttctttttatcacacgggttataacttaaaggtcccttccttagagaaaacttttctactatctacattatttttctatcacagtaactttttcttttccttctgactactatagtttgaattatattttatttttctattgccttgatttatatgtcattcctggtacattgtaaatgtcactaggtagaagcctatctccattccatcctgcattgtattcagcacactatttgtatgctgctaaccaattagtgtttgttgaatgaatataaaattatatttacaaaattgcctctataaattaggttaaagagttgagcaagcaaaatgtaagtatttttacccataactcgtttaattaaaatttgaaacacaggatggccctttagatgcctttatattacaagaaaaacaaccaaccaaatatgagagttcaataggcaccagtcttgagctacaagagtcatcaaccttactctgagaaataagggccacatcatgtgaacagtctgtcttgaaaccagagatgacagatgaaatggaagtgcaattagcactattacactctttctctttgtcctctacacttaagaaacattttccccttttcccaaggtctatcattaagaaatgcttaatgctgctgaagatgagctcaaaagaattggtaaattatttgaaaatttagcaatttgaaaactaagtaagctcaaagccatttaccactatcccatttaaacatgcatcaagaaacattttcccccttttccgagatctttcattaagaaatgtttaatgctgccaaacaggagctcaaaataagtggtaaattatttgaaaatttagcaattggaaaacaaagtaatctcaaagccatttacaaccaccctacctaaacatgtgtcaggtagctcctaggctttagggactaataaaaacagagccctgggtgagtttttctggttgcttagcaagtcactagaggaaaaatgcaagctggtagaagaataggtcctattgcctcttgtgttgggtggacttcctgaggagctatacaaggctaggacattagaatatgtaatatcatggatgctaatcttccacaagatagtgcctccaggttcaaacactgccctacctggtagctctggccctttttgggataactattttaaaccaggaaagatttataggaaaaaaagtgcttacaggacaaaataattagccccatttagcttttctttttcttctgtttcctcctcttcccccacttctactccatcctccttctcttctttcttatcctactgctgctcctcttcctttttcttcttcatttcaagagcataatcccacagagattttgtttccctgagactgatacataatgagttgaagcggaaagagtgaaattagagatcaggagaccccaaagtgcctggaaaacctctgttgcctcccaagagcacacagaacttcgcccttcttgaaaaaatccattagacaggaaatcattcagaattttagaggagtctggtgaagtctctcttagatttccaaaccctgcaggctgtttatcaaaatcttatacagcctcatacaaaccctgtgatctacaaagatgttatctaagactccagaaaggaaagccctttcatgtagttttctatatgtgatagggctcacagaagtagatggtcatcattcaaactggttctgtggaggtgagtcagtggtcagatctgaagaagtaagtgtgatctatgcatgtcttccgaacagagtctatcttaatggattatatagatagtactacagatcacatgaattatccctctgcttaggctgtgtatactactaaagtaaatgaatacctgtgtgtgtgtgtgtgtgtgtgtgtgtgtgtgtgtgtgtgtgttctctgcctgaagcatctaccaaaaaggtggccaagctctcaagaatatatataatgctggtattcttttcttcccttatgacaacttgacaacacacaacaggaattctcattcccctaatctgcattatttctctctttttttatttttgggtggaacatgttccatcaaatttatgtgcttcgctctctgtatctctgtctctttctcttggtttagaataattcatctataatggctcctgagagtcattgcctgggacactgcaacgtaacattgttttatttattttcctaggttatccacaatatcctgtcatgaaagtttaaaatgtcttttcctaggggaggatgataatcatgttttctgtctgataacctaacaatgtatggcccaaacttttcaaaacattttcaagtatgtcagtcaattaattgttaattcaaatcagttttcatctttctcaaggttaaagaggagaataaaatcaaagaccatgaataaaactatgggtccataattttataaatttgtatgaagtctgaagaacatcaagaatttgtgaaattttccacagagtagaagcacacaagctccatctaagttttatggggtgacaacaatataaacatgaaatagtcacttcttctctggtgtctgataattggtagtgaaaactttaaggataattttctttttccttattgaatttggctaccagaacttcaggggatttgcttcaatggcaatgcttctgaaagcacaagttcattgatttgctgtataattttaatctgcagggagatcttctagcagactaaagaatgcaggaataaggatcttaaggaatgcactgaatctcacttttgtttctagtctatccaaaagaaggtgcaataagaagggaaatggaaagcatagctcaggggagaagtcaaggttaatactagagacagatgcgcaggcaacaaatattgctgcagaaagttgatgaggcaagaggtcaagatgcattgttttagaggcaaggtctcaaaagcacattgactatgtatcaaacatatgccagagttatctttcaaaataaaagtctgaccaggtgattcctcagttcaaaaagtcatgactggcttaccactcttcttgaaaacagtaaaacaatttaatctagcacacaatatcaccagctatttcttattgaatattgatttttcttattgaaaacatggtgagaaacttacttaggttacccccaaattttaaatatatgggattttctcgacttttcacaatgattaagtttaattacatgtcaattattttcgatatccatgatcctaatataagaagtgccaatggccttcttatacactaactacatttgtagatattgagttttaaaagcaaaaaaagtttgaatgttaaagttatatgcctgactacggccaagttcatattggaaataccattgtttttaatttaaatttaagtactttgtatttaactccaaatagcaaaatcaagaaattactctgtgtcagtcatcatatcagaacaatttaataacgcataattactacaggtgcaaattatcagtgtgactaatatatatagttatatataacataactaaaactctgtggtcctactgtcaatagcatcctctgaattttttttttctaaattctcacctaattgaaatcaaataccttaaagatttccctgagaccactgtttatgactcaccagtcctagaaactgatatctgatacagaaccctgagtatgtacaagtaaaagagccatgaaacatttcagaagtcaaattgtttgatctttcctactattttggtaagaatacatggaattagcagacactataggtaaattcgtgggtcatcgatgtgaggatcccaatactcaactgatttttgagaactggcaagtagaaatttaaaactttctttttcttaccaccaaatatctataacatttagggaagcttttcttaagtcacagaatgttcaactgactgctcataagaaaagacatttatttcatgaaacatcttacgttcctccattggaaataatgtcctcattctctgaatctgtataatgttatgtgtttacattttatgctgcttacccatttcttttctgtgttataattgttgttttgcatgttgtatctcttctctacgaatctgagtttcttaggataaaaaaaatcttaaatagttgttagaatctaagttcaacaatatacacatattaagtgctaaaatatgtgtcataaaggatatattaaaaaataacataacctcacatctttccattcacactccttgaaagtaacttgcaagctttcctacctgttctccctagaacaatgtctccttgtattcaagaagacttgctacacttgacctcctatatagactattacttgagccaatctgagcaaacaaatttggactgcatacctttattttgccatccatagcatcttgtttttatacctctatcaacacatattagttaatatattatcatttgtttacccatttctcccttggagtattattctataccaacccaaacagccacagttgtcacacaccaatgaatacactgatcattttatacttatctttaactaatttatcattagaaacattaagttggcatcttcattttagaacattaagaacaatgtcttctgaacactttcaagcctctctcattttctacaacatactgtggcaatacatattttctttctcctttcagattgaagtgagtcagccttatagtcagaaagtctttgaagctagtcttcaaactctgggaatgtgcacacagccttctccttacttgggaattcaagtgcaaatgacatgaaaacagttacagaaagtaaggcaaaaccaaatcaaacactatcatacaaggacaccatctaacatccaaaatatatcaaaagcagcaagcaagatatgctgtgttgtacgtcagtatccctgagctgcatggagagcaacaaccaacaggtcttccttcctacgcattaactcttttcttagtttcatttatttttaattaaggggggaaaagcttaaagcaggtggtttctgtatgaataaaaaaaaagactcctaagccaaaagagaagtataaaaccctgccgtttctcagtggcaatgccagaaaaagcagagaaacagagattggtttttatcataaaaaacgcaatagatgcaagttatattttctcccactgccttgccagaatttaattatttctagaataagctagcaggtgtaaaatgcacagttccatttgttatcatgtaagaaccatgtgaagaaaagaagttttggttaaaaaaaaaaaagaaaaaattgaaggcactaagtcttagtctgttcaggctactgcaaaaaaagataccataaactggttgacttataaataacagaaatttatttctcatagatcaggaggctgggaagtacaagttgagggatgtttagtgtcggctttctcacagatggtgccttctaactatgtcctcataggctggaagggactatctagttatctgcagcttttttataagagcactcatcccaatcatgagtacttcaccctcatgactgaatcacctcccaaaagccctacattctaataccatagtcttaggggttagaacttcaacatttggatttgggtgagggagatacaaacactcaggccataacagaatagataagctaatctttatataagttaatgtattctgtgctcaccaaaagaaatctgagtatggctcagagtgaaaagatctagaactgtattttggttgcagagtgaaaactttctgacgtagtgctcatggatatagggtttgtattcactggacaaactacattctaacatttgctatctatgaataagcgaccaacatctctgagcctgtttcctcatcatcaccataggaataaataatgattcttacatcacaaaattgttttaatcattcaatagggtaaagtatccaagacatttagcctggcaaatagttaggcttccttcataaataataacgttttaatggaagcttatggctcaagtgatattttaaatcactctaaatattattgtagaaaacaatgcattatatctttagcagtgtatgatattgcattcaacagactgttccacaaaattcttgtgcttagttgtgattaacaccacaataattgtaatccattcatgttttcgttcatgtataataatcaacaaaattttatttagaatctactatgttgtatctgcctggagaacagaagtaggtaatatgtgcacagttcctgttttatggaacttattgaagaggagaaaagcagaccagagagggagaagggaatagagaagaagaggaagggaggtgagagtagttggtcaaataataaatatatagccacaaaaataattgatgaattacaattttagtaattgctatgaagacaaattataaaatgctgcctaatttcttgtgcgaatgcaaaatggtacaaatattttagaaaacagttgggcagtttctaagtaaacatactgttactgtataatccagtgagtgtgtgcctcgatgtatagcaaacgaattgaaaacatgttcacacaaaaaactccacaagaatattgataacagccttattcatgattgccaaaacttgaaaacaatcaagaaaaactttagtaggttgaacggataaaccatggtacatctggacaatggaacattattcagccctgacaggggctctcatgccatgaaaaaatcctggaaggatattaaatccccattattaagtgaaagaagccaatctaaaagggctatatactgtattacttcaactatatggcatccttacaaatgcaaaactatgaagaccctgaaaagatcaatgattgccagagatggaggggacagaggaattcacaggaggatcacagaggatttttagggcattgttactattctgtatctataatggtggttacatgtcattatgcatttgttcagacccaaagaatgtacaagaccaagagtgaactctaatgtgaactacagactttgggtgataatgatgtaatatagatttattgattgtaacaaatgtaccactctgtcatgggatgttgatagtgagggagcctgtgcatgtgtgtagggatgggtatatgagaactctctgtattttctgctcactttttctgtgtacctaaagctcttccagaaaatagtttaagaaaaaaagagttacctaagcacatgttgtggcagtattatgaggtttacctgaaaaagagggacatatgctaaaacctgaaagatgagtagaattgggatagtgggcaggaaggattggagatcattctagttaaagtgtagcatgtgcaaagacacacagccagaattttgaagggaatatttgagcaactgaaggctaaatagggggctacagtacagggttagaagatcaggaggaagtgaggctagagaagttatcaggaaggggtcaaactgcacacagccttgtagactacggcaaagttgtaggacttcggaatggattttggaatccaatctgtttttattttagagagtagcttaataatatctttgtacagacattgtggctcatgcctataatcccagcattttgggaggctgaagcaggacgggtgcttgaggccaggagttccagacaagcctggcaacatagtgagacctcatctctacaaaaaatattataaaaagttagctggttgtgggaacacatgtctgtacttccagctacttggtaggttgaggcaggagaaccatctgagcccagaagtttgacgctgcagtgagctatcatcatgtcactgccctccagcctgggcagcagagaaagagcttgtctaaatatatatatttagttatataatatattaactatatatagacaataatatagttatttatcttaaaaataaatggatattgcatttagttatctatcttaaaaataaatggataacatttatggcatagaggaaagaacactgatctaccattctgtaagtatgggcatttaaaattctgtgcccaactctccaatgggttaacaatgttatcttcaatatagccaagcttttaattcatccacatgttcatgctgtaagtgaagaaacaggctcagagaattttccatctaattgaagtctaaaatgttaagccattacttttttgagtcaatatatgacattaaatatattctaggtttctaccaaatacattcttccaccagccacattaagcaaaaatctgatgcataaagatgaaaggtgggcattcattatctttaatatctacataggtctatgaggtggtcattattttaccatactccatttaccaataaaaactgctgttgtaagaatttttttttttttttttttttttgagtctcactctgtcgcccaggctggagtgcagtggcaagatctcggctcactgccagctccaaatccccggttcaagcgatccttgtgcattggcctctccagtagttgggattactgacagccactaccaagcctggctaatttttgtatttttagtagaaacggggtttcaccatgttggccaggctgatctcaaacttctgacctcaagtgatccaccagccttggctccccaaagtgctggggttacaggcatgagccactgcaacaagcaagttgtaagacatttagattgtacatcacagctgtgccataataaaatgtaaggcaacttattttaaatattctacttctgaaaatattaaactacatttttcattatacattatacttatttaatacagaaaacttcctcttttcattaatatttatgtctttattctagtttgcaccatctcctcccccaaaaccctcacatatcttgcattacaaaatactgtcactgtgttgcttagaaatgctcagaacacacatccctccatctttttcccccccatagcactcattgctgcccataaacaaattaacaaataaataaacacaataattttgtttcttcccccatgcatcctctgctttttaggtggtagatttcataaaagctaggatcttggctctctgttaccagagcctaattgatctggggagaggaaaatacattttttgtgttttttttgttgtttgtggtaaaacttgtcctgagaagcagatcgagccttatttcttatggctattttatatttagcattctcattagcagtactgagcaaaccctcagggtggacttccactatgtggtgcagattaagtttcagcgcttttagagatacctttctaatccttaggaggaagccattatcttttgtccattgagaaatctttcctaacgactactttactcagagttcgccaattgctttattattttttaatattactaccaaataagcgtcctagctaatgcttttatttccctcatcatacagttttcttcattttgtacccaatgctgacttccttattatcccacacattatttgtctcttccatacagctgaatgttctctttggataacaaactgaaactaattgatttttatattattttaaggatctgcaaaaaatggtgctcaacatatattagagaaaactatcaaatttcacccgaataagagcattattgatttttttagtgcattgcaagaggatgtgagcctgtactcttttccttaatttgaatgtaagactagtgtatatgtatttctttataagttttccaaatacattgttttagtgagtatccaaaagatgtgttttgactgatctaaaatacaaattacttgaattcaaataaggataaatgtcaaaaccacaaaaatatctacttaaaagagcattacgagtttgtctaaaatggcatctttgctttatttcctattaggagataataaatattttttaatagaacaagtcatctcaaacacagaaaacacttggtaaatatttattaataatattgatgactttatcacatgagaaaataaagaccagaaacatagacatacatcaaaatgtttgtctgtcttgctatactggtgtcttctgtgttaggtttattttgaagatgacatttaaaaactgaacaccacaaataggctgtccttctgtagaactcagaacccttttttctcagaaaatagtttctccattttttcttcattttaatacaaatacagcttccacactatataaacatctgtgttttaatttaagggctgtaattaacactttcatcgactctatcatttacaaaacacaataagcctgaccaatagacactcatcggttaatgcatggagatcaatcttgtttggcagaatttcatttactgaggaagaaatgagcagttctgatcaaatgaaaaagagaatgatcatttttcttgaattcttaagcaagtttaggacattcaaaaattgtattctgtcatttaaattcttttacagaacatttgaatttcaaaatgatgtaagtactttaatcttgtttggaatcacttttgtaattggatctgcttaaacaaataatattcactaattatcagcttgtcagagattgtcatagctctaaacattaagaaaaacctgagagttcagacttttaatgttatcttcaaaaaattaattctcagaaataaagaaaaaaacagcttcccatctccctacccagcagggactatttacctcccacatcactcttcatcattaaacaagaataactgtagtaatattaatcctatctaatcctgtaaatatgtagctgaattaacatttttatatgatgacctaattagtgaaacttttaaagtagcttaaataaaaggaatctgggaaaaaagtgccatttttctgaagatctctgagaagaaagatattagagggaagttcaggtgaacataaaaggatttaatgtgaagagaattgctacaaattgttaggtaaaagccttattgctttgaattgtgctttgttgtttcatgttcaattaaaaattcaatacaaacatatttcaattatttgaattatttgaatgttctttacacagattgcatgtgctactgtatcagctggtgtagttagagtacacatgcaagacaatttttaatttttaattttttacatgttaatggagaatctgattgccaaattaatgacttttgaacaatcccataaagccttctagtaactctgaaaaacaagacaaccattcaagttgagatacctgagaagcctaattagaacaacaaaatcctttttttaaaagacacattgaattacatgaatgaaagaaaatccattcatgttttcttaataaatatattcataggtcctttcattctaaaacaatcacaaaattctgggttttggtctggtgtgtagagaatttggaagtcatcattcccatctacacaataagagaaaagctgaacaaactaaaaatcaactcttcttagatttttaagaaaattgagatcatttcccactaaaggaaaacttctgcccccaaacattggagagacagtcaggcaggtacaaagaattatagcttaccagagcagaaattcagaagcagaaacctctgctggagccaaaaccagggtagaaaaacaaactgtaattgatgaaatgctggaggctcagtgtgtacgagcttgagagttagttagaaactacaggggagcccactcttagggaatatcccacactgtaatgaactttatgttcaaaaatgctacagggttctcacagtgaggtttggagaaaaatcccctcatgcttccagcatggagaggagagaatagccattttgaagactcccagagcattctgttcctcttaacaaggcttgtcctcaagtgaaactattttaccagagcttagttgacctgcaggaagggaaatacccaactccagccctgtgtagattttctgtctcacctaagggaatggggtacagagaagcacattcgaaggtcacagaccagaggcacagaatcaccaagactgagacctaattataggactgttaaaggcttaccctctccctacaccttactgccatatcaacagggatcttttataacaacaggagattacaactgaaagaactccacacctcacacttctttaagaagaattttctaatgaaaccaaaatacaacaggcaagatgaaaataaaaatataagacgaaattttgacctctgacacctatggctgtagcatagcaaacacagcctgactcctagccagataaacataaaatgttatgctacaggcctatttatctgagttccttttacgcaatgcatcatgtgtttaaatataaaattacaagacacactaaaagccaaaaaaatagaagagacagagtaagcattgaagtcagactcaggtatgacagggagtctgtaattatcagactgggaatttaaaacaactgtgactaatatgctatgagcagtaataaaacaaccttaacaatgatgaccaaaatgaaaacacgtatacagatgctcctcgacttatgatggggttacattacgataaacccatcaaaagttgaaaatattgtaagtggaaaatgcatttaatacacctaatctactgaacatcatagtttggcctagcctaccttaaatttgtccagtacacttacattagccaacagcttgggcaaaatcattcaaccccacacccattttatattacagcgttgaatagatcatgtaacttattgaatgctgtgctaaaagtaaaaagcagaagggttgtagggatgttcaaaataccatttctactgaacgtatgtcactctcgtacaatcataaaatcgaataattgtaaattagtgaccgcctatactgtgctctgtgctcttaggaatactgcaacgtccagtgttgtcttcgtccttcaggagtttacagtgtttcagagttgacagagaaatgagcaaacgttccaacagaatgtgataactgatgcaatgtttagtctcttcccatctattctagtgctagaatgccatgacttaccccctgtacattgtcaactctccattatggacactgttttcatgttcacctacactctatgtacacacttcatttttagtactaatgcaaatcaatttaccttttttctaattcttataactgctttattcttaagactctctcaagtttgatatcttcctgtgaatgaagtacccatgaagtttcacatttccccatggttgtgatttttattcttttaatatcccatttgcactaaagattagtgggggagggaaaaataaacctaaaaagtgattttctaatgtttttatgcattttccatacctgtatccatttcaatattttatttcaatatttacaaatttaacgtgctacaaatattttatcaaatattttgaatatttgattttctgataattcagcagattattttattttctgttccaattaataatttgcgtgttattttcaaaagtatatttcttaggaatatctaatttagagtaaatacatactgctatagcattggcatgaataacatttcaatgttaaaattctttttcaataaactgaatttcccctatctttagctactcattttaaagaataactaatgcattagcaaaagttgaatctcccttatctcattgtagcatttcacacaaacattatctcttgctatgacaagtttttaaattttgtttcagctttcaagtacttagagaatggttgcaaaactatccatttgaaattaatttagtaaatgccttactaaaatgtaaatgcattatgtctataacattttcttctatttagtagacatgtggtcttataaaactatattttccaagatgtttctatttctaacatatactaatgtatttatccttcagatttgatttttttattaaagaaagagctcaaatattaatagattcatatttcacatgtgaaagaacatataccaggagattaactatttcaggaaattttatagatatttggtagtaaattatttgtttttatgaaaacatatcatatgtaaaataagcattgattttctaagttatttagattcctacgtatctaaggctgcactggcagaagacatagttaaataaaagacacatctcagtattttgctctttatactgactcttcgaggaagacattattggtataatctgaggtgtcagaaaaataacttcttggtaccaactaacttccaatttaagtatcagagcatctgatatttttctccaaagatctatcgcttttgtagcagtaagagaaaatctttttcctagggcaaatccaaaattagagaattctcagagaaaggaagatatctgtttgagctcattcatatccctccaaaacagatgagccctgggaatatcctttaagagggaacagcattggacttaagcccaggtccttctacaattgatttttcaaaatcttgtgttccgtgacagttattgattatttttttctatgtaattccttaacctcgtctagagactcttggttctggtttttcctttctgatctttcacttctgagaaggagtttctagctccatttacacttcccttcacacttgttcatcttttatacacactggccagatgcttgaagtatgattctttattctggcactgactctagtcacctgactataccccatctctaattatttagccttaatttcagtgaaggctggtctaataatgatatttataaatatacatttaaaatttctgataacacattcttaccaattgctgttttttcactatattcatgggctgcggtcagttttaataaaagactgtggtcaaatgctattttttaatagagacatttttaccaaggaaagtcatttctagtgctaatggagttcaggccagttcaaacttgctgaggaagcagatccgtcctcctcggacatacaatatgctgagcccaaccctggaagtagtactatgtccttgggcaaaataaaagttccgccaagaccctgacggtattaagtaattcctccactggcatcctccttccaaatgcattaagacattaaaggccaatacattaagtcacttgcaccttggtgtggatcagtttatcagaatgtttttcttctgaaagaaaggactgagggtgcaagtgatgcacggacaacaagggaaagaggaatgccgagaaaagtgtagcgtgcacagagaaggagagatgcgctgaagattaactactccgaccttatttttcaccatataattttctactatttactgtgtatcaaagagaataaaaaattattacaaccacaaccaccagtaatctttaccataaatccaggtgtgcataaacatgtcgagccaggttcattctccatgcagagttcatgaacacatgagttgggaatgcactcaagctcattctcacagtggtgtccagaccatcctgttcaacaaaattacaaagcagatatgcaatttttaatgataataaaaacagttatgctaatagcctatatttattggcttttactatttgaaataattatgctagatgttttgtacaaattacctcagtgtatcttcatgatcagtttatcaggtagctcttattctatctctatttagttcaagagaaaattaaactcagagaaaataaataatttgctctaaaatcacctagttaagtataaatgaaagtgagtacatgtatgatatgtctcagctcttatccgtggtgccatttaacattacatattcaaatgtctttacttattttactttggaataaatacatggaaagcaatagaataaagacacttaataattcccttaatatgaatcttaaattcagaggaaagcacctactatagatctctagatatacaatgttatttgtgatacttgtagtattacagttagtattttacatttagtatttgttatactgtgattctatagaatataagtattgtgtctacgtacatttggccattggctgtaagaattctcattaaacatgacaatctaaaattttccagaccaaaacacagtttgattgtatgtattttgtttggcttttgctagtcaaacattttattatttccatcatcaacctatcaaccaacattgctaagtattccataagctaatatctcagctatgctttactgggtagatattaggaacatttttttgaaaccattgattctttcccatcagataattacttctaatgaatcttaatatgcctaacatgctagccacaacatcatgttaacctaagtatacccttccacatagggacaatgggtctttacaggcagctctcactgctcactgactatgcttactctaatcacaactttttaacttttctttatttttctatgtattgtccaatagcatttaatctgaaccctggctgttgggaaatgtaaaatttaattattgtttatacttaggaagatattctgattgttcttccctgataaattgtaacaaaacaattaaatacatattttgaggtacttagaaatgatttattgaaacacttcattataagaaacaaatagggcctgagtctaaaagacatggcaatgtccacatcaaacttagaaatagcggccaagagactaaatttatcaaatcttcatccaagactctttccactttgcaatgctctttcatgtgctgggctgattctgcagagatctctactgaagaggctgtaaaaggtgatatggaaaaaaacatcttcacagggtttataaaaagccaatatgactttgttgagtctcacaaacatagttgagtctcacaaacatattattgagcataaaaacatattgcataaaaatacaccctgataaatgctcttataaaattcgaatgcatatgaaacttagtaacattgcttagagatgcatacatatataataaaactctaacaaatactaaaggaatgctgatataaaattcagaatagttacttcagggagtgggatgtccctggagggatatagaggtggcgagaattattgctaatattctatttctcagaacacatggtagttatacacatttattacagtgtattttgtattttttatatattgtatcctcttctgatcgaatatttcaaaatataatttaagcaattaaaatgacatagttttcctttgcttctcatactgtgaagaacatgataaagctttaaaccataagatgggaagtgtaaaagaaaaattgcactgggccagttatacagacaaagaagacttcattcaagagtactgcataggagacagatttttacaatagagtagagagcttgtactcaaccccactaaaataaatgggagcaggaacatttttaaaggccaggtgagctaacagaaaagtaccagggggatgtttgggtgggtgggaatttggtcaatttcaataggccacctgtacttgctgtctcttactgaagttaggcttctactctcccaaagagactgggaaataggggcactatttgtctcgttccagggttacatttgttttgttttgtctttcattgttgttgtttttgctgttttgttttgttttgtttttgagacagggtcttgcactggtgcccaggctggagtgcaggggtatgatcacacatcactgcagcctcaacctcctgggttcaagcaatcctctcacctcagcccccggagtacaggattacatttttgaaggaatgactcccaggtccttgggaaacagcctgagagaagatttacatctcaaagagacagagaaataatttacaactacaagttttctaaagtaaatgctctacgaaaagggagatcaggccctatagtcaggaagaagtctgtctaaagcctagtcaaactgagaaaaacattaaggctgtgttggtcaaagacaacaaacaaggatagaaaataaattagtcaagattcattacaagaaacagaaatcactctagttatttaagcaaaacggacctgaataatggaattagatgcttacaaaattatcagaaggaaggaaagctgtaggagtaacaccaagaaccacaggtatgactttctggaagatgtcccctcagtcaggatcaggaagatgagaaatataaaagcactcttaggatttttgagttcaagagcccattgtgctaatccaaggaaggttgaccaccaggcagctgccgtttcaatgcacctacgcactgaaatagtgactctacagtgagatctgctgcaaagatccacatagctccatgacttttttttaccagaagaatctgctaagacacccagaaatggtctccatcagagccttcagattttaggtatgtttcttactggtggaactcaattatatttgcaactccagttttgaaggattctggaagttgtagttttcaatactcttgcctctgcagtacaggaaaccacactacatgggagtggatactgagtgtcaatcatacccattagtatgaagaaacacgtaagatgaataggtgcttattctggtgtgggacaaggtaatgggtaagaaatgagaccagaataagaaaacataaatcaggcaaataaatatttattggattttttaatgttcagaaatgaaatatattttcttttgaatcttatgtaggttttatgttcattcttaataaggtaaccaaatattcagaaaatagtttggtaactgaaaacaaaaaccaaaaattgtcattagcaatctaggaaaagtaatcaaattattatggtgttaaactaatagtattaacctaatgtctgacacataatataaagtaagtaagtgcataaggaataaatgatttaaaataattgtggtgcaaaataaagacaactttaggtgacacattgcaataaaattggagtaaatttttactaatttttttttaaagacaatcttgctctgtcacccaggctggagtgtagtggcatgatcacagttcactgcaaccttaaactcctgggctcaagggagccaacccacccagcctaaaactagagtgatcttaagttgaagactaaaccaaatctttaaatacattgatatattcagctagaaatattgaccagttttaatattaccattctataacataagttataatactttgagtttatgaatgaaaataaatgtcactacttctaagatttatatattttattttcatttcattttccctctctgcccatagtgatttctatctgatgttatgaatataaaataaaaataaacctaaacctaaaataattttgtctaactagttaatacattatttagtaattggataacataaaattattttctcttcttagtctaactctagaatatgtaaaaaaattttacatgtacaccctcatgaaaatacaatagtatacactcttttatctcataataaggatttctttacttttcatggatcttgatttaaaaaaagattattctgtatctcttttgttctaaatgcagccacctcatcatcgacaataattgtggctactggtggcagatattatctatgtttgtttctctgttttcttgccccaaggatagtgcagcatttctgctacaaaatgaacaatactactttaagggcaaaacatgcatttgaagtttgcatcaccagcaatataacaccattgcacccctgctgggtataaaaagtatctgggcacagtgactgtcccagggattgagaacaactctgagtgaatttgtggtacacaaactgttccctatcactttcaatttgctcttcatgggatagctctgatcacttactgggtgttctacattgttagataacactatacatggtactatttcggctaaaaacacactaagtgtgtttctatttctataaaaaacatctgaatacctatattgatacttcattggaaatgagctcaaaaacccatttaattccctatataggtacaggatgaactctgtgattaggactgtcctaaatgatgttcaggatgtttcttgcacaaagaattcatgcaaagaggatgagtgaggtctgaaatctaacctgagctccacttgtcaagtcttataccttgttggcttggaggaagtggcatatttatataatttttctgcctagagatggtggagggctttatgcttaccatggccctgtcatgactggacaacattggccatcataaatgaattgtactttttcaatatgtgctgaacactccccaaggactgattatgatacaaactctctactaggatttggtgatacaaaaataaacaacatttacaatgtcttctaacccacttatatccaggttaaatttcagtgtgttttgcagactgtctggtggggaaaacagtatttagtttttcaaactgtgctctgttcagaatgttgcaggattcacacagctctgtttgtactaaaatgaagagggaagggagaaaagagataaaaccttttggcatagaggtggagttacccaggatgacaaccatggagttgttgttagataaagacaagagtattttgataattagcaacataatatgaatgtaagaaagatttccacaactgaagaaaatggcaatgatttatagtgtttagccaatttaaagacagaggaatacttgtgtagttttctacctggagctgtgtaagataagataatggcatgactgagatcaaagcctaggaaaaaattttcaaaattatttgaggctttttaaaaatcaatgacagagaagtggacatgtgtaaatgaaatgaatcagtctttgtgtttttctatggcatttaggagaaagcaaattgctgtgaattactcagaagagtgaaaagttttatatttttctaatggaatcttttaaagagaaaaacagattgggtaggagacttcctgagaattctcacagtgtttagaattgctaacatctagactaagctgaaccacactgattgattttattggggaaggcctttgttttttaatgattggtcaattcaattttttactgtagtaagcacatttaacatgagctctcaccatttaacacgtttaactgtgtaatacattactattaactataggcatgatattgtacagatctctagaatgtattcatcttgcatgactgaaactttatgaggagtttctcttcaccaagataacattttgggggaatatgagaaatgatgaatgcacaagtgtcagtgcagacttcttaggtgtgaatcttagctttgccactaacatgttgtgggacattacccagtggttctgggactctgtttccttattagaaaaattaggtaaaatgagatgcccttttctcgatgctatgaaaacttaattagttaatacatctaaaataacatggtgtctatgcagtaatactgatattattattattttctaagcacatacatgccaaagaactcacacatttgatcttcgaaatataaaattcatatacacgagacagaggtgctgaaaaaaggtagaattttcaataaaaattatagagaaaaattagtattctatcaaaatcagttccttttgggggtaaagagttaattacaaagggacagcatgagaaaattttggaggatggtggttaattgccttactgtgagggtggttacacaactttatgcatttaccaaagctataaaattgtacacaagagagttaattttactgtgggaataaaaataccctgaaaccgtggcaaactatgcccattaagaaaatgagaaagggatgaagagtaatctgcaggagcaagattattccttaaataactttaaagggaggatggattggcatgattaagagctatggctggagcagagacaggagtgttggggacgtgtcaatagcattttccaaaaatttgactttttcatttgtcacttagttttcactcccatgactaagttgtgaagagtgtaagtaactctaaagtcaaaggtatcagcagattttgaataacgcctagcaatacaggtggtatcattttgagatcttctgcttcccaatagtgatctgaaaagcagcctgaacaattcaacagcttaaaaatgtcctcatgcttacaagtgaatccagagtagtggaatcaacctacagcaacaaaactaatctagcacctgtaagatgtttattaacatgaaacagaaaatgaatctagtagttacaagatacctattgttatgataaacaaaatttatatgggtattttacttaactgtttctgtagaatttattgtttatgctagctaccatagagtatgaagtgtttgtgggcacaataaagatattttttgcttgaaagaggcaaaatgtttgaaatggtattcatttcttatataagaaaactgtaattttattctacttatgttacctgcaagagttcccattttatgtacggctggctatttcaaaagggaagtacaaagttctccagatgttctacgtgaccaaataaaacctagtactagtaatgaatgttcaaaaaacagagtaggtctctgagtgatgtttaacttctaaatagtatgtgggtgacactcagttgataggtattcactagtttgtatgacttcacataaatcatattagtcctaatactctcatggctattatttccgtggtgggcccaataaccagaagcccagaaccctagggtttccataggctttctgaagtcttctgtgaggtaggtaaatagggactattttttttctaagagatcaagtcctgctatgtttcccaagctggagttcagtggctatccacagatacaatcaaagcatgtatcagcctccatctcctgggctcaagtaatcctctcgcctcaatatagttggaactataggcatgctactatcatgactggctcaataactttttttaagtgaccagaaatatcccctacatatattcctgagaaattactgctgctcaaggaaatttaggcattgaacatccgttttgggttaactgaatgttgaaaataagatgagtggcagaagatgtaggaaaagagcaaaaatctgaagttagagaactaaagaaaaaagaaggaaaaaaatgcatgatcaacaatcacttatatcaatatagacctaaaaggaatatgatcaaaggtagagatggccaaaaagaccaatttttaatgagcagttttcttaatccattcaagactgctataacaaaaataccataaactggatagcttacagaaaacagaaatttatttctcacagttctggaagctgcagggtacaagaacaagttgatgacagatcctgtgtctgtggagagcctgcttcttggttcttagatgttgccttctggctgtgtcctcacattgtggaagggccagctagctctctagggtctactttataaaagtgctaatcccattcgcaagggctttactctcatgacctaatcatcttccaaagtcccacctcttaatactatactatcgtattgttgattagggttcaacacatgaatttcagggagacacaaatatttagacaatagcagcaattattccttgaagaaaacaagtttattcagctcgtccatctctgtgctgacaattgtgggaagaaataataatgtcaatactaataagagctaacattgataaagtacttgctgtgtgccaggcataattgatacaaagatcagaagtatgaggcttacatatgtttagaaaatccatcaataaggtattacactctaaacattaagatttcctgatgaaagcctaagtgcttgctttctagtatcatacaacattcatttcatgtttttaaagaatgatcattgcttaaaacttgattagtagtcaacaatagtattggtggagtggattgtcaaaattgtattatacatacatgtccatatacatttacataaacgtatatattattatatatgcagtatgcttattatttttaaaataattacctggttggcatttgcaaacatatccattgatgtgatcttcacagtctgcaccatgtagacatggtgatgaagagcattcatttatattaatttcacaaaattgaccagaaaatccaggaagacatctaaggaaaaaaaatgaaaacgatatttgtatatattatacacatgagcactatcacttttcatcttgggattccatcattcaaacgtgttttcagagctccaacaacatgtagctgggagccttccttggggtgacaatgagttgaattgtggccccaaaacagtatgtctaatacttaacactaaatatctgtgaatgtgaatttatttggaaatagagtctctgcagatttaattaagtatcttgagatgaggtcattctggattaactcggtgggctctaaatccagtgacaagtgttcttacaagcacagaagacagagacccacaggggagaaggccacgtgaacatgcacataaagattaacattatgcagccctaagtcaaggaacacccagagcctctagaagctggaagaggaaagataagattttttcctagagttttcagagggaacatggccttgctgacactttagttggacttctggtctccacaactatgaacaaataaatttctgttatcttaagctaacgagtttgtggtaatttattatgtcattcctaggaaactaatacagagattatgttattgcatgtatctgcttaaatccaagtgaactgtttgaaaagaaataaaacagaggtctctgggagactcttaaaatggagaaattgggggcatgtcatgaaaggtatgctccataattggaagaatagatatggaaagagtcaataggtcagagactattgtacttcctcttaatttttagggacgctttaataaaaaccatttagatgtcagctgttaaaccatgcttcaagaactgatggaggatccacaatattgattaaagtgcaatgtccatagctatagatacagatttgtcgagtgcctacaacatgcaggtattttatgaatgctaagaatacaaacgtaagtaaaactctgtgtctgccttcaagaagcactgagcccagttgggaaaatagacaagtagccgacacaattatatgataaatgctataatcagcatatagataaatgtatttttatcatggcagagtatacgcaagggcaagaataagaaaagagtgtgagttaatccagaaattgcaagtagttttgaaggctgaaatataatgtgggagagcacagtctggggtgatgctgatgaaaaaggataaattaaataaatagaaattagatcattatacagtattggatcataagttttaccacatatttactgaaaacttattcacaatatataactttaccaaagtcacaagacaagcaaatttgcaaaagtagaatttattggtctgtacttatcagctagccaaatttagccactgtgctttacttgcatacacagttacttaggtgatacaaaaattaagttctgtttttcactgcaactgggtctgcccggctgaagctaggtaacgatgaattttagaccgtccagaatgttagtaactccactgtgctagatccttacctagctgaagactttcttgaccaacaaacaataagacttgctttagggccgggggcggtggctcacgcctgtaatcccagcattttgggagaccgaggcgggtggatcatgaggtcaggagatcgagaccatcctggcgaacacggtgaaacccaatctctactaaaaaatacaaaaaattagccgggcgtggtggcgggcttctgtagtcccagctactcaggaggctgaggcaggagaatggcgtgaaccagggaggcggagcttgcagtgagcccagatcacgccactgcactccagcccgggcgacagtgcgagactccgtctcaaaaacaaaaacaaacaaacaaacaaacaaacaaagacttgttttaactgtgtgtggatttatggatggtctgattttgtactgtgaagatgacatcttcagtattgaattcccactgccacagtcaacctccccatctttgtagcaaaaagaaacccatagcagtgttttttttttttttgagaggaattcatcactagtggtttactcttatatgcaaaataaacttctatgcaaaataaactcaggtctgattttgtcaataatcgaagtgttcattgtctttccttgaatatcataaattgttcttcaaaaatgcattatcaatatatttattttatttatttttgagacaggttctttctctgctacccaggctggagtgcaatgcagtggcccgattatagctcactgtaatataaaactcaaagtaatcctcacacctcagcctcccacataggactacaggtggtgtgcaccatcacacctgcctaatttttgtgtgttcattatataaaatggacattttctctgtgtccattacacaaaatgggtcatgctatgttgcccagtcacattatcaatttatattcttggcagagttatctaaaatgtccatttgtctgcgttcttacctatgaacaatattaacatttattttaattttcattgcaaaggaaaaaaactacttacctaataaagattttttaaaggggatagtttaaaaaatttttaatataatttgtattttgcgataattttaaggataacaaaaaagttgcaagggtagcacagaatgttctcatagactatgtatccagtttcctttattgttaacatcgtacattcacatggtatgtttgtcacaactagtgacacaatattactacattattattaactgaagtctatgtattattgcagtttctttagcttttatctaatgtcttttgtttctgttcaagaatcctattcagaataccacattccatttagttgcatatctccttaggctcctttagactgtaatattttctcatacttccttgtttttgatgacttcgactgttttgaagggcattggtcaagtattttgtaaactatacctcaatttaggtttaatattattcccatggttacactggtgttatatgtttctgagagaaagacatcatagaaaaggctctcatcacattatattaacattactctttagagggaagttgctttgcacatcccacgcttaagagatgagaagtcatgcacacctctttaaaggagaagtgcctatataaataatttgaaataatttctttatatatatttttaaaatcttttctggaattttgagtgaaatggctttgaatctataaaagtcaagttgtaagaaacaatatcttaacaatactgagtttttcaatttatgttaagaaatatgtctccagtgacacatatctttgatttctttcaccgatattttatagttttctacacagagatattataaatattttattagatttatacctaaatgcttcatttttgtttactgttctaagtggtatatttgttttgttttgtgtttcttctttccgatattccagtgttcattactagaaagcaattgacttcagtatgatgatcttatatcctgcaaaccttgttacactagcttattaggtccaagagcttttttcaaaaatagtagagggttttctatagagaaaattatcttctacaaagataatgattgcatctgtagataaagaccgttctgtttcttcctgttcaatctacataccttttatttcttttccctgtcttattgcactcagtaggacttctagtaggatattaaatagcagtgttgtgagaggaaatgtttgcctgtatcaaatctgaaggagaaagggtttagttttcatcattaagaatgatgttagctataagtttttaaaatgtagcctttattaggttaaggagtttaccttttattctgagattttttttgttttttgtttttatttttgtttttgagatggagtctctctctgttgccaggctggagtgcagtggcacgatctcggctcactgcaaactccgccacccaggttcaagtgattcccctccctcagcttcccgagtagctgggactagaggcacacaccaccacgcccagctattttattttgtatttttaatagagacgggatttcaccatgttggccaggatggtctcgatctcctgacctcgtgatccacctgcctcggactcccaaagtgctgggattacaggcataagccaccacacctggcctattcttagtgtttttgacagtttttatgagtggaaattaagttttgtcaagtgatttttgtgcatccattaagatcattatatggttttacttattcatctgttgatatataatcatattgattaaatgatacatgatatgataatgattgatacagtcatgtgtatttttcttgatcaagtgttaaaatagtgaactatactgaatgttttatgaatgctaaggtttgctttcctggaatgaactccacttgctaatttcagagtgtgttaatgcagtcatcttcttgttatttgcaaagggcccatgatttcaattttaaacttttaatgttaaacttttactctttgttccttcaaggttatgtgatgtttacattcttagcttgaatggaggaaagattttgaaaacacttataaaatagaagtgcataacaatttataaccccatgtttcacaaaaatatttacacaatgatctgtaaaaatttataacatggggaaattgtgctacttatattggtattataagcagttttatcccatacgtatttattcactttataagcattttaatagaatgtctgacggattgaaattacttacccaacttgtttatacaaaaggatttactaaaaactgttaaacactactacataatgacactgtcacaccaggcttttaacataagaattgctctgcaatactaggagaaggggcataaaagacaagttgattttgcagcatagcaactaaaaatataacaatgaaagcaactgttaaaaatgagaactcagaacttaacattagagggacccaacatcatgcctccatttagctaattgatacaaaagagttagtttaactgctattaacaggtgacaggagccactctcaaatgattcttcaaattggaaagtactgtcttacaacctgttgttgcagataagaagtaaatgaaatcattttgtatggtttgcagctgtttggataaccacctggcctagatactttcccataatcattctgctagttaccacttattacccaagaccttcctgaaaatcctcctttaggccctcactattgttgctgatactgttcctttgatacagctgcttttatttcacatttattaagcccatcatagtagtatttattttccattattttcttcacttgtttctgttcgttaacgataatgcagagcccatgtctccttgttggtcttttccatgggagttttatagattttaccactccaaaaacagcacttggttcatttattaagataaattatgaggcacataacaaagcaattctccagaattgctttatttgtttattaacaaatgtgtctggtatcatacaaccgaagtaagaaagaataagaagggtacaaaaactgaattttcatcccccacaatctattctattcagaaacctttttttattttttgagatggataatattttaatttaaatgagacttaattcaagttacatacattcactaaattcttatttgcctttgaaatatttacattaaaaaacaattaaatttatattctatttatattacatttataatttctaatatcccatttgctgggctttgataatataattgataggatgtagtttaataattgtcaaggaaggaacgatgttatgactttttatatctgcaaagcatcaactttaaaatattaactctaaatgctcagaagctgagtgtttatttataaacttcactgaagccaagatttctcaagttagaatagttgaaaagtatcagatatgtaaatgacttcatacaatttcagaatcaccacagttcttttccgtgatttatcttcttttttaataattagtgaccacaactacatataacttattttcttaagatatgcaaaaaattaaagtatatatctctgtgaatagtactctattagtaactgatcatacttaatcatgaataggaagcctccagttagaaatctacacacctcggatattacttctgcttaattttatttacctgtgctgtagccaaaaattttgacggtttggaatttttgccttgtttttacataagaaactatagttctgaggaataaccataaaccaaaccaaaccaaaccattttacacttcacttacccctgtgtcctgacctcttctctgtcctggatgatataccagaatatctaactggattcatccttcagatgaatggccatgggcttacaaatttgacatattttcttttttaaaatgttatttttatagatgatattgtaaacttctatgtttctgggaaacacaataggagcatcaggttgataagtaggggatattcagtgaataggcaaagccaatgatctgagcagaatggtcttgattatgagttcaatattatactgcttctcatttcagtatttttattactattcaattgatcacattatatgctctaaatttttaaaaatacaggtattttaaactcatttcattgctttgttgcagagactgtgatagattggaatctaattattaaatgtattttcaaatgtgtaatttaattttattatagtcaaactgcataaagcataatccaaactgaattataaaataagtaattttagtgttgtttatattatgtatcttgaaggtcattttaatttaacatttttacttttatcctgagtaattctattgtcactatcaattatgcatacagattaagaggagttattcttagcaattattgtaacataaaccaaagtttcctgaaaccactttaaaaactagaatattgtctaaataactgttgaaattgtatgtagacatatacaaagatttaggtaaaaaggacattaactacacctgtctccgtagttatgaatgaatgaaactcaaagtagttcctttttatagatgatattatttcgtatcactttttagtaaaacattgctttatatattgatattgacagtatttaaacttcattaatttgaaatgatccatatgcagaaattaagacagagctgggtgcaggttgtttatttagaaggtgatccaagtaagcagaaatgaaggagtggaaagaacaaaacagggaaaaataaaagttaaataagaatgcattatttagcagtttgtcacattgagcaactgggactcagtctgactgcagtagttttcacattctttcatacttttctcagcaaaaaaaaaaaaaaaaaatggagcctaagcccccttttaacccccatcattggaaagttggcttcctcctactctgtttggatctcttgtgcaggcaagctagacagtctatcataaagaaactcatgtatcactataaagaggcccatgtggaaaagaactggagccttgaccaatagccacataagtaaatatagaaggggatctttcaaccccatgtgggtctttatatgattgtaatccagctcgcatcttgagtgcaacctcctgaaatatactaagccagcaccacccagacaagctgctcttaaattcttgactcacagaaatggtgagatgacaaatgcttgtgtttgtttctttgtttgtttgtttgagatagagtcgtgctctgacatccaggctggagagcagtggtgtgatctcaactcacttcaacctccgcctcccgagttcaagcaattctcctgcctcagcctcccaagtagctgggactacaggtgtgcgccaccaagcccagctaatttttgtatttttagtaaacacagggtttacccatgttggccagcatgatctcgatctcttcacctcgtgatccgcctgccttggcctcccaaagtgttgggattacaggcgtgagccaccacacctggcctaaatgcttgttgtttaaacaacagaattttgagggtagattgttatatgcaatacataattatgtacaaaatgaggactaattgaaaaatctgtaaagaagacaaatcagaaactacctcagaaccactgatgaacaaagcaattattcactgattcttattccctactagccatggatagctcataggctaatacgggcaaacttctgggctgatttatgagtggctatcttgtgcgtatactcagtaagataccctagcttccaaaaaaaaaaaaaaagagccctaaggcacaaaagtacaaaatattgaagtgtggtatagtcaatatacttgggaactgtccagcacagctgggatgagatgaaaagcattaaaaacaactgctccacatgccatgtgaggatccccaacctatttcatatgtcaaaaaacatctaagaaaaaatgaagaagggaatttaataaattcaaactacactgagaactttggttaagataatttttctcttctatattccacttttaagaacattcaatataaaagaaattagatttttattaaggggactatttttaagagataacaagcatgatggggatggcattgaatctgtaaattaccttgggcagtatggccattttcacgatattggttcttcctacccatgagcatggaatgttcttccatttgtttgtatcctcttttatttcattgagcagtggtttgtagttctccttgaagaggtccttcacatcccttgtaagttggattcctaggtattttattctctttgtagcaattgtgaatgggagttcactcatgatttggctctctgtttgtctgttactggtgtataagaatgctggtgatttttgcacatggatgttgtatcctgagactttgctgaagttgcctatcagcttgaggagattttgggctgagacgatggggttttccagatacacaatcatgtcatctgcaacagggacaatttgacttcctcttttcctaattgaataccctttatttccttctcccgcctgattgccctggccagaacttccaacactatgttgaataggagtggtgagagagggcatccctgtcttgtgccggttttcaaagggaatgcttccagtttttgcccattcagtatgatactggctgtgggtttgtcatagatagctcttattattttgagatatgtcccatcaatacctaatttattgagagtttttagcatgaagtagttgttgaattttgtcaaaggccttctctgcatctattgagattatcatgtggtatttgtctttggttctgtttatatgctggattacatttattgatttgcgtatattgaaccagccttgcatcccagggatgaagcccacttgatcatggtggataagtgttttgatgtgctgctggattcggtttgccagtattttattgaggattttgcatcaatgttcatcaaggatattggtcaaaaattctcttttttggttgtgtctctgccaggctttggtatcaggatgatgctggcttcataaaatgagttagggaggattcccgctttttctatttattggaatagtttcagaaggaatggtaccagctcctccttgtacctctggtagaatctggatgtgaatccatctggtcctggactttttttggttggtaagctattgattattgccacaattttggagcctgttattggtctattcagagattcaacttcaatcccatccccatcaagctatcaatgactttattcacagaattggaagaaattactttaaagttcatatggaaccaaaaaagagcctgcatcaccaagtcaatcctaagccaaaagaacaaagccagaagcatcacgctacctgacttcaaactatactacaaggctacagtaaccaaaacagcatggtactagtaccaaaacagagatatagataaatggaacagaacagagccctcagaaataatgccacatatctacaaccatctgatctttgacaaatctgacaaaaacaagaaatgaggaaagcgttccctatttaacaaatggtgctgggaaaactggctagccatatgtagaaagctgaaactggatcccgtccttacatcttatacaaaaattaattcaagatggattaaagacttacatgttagacctgaaaccataaaaaccctagaagaaaacctaggcaataccattcagaacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaattttgcaacctactcatctgacaaagggctaatatccagaatctacaatgaactcaaacaaattgacaagaaaaagacaaacaaccccatcaaaaagtgggcaaaggatatgaacagacacttctcaaaagaagacatttatgcagccaaatgacacatgaaaaaatgctcatcatcactggccatcagagaaatgcaaatcgaaaccacaatgagataccatctcacaccagttagaatggcaatcattaaaaagtcaggaaacaacaggtgctagagaggatatggagaaataggaacacttcttttacactgttggtgggactgtaaactagttcaaccattgtggaagtcagtgtggcgattcctcagggatctagaactggaaataccatttgacccagccatcccattactgggtatatacccaaaggactctaaatcatgctgctataaagacacatgcacacgtatgtttattgcggcactattcacaatagcaaagacttggaaccaacccaaatgtccaacaatgatagactggattgagaaaatgtggcatatatacaccatggaatactatgcagccataaaaaatgaagagttcatgtcctttgtagggacatggatgaaactggaaaccataattctcagcaaactatcgcaaggacaaaaaaacaaacaccacatgttctcactcatagatgggaatcgaacaatgagaacacatggacacaggaaggggaacatcacactctggggactgttgtggggtgtggggaggggggagggacagcattaggagatatacctaatgttaaatgacgagttaatgggtgcagcacaccaacatggcacatgtatacatatgtaactaacctgcacattgtgcacatgaaccctaaaacttaaagtataataataacaaaattaaaaaaaagagataacaagcaaatggccagaaccaacctggacaatgaaacttacctcaatctatcaccacgtctacattactctacagtgatcagaaatctcttctcaaggcaaaattctcaattattattgtcagtgtggggagggagctgggagagggagagcatcaggaagaatagctggtggatgctggtcttaatacctaggtcatgggttgatctgtgtagcaaaccaccatgacacacgtttacctttgtaacaaacctgcatgtgtaccacacataaaataaaagtttatggtaaaaaagaaaaaagaaatttttttgttctttttttacagtagcatgctatttctagatcaccttttaaaaaaaagagaatgaatacaactccaccaggcaccctgatggaccaaacccaacacaattcaaatatactgaacttaaggatacactgagcatttcagagcaacccactgtcctgaactgacagttcaaaaatgtataggagtgcattctgagaatacaactatatgatattttaaaaattctttattttatgaaaaaacaattttaaacacaggcagactactttgaactttggatataaatgttgggaagaatgtaggaccttctgaggcagggacagaactaaactttaaacagaactagcttattcctgaaagtgtttagttataggtagatacattgttcctttctaaagaagctatgactagactctctattaaatctaaaatagtgagaatatgaattgtatttacaatagaatacagaaattaataaattaaatgattattaaaatacacgcataatgttgtaatgataattattaagagctgtgaattgtcattcatctagttacctccacaacataaagctcctgtcttagttcagtccatctttcattttcttttaatttttaacatgtgtctttttcattatttgggagagttctagaatgagcaagacatcttgcctgtgttctttttagactatcttcaccctgagacaacaaaatcctccctgacacatctatctcatatatactttgtagtggggggtttaaagccatggcctcaaaatattcaagtgcagtcattttcaagcaattttctctgactatcttttcctctgggttttttgagggtgttaagaacatggtgctgatgtttctacttccctaccaaatgctgttctaatgttaccagttaccaacatattcaagccactcattttgtctttaaccacttgatgtgtttaacagttccttggttgctttagtaaattctttccttgtttacctccctgccccctctagtagattttcagggttgccataagaaagcaccacagataagtggcttgaacaacagaaattcattttctcacagttctggaggccagatgtccaaaatccatgtgtgggcaggatgacaggattggtatcctctgaagccgtctccttgacttgtgagagactgtctcctccttgtgtctttgcatggtcttccctccatgcatgtttgtgtccccatttcctcttttttataaggacaccagccatgttagattgaggcccaccttcatgacctcattttacctaacttaccttaattacctctttaagagacctgtctccagtcacaaccttaaagcaggtcttggaaaattacaaaatcaattttcagaaacttcatgaacatttatgttttcaagcatgagtattatatgtaaatatacatctcttttttcatcaatttgtggcttttaaaatcatgctcagttataagcattatacaaatttttcccatttcttaatatacaaaccttgaaacattctataaattaaaaagcgttttgcagcttttagtgaaaaggcattgcatgggaggcccttatgctaaagattaaaattccttacaccttatacaaaaattaattcaaggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctcattaaactaaagagcttctgcacaggaaaggaaactaccatcagagtgaacaggcaacctacagaatgggagaaaattttcgcaacctgttcatctgacaaagggctaatatccagaatctacaatgaactcaaacaaattgacaagaaaaagacaaacaaccccatcaaaaagtgggcaaaggatatgaacagacacttctcaaaagaagacatttatgcagccaaaagacacatgaaaaaatgctcatcatcactggccatcagagaaatgcaaatcgaaaccacaatgagataccatctcacaccagttagaatggcaatcattaaaaagtcaggaaacaacaggtgctagagaggatatggagaaataggaacacttcttttacactgttggtgggactgtaaactagttcaaccattgtggaagtcagtgtggcgattcctcagggatctagaactggaaataccatttgacccagccatcccattactgggtatatacccaaaggactctaaatcatgctgctataaagacacatgcacatgtatgtttattgcggcactattcacaatagcaaagacttggaaccaacccaaatgtccaacaatgatagactggattaagaaaatgtggcacatatacaccatggaatactatatacagccataaaaatgatgagttcatgtcctttgtagagacatggatgaaattggaaatatcattctcagtaaactatcgcaaggacaagaaaccaaacaccacatgttctcactcatagatgggaatcgaacaatgagaacacatggacacaggaagggggtcatcacactctggggactgttgtggggtggggggagtggggagggatagcattaggatatatacctgatgctaaatgacgagttaatgggtgcagcacacaagcatggcacatgtatacatatgtaactaacctgcacattgtgcacatgtaccctaaaacttaaagtataataataaaaaaataaaaagattaaaattcatgcaaagtattaaataaaaacattcttaagcttcatgatgaaaacaaaacaaaaatagctttgtattcttttctcgttctttgtaaccactaaacacatttagtgtctcattttggataaatgccattggaacacgaagctcagaatctaaggtcagctgccctattcaagaggcttaggacttctggatcctctcattcattaacgacatgacatttctactttatacaaaatattcagttgaaattaaattctccctaaccaggtagggcaggcagaatttgtttttaactccaaagctatatcttcacaatagaactacttggtattagtccattttcattctgttgataatgacatacccaagactgggcaatttacaaaagaaacaggtttaattggacttacagttccatgtggctagggtagcctcacaatcatagcagaaggcaaggaggagcaagtcccttcttgcacagatggcagcaggcaaagagagagtttgtacagggaaactccccttttgaaaatcatcaaatcttgagagactcattcactatcaccagaatagtgcaggaaagaacctccaccataattcaattgcctcccaccaggtgcctcctacaacatgtgggaaatcaagatgagatttgggtgtggacacagccaaaccatatcatgcttataatagtttgccaactttacatggtacagattgcatggtacagtaagaagaccaaatcaatgaatgggttccatgcatcaaaatagcatcagaagggaatctcttgctctctttctctctctctttcacagagacattgtggttgggggtgaatttcactttgagataaaaactgatttcactaacagtttccctttcatacttaaaaaactttactgtgtaaggcagaggtctccaacacccaggctggggactggtacaggtccatggcctgttaggaactgggctgcacagcaggaggtgagcggtgggtaagggagcgttacctcctgagctctgtctcctgtcgcaccagcagccacactgaattctcataggagcgtgaaccctattgtgaacctcatatgcaggggaattatgttgtgtactccttatgtgaatctaatgcctgatgatctgaggtagaacagttttatccccacacaactactccttcctcccatatgtgaaaaaattttcttccaaaaaaccagtccctggtgccaaaaaggttggggactgctggtgtaaggatgagatagctgttactaccactgtgtccacaaaaagaacaatgtagttagactggaaataacatgaagacagaaagattctggctccttgatggcatcatcaagctgctgaaagaaatctggaatcaccaactcttaagtttctgattttggggaaaaaaattaatctgtattgtttgtccattagtcagtttgttgttctggtggttacttaaagttaaaagcatcttgaattataacatttttgttttaaatttcattcgtaatttatctttatatttaacattcatcttaataaacttttttaataattaccagttttcagaacacatagaaatatgatatttgaaaaattatggtagctgagatttaatgtgccattatatattatgctctgtatttctccatggttatatacacatattttcctatacttacaatcgatatattcttttcttcccctagcttataaggttatcctactgtgagtgaagatgagagatatgacatagccctttctgtgctgtgctcttgtctccatatcattttgtccacattatttatttcaacatatataattttcctcttctttggagaaatcataaatgaaatgcttcctgtgaggaaaacttacattcaatttttgagtagccagggttcctgccagagagataacacttgtccagctaatgcattactaaaaagcaaacaaacaacaacaacaaaacctatgtatctattcttttcattctctctaaaacccttctctacattgagaggatagaagaaatgtgctgtgcaccccttcctttattaatagatagtactgggccaggtgcggtggctcacgcctgtaatcccagcactttgggaggctgaggcggacagatgacctgaggtcaggagttcgagaccagcatgaccaacatggagaaaccccgtctctactagaagtacaaaattagctgggcgtggtggcacatgcctctaatcccagctacttgaggggctgaggcaggagaatcacttgaacctgggaggcagagattgtggtgagccgagatcatgccattgcactccagcctgggcaacaagagtgaaactccatccccccccccaaaaaaaaacaacactgaagaaaagacgacttttcaactcctcttagttggtccaaatgcacccacttcctttcttagggagagaagacatgtgcttttatccatagagtgtataattggcatctaaatttagatatcaggtcagtgcaaaagtaattgtggttttgtcatcactttaatggcaaaactgcaattaattttacaccaacccaatactttggaggtttaaagtaagtcttactgttaattgtcctgggccaaaaacatgaataaacaaaaagaatttcagacaaagtggtatgtatggtcatcctacccataaaaggtctatgctctttggatgcttggcatcttttcctctaaggaaatcccacgtggtcctgggcagagttgggggtgagagtaggtgtagggaagtgtgtggtgttaacaatgatttcccaccacatatcccctgatacggtttggctgtgtccccacccaaatctcatcttgaattgtaacttccacaattcacacatgtcatgggagggacccaggggctggttactgaattatgggtgtgggtctttctcctgctttctcatgatagtgaataagtctcattagatatgatagttttataagggagagtttccttgcacaagctctttctttgcctgctgccatccacgtaagacgtgacttgctcctccttgccttccaggatgattgtgtggcctctccagccatgtggaactataagtccattaaacctctttcttttgtaaattgctcagtcttgggtaggtctttatcagcagcgtgagagtggactaacacattctgtaaggcactgaagtgatccaagctgtttaatccaaaaagctagttaatatatttcctgtaattttgtttgctttggaagtgagaattttactcaagtggtatcaattaagttttcttatatgacctgatttttcttttgaattgtagcctaagatacagtgaaggttaccagctgcaattttccccaccatatgtatacagtctacctttcagtaaagtcattatatacaagggagcagagtcaaaagataaataatttctggacgagtcattcctggatccagctgtgcttgaaattagcatcataatggagcatcccagttttatgagccataaaaattctatatatgacttaattaggcagagttaatttttttacttgcagttgacagtattaaaatggcatttttgtcatcttaggatttaaaagaattgggatggagtgaagagggtaagaaccaagagtaagaggaattaagataggagattatttctattgtgaggctgatcatgatgagaatgtatgaattttttatattttaatgtgcaatatgcttttaggaatgcatattctctggagatataaactatattcataagaattattacaaagctaatacattctggagatttatacttatatttaaccattttaaatacactaatatccagagaagtagtagaacattatgatatgaaaagatgatgagcaaggaaattatatatgcatggaaaaatatgtttgcaaaccaattcctgatttcagcctacctgaattgatataaatgtatattttaatgcagttaaaataatggtctgggttctcttacactgcaattgctaactatagctcatgtcatattctcagggttagtgcaatcatttacctgtgccaggcagctctgaataaaaaagatgtacatttactggatgggagaaatttctatatgagcctacaggatgcagcatcagcatgtcagcttcctgaactcttttattagtagttattttctgtgtaaaattttattgttttttaaatctctaatcacatttagtgagtaaacaactagaaataatcacttaccaattcattcatcagaatattattttacatcaactagcctttaagaagtagctaaatttctttggaaaactaaatactgtttaccatttctctttgccaccagactaatagaaagttttaggtatatctcactgctaaaacccaggctgaacactaagcaattgggagattgaaatgaacacatcattatccgagcaatgaaacattgaaaatcagacactggagcagtctcgtgtttgaatcaacaaataaaacagaagcattaagatttcaataaggtgcttaaacaacttaaagcagaacgattttagacaaatcacaatattgaatcctctctgggaacatcagtcctgtatgtaatcatggatctgaaattgacttcatgggaaattcaccagaagaccattttctaatttaacagaaaccaagaaacagcagtatgaaatagtaaaggtgtggaatattaagagtcagagttttaaagttcttgacatcagacggcgtggagatgagtaagatcactgagaattagatatgtgaccttggtaaatgacagatgcttttcatctataaatatccacaagctttttcatctgtaatatttggattacattagaaccaaaatcgtaggtctttttaaagatgaatgtaaataataagtgtaataataaatgaaaaaataaacttattagaatgctgtcagaaataaggctgcttaaatgctagtgattttttaattctctttttttagttctcttttattgctatgattgttgttactgaaaaattaaatttacattattaatagtgcaacaggcatattgttgagatgactaaggttaatctgtctccatttgcttaaatactctaaaagaaatacagcttgctattcttatcacaaaagtatatttttaaatcttttaatgtttctgctaaaatagaaaatgtgttaagatattagacagttacagttaacaagtttgaaatattaatattgaaaaactatactaggaagtaaaaatcatttggggatcctaaattctcagggtagctacacttcttgtgtaacagctatagaatctcagaaaaaagagaatcaagagaaaccggcaggggctacaaggcattttccaacccagtcgtggaagcatcacgtctgccctgttacttcagttgaggcatagagacatatatcgtatttataaccctaaaatctattttgagttgtggatgggctgtcaataaagaataacaaatatacataatcaactttggtaaaatgcttgagaaagggaaaaaatcaaaagtgaatcattcattggattcattatgaagatttcattgctctagacatatgattctgactcatataatggtaaaagagacatttaaccttcttttcccaaatattctcatattataagtacatgattgtctgctttcagatatttatgaagtttgagatatttataagaaaattctttataggcagggcgcggtgactcactcctgtaatcccagcactttgggaggctgaggcgggcagatcaagaggtcaggagatcaagaccatcctggctaacacggtgaaaccccgtctctactaaaaatacaaaaaaacattagccgggcgtggtggcgggcgcctgagtcccagctactcaggaggctgaggcaggagaatggcgtgaacccgggaggtggagcttgcagtaagctgagattgcgccactgcactccagctctggcgacagagcgagactccagctaaaagaaaaaaaaaaaaaaagaaaattcttcataaatgttgagttgcattattcctcatgagcataataatactattaacatgggatgaggtcttggagtgttacctagtttatacttctttgtgacagttatgacaaacatttgtaaggcattttaataaaggtgaagaaagagtagtgaatggaatgtcaaagatgatgccaataaagaggtaaagttgatttttttctaattttccaacttataaaagaaaccacttactgtgtaactgtgagacatattctacttcaagaagtaatatttacataatttaatactgaagtaactgtatgtccgaaaacatctcatataaaaatgtaaattacatcacttgaaaattcttcatatcatgcctatttttatgtaccaaattttagtaaagtacctcctgacaaaagaatttctaaacaaaaatgactacaaacaacagtaatactgagaaaggtcaaaattaatgcaaaaaaagaacatattctcacatgaaaggcagtttttaacacacacacacatattgagagagacagagctagctatactgaatttctagaagttatttaaactctacaagataaaattatcttaatacaggtaactttgttttggaattgttcattatgttcatgaagaatactcaacaactttataaactattaaataaacaaatagctatgtacagattttctatatgtataaatcactacaaaggaaagatgctttatggcactataccaatgattatcactttgtggcaagattatggctaatattttttatttgtgcaatcctttaaaaatattctgataatgaacatacattgtttctatagtcagaaaattacatgataaattatattaaaactcagttaaataaagaaaaaaaacgctagtattcttcaaactttttttctttaccagaggttttacttcaaacggcatttgttattctttattggcaaaattgttcaaccgactccttataggtaggaacctttttgcttatttaacctccagttggtgatcataagggtttatagaatgcatgagtgccttcatgaataaataaatggttttaaggaaaaaacatgcttccgtaagaaaaaatatctaatttcctgacatttgcctactaataattgatgtggtcatgccaatcgccctgtgaattacagggtaattataaccattgtatagccagttatgcttaaatggctgattaattaatcatgtattttgcatacaaatcttgtgttctctggatccagctaggtggtgtgttctctcatacactcatagccttatgatggctggcactgatgttatctcacctacctggtatttggactgaaaagactaaaaactaggggcagaaacagctgagctccttgccctccccctggtcttactagtttctctttgtcatggcctcgaggtaaccacactgcttgtgtgacaaccatagactcccagaaaaagaacatcaagaaaaactggcagaagctataagctgttttcctacctagccatgaaagcatcatttctactctattatttctgtctctattggttgaaatgatcataaaattctgtctgtgtttaagagagtgtcatagacataacttcttggtaagagaaatatcatataatttggaaatatggtctgaaaccactacaatctataggttaaagtacaacggcttaagggcacttaaaaaactgattgataataaattaacacagtacttctaagagtgcataatctgagtcaaatcatgtggaaatgtcagataaaccaaaattgaggcaaaattacaaggtaaacgatttataatcatcaaaaagtaaaggtcataaaagaaagatagactgataaaccgttcagaaggtacaactactaactataatttaggaatggattctggagggggaaaagtagaaatggagaaatagctaaaaataattttattgagataatttatgaaatttcagtaaagcttgtggattagcaaattgttttacatggagtttaatatcttaattgtgataatttaccaaggttatataattgaatattcataggaaatgctgaagtatttaggggtaaggctctgaatgtctgcacattttctctcatggttcaggaaaaacttgtaggcacttgtgtgtgtatgtgtatactttgcactaccttatatatacagaaagaaaggaaaatagaagaaatgatttagaagatctaacagttaagaattgatgagtccagatgaagagtatacaagcatttttttgctcttactgtaattttcctgttatgtttgaaattataacaaaatttaatgaaaaaagacactttaccatcataaaacttttccagcaacacactcaacattccagatttgccactatttaattttgaattataagcatatttgttaaatccatacttgtaactttaataatatgcttacatataatattaggactccatatatttctataactgccttttttttttgagatgtagtcttgctctgtcacccaggctggggtgcagtgccacgatctcagctcactgcaacctccgccttccagggttcaagcgattctcctgcccctcagcctcctgagtagctgggactacaggcacctgccactacacctggctagtagtagaaactttagtagagatggggtttcacaatgttggtcaggatggtcttcaactcctaacctcatgttctgcctgcctcagcctcccaaagtgctaggattacaggtgtgagccaccacgcccagccaactgctttctttttatagaaatcataattgcttctcatttttgtttgctttgttttctattttaccatcactaatttatctgacaaatatctcaaagacatgacaaatcaatgtccaagagaaaaatttgagtatctttctttcagaaagtgatggaacagtgaacaaaaaattaggatttttaatgtttataatacattattaagaaatttgatctcataaatatatatctagaaccatggcccaaggaaatagaatatattttgtgagggtaccatggactactcacagaaattaaccagtttttaagcctcaaagaaattttaataattcccccaaaccagaaatcatcatttagaacaaattttaaaatccaaatttaatataatttgatatctaacaaaatttcacagctaacagaaatattttcattgggaattttagaaaatactgttaagaagttaatgagttaaagagaaaatataaatttaaatgataatctagatatatagccatgcaaatactacatagcaaaaactctggtttaatcaaacattctcagagaaaattcaaagtttttaatgcatctataagaaaatattaaaaattaagtaaactaaatctttaagtagctacaaaatgaataaaataagaattaaaattatattaataaaagtggtaacacattaatttaacattaatttaaaaatacttaacaaaacctagatttttagttgttgtatttatcccttgaacaatgagtagaaaacttttagccagtgtgactaaaaacaaagagaaaccccaaaaagaaataaataacattaattacatgaaagatgagctggtgaaaatgtggattaaatgaaagattcataggagaatttaactttatacagcagtatgcttataaacctatactaagtgaatgctttttcaaagaaaatataaacttacaatattgttttgaggaaagggggaaaattggaaagcacaaattgtcagagaatatagtaaaaattttgactcctacagtcaccaagcctgagctctagtatcatgtgtactataaaaattttaagaaatatgtaaattcatgttgtataaactgtctcagaacatagaaaaaaggtgcttttcacatctacctacaaacctagagtaacctgatattaaaataattcaggtaagcacatgtacccactaaataaattatacacatatctttgaaaatcatgaagaaatcacaaaaataccacagcaatatattaaaaataataaaatataaaaatgtatcttcacgtttattgtttgactaatagaagaataaatacaaccttattgtctggcaactccttaatgagttatgatttacctatattatgaaatattatattgttatcatgaaggagccaatttaactattcgtgtagacagattccccaatatggttaactaaaaaagccagtaacttaaaaattggtttcaatgtctttctaacctaaaaaaaaggtccacatgaatattatagatagataaatgcttacagaaaggatagaatggttacgtatcactctgttaattgtaattactctggaaaaaagactaaatagttgccaggagaaagatgttattttaagaaatattatagtctacagttctatattacttgaatgcctcatattgagaatgtatctgtatatatgtgcagttcaaaaattatgtttgtttttgtttttttccaaagtacctaaaaataagccattagattagagagtagattcatgggaataatcagagagggagagggaagagagaatatgaaagataataaagtaaaataaatgaggaagggaaaatacagggcaaaaaacaaacttgtaaaaatattcataaaggctaggcacagtggcttacgcctgtaatcccatcacatcgggaggctgagacgggagaatcgcttgaacccgggaggcagaggttgccattagccgagaccgcgccaccgcactccagcgtggtgacagagcgagactccgtctcaaaaaaaggaaaaaaaaattcataaaatacatatcagagaaaagttcaatattgttataagagattttatatatcactgagaatggaaaattagaacaaaatgaatatgaacataaagaaagacatattagtgaacaataaacctaactcaatgttttctcttatttatcattttgataatctacagttacataaagtaagataccaatctttatcatattgcttatcaaaagattttgctgttattgtttaatgttgagataaagttctgttaattggcatacactggcatacaggcactccaagtgtactggtggaagtgaaaattagactttaacaacaggttttaaaagcttacaaaaatttgcatttactttgagggagcaatttccctgccaagaacttattttaggacagttattctcaaaaacacaaagatgaactaatgagatgatttttagtaggcagaattctaaggtgacccacagtcatgtatataatcttctcttaagtataaatgaagcctactaatattatgaaatgtcactttgtgatcaagttttatggcaatagagaaattaactgggggtgggccttaatctaatcaggtgagctcattaaaaacagtattttctctgatggggcacagaaagggcagaaagattcattctggctggcctagaaggaagcaataatttgcattgtgaacaagggggcaaggacctaacgatgcatctaagagctgaaagtattttctacctgacaaaaaatggaaacctcagtcctacaaccacaaggaaatgaattttgccaccatccattgagcttggaaggaaaccctaaggcctagagagaaactacaaccccaacaaacactctgattttagcccagtgagactctggacagagaaccagtcacgccatgcctgaacttctagtctacaaaaactgtgagaaaataaatttgttttgtttcatacttctaaatcagtgataatttgttatgcagcaatatgaaactaataccatattcatgaaatcgtcatttatgatagcaagtaaatggaaacctcctctacatgtagcgataaagaacaggtaagcaaaatatgacatactacacacagcaattaactctcatgtttgcaaagcctatttacaaacttcgtaagaactatgtataaaattccgtgtgtgtgtacatatgtgtgtgtgtgtttgtgcattttacatacattcgcacagttttgcattgcatattattcattaggggttgaattctgtctctcagaaaaggatatttgaagtcctaattctcagtacccccgtatgtaacgttatttagaaataggatctttgccgatgaaagtaagatggggttattagagtggactctaatgcaatctgactggtatccctaattaaaatcagaaaattgggctaaatggagagaaatgcaccaagggaagactatctggacacagggagaccaccatctataagccaaggaatgcctgatgctaccaaaagctactagagaggaaaggagctttcccttacagttcccagcaaaaaatcaaccctgataacaccttgatttcagactagcaccaaactatgaaacaataaatttattttgtttaaaccacccagtttgtgatagtttgttatggcagccaggaaagtaatatagatacctctatgttcatgtagatggaattgcaacaaaatttaacagtgactgtctcagttattgggaatatattaggcgggttaatactcaatttttaatatttggccacatttaacctataaacgtggcaatttgacatgtttcagttcattaatttcttctatattttttgtgctcatcttaatttttaattgtctttcttttcatttttttgagacaggttcttgttccccaggctggaaggcagtggcgtgactgtggctcactgcagcctcaaccttttgggctcaagcaatcctcctgcttcagcctcctgagtagctgaaaccacaggctcataccaccatgcccagctattttttttttttttggtagagatgaggtcttactatgttgccaaggctgatctcaaactcctaggcttaagtgatcatcccgcctctgcctcccagaatgcttggatgacaggaatgagccaccacacctagcctcctctaaatttttgaagttttcataatatgtgttatttccatagccaaataaatttgataatcacaaaaagtagacaaccctcttcaaataagcaaatgttggagattatttatattcataaagatgttaaaccaagatgaattgctaacttgaaaatcatttcctttcctatattcctttttctgcattcagtctcttcatatttaccttaagatgttttatagtttatgcattatttgtatatgtcaggttttaaattgaaatattagaaacagacattattggaaacagcagttttctgtttctactagagcaaaataactaatgggagattaatattaatagactatgcactgaatttttcttataaaagttcaattgtctaataaattaatgatacctctcacttttacaaataatatgcatatctctacttgctagtgttgatctgatcattcaataatcatttaaggattcattgaaatccaaaaattggctaagaaacatgctactgttgtctagagggaaagacaggcatcaaacaagcaattacaaaaatgtatggttagtcttataatgggaaacatgaattatatggaactaaccaagtcaaaggtgagaaaatgccctctgaggaagtgatttgcaaggtgaagttttccgatttggcaggataagtaggaccaagttgcagagggagctggggcttgcactgtatagaatgattaaaaatagaacaaatgttgcttgacaaagttctgtgattttagttacaacacctgaaaaatgttatgatgctattgtcttttaaatacatgatttcttttgacatgaatcctgattttttagaaatattttcaaatctgcattttctgtcacgaataaatctcattaactgctccactccaaatggccacttctgtcactgcaaatttatatagggacagctatacattattaacaagctatgaaaagtcaccggctaaatgtcaccaaagctgaggtatagctgcaccttgggattcatatagcaaacagtttagttttaatcatcccggaccacaggatgtcttgacatttgagcagcaactttttcctctttaacttgcactggaatcagacctctattatctcagccataatttttagcttaaattgtgatagaaagttttaccttctaaattaaaaacgtgaaaaaaatcgatccatcaaagaacttatcattcatgtaatcattgctcacctgcagccctcttcctcttaacccccactccaagaaaggtgatcaaggacagctataaaattcaaacatctttagacctgccagaaattttttgagctaaatgcttttctgttacattaagacctacaagaaatgaccttgctgaactgcattaagagagatgattgattttaccgtgaaatattttttattttgataaaataagtaggtttcatatttttaaaatatgcttttgaatctttttctgctcaaagtctaataatgttatcaggatatcaatctttgatgcctacaaagtgtctaaatttattaatattttataaaaaatatctaatgcatattatatatttgagtcttcttaagatctatcattttagcccttcattgtggagcattcacagtaattaacatagtaattagaaaaaaagggaaacagacatatcaataaagataatgtttgctatatatatgtgtcttataacctcatgctgtataccttaaaatggtcatcaatacaatactacaaatgcattacataacctgttctgaacaaatatgactggcttactgataatttttctatatatataataagtcatggataagcaattattaaaaaagggcttattgtcaaataaattggcttattggtatctatcatacagctcttactttatttaataataaatatcatatggtccataatgaatagtatagtgaatgcatacatcaaaataaaagtagatgatggaatttaaaacaatgatcatagcattgtttcttaactgttttatgagttaacacctaaaaatatgtaaatttataatatgtcttctttttatttcaccaaaaaatacatgtgatggaaaattgtctatggttgtcttcacctctttgaaaagttaacagcatcacttttatgtttgcttctattttctctattttatgaacaacattcaagtagtatttgtcaattacctattatgttatgaggtattgtaggtttcatacagtgatgagcaccatggacaagatctttgtagatattacaatcaaatacagagagaaaaattagtatcacagaaaaaaaaataaatgctgctatgttttacgatggtgtctaatgagagatacaactttattgagtgggttggtgggaggtggggaaagaagattttcccatacctgttcttttgagagtgagttaggggagcattagcaattattcttgaataacaggcttaactcaggcacatatttagtcaactaaccctacaaccttgactgattgatggagaatatggtaggtcttgagaacttttccaagacaggaataccttagttgggagtctccagaaacagaccttgagcaaaaagtttgagtagaagtagttttttaggagatataaaacacacctaaagttgagtaagttggtagatgaaagagaatgtagaaaatgaaattaaatcaactattaaagtgggtgcttagaggttattcccctaggaaactctgatcaaccgtaaaaaacacacacttcagaattatcccacctgatagactaagaaagctaaggtgtgtatacccaaacttccatcagtaattgttgggggctgcatcctggattgggaggatgagaaggggaagggggttaattcaccagaatttctgttctgctttgcatgaaagtagtttctgaaataaacaagctcataaataaatacacagtttgctggaaattggctgtaaaaggttgaaatggtaggatgagaggagtaggagtgatagccacccattagacaacagcatgacagagtgagctaaggtatttgcatctattaagattatcagtctcccattattattgtgtgggagtctaagtctctttctaggtctctaaggacttgctttatgaatctgggtcctcctgtattgggtgcatatatatttaggatagttagctcttcttgttgaattgatccctttaccattatgtaatggccttctttgtctcttttgaactttgttggtttaaagtctgttttatcagagactaggattgcaacccctgcctttttttgttttccatttgcttggtagatcttcctccatccctttattttgagcctatgtgtgtctctgcacatgagatgggtttcctgaatacagcacactgatgggtcttgactttttatccaatttgccagtctgtgtcttttaattggagcatttagcccatttacatttaggcttaatattgttacgtgtgaatttgattctgtcattatgatgttagctggttattttgctcattagttgatgcagtttcttcctagcattgatggtctttacaatttggcatgtttttgcagtggctggtactggttgttcctttccaagtttagtgcttctttcaggagctcttttagggcaggcctggtggtgagaaaatatctcagaatttgcttgtctgtaaaggtttttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccccttgtaggtaacccaacctttctctctggctgcccttaacattatttccttcatttcaactttggtgaatctgacaattatgtgtcttggagttgctcttctcgaggagtatctttttggcattctctgtatttcctgaatttgaatattggcctgccttgctagattggggaagttctcctggataatatcctgcagagtgttttccaacgtggttccattctccttgtcaatttcaggtacaccaatcagatgtagatttggtcttttcacatagtcccatatttctgggaggctttgttcacttctttttactctttttcctctaaacttctcttcttgcttcatttcattcatttgatcttccatcactgataccctttcttccagttaacaaatcggctactgaggcttgtgcattcgtcacgtagttctcctgccttggttttcagctccatcaggtcctttaaggacttctctgcattgattattctagttatccgttcgtctaattttttttcaaggtttttaacttctttgccatgggttcgaacttcctcctttagctcggaagtttgatcgtctgaagccttcttctctcagctcatcaaagtcattctccgtccagcattgttctgctgctggtgaggagctgcattcctttggaggaggagaggtactctgatttttagagtttccagtttttctgctctctgttttttccccatctttgtggatttatctacttttggtctttgatgatggtgacgtacagatggggttttggtgtggatgtcctttctgtttgtcagtttttcttctaacagtcaggaccctcagctggaggtctgttggagtttgctggagatccactccagaccctgtttgcctgggtatcagcagcggaggctgcagaacagcggatattggtgagcagcaaatgttgctactggatcaatcctctggaagtcttgtctcagaggagtacccggccatgtgaggtgtcagtctgcccctactggggggtgcctcccagttaggctacttgggggtcaccccactgtcaatattagacagatcaacgagacagaaaggtaacaaggatatccaggaattgaactcagctctgcaccaagtggacctaatagacatcttcagaactctccaccccaaatcaacagaatatacattcttctcagcaccacactgcacttattctaaaattgaccacatagttggaagtagagcactcctcagcaaatgcaaaagaacagaaattataaactgtctttcagaccagagtgcaaccaaactagaactcaggattaagaaactcactcaaaaccgctcaactacatggaaactgaacaacctgctcctgaatgactactgggtacataacaaaatgaaggaagaaataaagatgttctttgaaaccaatgagaacaaagacacaacattccagaatctctgggacacattcaaagcagtgtgtagagggaaatttatagcactaaatgcccacaagagaaagcaggaaagatttaaaattgacaccctaacatcacaattaaaagaactagataagaaagagcaaacacattcaaaagctagcagaaggcaagaaataactaagatcagagcagaactgaaggaaatagagacacaaaaaacccttcaaaaaatcaatgaatccaggagctggttttttgaaaagatcaacaaaattgatagacctttagcaagactaataaagaagaaaagagagaagaatcaaatagatgcaataaaaaatgataaaggggataccaccaccgatcccacagaaatacaaactaccatcagagaatactataaacacctctaagcaaataaactagaaaatccagaataaatatataaattccttgacacatacaccctcccaagactaaaccaggaagaagttgaatctctgaatggaccaataacaggctctgaaattgaggcaaaaactaagagcttaccaaccaaaaaaagtgcaggaccagatggattcacagccgaattctaccagaggtacaagcaggagctggtaccattccttccgaaattattccaatcaatagaaaaagagggactcctccctaactcattttatgaggccagcatcatcctgataccaaagcctggcagagacacaaccaaaaaagagaatttcagaccaatatccctgatgaatatcgaggcaaaaatcctcaataaaatactggcaaactgaatccagcagcacatcaaaaagcttatccactatgatcaagcaggcttcatccctgggatgcaaggctggttcaacatacacaaatcaataaacataatccagcatataaacagaaccaacgacaaaaaccacatgattatctcaatagatgcagaaaaggcctttgacaaaattcaacaacacttcatgctaaaaactctcaataaattaggtattgatgggaagtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattttatatctagaaaacccgatcatctcagcccaaaatctccttaagctgataagcaacttcagcaaagtctcaggatacaaaagccatgtgcaaaaatcactagcattctaatactccaataacagacagacagagagccaaatcatgagtgaactcccattcacaattgtttcaaagagaataaaatacctaggaatccaatttacaagggatgtgaaggacctcttcaaggagaactacaaaccactgctcaatgaaataaaagaggacagaaacaaatggaagaacattccacgctcatgggtaagaagaatcaatatcatgaaaatggccatacagcccaaggtaatttatagattcaatgccatccccatcaagctaccaattactttcttcacagaattggaaaaaactactttaaagttcatatggaaacaaaaatgagcccgcattgccaagtcaatcctaagccaaaagaacaaagctggaggcatcacactacctgacttcaaactatactacaaggctacagtaaccaaaaagcatgttactggtaccaaaacagagatatagaccaatggaacagaacagagccctcagaaataatgccacatatctacaaccatctgatctttgacaaacctgacaaaaacaagaaatggggaaacgattccctatttaataaatggtgctgggaaaactggctagccatatgtagaaagctgaaactggatcctgtccttacaccttataggaaaattaattcaagatggattagagacttacatgttagacctgaaaccataaaaaccctagaagaaaacctaggcaataccattcaggacataggtatgggcaaggacttcatatgtaaaacaccaaaagcaatggcaacaaaagccaaaattgacaaatggtatctaattaaactaaaaagcttctgcacagcaaaagaaactaccatcagagtgaacaggaaacctacagaatgggagaaaatttttgcaatctactcatctgacaaagggctaatatccagaatctaaaatgaactcaaacaaattgacaagaaaaaaacaaccccatcaaaaattgggcgaaggatatgaacagacacttctcaaaagaagacatttatgcagccaaaagacacatgaaaaatgctcatcatcactggccaacagagaaatgcaaatcaaaaccacaatgagataccatctcacaccagttagaatggtgatcattaaaaagtcaggaaacaacaggtgctggagaggatatggagaaataggaacacttttacactgttggtgggactgtaaactagttcaaccattgtggaattcagtgtggcaattcctcagggatctagaactagaaataccatttgacccagccatcccattactgggtatatacccaaagtattataaatcatgctgctataaagacacatgcacacgtatgtttattgcggcactattcacaatagcaaagacttggaaccaacccaaatgtccaacaatgatagactcaattaagaaaacatggcacatatacaccatggaatactatgcagccataaaaaacgatgagttcatgtcctttgtagggacatggatgaagctggaaaccatcattctcagcaaactatcacaaggacaaaaaaccaaacaccacatgttctcactcataggtgggaactgaacaatgagaacacatggacacaggaaggggaacatcacacactggggcctgttgtggggtggggggaggggggagggatagcattaggagatatacctaatgttaaatgacgagttactgggtgcagcataccaacatggcagatgtatacatatgtaactaacctgcacgttgtgcacatgtaccctaaaacttaaagtataataaaaaaagattatcatttaaaagtcccagatttagtttgcttatagacttttgtccagtagagatgcaaatactttctgttcagaagagaaaaataaccccaaagttataatttattgtcccgtgggacagcaagcagatatgcatctcatccagcaaatattattctgaaatgcctttattaaactcccagtgaatacacaactcttcaaatgctctctagtctgtttgtataatagtttgtaatttcaaactattataggctaaatcaaatttagccttgcttcgctcatagattttttttgtttagactatgttttaggttccaggttttgtataacattttacataatatattgagatagttcctactcttatttttgttttataaatgagaatgattgtgttttaataaggttaagtaatttcccaagatcacgcagttagcaaataatggatttagattctgactcaaggaattctgacttgagatccttctgatatacctccaccccatttttgagaattactgctctagaccttttctgaaaggaacctagactgtttatatctaaacacacaactaccaagtatctgtgcaattcaggtcagaaattacataaagttgcagatctttgaataggaatgtattcaagaaaatagctttttattgaagagggctagatttttaaaaatctgtaagagttaatcagagcttagcgaattgatgattttcctaaaaaataatagaattagacttcccaatgttactagttatcttgataacaattttgctaaaaattcaaaatccactgacaacaataattatgtatgcttgtaaaacaaaaaagccatattctgacgaaatataccattggtaataagggaaaattgctcagtttttattctcattaagtctcaagaaagtctgagtgaggaaaactttaattggataccacttcatttggtaacaccattaattggacagttaacaactttttcaaaaggttgataagtaaattggtcatggtagactaacttatgctgtttgaaaaaataatccccaaatctcagaggctaaagtaacaaaagcttatttcttgcttataagacaaagctatcacgggttcactagaactacattcttcggatcattgtcctccctttggacctggctgatgatgtattaccaatgtccatatcagcaaaaaaagtgagcctgcaattctctcatgagtatttaattgctcttcccacagaggaacacgttacttccagccaacttctccccttagtgaaaaatattgacgttgcctcaaccaaacagaaggaagctagatgtaccgtcatactgttagcagcgggtctttgctcccagagcccccaagatggcagcaagcctcttgcactctgacctggggttcttggcctcaaggattccaaggaatagaaccttgggccatgcagtaagtgttatagctctattagaagccctgggtcacggaagagaaccatggaacccagcgactagtgttaagctagattaggatgaacctgggcacttagctgcacagaataatggcgagcctctagcccgatcaggagtggcattaggcgccttgctggattagaagcgcagcagacaccctgcccgatctggagggatggaagtaagcggcaggtctgcaacgcagggatcagtagtggtggacggcgagtgataactcagctccagctggaacaaacatggaccagcagagtatgcagttgcatgatttaatagagtgaaaacagagctcccatacaatgggaggggacccaaagggggtttcccactccccacttaatggctggggtttatatcccaatcattgtcccttcccctgtgctctcagatgatagatgatgtgactatttctttacctcctgtttttagcctaattggtgttttagtgagccctctttactacctgattggttgggtgtgagctgagttacaagctccgtgtttaaaggtggatgcagtcaccttcccagcaaggcttaggaattcttagttggcctaggaaatccagctagtcctgtctctcaatatgatatgtctggaaagaggggaagtgggatatttggccaaaagagttaaaaaacactgcagtgagctgaatgtttatttccacctcctcacccgcccccaaattcatatgttgaaatcttaaccttcacagctgggtttaattgggaggtgagacttttaccaaatgattaggtcctgagggctttgctctaatgaataggagtattattcttatgaaagaggccagagggagctcatttgaccttttcatcatgagaacacagtaagaagacagctgactatctatgaactagaaaatgggtccccaccagacatgaatttgctagcatcttgatcttggacttcccatcctccagaaatatgagaaataaatttttgttgtttacaagccgtccagtttaaggtgttttatatagcaacctgaacagaccaagacaagtaccacaacatgaaatgaggtgattatgtatacctatattaatatacatctattactatagagtacatcaatttcttgcatatttctgcacatgtgtgaaaaaagagtcacatgaaaagtcttatctttgtaaatatacatatgtgggaatgtgtaaacatgatacaactgtgatacaaataatatagactttgaaagttttcataaatgaaacgcttgttttccgaaactttgtccactgtaataatgttctggcatttataaaatactgcatgtgaggtttttaataattagtaaattcacatatgtgttttaaataacatagtaaaataatctttttaggtaatgtggaacaaattgtgaaaaaaatgcaagagtgaagtagaaatgataaaaataaaacataatttaattgttgtaagtgctttgagtaagggatttatccaaaattggatttcaaactattataggctaaatcaaatttagccttgcttggctcatagactttttttgtttagactatgttttaggttccaggttttgtataaaattttaacttggagaaacagccctagtcaccattaatatggtcattctaagttttttggatgtttcaaaattatcgttatgctaaaagtgcatttgtattatatttaaatgtcttaagttaataggtctgaaaattatctgtatatagacatttaaaacaaatttagaaattattatactggtataaaaagcacacttaatactatgcttcaattgaaccaattgtcacgttttcacttccaagaccccctcccgcttttcttttttccatactgagttctgttcctactgttctgagaaagctatgctcttactgttttccaaagctgggcctccatatttgtgaacatgccatatatttgtcactccattctaaagagaatgcccgattttcctacctattacccaatttgctgttttcccttcatcatcaacataatgtgtactctagtgagggggtggctggaggccaggaacttggatggagctggaggctgttatccttagcaaactaatgcaggaacagaaaaccaaatactgcatgctctcacttataagttggagctaaataaaaacatatgaacacaaagaagggaacaacagacactgaggtctaagtgtggagagtgaggagagtgaggagagggagaggagcagaaaaataactatcgaggactgagcttaatacctggctgatgaaataatatgtacagcaaatcactgtgatgtgaatttacctatgtaacaaacgttcaagtgtacccccaaacctaaaacttaaaaataaaacaaaacacaaaacctgtactcactgctttgatttttaatttcccatttacttctcaactcatgacaacatatctttcacctctaatgtttaaattgctctaacaaaaatcatccaatctaatgattacaaaagtcaagactctctgctaatcctgacttcattttgggatcaatgcaataaatcaatctctccttgaagttaattctcccctagttcccatgacattcccattccaatcttttgctacttgtttatttactttcactgtgtcaacttcaatcacacacttcttaaatgttactgtttctttgggctgtaatgtctgttgtcttcttttcattaaattattgctaaataataccaaccagaaatcaatgttatttataactgatatgacaatgactactaacttgtgtttccagtcctaactgctctcattaaactagatctatattttcagtggccacttagttatctccacatggatgctctacacacatctcaaaaggaacctaccaataaccagtctgtttatcctactttctcctcacaacctgattccatatatttaatgggctatgtaagaattatttttttcttatttcatcctcatcagtcgactcctttgagagtgtttgaaatatttctcaattctttcattttcctagacttttgtgtttttgttttattttctcccctggagatcaatgggcagaccagaatagttttattacagttcaatggcatttagggaaaggagcaaatcatcatattcactgtgacatcacaaaaagaatcacagaaatcaagaggagtttcatagttgatatttaagaacaccaagaactttccctatatcctcactcaggattctctgcttaatgaaatgtgtaagagcacagagaacttattaaatatttaataatatttataatatataataatataaaatatattatttcctcttaaaatgattaacatcatttattggtatctaagtttttaatataaaaattaatttatttgatctcctaatttcttaaagatgccaaatacatggagccttcccctgatgtcctgatggcagaatcccattttgttacaccgtgggtggagagagcagatgccccagtgcctccttgcagctttggacacaacgtgcagatggcatcattatctcttttacatcttggatggattgctgggaaggacattctgttaaatagttattttaaaagatcatttgggaacttatgacttttttttttgctatttccttatatattttatgactaacatatattgttatttttaatttttttctgagttcattcccttagtttatcatgttaaatttctctaaagagtagtagttttctttcatttattcagaatattatattttcatatagagggagatccagcacccataaaacattagaaacactcaaaaggtaatttacatattgttttttaagatttttaatattattgaaaatacattgtggtcattttattgtccatcacaaatgaataaattcatacacaaatatatgataataaaaaatgctctacaagcaggtagaggagtgaaaggactccatgtattcagctaaagactttgagccagtatttgcaggtaagtatcataagccaaatgtctcaaactttagcatgcatcataacatctggagggcttaaaaattcagcttatgttacccatcccagagtttttcattcagtgagtctacagttgggcgtaagaatttgcatctataataacttctcagataaggttactgctgctcaaaatgtgggaactactgcttgaagtcacctatagaatatttggaaatattgaaaaaccaaaagcaacctgaaactagcaaatatagttaatacagacaataatactaataaattgcaatgttaagatatcaattattttaatgctttcatgctaaaaggactaacagaacaaaagtgtttaatgatcaaaataaaacaaaccttttggaagtaatagatgaaaacaaaacctttcatgataacattttgtgttgttttaaacgtacagaaaagtgcgaattaccttcaaaatatacttcacaaaaaggtcccctgcggtgtagacattggaaaaggtcaaaataactattttctctaaatgcttatcatatttgttgctttcacctattttaggtgacacaatttgctccttttttagtgtcttatttccctatttatggcactaccctcacccagccttccagctagtaccacaattctttttttttttttttttttttttcgggacagagtctcgctctgtcgcccaggctggagtgcagtgggctggagtgcagtcacgcaatctcggctcaccgcaagctcggccttctgggttcacaccattctcctgcctcagcctcccaagtagctgggactacaggtacccgccaccacgcccagctaattttttgtatttttttaagtagagacggggtttcagcatgttggccaggatggtctcaatctcctgacctcgtgatccacccgcctcagcctcccaaagtgctggtattacaggtgtgagccaccacacctggccgctagtaccataattcttgtgaacactgactggcactctgaccatcatttttcccaatttatttagtttaaataaatcacgtgttttgccaattgtagttggttatctgtgtgcttttctttcttcttagcttctgcctgtaccttccaatatttcttctctgaagtaaattaaagaagaaccctcacaatatcttctataatgctgtaaaaaatagcattttaacgtggcctttatatactcactcgtttcttagaaaacaagttggcttatttcagtttgaaacataagtaattgatccttaccaaacaggattaaaaatagtagcaactgtaatagaaattttgatattgaccacataacaatcttatcttactttacagattagtctaagatgctaggagttgcaaagagacttaacaggcttgaatggatataatctgtacagattctgatctttatctaaaaaaactgatattcaccctttgatgcaaaaaagagagagagagataggtttgcagagtgggggaaagatgaagagagagagagagaaacgacctcagatttgggcttgtgtaagagttttgtggaattcagtgactgaagggccctggaccagttctttgaatgagagtactggggagaaaagggggctttgagaagtgattacatgaataatgaaatgaattttctgtaatgttccttaagacacaattaagtgattgcatttatttttatttgtgcaatggactgtgctttaataagtgcaaatctctgcagagccttggttgcttgggcctcaggatttataaaagctatgtgttttttatttgttcttaaaatgacattttcttgattttagttattttcagaatgttgagagtgggaatgaaaggcaactttagaatcagaatttgacagtagtaggaaaaaagtgataattatactgacatggtcaaattcacaaaatgttcttaaccttgtggtacttaattttgcatattgaccaaaaaaggccttaacattcttctcagcttaacgttagataggttgtttaagttcctcaccttccttttcttagagcaattaacatagagaacttttaactttctagcctttgacatgtaaatcttttaaaaactcttataagctttacaacctaggactaagtttctccaggatccgggagccacccttttgaaatataatcaccatagagataatgccctgatctccccgtctctaagggaaagtaggagcctaactttggtgggcaccttactccaagttgtaaaactccctcctgtcatgaagaaagtctatttttccttagggtaaagccaattaacaaacacagatgactcgtggatccttctcgccctcatttttaaaagatcgtccacgctttgtcttagaggagttcagctcagactgagttatggcctctcccctatttcaacagccttgaacgaagtctacattgcctgattaactttgtccagtgcattttttactttaacaatatgaagtggcccaaaataaataaataaataaataaataaataaataaataaataaatgaaaaaaaaacgttaatagcactagaaaaactacaggcagaaccgtgttacgtttgacctttgctttattattattgcattcgcacagcttcagttgtttacacttcaaaacatagagtatgagacattttgcatttctgtatttcactacaccacagtcaggatcttttgtgtccccagcttccaggaagcaggaaaatgcaatcttgcttgttttaggaactacccttcgtctgctaacaagggcttatttaagaatcttggttgtcctagtgccaaaaaatggccaaagacataagtacatttcatggagaatgctgtacttttgttcccaggctctacattgctcaggaactcaggtttatactatttttttcctcaggagttactccttcaggtatattaaggatagtaactcacagtagaccctctccttcaccagcagcctccctcccccaccctccaattctaaatgataagtaaaagtggagtcctagactctgctgctggaacccatttcttctcccaatattggaaagacctcaaattcattcccagacctactatttcctcctcccacaggaagaaagtactttattttgcattcattccctcaaggctagaaaaacttcctcaaatttattctactttcaagttctaaaacactgaagaaatgtatctacttttttacctggaggagggttaaggaagataaagcgtcagaccatctgccatggtctgaatgtttgtgtctccccaaaattcatacattgaaacccagtccccagtgtgatggtattagaaggtggagcctttgggagaggattaggtcaggaaggtggagccctcatgaatgaaacagtacccttataaaagagaccccagagagatagctggcatgttctaccatgtggggacacagcaaggagccatttaagaaccagagagagagccctcaccagaccctgagtctgttggcaccttgagcttggacttcccagactccagaactgtgagcaacaaatttctgttgtttataagccgcccatgtattatatttttgttgtagccgaccaaaagagctaagaaccatctttttgagacagtatgttggtgtgtcatttcagggatgaggaaggagcttcaacctggttatattttgtttttaagacactctaaactgatgatacaatttaatgatgaaaataacagcaaatacacatctgacagttctgttgcaaacattatcctaaggcttctcagttgtgtattataatagaatttaaaaaaaaaccaaacatagttttagaagagggagacactcagtgcataagaatatggctactaatatattcctgctcagtgtttgaaaagtattcatttcccctgatatgcacatgattttctacatgtccaaaaacaacattattattaagtatgttgatagaaaaaaaacaataatttatgatcacctcactgtaattgcatacaaaaattaatatgtggaaacccaccaagaagaagttatgtatcttcaaagcgcaattattttattgaattcttagaagaaattaaaatgaatatggcattttattactgaattattctggttttagatcatacctagatacctttaaaggaaagtcatttcgtagctgtgtcttccagaggcttttcaaatatatatttagcttgtgagatttttcttttgaataacctttcccttttaactgatgccctagtctctgattacccactccctggcctctgcccttttctcaaatcatcttactcagcggtaatgaaacagcagccacagaacagcagtgttgcaagactcaaatgcattagcctatcacggaaaaacacaagacctttgtttagatacaagtacgtacaatctgagttctcttttttcccctgtcatgaactctatatatcttgatgactttgaaaactaaactttcttccccttttcttagactaggattctaatttaggtataatgggatttgaacctccctcaagccttttaaagtattcaagggaggcataaaagaaatagcagagagacattcactttttattactctctatgatggggatattgtattgctcacatactaatgtaaattcctctaaaatatataatttcaacccttttattctctcactattccctttccactatcaatttggatttctgagaccttacgcaactaaactaaatcgtttcctgaagcttatgtgccttggtcttttgagtacagtaactgcacaatcgacagaagttacaactaataaatttctctttgtgactcttcctgacaaccagaaaaaaacagtaatttaacttttctggttaaacttgaaccaaggcctaaaaagtagataagtgactcaaactatttatcttactactcctaccctataaccctcacagggaaatgaaatattgccagcattctaaaacttgttgaaagggaagcattcatatttaggaaaaagttacagatagagatcattaaaatttagaaacattccttttcaacttccgcataacttctatctttatagttagtcttgctctgcttaaagctatactgaggaatgtattttaaatttagaaccaattttaccctttcttttataattcaaaaagttggaatatttgttttaataatttctgtaaaaacaaaatgccatagaatttcatattcaggatattagtatatacctcactatcttgatagactcttttagaatcttctcactcctcacatagagaaacagtgcatagacatccaggacacagaagcgactgtaacaattattttgataagacatatatgagatggaagatgaacattatttatgttgaccatagggacagcacagtataattgagttatgataacactaactccttcatcatgtgaacagatgctaagaagcaacatgttcaattactatttgaatacattatctcattctttgcccttaataaaatatcctagtgccacaatttcaaaatgagttgaaactttgatgtactgctgccaacagccacagaacttttaaaagtcactgtctagttattttgcctctaacaaggaaacacatttgctgagaattagaatgaattaatattatacttatcgagactattcatgataaagctgtctcttcaggatctttataaatgatcaacctctcctggatgtgatattttctgctaaattcagaaataatcagaagagacaatctttatctcattgatatcaatgctggttttaatgcctactacagtacctacagacaactaaaccacattcttacaatgttttaatgatgcctactatggtacctaaaaacaatcaacattaggaaaaagtaacagttaaataaatagaaacctgtactttgcactattagaaaaatttatgttttaaataaaatcagcatgtaaattaaataatgaatgcaatatgtgttctaaaccatgctacaatttaaagatttaaacaaatgtgttgagatgtaactaatagaaatacaatgaagcagttcacatacttgaaaaaccaaaaaacttaataaaaaatatatatgcagatgacatttcttgactagtgatacagagaaatgtcctataaaagttgcatagaggcctatgaacttcaataaatatttaaaatctattctttactgagaatagatcttatcataaatttatccatctcttttattggcagaggagagaagcagtacaaatatccttggaatgctttacctttttagcagagggcagctgatacatcatgtagagaattgttcaataggtgctctgagaagacaaaatgtccctatttctttgagactttattcactaatatttcaatttggcaaagtgtgtccatttttttttcttatgtgatgggaagggatttaagaactttattttataagtcaggatctctatttatacaggaaaagtacaattactgtcagtaaaatgaaagtcttctatattcagctggcaaccctaagaggcagttcagagagtttcttaaagcagagaaaggtttaaaattatgaagtgatggatatactttatccaaattcctgctgtcatatttactattatctttaatataccaacacactgttaattgcctaaggaatagaaagtccttggcttatcttgctttcttgcctgcatagaaacctcttaaaactatacttttcttttatctgttatgcctctaacatttctgtcattaacacacacacacacacacacacacgcatatatacatacacacacacacacatatatatacacacacatacatatacttacacatacatttctacgtttggggctttgttatactccaattgcttggagaaaaaaaaatcaaagttttaacgcttgaaaacttttgccaaactttctttttccatatgctctaccattagggatttctttattttcagggactcaaaagtttatgacactccagccctgacctgacatcatgctgaaattgtcaataacccacttttatttctactgttgcccaaatcaacatgtccaacataaaatttgttttgccatccccccaaattctaatacaagttttaattaatggctgtaccacattttagtaatgctaagctttaagcatttttggctcattttttctatcttaaattttagtcagattccaagtcatgtatagtatacattcaaaatgtcttaggcttttgctccccaccttacactcctacactcggtatcttctatcatgtaccatctgttcactataatgtttcctaagtattttacagctgtcttccctgacttcagttcttaataaatgcaatagcaaaataaatcttcctaaactaaagattctggtcatatgcctgtgattgcaaacctttcttttcgtttttcctgtttctctttttttttctttttttttttttttttgagatggagtctggctctgttgcccttgctggagtgcagtggtgcaatcttggctcactgcaacctccacctcctaggttcaagcaattctcctgcctcagcctccagagtacctgggtggttacaggtgcccacccccatacctggctaatgtttgtatttttagtagagacagggtttcaccatgttggctaggctgatctcgaactttacctcaggtgatccgcccaccttggcctcccaaagtgctgggattacaggcatgagccaccacacctggcctgtgattggaaacttttctagggtaccatcacatatggaattaattacagctttctctacctatcctgtaagtactttacctgcactatggtctcttagaaagttacttaactacttaatcccttagttactatttgtaaaagggaataataatatgaaacttttagacatgttgagaagattaaatggctctctctctctccctctttatatatatctagatatatctatcgatatatctattgatcgatagatctatatatggacagattctatatatctagatatatatcgatagatatatatagatatacatatctatatatatggatagatctatatatagatagatagagagagagagggagagagagagagccatttaatcttctcaacatgtctaagactttcatattattattcccttttacaaatagtaactaagggattaagtagttaagtaactttctaagagaccatagtgcaggtaaggtacttacaggataggtagagaaagctgtaattaattccatatgcagtggtaccctagaaaagtttccaatatatctatatctatatccaatatatctatatatatatatctatatatctatatatatatatagagagagagagggagagaaagagggagagagagcaagaagagaggagcattataggtactcaaaaattgacactttattatctacgtttctgacctcactttttaaaataacttattcttttgatttgtttataattgttattacaaataattttcaacatacataaaaattttaaaaatagtgcaatacataccagtaaacctacaaccaaaattaaataactgttaacattttgccatacattttgtatatatatgttgtcttagtctgtttgggctgctatagcaaaacaccatagactggtagcttatgaataatagaaattcttttattacagatctggagacagggaagtctaagatcaaggcgtcagcagactcagtgtctggtgagggcccgcttcttcatagatggccttcttttcactgtaacctctcatgatgacaggagctctctctggtctttcatagcacgaattcctttcatgagggctctgctctcaagacctaatcatctccgaaaggtcccacctcttaataccgtcaccttgggagttaggatttcaacatatgaatcaacgtatgaattttgagtgggcacataaacattccatccactttatatgttaaagtgcaaatgcatgctttttgaactgtttcaaaacaagcggaagacactttaataaagcagatgatactttatccttaaatactctaacatccatctgttattaataatcagaatattctccatgctgcctaggccattatcacatctaacaatattaatcataaatattgagtattagctattatctaagtcttatcacaatctccccaactgttcctttaatgcatttcataactgttttgccttcagtttagtgttattttttaaccaggatgcaattaagtttcatatggttgttagaaatgttctctctctctcttaatttaaaggagctctactggttttttaaaaaaacgcaatgctactttattaaatatctgaaattatggattttaccatttgctaactcagtttttctaaactccatatttctgccaaattggaaattagatctaagaccaaattaaatcatgttagccactttcggtaagcatctttcatgagcttttcataaaatattacatcaagacaaatatatcatggtgtcttaaaggtagtaatgctaaatttgactgatgatttaagatgacctccatatcactttattttatagtttggtaattttctttgcaattagaaaatatgcagtgaatgatacttttactatgttggtttatgaaataaaacatttcttctaaaagtttcagtatccactgagggttctgtaaaaatcaactatttagttataaattttaaaaaaatgtctaattctgtcattttcatacataacaaaatggggtttcttttttcacctcatcaaatcaatatgaactacaatttgtcttaaaaagagaaggtaaaaaattatctccctttaattactaatgctaagaacaaggagttgatatatacctactaggtatacacaaaatttaaaagtaaaaaaaaaaatgactataaaggaataagcagttgaagtaatagtaattttcaaagatagtaaaactttttcctctttttattttagtaacactaagaaatcaggatttttcccccttgctgttttatatttacttatgcccattattctttctcatgctcacattatgtcatatttggccactgagtccattcaggctggctcctgtgtccttttgtcacatctctactagcttttgagtatcaaaaagagtctggcttacatgtactactttttgtcctcaaaatatattgtacttacttactatttttgatactcaaaagctagtagagatgtgacaaaaggatactgtgttaaaaatcattgagaatacgccaggtgcggtggctcacacctgtaatcccagcactgtgggaggccaaggtgggcagatcacctgaggtccggagtttgaggacagcctggccaacatggcgaaaccccatctctactaaaaatacaaacattagctgggcatggtggcacgttcctgtattcccagctacttgggaggctgagacaggagaatcacttgaacccaggaggcggaggttgcagtgaaccaagatagggtgactgcactccagcctgggcaacagagcgagactccgtcttaaaaacagaaacaaaaaataatttgaaatatttttttcactctgtagttttgctatgaacttaatacaagttgtgtttatttgtttagtttgtttccaatttcacaattcaaacatatcattttgaggcctgcacagtggctctcgcctgtcatcccagcactttgggaggccgaggcgggtggatcaattgaggtctggtgttcaagaccagcctggccaacatggtgaaaccccgtctccactaaagacacaaaacaattagccgggtttggtgataggcgcctgtaatcccagctgctcgggaggctgaggcagaaggatccctagaacctgggaggcagaggttgcaataagcaaagattgtgccactgcactccagccttggcgatagagactccctctcaaaaaaaaaaaaaaacactttgattttttaaaatgtgttcaatatgttatacacttacataatttaaagtttatatattcataatctataaaaagctgtactataaaaagttacactttcatttctatcctcttctctgcagtctctaccccaacttcacatcttgtagagatttccctctttaattagtttctggtttatcgttctgatggttctttttttttatggatgtatgagtgtattgttgggtatgtttgtaagtgtgtatgtgcatatgtgtgtgttgcccttccttccttagaaaaaaggctgcatagcttttctcgggcactttatctttttggatatatatagcctaaggattattcaagtactccataatcttccttgtgctttttacacctccttattacacctttatgtagctttatttttttcccaccaagtcaactattggtagtcatttggattgtttccaatctcttaccattatatataatactgctgggaaaagtctaatgcatacattgattctatctgtagaaccgcattttcagtatagagtcctggaagtggaactatgagtcagtggttatttaatgtgatcatgttaaaaacatgaccaaatttcccttgatatgattaaataagtctccacacccaactgcagtgtgtgggagggcatttacagctttgacaactgagtgtgttgtcatcattttggttatttgctggagatataactttaaaaatatattttaataccattttaattattttttctttattatgagtgagataagcgtattttcacatgctacacacatttactttctttttctgaacattttatgcatgtattgtaacctttttattctaccagaactctttttatatcctagagattagctctttgtcttaagttactttctccccttatataacttctaactttactcttatctcttctacaacaggtatcctactgtccaggccaaatttttacatagggaaaataaattaggttccacatgtgtcaaaataaaataattctttttttgcattaaaataaaggaattattttttaaacctagatgatggaaaaaaaaacctattcaataaataaaacagatagtcccttaaacataaaataaagagggtttgggaaagactatttgtatgccaaaagtgagtgatgaagaaaggaaaagcttaagaaagcaatgggaacagactgccttagtagtaaagtggagaggggtccacctccagagtgccagcatgagcttccctgctgatgccatccccagtgaaacgaccataactggtaaaaactataacaaaatgatcattttatgttctacaggcaggaatacaacaaataaggaaacttttgtttaagaaaatgtactaattcaaatgagtgctgagagtctgtgacacttgaaccacaacccattaaccacaacttccagctgactgtgttggaatctctactttcagtgaatatggctgagaagatgaagctaactctcttctcaactcccaatcaacagatattgtatctcactggaaatggaaaggccaccagcatttatctgcttaaacgttgagttgcagaggttaagatcctggttagtgtgactaagagtttacggcttccttttctacacccaaccccaactcatagggcagaattatttaccttagtttcagcaggccaagaatatgtggagaccgattaccttagccctagtttgcttgtactgtgggggtttcacatgcagagaagttcagaggctctcaccttcacgcagggcctggaggagtgactcagagattttgccccggggaaaacacagtccataaaacagagttcccaaaccctctccaagaaactaatttttatttaaaacgtaatgtgaggtagtgcaaaaccaaaggcaatcttgatgacaaagaaaattttgggggtaagtatttaagaggaggctggtatatatagcagagcaacaaactaatccttaggccaattagcttactggagagaaatggggaaaaaagcagctaagaagagcctgggacaggaggaaagtgttaaaacatatctcaaatactagcctcacaaatgactactttggctattggcacagtagtttatctcagaattactgtctttaaaaatctggagaaaatataaaaacataactgaaggcaccagaacatgaccaaagacaggaagaaactgaagaagattcaacccttgaaagaagagaattgcacctagtgagtagaattttttattgtatgactattgcttgagggtaatttctggtcccccgtgcccttttgtgtttgggttgctagagatcaagtacaaagttgcaatttcactggcttaatagagtgtgacaataactgaaagaataactaaaagatgaggggggaaaatactagggcaaatactagaaaggaaacagctgtttgatgtagctcaaaatgctacaatttaggtagttaggcagttagacaggcatgagtggggctggcgagggctcttccctcgtccactaggaatgtcaggtgatggttccgcaatgatcacctggcctcgctaaaagtgattcacggccgggcgcggtggctcaggcctgtaatcccaacattttgggaggctgaggcgggcgcatcacaaggtcaggatgttgcgggacaatcaaacaggagagaccgacaaggttaaggagagcgctttattattaaggtgatcaccggctcagtcagactagggtccaatcaccttttaagctgtttgtggcgggagttacgtgctacgggaagagtacttgcagaagcgagaacaaaggcagttaatcattcttttacatttgttacaccacatgtcttacatccttgggaatacatgtttttgcaacatttgcttatcatccttgtgacttaacagctgcgctagggagagaagcaagaacacgccgtgcctcaaggaacgtgaaatgatagaacacagataagcctctctgggcacagaggagaaacaagcagttaatattctctcaacccaggcccccgggtggggctatattgcattctacctttaaggaaaagaataaatttcttggctattataaaattcattaattttcccttcaaggagatcgagaccatcctggctaatagggtgaaatcctgtctctactaaaaatacaaaaacaaaattagctgggcgtggtggcgggcgcctgtagtcccagctactccggaggctgaggtgggagaatggcgtgaacctgggaggtggagtttgcagtgagccgaaatcgcgccactgtactccagcctgggagacagagggagactccatctcaaaacaacaaaaacaacaacaacaacaacaaaaagtgattcactggcagtggcaccagagagaggccaattcctgatggtccacactgttgcacgaaagtgttaattggatgcaggcaccagggagatgcaacttcctgggcatgttcattaagagacaaaatggcagagtatgaccttccaggggcagttcatcagaaaagtgaagaaagcctcacatggacatgcctacaacttcctaaacacactgtgcgccctcaccttccaagggtaaggagtactttgcatgcaggcagcccaccctaagggagtagtattgagaaagaagacagtctgtgaagtcttaggatcaaggttgaacatcgcacttggccttcacatacccacttggatttcttccaaacgtaccttcctttttttcctgttctaaagaacctttttaaataaacttccgctcctgctctgaaacttgcctgggtctctgtttctgccttatgctgctcagttgacttatttcttctgagaaggcaagaattgaggttgcttcctgacccatatggattcacagccagtaactcggatacctaacacccctaagaaaaatctttacccagctccttaactaatacagaaatagttcatgtataggagagagcatgaggatatagaaggaagcagtagccgcaaggctgagagagcccagcagagactttagctgctgtacactctagggaaggcagagtttagagtagtaatccttccatgtcatctgtctgctaaaggcagaatcaacattctttataaaaagaatccaaaggctcaatagcctatcattcacaatccatttttttaaacatggaaagaaataagaaaatgtgatctacatgttaattttgcactgagctcataaatgttttagccatttctgatagcagagaaataattaaaaggagccaatatcaatatatttaaggagttaaaaaaaaggctagggccacatgaattaacagatggggaacatccatggataaatagaaactataacaaagcaccaaatgaacattttaaaactaaaatttgtattatctgaaatgaaaaatttattgaatttgcttaatattggattagagaaggcaaaagaaactatcagtgaaattgaagtcatataaacagtaatttataaagtactgaaaatacaggagagaacaagtttgaaaataaaatggagtctagatgtcctaggataggagataaagaatagggcagaaaattgtacttaatggctgacattttcccaaacatggtgaaaagtgcaaattacacacaaaaagctcagcaaatccaaagaattaatacaaagtcaaaattgcaacttaggcatgttagctcaagttgctccagtttgtacaaccccaccattgtgcagaccgtggtgagagtggaaaattccactagggttgggaccatgagaaacatcctcctggacaagtcccaggcctaaccgcctgaccacaggaaattcctccttatcagcagccaacctcgctgcccaccccatttcacagtaagcccagagcttcccccgccctagtctgtaaacgaaggcaggctcctgcactagctggtgtccgcctccgcaggtctttgttcaataaacctgtgttgctgttgagctgccaactctctcactctttcttttaccttcaccttcgtttcagagccttacaatgcatatcttaagagataaagaaaatatcttaaaagcaatacaatatcttgtattctatacaagagaataactgtatgaatggtatctgacttccggtcagagaaaacaaaaaggtaggctggaagacaatgaaatgatatcttttaagtgctgaacaaattaccatgaacaacaacagaaatataaaacctgtcagctcagaaatatgttatccatcaaaaatatttttaaaaaatgaaacctaagtaaaaaaagatatttctgaatacaaacctcttattttctttgagtttcaataataattcatttcagtggacctgcatttcagtaaatgctaaaaaaaacacaactgaagagaaattatactgaaaactacactaagaataaagagcaccagatatggcaaatttgtaggtaaagtcttatattttctccttattttttaaaatacacaatttttaaagcaacaattataacacataattataggaaaaaaaatatatagagagagagatatatatgtatatgagtggacacacacacatatacactataacataatggcctggtaaggatatggaaatatagtatgacaagtttttgacattttataagaagtgttacaatattaattctaggtggactgcaataaattaaagattcaatcccaaggacgttaataaaaatggaatgtataaagatatagtcaatagaaaaattaaaataagatattaaaaactttcagttaactgaaaagaagacagaataggaagtaaattatcaataccagatgggataaatagaaaattaataacatgataaacccaaatccaaccatataattgttataataaattaaatggcaataaactaataagtgcatataaaaggtagacattttccaaatagataagtctcaactacagactaatataagagatgtactttaaatataaaatgttgaaagcaaaggtaaaagatgaaaagcagtatgttgtggaaacaaaaagtataagaaatttggcctgattataataatatcagacagaaaaagtcaagatgggaaacattaccagagataaagaaggggatttcataatggcaaaaggaaaaatttatcagaaaaatatattaatcctaaatatgcacatacttaaaagaataattatagttggacatttcaaagattctttataaatacttgatttaaaaaaaatctcaaattcttattaatgatacagaagttgtgaattaaattattaaccactgctatcatttgtatgtttgtctcctccaaatttgatccgtattgttgaagttgggatctgatgggaggtgtttgggtcatgggggtagatccctcatgaatagactaatgttttggggtggtggtgagtgagttccaactctgtagtttccaggagagctggttgtttaagagtctggcacctccagtctctctcttgcttcctctcttgccatgtgatctctgcacctgctggctccctttcacattcctccacgagtggaaacagcctgaggcttttgctagaagttcaagcttccagccagcagaatcttcagctgctgctggcatttttttctttataaattattcagtttcaggtatgcctttatagcaacacaaatttacttgtaagagacccacactcagtatacttcagaatacactattttttcaagtacctttgaatcattatatattttcagaattgaatcaaaataccctatcttttcaactacatttgaatcattaaccaagggtgataacatgctgggctacagaatatatctcagtaaattgtaagagtttgaaatcttatagagtatgttttctgaccatgataaactcaatggaaagcaataaaaataaagtatggaaaaaagtcagacatatttggaaattacacaatgcacttctaactcacccaagagccaaatgaaaaaaacaagagaaattagaaaatacttttaacattaaaaacattaaaaaaaaacaggaaactgttaaagcagtgcttagggaaaaaattacagctttaatagcaattatgagaaaataagaaaaatttaaagttaatgacctaaattcctatctgtaagaagatagaaataaaaagataaatttcaataaaatagagggaagtaaatacacatcagcaaataaattatttaaatttctaataagagaaatcttttataaataaaaatgttgattttttgaaaagataaatgaaataaataaatgcctggaaatactgatgaagtaaaaaggaaataaaacaaacattaccaatatgataaatgaaatagaattatataaatattaaaatgattataatagggtgagcgcggtggctcacgcgtgttatcccagctctttgggaggccgaggcgggcggatcacgaggtcaggagatcgagaccatcctggttaatgcggtaaaaccccgtctctactaaaaatacaaaaatttagcgggccatggtggccggcccctgtagtcccagctactcgggaggctgaggcaggagaatgacatgaatccaggaagcgggagcttgcagtgagccaagatcgcaccactgcactccagcctgggcgacagagcaagattccatctaaatatatatatatatatatatgtgtgtatatatatatatatatatatgtgtgtatatatatatgtgtgtatatatatatgtgtatatatatatatacgtgtatatatatatatgtgtatatatatacgtgtatatatatatacacacacatatatatgtgtatatatatacacacatatatatacgtatatatatacacatatatatacatagatatataattttattctaaaaacctagaaaaactggataaaataaactaattcctagaaaaacacaattttcctaaatgagaaacatttgaatagaaaaccagagtagtcctcatatgtattaaagaaattggtttcactggcatattctatgaaacatttaacgtagaaataatgctaattctacataaactctctaaaactagagagaaagaaacacattccaagtaacattaagtggccaaagtaactctgatactgaaatctgacaaatatattttaagaaaatatgattacaaaccaatatttctcatgaacatgattgtaaaaattattatattagaaaattaaatcaagtaatatgttacaaaaataacatatttgtattaatagatgcattggaagaatgcatgagagtttaaattgtttaaaagtcatgcatcaatacctaattcattgagagtttttagcatgaagggctgttgaattttgttgaaggccttttctgcatctattgagataatcatgtggtttttgtcattggttctatttatatgatggattacatttattgatttgcatatgttgaaccagccttacatcccagggatgaagccaacttgattatggtggataaactttttgatatgcggctggattcggtttgccagtattttattgaggatttttgcatcaatgttcatcagggatattagtctaaaattctctttttttgttgtgtctctgccacgctttgttatcagcatgatgctggcctcataaaatgagttagggaggattccctttttttctattgattggaatagtttcagaaggaacggtaccatctcctctttgtacctctggtagaattcggcagtgaatcagtctggtcctggaattttttttggttggtaggctcttaattattgcctcaatttcagagcctgttattattggtctgttcagggattcaacttcttctttgtttagtctttgcagggtgtatgtgtccaggaatttatcaatttcttctagattttctagtttatttgtgtagaggtgtttatagtattctctaatggtagtttgtatctctgtgggatcggtggtggtatcccctttatcattttttattgtgtctatttgattcttctctcttttcttctttattagtcttgctagcggtcaatcaatcttgtggatcttttcaaaaaaacagctcccggattcattgatttttttaatggttttctgtgtctctatctccttcagttctgctttgatcttagttatttctttccttctgctagcttttgaatgtgtttgctcttgcttatctagttcttttaattgtgatgttagggtgtcaattttagatcttcctgctttctcttatgggcatttagtgctataaatttccctctacacactgctttgaatgtgtcccagagattctggaatgttgtgtctttgttctcattggtttcaaagaacatctttatttctgccttcattttgttatgtacccagtagtcattcaggagcaggttgttcagtttccatgtaattgagtggctttgagtgagtttcttaatcctgagttctagtttgattgcactgtggtctgagagacagtttgttataatttctgttcttttgcatttgctgaggagtgctttacttccaaccctgtggtcaattttagagtaagtgcagtgtggtgctgagaagaatgaatattctgttgatttggggtggagagttctggagatgtctattaggtccgcttggtgcagagctgagttcaattcctggatatccttgttaactttctgtctcgtggatatgtctaatgttgacagtggggtgttaaaatctcccattatgacaaacccacagccaatatcatactgaatggacaaaaactggaagcattccctttgaaaactggcacaagacagtgatgccctctctcaccactcctattcaacatagtgttggaggttctggccagggcaatcaggcaggagaaggaaataaagggcattcaattaggaaaagaggaagtcaaattgtccctgtttgcagatgacatgattgtatatttaaaaaaccccatcgtctcagcccaaaatctacttaagctgataagcaacttcagcaaagtctcaggatacaaaatcaatgtgcaaaaatcacaagcattcctatacactaataacagacaaacagagagccaaatcatgagtgaactcccattcacaattgcttcaaagagaataaaatacctgggaatccaacttgcaagggatgtgaaggacctcttcaaggagaactacaaaccactgctcaatgaagtaaaagaggacacaaacaaatggaagaacattccatgctctcagataggaagaatcaatatcatgaaaatggccatactgcccaaggtaatttatacattcaatgccatccccatcaagctaccaatgactttcttcacagaactggaaaaaaaaaaactactttaaagttcatatggaaccaaagaagagcccgcattgccaagacaatcctaagccaaaagaacaaagctggaggcatcacactacctgacttcacactatactacaaggctacagtaaccaaaacagcatggtactggtaccaaaacagagatatagggcaatggaacagaagagagccctcagaaataatactacacacctagaaccatctgatctttgacaaacctgacaaaaacaagcaatggggaaaggattccctatttaataaatggtgctgggaaaactggctagccatatgtagaaagctgagactggatcccttccttacaccttatgcaaaaatcaattcaagatggattaaagacctaaatgttagacctaaaaccataaaaacgctggaagaaaacctaagcaataccattcaggacacaggcatggacaaggacttcacgtctaaaacaccaaaagcaatggcaacagaagccaaaattgacaaatgggatctaattaaactaaagagcttctgcacagtaaaagaaactaccatcagagtgaacaggcaacctacagaatgggagaaaatttttgcaatctactcatctgtcaaagggctaatatccagaatctacaaagaactcaaacaaatttacaagaaaaaaacaaacaaccccatcaaaaagtgggcgaaggatatgaacagacacttctcgaaagaagacatttatgcagccaacaaacacatgaaaaaatgctcatcatcactgaccatcagagaaatgcaaatcaaaaccacgacgagataccatctcacaccagttagaatggtgatcattaaaaagtcaggaaacaacaggtgctggagaggatgtcgagaaattggaacgcttttacactgttggtgggagtgtaaactagttcaaccatcgtggaagacagtgtggcgattcctcaaggatctataactagaaataccatttgacccaaagatcctattattgggtatatacccaaaggattataaatcatgccactataaagacacaggcatgcgcttgtttattgcggcactattcatgatagcaaagacttggaatcaacccaaatgtccatcaatgatagactggattaagaaaatgtgtcacaaatatacaacatggaatactatgcagccataaaaaggatgagtttatgtcctttgtagggacatggatgtagctggaatccatcattctgagcatactcgcgcaaggacagaaaaccaaacaccgcatgttcacactcataggcgggaattgaataatgagaacacttggacaaaggatggggaacatcacacactggggcctgtcctggggtggggggagcggggagggatagcattaggagatatacctaatgtaaatgatgcattaatgggtgcagcacaccaacatggcacatgtatacatatgtagcaaacctgcatgttgtgcacatgtactctagaacttaaggtataataataataaataataaaaataataaaaagtaaaagtcatgcatatataatattaaaagaggaaaatataaatatatcattacctcaataaatttaaaaaatcatttgaaaattttatcatccattcatgatttaaataactattagcaaattacaaataaaaataaactatttcagtctaataaagggcaatgattaaaaagtacgcatgtaacattagatttcatagtgaaatattaactatgcagtctttaaggtcacgaacagggcatggatgactactctccatcttctatttaacatgttacaagtcttagtcagtataaaccacaaagtttggataaaaagaaatagaaatgcgtctatacacagagaacaagatttacttcccagaagttttatggaacctacagaacagctaataataactaatgaatagagtatttttcagaatacagtatatatgtacatatagtcaatgaatttttatatgcaacagaaacagtttggaaaataaattttaaaaatttcagtttcaacttctctttaagatacagcagttacatgtgcagatttgttacatgggaatatatgctgctgagctttggagtatggatcctgtcacccaggtagtgagcatagtaccctataggtcatttttttagccctcccaccttcctccatcctctagtaacctacagtgtttattattctcatatatatgtcaatgtgtgttcaatgtttagctcccttttgtaagtgagaacatgcagtatttggttttctgtttctgcattaattcgcttctggttatagcctccagctccatccatcttgctgcaaaggacatgatttcattcttttatatggtagcatagtattccaagtgtatatgtatcacattttctttatccaatctataattgatgggcacctggattggtttcacgtttttgttcttgtgaatagcacagtgacaaacacacgagtccatgtgtctttttggtagaccaatttattttcttgtggatatatacccagtaatgagattgctggattgtatggtagctctacttgatgttctctgagaaatatccacactgctttctacagtgactggactaattttatattctcatcaccagtaaataagtgttcccttttctccatagcctcactagcatctgttgttttctgacattttaataatagccattctaatgtgagataatatctcactgtggttttgatttgcatttctctgatgtttagtgatgctaagcattttatcttatgtctgtaggccacttgtatgctttctttggagaagtgtctgttcatgtcctttgcccattttttaacggggttattagttaaattctcaatataagacatttgtcagatggatagtttgtgaacatcttctcccattttgtaggttatctgtttatactgtttatatcttttgctgcaaagaagctctttagtttaattcacttgcgcttatctagatatttttgttttcattgcaattgcttttggagacttagccaaaaattctttgccaaggttaatgttcagaagagtactttctaggttgtcttccaggatttttatattttgaggtcttacattgaaataatttttgactcatgatttaaaagaactattagcagaggtaatttttgaatatgctgaatggtaggcatccagcttcagcctactacatatggctatccagttatcccagcatcatttattgaataaggagccctttctccattgcttgtttttgtctacctcatcgaagatcagatggttgataagttggtggctttatttctgagttttctattcttttctattgatctatatgtccgttttcattctagtaccaagctgttttggttacagctgctctgtagtacagcttgaagttcaggagtatgatgatgcctctggctttattattttgcttgggattggtttggctgcttgggcttttttttttttttttttttttggttccagaggaattttagaattttttttttctaattctgtggagaatattgtttatgatttgataggaatatcttttttaaaaagcacaagtatgaataaatttaagaaaaatgtaaattagttctactctagaaactacagaataatgcagatagaaatttttaaaaagttaggtaaatttaaaatattatcatgttcgttaattgaaagacttaatttttttcattttaattcttcccaattgattcagtccaaatgtcttgatcttaatttcatcatgtttttaaaaatagaaattggcaagcaaattctaaaattgatctggaaaaatcgaaatatttctaaaaatttataataatgttagaggatacacatttgctaattttatgatttattataaagtactgtaatgaaaatgagctattgtgataaaggtatgcacatagattactgcaacagaatagagttcagaaataaacctacacttaaatggtcaattgagcatcatttacaggggtgccaaagtaattcaatagtgaatgtaaaggcttgctgccagattgtgatgagacaactaagtatcactatggaggaaaaaatgaattttgaatcctcacatcataggtaaaattgaattcaaaattaatagacccaaatgtattttttaatggaaaagacaataaaaatgccttcatgtcttgagggttgggaacgttcttaggtcacaaatagcgtagccattaatttttttaaaaaatcaataaagaaggctttataaaaattaagatactctcttcattaaaaatggaagttaaaaaaataagacttagatgggggagaagtagcctccaaacatacatcaaactaaagaattatactcatacatatatttgttcacatatatgtattacatttatacataagtgatgaaatgattaaaaggcaatcaatcctatcttttaaaaaatataagaaggcttaaatgggaacataataattactcaaaaatcttacagattcacatcaatgaataaggagaaaaaactgatataatcttgttttgatttttttctctatacaaaatttattgttcaaacttaaaagttaaatgatagtagctgaaaattaaaattgaaaaataaatcgttgttgggttttttccccaagatggtggaatagaggctttgccagcatgacttatttacctgtaaatagtaaaacagtatatagagattcacattacgaacttttatccatgaaggaacatggggtcacaacataaaagttaaaaaaccattgaatgcttttaaaaataaggcagaaaacagctcacatggcatgtacagcagaagattgagagtaaattctcaatgcataagaaggaaaaagaatgcctttgcaatgcacattcccactgggaagctgggcaactcaggccacaggggaactccttgaccctgctaagccctcggtctgacctggggagcaatcaggagactgtgaggaggattgatactaggaagtgccctgcatgcattcccagacccacatgccaatagaagaccattctttatcctttaattcataggtgactgcacaggaagctgccagcaagcacaggctggagtcactggtttggagactaactggatgggaatttgtgatgtagtctcaagctggggagaagccttcataactagaactgagaggtaaacgtagcataagctccagcgatggacatgggagttggatgtccccacttttgtgagactggatcaggagaagtttagcctgagaactgcagttttgactcaggcagcaaattttttggcctggtgcagtttcacggtctgaagacaaactgcttgtgacttggctaactggtcattcttgctgccagtgtcaggctgtgggagagagccccactgggtcaggagcaggagagtaaagcaggctacactaccacctgctagtctctggagcctgagcttcccctctttccccatgctgcatctttggttcatcagtagttgctgtgctcttctatggaacattattctaggggcctgagaactgccttccaaccacttggaaggctgccacttgtccccactattggccatctcagccccatccaacccaccctagaggcagagcataggactgggaccactgagagttccagggcctaaaccatagcctgggacactcaggtacttctcatggctaacaaagggcaagcataagccctattgccaccaatgcagctgactcccacctgaaagcacaaccttcttgcctggaggtcaacttgcacagctcattacaacatctgctgataccaattcataacatttgcaaaggagacaccctttgcgtgatcttctgctaccttcattgcccattgcaccccagctactgagaaggccttcagctcactcatcctcccagtacattgctattacaactggcatttgaggaagccaccacactaaggctaattataaccaaggaaatcatacagagtatacaccactgaatgcatccagaagaaatgccaaataatcatactttttttcttttaactttttttttttttttgagaaggagtctagctctgtcacccaggctggagtgcagtggcatgatcttagctcactgcaacctccttctcccgggttcaagtgattctcctgcatcagcctcacaagtagctgggtttacaggcatgcaccaccatgcccggctaatttttgtatttttagtagagatggggtttcactatgttggccatgctggtcttgaactcctgacctcatacttaatatatatcatagacacagcctcacataaaaaagtgccatcccaatgaaaagtaaatacaaaagtaagaagtgactcttcccacatatgcaaataaatcaatgtcataatactggaagtattttttttaaaggtactattacacctctaaggaacacagttttctgtagcaatggataccaaacaaaaagaaatattcaaaatgccagataaaaaattcaaaatgctgatttaaaagatattcaaaaagatacaagataaatctgaaaacccatacaaagaaatcagaaaatcaattcaggatatgaatgagaaatgtaccaaagagatagatatcttttaaaaagataaacaaaacttctggaaataaaaaatttgttgaaagaattacaaaatacatttgaaagcttcaacagtagaatagaccgagcacaagaaagaatctcagaatgtgaaaacaagtcttttgactttatccaatgagacaaaatgaagaaaaaagaattttaaagaataaacaaagcctttgagaagtatggaactacatgaaatgaagtaaatatatgaatcatatgtattccagagggagaagaaatgaaacatctggaaaatctatttaagaaaaagctttcttagtctagcatgagatttagacatccagatacaagagtcccccaaaattccagcaaagtatattgcaagaaggacctcaccatgacatgtagccattagactctctaaagtcaatatgttggaaaaaaatttctaaaaccagaaagagaaaagcgtctcattgcctacaaaagaaaccccatcagactaacagcagactcttcagcagaagccatactggccagaaataattatattttcaaagtgcttaaagaaaaaaactgtcaactatatattctgccagaataaccttcatgaaaaaaagaagaaataatgtgttgggcgacaagcaaatgctaaggaaatttgtcaccatgagactggtcctacaagaaatgcccaaaggtgttttaaatatagaaataaaaagttgataccagccatcataaaaacacaaaattataaaacttacaagttatataaagcaattacacaaaggaggaagataaatggcaacatgagaaaatgctatcaaaccacagacaaacagaggaaaaagagaaacagactcaacaaagcaactaaataatgcttaacattacaacaggaacaaatcctgtcagaactaaccttgaatataactggatttaatgctccacttaaaaatatagttcggcagtgtggatttaaaaaaaacatgaatcaactacatgctgcttacaagaaactcagcttattggtaacagtatttataaattgaaggtagagcagtagaaaaagagattccacacaaatgaaaactaaaagaagctatacttatatcagataaaacagacttaaaatcaaaaacagtaaaaaaagacaaaaaggtcattatataatgataaagggatcaatataacaacccaaaatacatatgcaccccaaactggagaacccacattcgtaaaacaaatattattagacctaaggaaagggagagacagcaatgcaatcatattgggtgacttcaataccccactcatagcactggacatgtcattgagatagaaaatcagcaaagaatcacttaacactttaacaggactttagaccaaataaacctaacagacatttacagaacattctactttacaaaagcagaatatgcattgtcctcagtgcatggaatattctccaagagaggccatatgttaattaacaaaaccagtctcaataaattgcaggccagacacggtggctcatgcctgtaatcccagcactttgggtggctgaggcaggtggatcatgaggtcaagagattgagaccaacctggctaacactgtgaaaccccatctctactaaaaatataaaaattagctaggcatggtggcacgcacctgtagtcccagctactcaggcggctgaggcaggataatcacttgaacctgggaggctgaggttgcagtgagctgagattgtaccactgcactccagcctgatgacagaacaagactccgtctcaaaacaaacaaacaaaaaaaagcaaaaaaaatcaaaattagattaaataacttcttgaaatacagcagtataaaactagaaatcacttccaagagaaactcttgaaactataaaaatacatggaaattaaacaacatactactgttgttgtgtcaacaacacaattaagaagcaaaattttaaacattttgaaacaattgaaaatggaaataaaacgtaccaaaacctttgggatatagcaaaagcagtgctaagagagaagtttattgcattaaatacctacatgaaagaaatagattataaattaacaacctgccattacctcaatgaactaaaaaaataggaacaaataaaatccaaaactactagaagaagagaataaccaagatcaaaacagaactaaaggaaattgagaataaaatataagggctcaacaaaataaaaaattggttgttaaaaataaacaaaattaaaagaccatcagttggactaaccaagaaaagaagagggaagatttaacaacaaaagcaaaaatggacaagtgggatctaattaaatttaagggcttctacacagcagcagaaattataaatggagtaaatagacaacctatggaatgggagaaaatatttggaaactatgtatctgacaaaggtctaatatggaccgtctataagaaacttaaatttacaagagaaaaacaatctcattaaaaagtaggcaaaggacatgaaccgactcttttcaaaagattataaacatgtggcaaacaagcatataaaaaaagctcaatatcaatcatcatcagagaaatgcaaatcaaaaccacattaagataccatcttacaccagtcagaatagctattattaaaaagtcacaaaataacatgctggcaaggttgccaagaaaagaacatacctatacactattggtgggagttaaaattagttcaaccattgtagaaagtggtatggtgattcctcaaagagctaaaagcagaactatgattcaacccagcagtcccattattaggtatatgcccagaggaatataaatcattctaccataaagacacatgcacgtgaatgttcactgcagctctattcacaaaagcaaagattaatcaacttaaatgcccatcaatgacagatcggataaagaaaatgtggtacatatataccatagaatattatgcagccataaaaaaagaacaagatcatgtcttttgtgggaacatgggtggagctggaggcttattatacttagcaaactaacacaggaaccgaaaaccaaataccacatgttctttcttacaagtgggaattaaatgatgataacttatgaacacaaagaaggaaacaacagtcatgggagtctacttgagggtggagcatgggagcagacagtggagcagaaaagataactattgggtactgggctgaatacctgggtgataaaataattggtacaaaaaatccccattacacaagtttatctatgtaacaaacattcatatgtacccccaaacttaaaataaaagttaattaaatgagaaatagaaaggggtctcctttacagttgataccacagaaattcaaaggatcatcagagactactgtgaacaactatatatacccacaaatcagaaaacctaaataaagtggataaatttctgggaacatacaactcccaagattcatgcaggaagaaatagaaatcctgaatagatcaataacaagtaatgacactgaattagcaataaaaaatctcccaaccaaaaattcccaagactggtcaaattcacagatgaattctatcaaatctacaaagaaaaactggtaccaagcctccagaaactcttcaagaaattcgaagagaagggaatcctccataacccattttacaaacccagtattttgatgtcaaggccggaaagggacacaacactaacaaacaaaagtaaactacatacccatatctctgatagatatagatgcaaaaatcccccatatctctgataaatataggtgtaaaaatccccaccaaaaaactagtaaattgaatccaacagcacatcaaaaagataatataccataatcaagtgggttttattccagggaaccaaggatgggtcaatatacacaaatcaataaatgtgattccccacataaacggaattaaaatttaaaaccatataatcatctaaatagatgcagaacaagcatttgatgaaatggagtatctcttcatgacacaaaccctcaacaaaccagacatcaaaataacatacctgaaaataataaaagccatataaggcaaacccacaacccacatcatactaaatgaagaaaaagttaaagaatttatcctaagaactggaacaagacaaagatgcatactttcaccatttctagtcaccatagaactagaagtcttagccagagcaatcaggcaatagaaagaaataaaaggcatccagattggaaaagaggaagtcaaattatctgttagttgacaatatattcttatacctaggaaaggctaaagactcctgcaaaagctttctagatttgatacatgactttaataatgttcccaaatgaaaatcaacaaaaatatcagtagcctttctatatacaaatgatgacaaagagatacaaataaataagtcaattatgtttatgataactaaaatattaaagtaactaggaatatatttaaccctggaggggaattatctctataaggaaaattacattacactgatgaaacaaatcatagatgattcaaacaaatgaaaaaaacatcccatgatcatggattgcaaaagttaatgttgttaacgtggccacactatccaaagcaaagtacagatttatgacattcctttcaaaatatcatcatcacgttttacagaataaaaacaattctaaaattcatatggaaccaaaacagagcccgagtaagccaatgaaattctaagcaaaaagaataaagttggagacatcatattagttgacttcaaattatactacaaggctatagtaacccaaacaacatgatcctggtgtaaacctagacctatagatcaatgaaacagaataaagaacccagaaataaagtcacgtaactatagtccattgatatttgacaaagctgatgaaaacatacactggaaaaaggataccctattcaataaatggtgctggccgaactggattgccatatgccgaataacataactggatccttatctctcattatgtacaaaaattaacttaagattaattaaagatttaaatgtaagacttgaagccataaaaatactaaaagaaaacttaaaagaaatcttggatatttgcctaggcaaagaattcaaaagcaaatgcaacaacaacaagaaaatagataaatgagacttaaactaaaataatcaacagggtcaacagacaacttgcagaatgggagaaactatttgcatactatgcaactgaatagagactaatatccagaatctaccaaaaggaaaaaaaccattataaaaagatatctgtacttgtatgtttattgcagcactattcacatgcctttggtattttaataccaaattcaaaacatgtatagaactggaggccttatcttaagcagaacaacttagaaaatcaaatactgcaggttctcacttaaattgtgaactaaagaatgtgtacatatggacataaagtgtccacaatagacactggagtctcagaagggtcagaggtgggtgagggatgagaaattacgtaataggtacaatgtaagttattcaggtaacgggtacagtaaaagcccagacttcactatacaatatatccatgtcacaaagctgctctcacagcccttaaatttattcaaataaaaaataaattgaaaaaaataaactcaaaaattaaaagagcagaagtatataataactttaaaatagtctggttttttttgaatttgctttgcaatttacaataattattttgagaatggagtgcatattatgtgttaactattaaaataaaatgcagtaaattttacccttgtgctattagtcataaaatgcctttttttttctcattggttttcaataacaaaaaacctcatttgattcaacttcacctacatatgaataaagtagccactatcttttaagggaattgggcttcaaacacaactggacaatttttacatattttaaaagaaaagcgtgtctatgaaagaaacacttctctagaatgaacatttttacaaatacaaaaaaagaagtttcacaccctttctacaaagatgaaatagagaacagagcctaccagtatcaatcatacagcctcagttttctaagttaaaagacaagaatgtatttattcaaaatgctcaatgtaggaccaagacaaagaagacatgcacacatgcacaaacacatataactatgtaaaataaaatttaaaactgtataatatagacattaaaattaatgcttttatatatctatatgttacataaattgacaaatttatgtactttatgtaatcaattcagaacatcgtcaagatcagattcagatatgtgagatatttaaacagatctgaaaaaatgtaccacctcaaataacatctgttaataagttctcctgtgtaataactgctttcaaagtcctttctgttgatctctgggttcattcaagtttatactatcaagtgccataaaaagaatacaagatcagaaagggtatccattactcatttgtttatttagcaaacttttatggaacacttaatgctatactctgtactatgcactgtgaatacagacataaatatttaaaaccataagtttaagcatttcaatacagaaataactaaagtttaactaattctaagggaaataagtgttttggagtgtaacaaattcttaatggctaaaagcaatgctttgcaagtcacaaaagaaaaatttttactgatagataaaatggggagaatagaaaacattgtattacctgttaatgtgacagacattgttaaataacaatgtgattaaacaatttttttcacactctcaagaactgtgaagcttcagaaattttgctgtaatcacaagctaagagtaaactcataagcatttcaaggttttatggagattggcagaagaaaaaagacaaggtaagagaaaaaggacctgattaactctattactcacggcagagcaggtagcatgaggttcataatattgtgtttattccccttgtctaattgatggtgatacatataaacatagctaaatgttatcttattaatatccttgttgtattgaaatatagtgcccaaataattatctgcaatgctaattttttatgtatgtatactggaggtttcttaaatatatacatacacatacaaacacacacacagacacacacacacacacacacacacacacatatatatatatatatatattttttttttttttttttgagatggagccttgctctgtcacccaggctggagtagtgcagtggcgcgatctcagctcactgaaatctccacctcccgggttcaagtgattcttctgcctcagcctcccgattagctgggactacaggtgtgcaccaccatgccaggctaatttcccaggacaatgtggagtaatccaagtggatgactctttggttcattacaacattcatgaagagggaattttcagtgtcaaagttcattgaacattgatgcatttaaatatataatctcaccacgcaaactgtggtaattgttattacaagaacaaaaatgacaaattgtgaaacaaaagcaacaatcaaaatagtaacatattttaagtatgtatatgtggataactattctaccaaaattcaaaacaaaatcaattagttggcagttagaagggagaggtgaaaataacgagggcattattattttatctttctcagagctgaatacaaaatatgcacattggtgcatatttatttgaagaccaatttttcaatgtggttccatatgtctcacaatgtatttaattgactaaacagttctacatctaataataaatcctacagaaataattgcatacccttatatgaaagagatttaaaaaaaacttcagtgaaaaatatttcgcaataacaaaattctggactcgcatgaaattctaaacaagaatttggacaattgagttaaatgtgtttgcactaatggaacatgtaaaaaatatatcaggaaaaattttagatgtattcatattataattccacttatatctgtactttgtttaattttaatgagtattctaatataaatgtaatactatatatttatatgtatgtactatatataaatatatatacatatataaaataattgctacatttatctttcttatacagcaataaaattgtatctagttgcagggttcatgagtggcaatctaaattatatttctataatataatctatattataatataattataatataatacttataattatattataattataatataatacttataataatattataattataatacttataataatattataattataatacttataatactctcattgaaagtagatttgggaaggtgatgacattgtcccatggaatatgacttcacatctgaggctagcaagtgaaatatcggttatgactcacctgcaatttcctcctcctggattttggagctatgtttcatgaaaataaagcaaagcttggagggaagggaagaacaatgattgaatgacttcacgagttacagctgttccacaaacctgggcaggtcttacgaccatcaaatattgaaaagacagaaaaacatctaactgtaatgccataaaaccatctatcacaaatccacagccaaaatagtactgaacggggaaaagttaatagcattcccgttgaaaactggaacaagacaaggatgcccactctcaccacttctattcaacatagtactggaagtcctagccagagcaatcagaaaagataaaaaaaaataataaagggtggtaaagaggaagtcaaactgttgctgtttgctgatgatatgatcaaacgtttacctagaataccgtaaggatgcctccaaatagctcctaaaactgataaataaattcaacaaagtttcaggataaaagattaatgtacacaaatctgcagctctgctatacaccaacagcgaccaagctgagaatcaaattaagaactcaaccccttttacaatagctgccaaaaaatataataaaatgcttaggaatttacctaaccaatgaagtgaaaaatgtctgcaagggaaactacaaaatactgctgaaggaaatcatagataaacaaacagagacacatcccattctcatggatgggcagaatcaatattgtgaaaatgaccatactgccaaaagcaatctacaaaatcaatgcaatgcccatcaaaataccaccatcattctttacagaactaggaaaaaaatcctaaaattcatatggaaccaaaaaaaagcatgcatagccaaagcaagactaagcaaaaagcacaaatctgtaaccaatagcaaagacttggaaccaacccaaatgtccaacaatgatagactgggttaagaaaatgtggcacatatacaccatggaatactatgcagccataaaaaatgatgagttcatgtcctttgtagggacatggatgaaattggaaatcgtcattctcagtaaactatcgcaagaacaaaaaaccaaacaccgcatattctcactcataggtgggaattgaacaatgagatcacatggacgcaggaaggggaacatcacactctggggactgttgtggggtgggagggaggggggaggggggagggatagcattgggagatatacctaatgctagatgacgagttagagggtgcagcgcaccagcatggcacatgtatacatatgtaagtaacctgcacaatgtgcacatgtaccctaaaactttaagtataataattaaaaataactaactaaataaaaattattcaaaaaaaaaaaagcacaaatctggaggcatcacattaccttacctcaaactatactaaaaggccatagtcaccaaaacggcatgatactggcacaaaaataagcacatagatcaatggaacagaatagagaacccagaaataaagccaaatacttacagccaactaatcttcaacaaagcaaacaaaaacattaagtggggaaagggcacactattcaacgaatggtgatgggataattggcaagccacacgtagatgcgtgaaactggatcctcatctctcaccttatacaaaaataaactcaagataaaggactttaagatctaacattataaaaattctagaagatgacatcagaaaaacctttctagacattggcttagtcaaagacttcatgaccaagtacccaaaagcaaatgcaactaaaacaaagataaatatatgggacttaattaaactaaaaaactctgcactgcaaaagaaataatcagtagactaaatagacaactcacagaatgggagaaaatcttcacaatctatacatctgacaaaggactaatattcagactctacaagcaactcaaacaaatcagcaagaaaaaaaacaaacaattccatcaaacagtgggctaaggacacgaatagacaattctctaaagaagatatacaaatggccaacaaacatataaaataacattcattatcactaatgatcaggaaaatgcaaatcaaaaccacaatacaataccatcttactcctgcaagaatggccaaaataaaaaaaatcaaaaaataatacatcttggtggggatgtggtaaaaaggcaacacttttacaccactggtgggaatgtagactagtaaaaccactgtggaaaacaatgtggaaattccttaaagaactaaaagtagaactaccatttgattcagcaaccccactgctgggtatttatctggaggaaaagatacaaaaaagatacttgcacacacgtttatagtagcaaaattcgcaattggaaaaatatggaatcagaccaaatgcccattaatcaatcagtggacaaagaaattgtgagatatatatgcatacacacacacacacacacacacacatatatatatgtgtcatggaatacaactcagccatgaaaagggaggaaataatggcattttcagcaatctgaatagaattgaagaccattattttaagtgaagtaactcaggaatggaaaaccaaacattgtatcttttcactcataagtgggagctaagctctgaggatgcaaaggtataagaataatacaatggactttgggaacttgggggaaagggaggcaatagggtgagggataaaagactacatattgggggccaggcatggtggctcacgcctgtaatcccagcactttgggagaccgaggtgggcgggtcacgaggtcaggagatcaagaccatcctggctaacacagtgaaaccctgtctctactaagaatacaaaaaattagccgggcgtggtggcgggcgcctgtagtcccagctactccggaggctgaggcaggagaatggcgtgaacccgggaggccttgcagtgagtggagatcacgccactgcactccagccggggcgacagagtgagactcgtatcaaaaaaaaaaaaaaaaaaaagactacacattgggtacagtgtacactgcttgggtgatggatgcagaagaatctcagaaatcaccacttatttatgtaaccaaatcccactggttacacaaaacctattgaaatcaaaaaagaaaactaactctacattatgtaggtcaaataattatgaggtcttgttaaagcagcttagctttccttaaaaagaaaaaaaacatgaagttgaatcacctatttttaaaaaagtatgaaagggactatgaagtgatacagaatataaatcacagtgaggatttgcatgggttttaatgcataaaattatataaaatagaaatatacagcacaaaaaaaaacccggataaacatgggggagcccacacaaacacaaatgaagacataccctttaataaactatttagtcttcagcagattaagtaaacaagtgtaagtataagatgtgagtaacacgtatgcaggcctgaaaaaatgagtactgtcataacttgttgacccaacaattcttctagcttaaataattggttggtttaaaaaattaatcaggcatgtgtgcaaaaatgtacctgcatttagcagtactgcgtatgacagggaaacccttaagacactttatatccaaagcaacctattctgatattcagcttattttaataaagcaaaatgcttgtttacctctcttattaaataattcagacccaaatctttttgctttcagttccaaatttaatccttttactcccaattccaaattcctggggaaggaagtctgatctacccaggtttgataaaactacctcattttgttgggatacaattgtccatgggtctctcatgtttctgcatgtcatgtgcccagagtcaatattctggacaatcttcacaaggatgtttgtcttccttcagcgtaaatgacagatttgttagctatttgggaaaaaaaaagtctccctcaagggcaaaggctgggcaagtttgctagtatatctcctataaaagattaggattacctaaacttggattttccagctgtgatgcaaactcactacatgtatagcatctacaaggactgtctgcattgtcctggaaacaaggagaactaaaacaaatgtgaagttgtgatgcctgctgtgccatgaaaaatcaagtccattgtttctgactcaagtatcccttagatcctaccagaatttatgaaactttagcaatctaacatgcaagtttacaaaaagcagaaaatagcagaccattcccagtttttgacatcgtgtttaatttgaatattgtattaatgcatagggcaaagatgattgcctggcatacatgcacacatacacacacacacacacacagcagtaagtaatgtactaaattatctatgtgcaatggaaaatacagatgaaaatataatatgtttttaaaaagtctggaaaaatgatgaccaaatgggtacagtaattatctttgagtgttagaattttctttgtttcctattttgtcttttcaaataagcatgtatatttttataacttataccatctcatttgaaaatgtgaaatccttacaattgtgatacatcattaaagtgatattagtcatcacaatgttgtcagtaatcaaacactgcatagggcatttcttccaaatcactatcctaagcttaaaaataacatttgatggagttcatttcttcagcatttttctatatccagttagatgacattacaccttctttatataaatattttttctctctttatattcttttgtacatctatacatttgctcatattttaaatattttaattatttatattcaataggctaccaaattgttttaaataataactttgctgctaagtatacccctgttaggaaagtcagaatattatttaccataatcacttctaggtgttcttgaagcaatgaaggcaataacaaaaatattggctgtaaattgtatagtccattaaaattcaagataagaagtcagattgtatgaaggagctagatgccacatatgaaaattcgtcctagaggagtagtatgtggtaacacattgttctcattacaatgtaagctatgcattaatatgatggaccatttattttaactttgtggcatgaaaattaataaatcatgagcaactgcaaactggtgattttttctttaggcatattttcaaaatatttttaacctggtttttttctggtgctcttcagctaagtcttggaatctactgtgtgacttatgatcaaattgtgttttttacttgatatatacagaaattgtccctcaaattaattttccaaaatatgaagaatatgaaaactttactttgcaggaaatatacttctaaaaataagtatttccttttagaaaagagggggaaaccaagaaaatattttaataaacacgtcttataaatagggacatgattattaatgattaaattctcattgtataaatgacaatttgtagatacagaattaagtaatttgtctaaggttagacaggtaagaattaatagggtcacaataaaatccatgtcttctcattatgtagatggttttccacatggcatttcatagctggtattgtcatgttcatagtaaccctgtatccactcttaaaatgttacaacccttcctcttctaccacatctcaggtggaaaaggagagtgccaagcatgggccatcccttcacctgcatagggcaccaattcacctcagcctttcattagccacggaccaaatccttcatccagttaaagggtagccaatagggacctcacaaggagtacagaaaaccaagaaacctggaattgggcccttgagccgcttgctctggcccactcccaccctgtggagtgctttctcactttaataaatttctggtttagctgcttccttcctgtgtttccttcctttgttactttgtgcagttttgttcaattctttgtccacaacatcaaggacctggacaactcatagtcaccaccttgcttcctgtaacaaaaagacactgcgtaaccttaaatagaagctcacttgctcaaagagtgctctccagaatatgattggggcagattgccatttacttcatgttgccatgttttcttgtggaacatttatgcaaatgctcacaggaggttggagatagtttgaattatggtcaggacaacttattttatagttcaaaagcagcagcctggtcttcactttatgaaatgatatatgatataggtgctgccacctcgaataaacctgaaagttacacagggattctgtggacagaaaaagagtattgccttgaaagaaaaatgccgtaccgtaagacagagctacggagatttttgcagaaaatacaattttctgacaaggttgtctcatcttgacaagacatgaattaggtgttaatactgtaattaggcgtctcattactaataattaaaaagacattgtttacctcaaaaattgattgcaccaatatttgatttacaagaaaataaaggctttaagacaactgcttcaagcagaaagcaacattgtattttaaaagttaaacctagaaatgcttgtttttagaaaatagaaaatatatctttgtattaagacagttgacactttcattgtgttttaaactccctgttttatacatgtggcttatatatgtgtgcccacaatagtgtgtacagggttgaattttgttactaactttctttaataagaggaaaaaaacactaagaattgcaattcaatagtttatgtattacatgcatatcaagatgaaaatctattaaaattggtcaaattactctgctatgaccatgaccattaaccaagaaacactgggtttggcctagtcttaggcatcaccggaaaatgtaaagaatataatgaatcggctcattcttactctgtccagtttaattctacagaaacaaggtaatacaaaatattcatccaagagtataaaatttaatgagaaagattttcagatacacagatatgatgcaatataaatattctaagtatgctattctaaatacgctatgctattcctcagaaccttttcagacttgcgcccctccgaagtcaggttgtctcttccccgaagtcaggccatctcctcctctaccaaatgagactccggtctttataggcacaggatggggagtgcattctgactggtttgtgaatatgcaaaaatggttaaagcaaagacaccactcaaagttgggcacaacagtgtggagaaacaattaggaaagggtaggtatatgtaaaataggtgaagggtggggattgataagaggaaagtgcaccgaacccagaggacaagttctcaatctggtccaaggatttaactcgtaacttggctttcaggctttaaggtgccttcagcttggagatggggtttcactaggtacctgtccctatctgcctaggcatttggctgcctcctgctactatcaattccataacagaaaaagacatgtagcaatgtgtgtgtgaaataaaatagtgtgtgaatgtgagtctaagaaatatccttaacattctcagctatagaatatatacgagctgtagcatatgaggcacaaaaggtaggtggagtatacttcataaagtgtcttagttaaagagataagagtgtttgtggaagcatgattaatctacttcagaaagatagctttagcaccagtgtgaaaatgatttgattgtgaggatcctggtgatgttaaaggacgaggaagctggaggaaggaagttgggggattatggaaactttatgttcagcaacgaattaggatcctgcacaagcaaggaatgttaaaggccagaattaagacaatagtgaaacaacaacagaggaattaatgttctggaagcagtgaatgatcccagtggaatttctgaatattgtgtatatttgtcagaatgtagcaccaactatgcaaatgttcttgcaccaaaaacttgcaaaccacaaaggcaaccccttaattactaatgccagttagtgccactgcagtaatttcctgagtaagcaatgagttcatttctctggcaagttatctcaaagcatggaaaggctgaggcatttcaggacccacgccctgcaaaagaaactgaaatgctctaaggtaaaacagaagacaactatgcaacaagagagccaaattctcaaaggcaatggagtgtagcacagtttgcatccaaagatcaaattcataaagccacacatcaaaacaactattagaagaatgcattctaaaatcatccgcaacaccactgacacagtcaaaatattcataaaccaaacaaaacaatgttcaagcacccacaggtccctatcaatcttttgaagtgcaaaacagccaaggaaaatgcatttttaagataagtgcacctaatatgactttgtaaagtaactttatgtcctaaaatgccagtgttataggtaataaatataaaatcaaggcaataaatattccttcaaacatgcagcagcattgagcagcattcccttttggtttccagaatatgatttccaaaactgcagcagggaaaatacttactttgaacctcctgcctctccaaatccaacataagctggtctggattggaacaattgtcacctatagtctcagcatggaatgtgactgttttcaagattcctttcatgatgctgtcagcgtgaaaacactcaattgtgtcctcagcttgatctttaaatgtcatttttaaaacagatttgaagtaaaagaataccattctctccatttgttcaaaaggagatatttccttcataagtttataaaagtctaggtgttaatgaattactcacctaatatagactccttaaggcatcagcagcagcttgcatcaggcgccctagggagtataggggacttagaaataaagaactatttacctataaatcttgtgcacatgttttcagaagggcaagacttgttcttggtttcaggtaaggtcaacaagcttaaaaaatgacaattcttggaatttctcagtgactctatgagacctatgtaacagccacttaatatatatgttaaataatgttttctgtgaaatttctttatatattaagaagggctttcctgtatttcttattccactggattcctggaaggggactatcccactttggcaaagctccatgaaacgaataaccttgggaaaatgtgcataaaaatgtattactgaaggcattatgttccaatatatgagcctttagtttctttgcttttcaggggctcacaaagctatatattttcagagaactaattgtgttcatttattgcaaattttataatagcaagctaaatatgttggtattttagaagatgaatttgaagaagtaaattgtagagatctttgagaggcaatgtggtctgcattacaatgatggtggtaaaataaatggaaagacttggaaagattcaagaaatgtttgatagacaatgacaagtaaattattgcatgtagtggatgagggagtacacaaagaaaacctcattgttttgggcttgagtaactgggtgattatattaataaccatgagaaaaaaagataaaatctagtacgggaagtattctaataagtgtcttttcccagataaggaataattgagaggaaaactttcctttttgactcagtcatggctttagcagaaggcaatatgacataatagatttcactgtcaacagacaagtttttaaaattttcatctagcagttgactcgtgtgtaatattagtaaagccatttgacttatttgaaacacattttctttctttctttttttttttttttttttttttttttgagacggagtctggctctgtcgcccaggctggagtgcagtggcgcaatctcggctcactgcaagctccgcctcccgggttcacaccactctcctgcctcagcctctggagtagctgggactataggagcctgccaccacgcccagctaattttttgtattttttagtagagacggggtttcaccttgttagccaggatggtctcaatctcctgacctcgtgatccgcctgcctcggcctcccaaagtgctgggattacaggcgtgagccaccatgcccggcctaaaacacattttcatgatctctaaaataaataggctgatgagaccaccccctctaccagttgctaggagaacaaaattagatcgtgtataaagtgccgcttgaaaatgtctatctagtctcaaactctcctgcctttttctagatgtgttaatatgtaggtgaccaaagcaaattgtattaatagtttaaagcagcagtccccagttttttttttttggcaccagggaccagatctgtggaagattatttatccatggactgggggtgagatatggtttttgggatgattcaagtgcattatatttatcatgtactttatttctattacaattacattgtaatatttaatgaaataattatagaactcactataatgtagaatcagtgggagccttgagtttgttttcctgcaactaaatggttccttctgggggtgatgggagacagtggtacctgaagtgtgttgcttacgtccagtctactccaaaattgcttttcagttgttgtcactgcagaaaaccgtgcttcacaaagatagcatgatggaaatggaagcaggcttctcagtgcttttgtggcaatctcaggatattctgccttgactttaatctgaaatgtatggagatttgaagttgtctcaaacatacttttaaggccaccatcatttgtgatctcaagagggtgatcctcttctagcacagacaaagttgattaacctggcttattcacaaatgggctgcagatccattccttccaagtttgggggttttctgtggctgggaagtaatgctcagatgcttgaaagctgagataggtgatgatgtaccaactgggagaaagaagaccctggctcagtctctttcaaaatctctgctaatgtttgaaacatgtcaaaaatcccaatgctcactcattgccctcataattcccatttggctttgaatgcctccactttatctgctgactggaacagttatcatttgcccctgacgtcacagcttgaattcgttgagcaggttgaatacgtcacacaagtaagcaagttttgtcacccattctgtgccactgagttgtgcttccagtggtgactgtttttctaaaagaaatctctggagtggctcttataactccaaacctctggccagtgatctacctttagaaagtcacctaacttctgcagataaaagaagaaacaagtgctctgcctccatctcctcacagagctgcatgaagagacgtgtgagttaagggtgtatagtttagtgtggttgataattttaatcacaccctgcaaaaggttaagttcaggtgacatttttgagttagccagcatttctctatggatgacacagtgtgtaaactcacattcagaagcaatctctttgatccaaatagtgaaaccagaaagcagtcaagtcatggtagccgctccatccatccatatattcagcacaaaaaccaattcagttttcctggcacgtaatcattcaaagacttggatagttttgcaattgcgatattggttggcaacaaaagcacacataacatgtgttcatgcacctcctgaaaaatatgttgcataaaaacaagcattgttgccttgttatcaacattggtacactcctcaacctggattgcataccatggtgattcattaatcctctctaacaattgtgccttaatatcctctgccatttcaccaatttgtctacttatggttctagctgaaagaggaagacgttgccaccttttgaactgcagcctctctgagaagttcatgacaaatgtccttagcaacaggcaggatcaactcttcaccaatagtgaagagcttcttggctttagcaatgcagttagcaactaagaatgatgcgctcagtgcagacacatttgatgaagtggtagtcttcagtaattgcttctgttctttacgttgatatttttttttcttttgaaaaactccaaaggcttgtattttaatgcaggttgcttggtctccaactggggaagcagttttgaaggtttcatgcctttgttggatagctggttgccacatattatacaaagtgggcttggagaaagtgaatcgcctgtagcaatgaactcatgatttaagtaggactcttggtattttattttaaatgcagatttttgttggcagtcttagagtcttctgctgtctcatcattggctcttcccccttttcaaagttttccagtaatgtttgattttaactcattttggctagggttagcttgtgggtttaccaaaaccgtgactgagacaagtgcatagtgtgagaaaaaggtatagatggaagtggtaaataaaataatgagtggaccacatgtggactaaaataagtgtcagattctgacttaaatcctgccaccagatgtagcttgtcgcttgccagtcactaatagggatttgatatgagtctgcaagcaattgacgtattatggtctctgttcagtgaaacctgtctgctaatgttaatctttatttgcagctgctccccattgctcatatcaccacctcagctccaccttagatcatcaggcattaggttatcataaggagcttgcagcttaggtccctcacacacacagttcacaatagagtttgggctcctatcagaatttaatcctgctactgatctgacagaaggcaaagctcagggcggtaatgtgagtgatagggagtagctgtacatacagatgaagctttgcttgctcactgatcacctcctgctgtgcagcctagttcctaacaggccacgaactggtacctaagaggccatgaactggcacccctagtttaaggaatatagagtttttcctgcttacttcaaaaagagtgtatcaaaccaaagtccataccctttgaaactatgctatgaggcttttctcaaaattccatcatgtaatgtagaggtatatgggtctttacacttaggttcaaagttgatggaggccagaaattgtggtagaatgcttatttattgggccacactatgagagtcactacctcaaaagcctttagaaagattatgatacatattaaaatttctcagtatagaaattcctcaaaattctctttttcacattttctttgatgaatgcagagaggaaagagagacagagtgtatgtttgtgtgtgtaaaataagctcagacattatgaaatgaccctgctctgagctgttctgcctcttactacagttagttctgctataacaattgttttgaaaacacaaatttattctagtgtaatggatatattagggtacaatttaagcatggtgtgaatttcctgtttacttatgcatgaattcatccccgaggaacactaggtgaatgcataaaaccacttagctgaactgagctaggtaggaatccacaacagtgcaagcacaaacacccctcaagtatctaccagccgccttagctgatgacatgggttatgagccactcccatccacccctgtagttacagctttccacctgatttcaaataaccctcctttcaccacttcacaattacttgcaggctgaaaccttccaataacctctccctaaagcaaacttcacatctttctcaaggtaaaatacatatttcatgtatttttttacatatttatcaattccttaatgtatatgcaatgcacttttgaccttatcagtttatcattttttcaaatgtgtcccttatgaagttgttgaatgttatacacttcacctcatctccaccttaacattcacgcttttcattgtgtgattttgcatagcacagtacattttaggaatacatatgcctcacagcataattgactgtatctaacaacttgttcaggtaacatgatcctcttcagtactccctgtaaaaggttaaaaatagtagaatcaatctcagagctgttgacaaaattaaaatacgtgtggcgcatttagtatatgccatgcaatatcatagtacttaatacatgttagatattgtgataagcagtatgatagctccctgaaggtatccacacactaatctctggaacttgtgaatattttgtgttacacggaaaagtggactttgccaatgtaattaagactttggatattcaaataaagagtatcctggatgacccaggtaggcccagtctaaatacgtgaacccttaaaggcagacgattttcttaggatgaagtcagaaagatgcagcagaggaaaattcagtgagatttgaaattcttgacaagccattgctgatttgaagatgaaggcgggcaagtgatgtgggaatgtaggagtctttacggacaggctccaggataacagtcagcaaggaaaaggaaattagatttttcccttaacctcaatgaggttagaaccagattcttcctagctagctgacaccttgatttgggcctttcccaacctgaaatggagaagcaaaacaagtccatccatacttctgacctacggagttctgggatatgttttaaactgtgaacttttgggtaatttattatgggaacaatagaaaatgtaagttttattgctattaaatatttctatttttattaagggaagagtacattgctattgggaaaaatatcattttaaactaaaaatgttatattttaagtttttaagttaacaagtcagtcatcagttactaccttaagagcagcatgaaaggaacaaaagaaaaattcctgagagagaaaccttggcaagaaggagagatgttgcaggcaaactccatttgcctcacaaatgtgttttgggccagtctttctttatatgtcgctaaactttgttaaatatttgtatatacttcgggaggctgaggcaggtgaatcactggaagtcaggagttctccaccagcctggccaacgtgggaaaaccccgtctctactaaaaatacaaaaattagccaggcatggtgcgcatgcctatagtcccagaacgggaggctgaggcaagagaatttcttgaacctgggaggtggaggctgcagtgagccgagattgcaccacagcactccaacctgggtgacagagtgagactccatctcgaaaataaataaatagtatgtcaactccaagtcttgccgttagaaagaccataaaaggtttaaacctatatgttagtgtcctattactgctgtaacaaattactaaaacactagtgtcttgaaacaatacaaatgtattgtctcccagttctggaggtctgaagttgaaaatgggtctcactggtataaagtcaatgtatcagagggcatagggctactactggaggcactaagatagaatctacttcctcaccttttccagcttctacaggctgccagcagctgttagcttatagctccttcctccctcttcaaagccagcagtgcagcatcttcacatccttctctaacctctgcttccttcatcacatctccttctctcaccttttccttcctgcatccttcttatgagggtccttatgattacatcagttctacccagattatccaggacaatctccccatctcaatatccttaacttaatccttaagtaaatttccctgtgccctgtaaagtagaatattcacaggttcttggtattaggatttagacattttgggagggccatcattctgcttcccacagccagaaacaaatatatttctaatggaacacatgatttcttaaataattataacagttccattccagctatttctcttaaatcatatattcttgcagttttccatcccctagagtctctttttgcttcaggacatgagtagatagaacctcattaatgagacaataggctggaagaaaggttccaggtgaagactatactagtgagggggaaaaaacaaaaatactgtgtttttggactcctccaatattattccagttgttctacaaacaacacacacacataccagtctatctttctctttatcaatctatccatccatataactacctatctatttagacatttatttttcaaaatgatttatggtgcctcttttggtgtttaattttctaaatgtgcaaacatctgcatttttttatgaaagcctaaaatatgcatcataagcatgccatattattaagcatgttttgagatctaaaaccagttagtgctctgtaaactgaaaataagtaataaggtgtttttatattctctaagccaaatattccaacttacacttttattctacaactaattatcaagtgtctacaaagtgccaggctctattctgggcctggggatttagtaggaccagaaacaagaacaacaggaacaacaaaggctaacacaaatatctgtctttatggagctcacaattcaataagatagctgagcagtaagtaaataaataataaaacaaggacagtataatatgtcacttaatgatagtgctacaggagagtgaaaaaaggcaggaaagtggggctaggggcaggaaggttccaaaggaaactgcaattttaactatggtggccagagtcagatgctttgctgagaaagtatctgagcaaataaaaaggaggtgagagataaagactcaagagtatttcaagaaaagaatctttggtggaggaagtggaaaatcctagagcaggaaatgagatttattctttgagaacattaattccatcttttaactaatatttattgatggcctcaaatgggtggggcactcttacatcagtacacaaaataaatcccctttcttcaaaaaacttatattccaaggaataacttgactttcctttaatttattctactctgtcatttttctgaaaatgagggaaaatcaattttcctgtttatgaaacaagaatagcacgataagcccaaaagagaactttagagattatttagctaaaatgtttaaagtactaagaatcatttttatagaataatgattggccagtataatcaccacattgaaatcttggttttagtttgcttattgttagtttgaattttagttccatcgcatctaggccttacatttgtagggcttcagttggaaccagatgatatttggaacaaaactgatttcatgaagatgatttcctagagtctaacacccagtaaatgcagtcagtttattcaaacattacactgtttccagagtaatgtatgttgcacaaataaaataaatcatggatttagagagaagctgaagtgttgtcaactgggctgtaaatgtttcaacataataaactgtacagtagaatagaagtagctcaaaagttgaagatttcagtttgtgatgcagggaaaaaggatctgatttaggtaggaaagaaaagagaattttaatgatggaaatggtctaaaagaaatcgtatatattacggttgtcagtgtgacagatggtgagactgtatataataaagtcaaaagatattttgacaagaaagaagatggatctgacagttcagaaatcagaatcctgggcagtaaaaaatgagaaaaatataattgaatgtgtgctcagctgatacatagttaattttacacagcccaaggcaacagagtatgggaaatggtcagtagtgttagcagacttgataaaacgaagagaagaggagggataatgtgaaaacaaagcaaaggaagacaacattctaccacctgtaaaatagtattttcagtaaattatttgaaaaaaaaaaaaaccagaaactaacccatctgaatccattcaaaatggtcatttgaacaatacagggctagatttaaatgctattatactttacataaatatacaacatcccttaaagtaaaactaatttttttcacagctacaaaggaaatacatttcattaacactgtttcttaaaataatcctagaaaacaaggtctctttttgacacaggtatttgaatttccttggccattaacatcttgtaactaccattgttttcagatataattctatttaaacaaatctaaaaagtgatagattctttagaacatgaataagttatataaaggattacccctttttctttcaaaaagtgactgtgttattcgcctgatgttatgctaggcttccgtattgttatcacagggacactctcaagtatagcttaaaaatacacttgtccttcacattcttaatacttttaggtcagtatatctgtagcagcaaccccttatgttaaaacctggaaagggtaaaacataatggcttcatactgaaggtttcagaaggggaaagaaaggccctaaggaaaaaaaaaaaagaaactggtttaagaacacacagtgagcatgggcagagtggacacatcgaggcagacattccatctgtgtagtccatgctcttaacaactttgccataatgacttatgagccttacctgtgaaacattccttgtcattatccttgtcagtcacatgtgcatttacaacaggaaaacgagacaaatacctaaatgctttcagaagaaacccaacagtaggaaaaaataccagaaatgaagaatgtctctatgttgtttttgtaaaggacagagttctcagagatattttatgtgtatagatgaaactaaaaacggcactgcaggatgctttaataatctttattgcatcatatttgtgaaaattatactacatcactgccatctgtagtgatgcataaatcacaaggcaataaagcctcctaataaatcttacgcccactctcttcacattattgatcccttttatttgctgatgcaagaactcttccatatgttgatgcagcatccgtgatctatgtgtcattatcctttatgtctaatagcattttctataaatcaatatccttcctctttgaagatggtcctgcagaatgaattgctatatgcttgtgtgagcatcgctgaaagcctggaggtgtggcatggcttgccattccctcattagtctgaggaaatttgtaggtgatcgtttgtggatcttccatgggttttgtcacagcctcaccctgttaactctatgttcctagtgagtagcctcagcagttttagcctcatcactgcactgtgcctagtggtcagcagtcttggatctgtgcttatcatcagatacagccctgttccactacttgacactctccttaaccataacctcctggtggtcccacttctatcagcctccatctgctaacacatcaatcacagaggatttgtttgagactcttaatgtctcataatgttataatcattgttgtttttttttttgttgttttaacatttaatacaaggaaactgctatagtgagaacatatttagtgctgatttgatagtaaacttgaggagctgatttaagcgattgtaggtaaagtcggttatacactagttctctaacccattcaggctgagccacttacagaaaacccaatctgcagtgttgtgttatatttcttttgcctgccagcctctcaaagcatgtgcagttttgacagtttcttttgccttgcctgctagccaagcaggtgacagaacattgctgtaaaagaaactgctttggatagctttcaacgttaaatcactaatgtagatttttaatgttaagcaaaaagtccatggtgcaaatggaagtatgtctgccttcatatttcacagactcttagcctaatatgtgtttgatatgctatcaccttaaaccactaaagccatgtgctgctcaaacatcataaaacatacaatcctatttttctataaagaatagtttacatctgaagtcagatttattttgaaatttcacatgctaacacaaagcattaatgttgagtgggaaaactatagaatctttagaaaggtatcagaataacttcaaaatgaattcagtatttttatgtattattatatacatcatctgatatgcactgaaaggatgaaaccatttaataaaggttaaaaaatagcatttgtgagtcaataatgacttcaaaattaaaacaaataggtaacattctaataatacaagtaatataccacttttaagaaaaataatttgtaaaaggtggcttcaaattttgctatagaaattatggaaagaacaacttaatctcaaaatcttttctagtatacccaaataagctgactaagaatttcaactctagaaacttaacaaaaatgaaaaaacaaatcaaacaaaaactccaaaatacaccaaaaatgtaaaagtgtatatttattagggttaataaataaagaagaaagtaaaagaagagataacacagaatgcttcttccctctaaccacccatttctggtcacagatgggaaaatcttacatttaagatcctctctaatatagatgttgcttgtaatatgtaggatattaatagttccctttggaccacgatgttcttgacaataagtccagtaagtcctacaattccttatatccaagcagaaagttattgtagtagaaatgggtaatcaaatgacatttgattcattcattcattccactcattgaggagagggtttcatgttttgagttactttcctatcgtgttctcccagcccaaccccttcccacccatcagaataggggctaatcccccaaagtatcatatcttattgacttatttactcagactcagagaagcaatgatttaaggcattatgagctcaactggtttatcttcctagagaaatgaaggactgctaaaataagagtcaaaatattcatatgccctagccctattatgaatacaatattaaatttaactcatctattcaggcaaataaaaataatcattgtcattttgacttcaaagtgtcctctgacttactcctccaagtcttatttcagaactaaacagcatcaccatccaccaagacctccagcacagaggaagcaggagtcatcattgattctacttcatcctcaacgttcattttatatccatgtcttattgatttcaccttcagtaactgtttaatcaacctcttctgtttaatcaagctttttccttcttctgtttttacatcctacaatttcctgagagctctcctcataaaacataaaattaatcatgtagctacattgctgatacatttaggtggccttctaatgcctacaaattaaacccaaaacctttatcactatgcaatgtaaacaaaagtgtttcaacatgttccatttataatgaacacttaatgttacaggttcaaaaatacccctattcttcccaagtatgttgacttgacaatatccaagacttttgtctccctcattcttttccttctttataagttgtctttcatcttcttctctgccaaacaaaattcaaccaaccctcgagggcccaattcaaatctcactcttcttttatgagccttgctctatacactctttcccccacatcacctctttttctagaaattctaattatttggatgttatgatgtgtgatgaatgtcttttaacaatttacatgcctgcatgtaaatgagattctggagggcaaagaatatctaattcatacttgaatctcaatatttcacacattgcctagcactggagtttataaatatttattgaatcaagtaaaattctctaatcttttaaatatgcaaacatgatctatgtatcttatttaaataaatatggctcatgacttagtagctaactatagatagatattataaaactatattgtttaaagttctgtcatggtatatttctaccaaaatgttcagatagaaaaagaagagattcagttggaaatgctcttgtaaagaacacttttattctatgataaatagaagaatttatccctgactaattcaaccagaaaagtctttttgtagaattcaattctataaccctattcaatggagttaatgattgtttcacatgagtgatagtaatacattaagatttatagaaggatgtgcaagaaaacatagccgaaagcagatataatatttaaaatataattcctgtagaacgaaaacaaaatctataagacagggctccatagaaacataatgttccatttcaggctttcaaaacagacttacaaatgaaacatttcataaacaatgaataacatgcacttaagaacctcacacagagaaaaattgcaactgagcatgcatgtgtaatttgcactacagtaatcttactttttagcaaatgcaaggaatcctgtcaccgaatggtgagcaaagtgatgggtggcatactgatgttactgaaattctctccagaggaatatggatacaaaaatataagtgtaatgttttgtacatataatttttaattgccaacaaatgtaaataaataatttgaagcttgttttcatcaagctatcgatacgctctttagaagaagccactcataagactgaggaattagacatattaaattcttaaagttttatcttggaggtgggacgatgctcatatttctgcattgcgtaattatgctttttttcagagatacaatttccttcagttttctcacttgcacaaagcatggaattctggtacttaaaaaatttattagacttttagtttgttttatttctttgcatacatataaaccatgggttaccagctgtttacaagtttactcatgaatctcaactctcctgcactgacctatcatcaaacggtagccatatcacctaccagttcctcagggaacacatgttattgaagctacttttttctctttaaatgtgttacaagtagtaaactatataattattttccggaaaaacaatccttgaatttcttgtgaatgaagataaaaatatcagttgaattaaatagtgaaaagtaaaggtgagtcttgtttttatatttacaaagaaaccctaattaattaatcatcttagccaacaacatcttagcacacaatctcataacacaatgtttagacagtgacccaatcctagaacatagtatggacttcatttatggttactgaaccaaaggtgatgacatagattttgtaaaataactcagaggaataagttgtttctttacaaagtagcctaataagtactttgtccaaaacaacctacctaggtaccatgattcctgtcagctacatcatcacttctaattctatctgaagatacaattgaaaccactactgaagcaggaaatttccctgaccccttcacgggtggaaactggaatgcatgggcactggaactagctggctgcttcttcggggcggcaggggtggactcccctggctcagtctcactgcattccaccccttgaggaggggagtgcaggtgaacaggtgcaggagccagggcaagtgcttttgggcattggcaggagcaaaactttgtgcggaccctgtggcagtgtctagtgaggagtacccatgacccctgaagccccagaggatgtgagttacagtgtttttttgttttgttttaaacctgtgtaaaaaaaaaatgtaaactaataaatactaatagctttaaatacctaattcaatgtttcttctctttttatttattttttatttttttgagatggagtcttgctctgtcgcccaggctggagtgcagtggcacaatctcggctcactgcaagctctgcctcccgggttcaccccattctcctgccttagcctcctgagtagctggggctacaggcgcccgccaccatgcctgactaatttttttgtatttttagtagaggtggggtttcaccgcattatccaggatggtctctatctcctgacctcgtgatctgcccaccttgacctcccagagtgctgagattataggtgtgagccaccgcgaccagccatgttacagtgttcttttagttttgccatctgtggacagcttaagtcttaaacagctcagtgggccccctgccttttcacgtgtggtggttgctctccaccagcaagggcaaagagtcagtgtgacagtcttcactgtctgcacccatggctcctgagctcttgttcagtgtccaggaaaaatcaggtcttactaacgaattggagggtggtgaatgtggaggattttattgctgatgaaaatggctctctgtggggaggggagctggaaagcagatggagtgggagggcaatcctcccctggagttcagcagtccttggccagactcctctctgaagccacgttgtcaagttgtctctttgaagtcaagctgcttctcttggatatccagttgcttctcttctctgctctctgctgatggagcctggggtttttatgggcacaggattgggggaagagtgggccataggtggttttggaaaaggcaacattcgagtgggaaaacaggaatacatgttctcacattgggccacggttccaggtttgagggtgggacccttgccaaagacctgccctcttctgcccagaatttccctgcctcctatccttatcactactaaggctgtattgtatcaagaaacccaagtgagataaattatattattgcttaacaagtattcactttctatccccttctgtgaaaggaatatattccctacccaattgatgttgaacgtggctatgtgacttgctttttctaatgggatgatagtggaaattatgtgagtagaatttgaaatgtgcttgtgtgatttgacttggtctcctgcactttgatctttttttcataaaaaggatatgtctcagctatcttcagttttaagaaggatgagaaacaagtgaatgtagttcacagctagaaagcaagcctaattgcgccaaatctaaagtagctgaactcatgtcaacccatagatgagtaagaaatggatgcttattggcaagcaggttggtaagtagtttggtataaaagtaatcatgtttttttgtccgtaaaagtaatggtaaaaaccgcaataacttttgcaccaacctaatacatgccaatgagttttgattttttttttacacaatgttattatggatacaaacgactgatacaccaaggaataaaagcatttcatcaatacacaaggagaagaaataattttaaaagttacttaattgtgaaactattggtttaactggtaaaatagttgtacaggtgaaagtttagttttgttatgcatgtaaagacattaataacagaagattttgaaaagtaaagcatccagtgagaaaatataaaaggaaaatgacaaatatagaaaaatcttaggaatgttattggtgaaaggaaggaaaaactaagagtgaagcttgaaggggtattagaaaatggaagccttgttaaatttttgtttctttttttctttaaaggaataaatgatctaaatatatttacaattagaagagaaatatcaatgaagcaagagccctaaaatgcaagggagggacttattaactgatttcaaacaaagctttggctcagctgagttgtgaatgacactctgcacaaagtgaaagagaggaaacaaacttactctgagacaggaggaagaaaagagtaatgttacagataagttctaaagacataaggaagctgtgatcacctagatatgttgaaatgacaagatagatagcaaacaaaggcacttgtgctagatgacctatatttgccaacatgggataaggagattgcatgactgaatatcttggagaagagcacaaacaacttttacttttacttatttattttttttgagatgggcatcctgctctctcgccaggctggagtgcagtggcgcgatcttggctcactgcaacctcagcctcccaggttcaagcaattctcctgcctcagcctccgagtagctaggactacaggcacgcaccaccatgcccagctaatttttatatttttagtagagacgagttttctccatgttggccaggatggtctccatctcttgacctagtgatcagcctgcctcggcctcccaaagtgttgggattacagccatgagccaccatgcccggcgtgtatcaataacaaagatgatggtgacaagagcaaactgtctgaaaattcgatgttatttatattagtaatactacaaactcttagtcttgttaagattaattccaaaatgtgatcttaacgtaaattcgaggattcatttggggcaggcaattcaatgtctaggatccatttacttctgctttcctgtttttaacatagggcaactacagtttcatcttggagaaaagaaaatcatagattttatcaaataacctcatcttttacatgaacaagataactatttactttctctttaaaaataaagcataatgaaactggaccccttccttataccttatacaaaaattaactcaagatagattaaatacttaaatgtaatacataaaaccataaaaaccctagaagaaatcctaggcaataccatccaggacataggcatgggcaaagactacatgactaaaacaccaaaagcaattgcaacaaaagccccagttgacatatgggatctaattaaactaagagcttctgcacagcaaaaaacaaaaccaaaaacaaacaaacaaaaaaacaaaaaacaaaaaactatcattacagtgaacgggcagcctacagaatgggaaaacatttttgcaatccatctgacaaagggctaatatccagaatctacaaggaacttaaacaaatgtacaagaaaaatacaatgctatcaaaaagtgggcgaaggacaggaacaaacacttctcaaaagaagaaatttatgcaggcaacaaacatatgaaaaaaagctcatcttcactggttattagagaaatgcagatcaaaaccacaatgagataccatgtcacaccagttagaatggtgatcattgaaacgtcaggaaacaacagatgctggagaggatgtggagaaataggaatgcttttacgctgttggtgggaatgtaaattagtttaaatgttgtggaagacagtgtggcgattcctgaaggatctagaaccagaaataccatttgatccagcaatcccattactgcgcatatacccaaaggattataaatcattatactaaagagacacatgcacacacatgtttattgcagcattgttcacaatagcaaatatatggaaccaaatcaaatgcccatcaatgttagactggataaagaaaatgtggcacatatataccatggattactatgcagccataaaaaaggatgagttcatgtcctttgtagtgacatggatgaaggtggaaaccatcaatctcagcaaactaacagaggaacagaaaaccaaacaccacatgttctcactcataagtgggagttgaacaatgagaacacatggacacagggagaggaacatcacacactggggcctgtcggggttggggggcaaggggagggatagcattaggagaaatacctaatgttggtgatgggttgctgggtgcagcaaaccaccgtggcacgtgtatacctatgtaacaaacctgcatgttctgcacatgtatcccagaacttaaagtattaaaaaaaaaaaaaagatgttattacctcctggactggattgcagagaaaactgtaaatgttttaacacactagtgtttctactgccaaattcctgttagctcattaattgcattccatatacacctttgcaaatgtttgccctatagtctgtttataaacatcttagatatggcagaaatttaaaaaaaagtaaaagagataaaaaacaacattcatatgaattatactaatttatttttatttttgaattcttattttttgagggaatcgtaagtataaatttactgtatacctagtggcgtatagtaaaattgtaggcataaggataaaaggaaataataaacttcatagtgctcagcttcaaacccaaacctctaaataacaggacaggctcagatacctcagggatcaggcagataatacaaataaatgaaacaggcaaaaaagagtacagtcttgccaagagaggcaatccctacttaactccaactgattgttctcgtttgaaaacacaaatcacaactgccaaatctgattgttcaggagaagccagaaattctgatgtataacgtgaaacctctagatttcttatatggtagcacaattttctctaaaacactaggtaatctaaataaagctgaccatctatcagtttcagtgctgtgttgtgcaaatgatgaatggcatatcccctaattgtggtattagactgcctctcaccagccacaatttgtaattgcaacaatggcatcaccagataggactctcctgctttgctatgcacacattcctgagccctggagaacaactaactctacaggaaaaagtggaaggctcatctaagccattcttgctagctttcatgactagctgctggcctacaggcaataaattcccaactgctcctgcaagtaggctttagggcctgggaggtctttatctggttcagaaggcaaggctgcttctcaaagcacctccaagtgctttggggcccctgttcagatggcaggcatttctggttaccagcacctgatgactgacaggagcagggcagtcatactcacatccaggagcttggtgcttaacagatggtacactgatttcacaacatcatctactctggggatgatccacttggccaccacaatgatgctgctgacagtggttgaagtcttcttttcagcctctgagcccattgtcatggcaacaagtttttctctcaaagtgtgacaaatcttcaagatgacaatgcagtgggacatgagacccaaggcatcctagatccagtcttcattctccagaatgggctctatgccagagtgggcgatgatgacatcatctagttctaactcagagagctcagattgggtctccatggcacccaagagactcataatgggcttagaatcatagcgctgcagcaggtctcctggccagcagtagcgctgcactcaaaccaccaccaagactgcaaacaaagccagaaagatggtagccagcacgcttatggcaacaatcactgtggccttcttgcttctctgtggctcctgacttagtctcactcatatcctcctcataggctaaattttctgaactgtagatgaccagtcccatggcggtgggagcaagctatattaatttattttttaaagaaatgaagaagtattttttaaataccacaaaatatgataccttcaattacgtttaaaacaataaaacaaacgaaacccttagatgacaaatcctagtaacaatattatattgtggtgcttacccaatcacgaatcttctgcccatattgcagatattttaagggaaaaaaaaaaacaagtagaaacaaacaaaaaaatagatttactgctggccatatggagaaattctattttcaataaataatataattcagaaaagctttgttgaggactaaagcgaataagcactttgtaacctttacttctaagaaacattccttttattatccatgtaagttatctatagaaaaaaatatttctagcatgtttttattttttttttaagttttgtttgaagctttgaagtattccttagcaatttgtgtttggagagaaaaactagatatctggcatatgcaataggcacaacttttagtttgcaagtgttttgatgtgattttttccactgaaaatattgctataagagcatagaaatcagaataagttaaatcaatctccttataaaaaattttggggtttgtgtagacaatctgttgtaagttgtttatgactatttctaagtatttctgttagccatttacaattttttgtaaaagttgaggccattctgctccattttctctaagttctctctcaaggaaaaaataaattctacctaaaactacactagaaagtgtgtatatgctcgcacatgtgtccacatggggaagagtagagattggagaaaatgttcacacggacaggaaggggtattactgtgccctctcagaaataaagaacaaaatcaagaacactatgatttttcttaattttaatatatcttttgagtatttgtatatagtgacattctcattaactatgatttcagaacaataggaattctatatttattattctattatttttctattagttctttctctctaatatatgttgcacagaggtatgcttatataaacctaaatatgttaatgaggtgattaagacataatatgcactatattataagactgaagtgtctagtctaaatgacttactttatggtacagtataggttaagttttctgactttgttttttttgagacccagtcatgctctgtcgcccaggctgtagtgcagcggtgcaatctctgctcactgcaagctccatcttccgggttcacgccattctcctgcctcagcctcccgagtggctgagactacaggcgcctgccaccatgcctggctagtttttcgtatttttagtagagacggggtttcaccgtgttagccaggatggtctcgatctcctgacctcgtgatcagcctgccttggcctccaagagtgctgggattacaggcgtgaaccaccgtgcccggccagttttctgacctttttttctgcctcctgtgcactatcttatttatttaaatttggatagtgacacaactgatctgaaaattgcatgaatatactcctttcagataataatatatccatgagaagaaaaaacacaaaatttgaaaaaaattgtataacttatactttgtcttatttaagtatttctactacatagcaagtaaagtatatgagtttgatttcactttcttaaactgaaaggaaaatgattgtacacatttgaataatatattattgaaaccttaatggtattagggacatatcaaaaaagaaatatttacaattgttacaattgatggatagtgtctgacaaaagtatttattttttgacataaatgtagtttggctattgatgaagttgttaggtagcaatttactaatgtgtataatataataaccaatagatacaaattcctatttcatggaggatggaaataaagacaaaataaagaactatgatcacactgggagactgaaaacataagcatataattagattaattgaaatagagcttttttgagttacatatttcagttacaatcaaaccgatagcttagtccttgaagttctataaaagatgaattaaatctaatatatgcaattggttgtatgctcgaaaattagttactgaaattctcaagccctttctatattattacaaaggttttcttctgatagcatatactactggttaataaaaattcacagtaaattcactgaaaatataacaatttaaattttaacaattttgaaacattccacactggatttgaatttattctttccattcccttttcattacatgttttaagaaacttctatgaatattaccttttataaaaatgagatacttaaatacattacatataaatagaaatcatgtagttaaaaataaaattctatttttgagtattgaatgaacaatgaggaaactactgacttcctagaatattttagatatattcaaaataaaattctctaaagagtggttgaagaaataactgaaatgttaatttcttaaaacagtctttactcttttagtggtattgcactaactctatgactcagtgacaataaaactactttaaagtatttttgctagaatcattacagagtattggttacaaaagcttccccaaacttgttcctccctttggcccattctcgtaattgttactattttatcttttctgtagagtctttcctggtaagtcaaatattttcctgtttttaacattatatttctattgcgaaatgagtcctgcttgaggtatttctatatttttgaattagcagtgtttattaagtgcatatgccagttctcaccactgtgtcagacactgagtcaaggctggactatacacgagtgagcaaaatcagataagggaagcttactattgaagaagacagagaataaggtaatcacacaaagaaacataaaataaaaattcacaataattcctacaaagaaaaattgtataaaaatgtgagggacgtgtccttttctaggaaacagaagaatacaatttatcattttatattaccttatgatgtttcattgtgtattttcattttatattagtatagtttgcctttcaaattgtgtgtcacccaaattgtgaagaaacaatgtaatgtactattttttattcatccctttgaatctaggcacataaaagatgtgtctgtagcttactacctgcatgaagaccaatatcattttttgtgatagaaatcttataataatccactgtgatataaaaagtttctggatgtgcatctttaaaaatcataaaatgcatttctttagcaaaacagcctaatcaaatatcattgatatcagtattcttttcttttcctaattcaatattcagttttctttttttaactgtatgctctactttagtaaaagaccaagttttattgggtaaaatataatttatgatgttatataacggtccattttaaaccaaatgcaaccacgctttaacctggtagagaaaaacaatggtaattcattatccaatgatcattgcaaaacatttctctgaagcaaaatctggaaactttcacctctcttttcctaaagctgattcagccacaaagatggcatcacaagcttggcatttggtgtaatttcattttctgctgtcaccatcttgaaatttttaacatttttatcttggaatgtatgttttgcaagtgaggtctgataggtctgataggacaatggaacatgccagtgagcagagctgcttcctttgtagacatcatgcccagtttcttatgaacacagaattcttgtggatccacaacatgcaggagttcaggaagactcagatctactacaaagtcagagtgttgcatgaaccatcgagtaactgtgataaggaaagggagcactgacattctcaagaggtcacagtttccatttgagcaatacttgctttaactgtggaaataatgcaatgatgttctatcatgaatgaaaaactctccatatcctttatttgttttactcctctgtattaaccaaccatcgatgctcaaagccatggttccttttccttatagtctttctttagcttatcactatgctaaaggtatagaggttggtagcatgtgtactatcgagaatgaaataaaaacaattgtgttagtttgtgcagtatttccaccattctgataaggatttgatgtaatttagatatttgtcccctcaaaacctcatattgaaatgtgatctccaatgttgcagatggggtctgggaagttgttgggtcatgaaagggctggatggggctggatccctcatgaatggcttgataccctccctacagtaatgaatgtgttctcactctaatagttagcgtgtgtctgactgtttaaaagaggctggtacatttcttgcttcctctttccttgtgtgacaggtctgttcttccttcaccttgctccataagtaaaagcttccaaaagctttaacagaagtcaagcagatgttggtgccatgcttgtacaaggtgcagaactgtgagccaaataaacctcttttctttataagtaactcagtctcaggtagctctttatggcagtgaaaaacagactaatgcaggataaaatatgtgttgtggaattttggtgatgctactttcaagttaaaggcccttatatttgtataggaaatggcattgcacaatagaaaatgaacagtttagtctatgttcatatttgaaaattttaatttttctttatttaaaacaacaatagtggcaattttaaaaatatcatgacaagatgagagaaaggccatgcaaaaaaggaaaaagactcaaattttagtaattttttttaagatgtaattttgcccttgttgcctaggatggagtgcaatggcacgatcttggctcactgcaacctccgcctcccaggttcaagagattctcctgcctcaggctcccaagtagctgggattacagatgcctgccaccacatcccgctaatttttgtatttttaattttaaccatgttggccaggctggcctcaaacccctgaccttaggtggtcagcccgcttcagtctcccaaagtgctgggattacaggcgtgagccaccatgcctgtccagtaatttaacagtacttttttcttcctgtttgtacaagagtgtcctttttttcactctactgagctggacctctatagcctcagacaatcaaatactctttttcatcatacaaggtagatgggttagtcatgcaacaatcatttcagtcacatctcagtaaatttatgataatcactattttgtttttgaaaactaaaactattcactcacattaagaaattaaaaccatgctgtgatgccatttactggaggaacttgtaatatagtagtttaaaatctaaacaagagacaaaggtgaaaactaaggacaattgtctgtgtataccaaccaaggaagataattatttttatgagttaaactgcaggtttttctttaaagactaaagtttagcaataatgatcatgaccacatataaaataatttctatggtgctagtatcaaaatgttattaccagaaagatctgtttaggcatcttaatctctaatcgtatcagacagattgcatgtgtactaaagtattcaaatttattttctctatatcccagttgtacctattgttctttgctaggtaattccattcagaaccattacttttctatacaacagaagcacctagaataaaaaccttgattgctttcctgaataatattaaaaaatttctatttaccacaaaattctgtaaggaccttaaaacaataccgacattccttcaaattctcagaaattctaaaatgtaatttacataaatgttagggtcctagaataaccctattagggttccttcatccattttgtaggggcaggggaaatataaacaatactattattaggaaaataagtgaataggaaataatgtttttaaactcttattttatgttaatagttgttacacacattaggctaaggtgttaataataaaaaaatataagaaactcttagaactcattagcaaaaaatcaaaccaatcaaaaatctggtggggggtgtatttctagggagaggtaactaaatggtaattgctaataaaacttactgatttcttttcctagtcttaggaactttcttcaagcatttaaagtatgaagagaaagtattctttctcctcctcatcagaacccccagcacaatctacataatcacaataaatttacataaaatacagttatgagcagttctaatacatttcctaaatcttgaaatactttattctattgtttctactatattttcaaattataaaaaaaatatgagaatgaattatctttgttttatacttcagtattaggtcatggaatctacataatggttaaatgattattagtttcttgtatttcaaacactcattaaaagcttatatattctattcaccttggagaacaggtgatctatagaagcagagcaaaatagtttctgtgtccataacttttaatgctaatctttattttagtttactttggtacctaagcaaacctatattctagcataattaagcagaggagagaccatagagcacctacaccacagaacaaagtaaggtgatggctctactctggttgtcacttcccatatgtctgtgagacacattatcatacatgcctgtcattgcacagtaactttgaacatccagctaaaattccagagtctgtccagaaagaatatgtccactttttttttttttttttttactgagtctcgctctgtcacccaggctggagtgcagtggcatgatcttggcccactgcaagctccgcctcctgggttcacaccattctcctgcctcagcctcctgagtagctgggactacaggcgccagccaccacgcctggctaattttttgtatttttagtagacacggggtttcaccatgttagccaggatggtctcgatctcctgacctcgtgatctgcccatctcggcctcccaaagtgctgggattacaggcgtgagccaccgcgcctggccatgaatgttcttaatgacatctagcatgatgaatccttttcagaaggtttttgattgactttgtctagatctaccagagaaatcactgcctatgacagctgcagccttatgaaatgtatttcttaaataataatacttgaaagtcaaaattactccttgatccatgggcttcagaagggaagttacgttagcaggcatgagaacattaatattcttgtacatctccatcagagctcttgggtgaccaggcccctcgtcaataatatttttaattttttttctgctcagtaagtctgaaaaacggacttaacatattcagtaagcaaactgtaaacaaatgtgctgtcatccacgctttgttccattcacagagcacaagcaaagtagatttaacataattcttaagggccttacgatttttggaatggtaaattagcattggcttcaactaaaagtcactagctgcatcagcccctagcaagaggcaacttgtcctttgaagctttgaagccaggcactgaattctctctatctgtgaatgtcctaggtggcatcttctaagaaaaaggctattttatctacattgcaaatctgttatttggttaatcaattatgttagctagatcttctagataactttctgcaacttctacatcagcacttgctccttcaccttgtacttttatgttatggaaatggcttttttaaaaaattaaacattatgaagcaaccactgctggcttcagatttttcttctgcagcttcctcacctctttcagccttcacagaattgaagacagagagtcagggtcttgctctggattagagttttggctaaagagaatgtcatacctggtttgatcttctatccagatcactaaaactttcttcctaggagcaatgaggctgcttctgtttcttactatttacacgttcactggagaaccacttttaattttcttcaaatatttttttttatttgcattcaaaacctggctatttggtgcaagaggcccagatttcagcctgtcttgactttccatatgccttcttcaataggcttagtcatttctagcttttgagttaaagtgagacacatgtaactctttctttcacctaaaaacttagatatcaatatagggttattaattggcttaattttaatatttttatgtctcaccaaatagagagatttgaggagaggagagagctaaagaagagcgagtttgtggagtagtcagaacacacatttactgattgtttgccatcttatatgggtgtggcttatggcccactcaaaacaattacaatagtagcatcaaagatcactaatcatagatcactgtaacagatttaatgacaatgaacaaatttaaaatatagtgaaaattaccaaaaagtgacccagaaacacaaaatgagcacctactgtggcaaaaatggtgtcaataaaattggtcaaaacagggttactaaatacttcgctatcttgaagtgtaatatgatgaagtttgactgtacttaaaactgatcgagagagtagaatttatgttaaatgttcttcacatacacacaagtaataataaaggaggcagtagaaaaatttgggaagtgatggatgtggttatgtccctgatggtagtgatgggttcacaggtgcatacttattctcaagcttattgagttgtaaacattaagtatgtacaactgtttacatgtcaatcatatttaaataagacaattttaacaacaagaaagaaatactcccctgagaatttcaggacctcagagggaatggctccatgatgcacacagggagcttaatcgtgtcattcattcagtttttcagttttgtcaaagcttctcacattacgaggcaagtatgaaagccacaaaatcaccggtgataaaggaattaggttaactgcaaataagaaaatttagtagtgaatacggaagacttaagattaaaggatttagtctctttcctcccatactgtgctatctgctaagatttacttctttgtctgaggacagagtagacatctaaaaatgacctcatttgaattatcttctagtgaaatgagatggaaaccgaggtgacattcaagcagaaacaaaatgaacaaatgtgataaacctaagtttacagcataagactaatatctgctataaaattacattttaaagatttacttattttatagaaataagtctataatttttttgaaccttactggtagtgcctacagaaccatggggtgatttcataaatatgacatgtgtaggtgacaaaagacaaaaggcaccaggcccaatctaaaatgccttttaatttcacatctggccaaaccacataattgctacaattatgtaaatgaaagtctatatttggcaaacttccatataaattttattggttatagaaatagtaaataatgatttactgtcaattttcaattttttttctaatggtaaagagcattcttaactattgatatttttgaaagttatcttcacagaatggtccatgaaaagcagttctgattgcttttcaaagtatctgcagttattttacagtaaaagacatttttcatctcatgagatcaaacagcatggaaataacttaggatatttgtgaaaagtaagagtgttataaattcattgatttaaatatccaaagttctggagaagttacttgatttttttgtttattttattggaaatactatcacattacataagggttagaatatttagaattgttacaaaaagtgtcagaaaataattgataatcttaacttaaaaggaacaaagcacaataccaaattaataagggggaaatgataccaaagtactgctcttctgtagatgaaatacaagtggctatcaaactttagtgattgttacattactctaaaatagagaatactatcatatcattttctatttctagaataattctataatgcatagatgactctttgtaaaatttggtatacattctctacattcatgtctttacatgacattaaaatattgatgaaatatgtggcttaattggcaatcttggcctaaattaagctattacgaagaatcttatgtttctaatatttaaaaaaagcatattttgccattcaatgagctttagaaacaacacagtttttaagcaaatcacctagtagcattattgaatcaattctagttggtaaagaaatcagaaaatgggtcgtaaaccactggggctccacaccactaatctataaattcaattttccagttaaaagagacttaaatcccaagttgggtaagacttggagtgagaaacagatgctgcttgttttgtgcttctaagccaatacggaatctctggaggctgtattcaagagacccaatcaaggcatcttatcacctgcccaatattgggttattctagacattttctaagactcctctcacatgttcctagccaatatagtaactatagtacagtttcaatgtctatacgcaaccagtatcagaatttacggaagtagactaaaagttaaacaatctggcatttatattaacaaaattagttattaaaactttaatttagtaaaacttgaactaaaaacatgtatgtgtaccaaaatgcatgcacattatatatgcagattaaaagtaatgctagttttagagtgtatacactgaaaaaacagttcccttttaagaagaaataaaatatgattgagaaatttttatctcaggtacatttattttaaatttaaaaagtagagaaaaaatcactttaattatgcgaattgctaaaaaaataatatttgacaaaaattgcacactaaaagctcttaaacattatttccagatatactggaaagatttttcttctcagtattgccaaattatttgaaatagatgtttgttattaaaaactctggaacagttatgaaaaaatttctatgtatattttcttacttctctaaaactctcataagcagcatgaggggaaacagtgtgtcatgcaccctacagccctcgtttgtcctaatgggaagacagagtgcgctcatcatatttgataacattttcacacaatttcaaaaagaaaactgtttcatttttttctttgaaacatttctaaaaatacttcaatttagttttcctaaaaaattctgaaaaaactctctaagcatcacaatgactgttctgagatatgtataataaaaatacatgttattaataagatgttaagaaaaccaggattttaaaagtcagtacataaatgtcaatatacaaaatggcagtcatttatgggcttagtaggtgaatagtgaattaaaatgtgcaaaataaaaaatgcagtttattttgttaatgaatatttaactattttattaaagtgaaatttatataacaaaatttagccattttgagttgtaaaattcagtggcatttagtatatcataatattgtataaccatcacctctatcaaggttccaaaatattttcataaccttccaaaaatagactttactcattaaacagttacttaagcgacaatattttaaaacttgttagccactgtaatccagaaaaatggtaccactatgtataaaaataagcagttacttaagcaataatattttaaaacttattagccactgtaatccagaaaaatggtacccctatgtccaaaaatccagaaggggaaaatttcttatggtttttgaaatcttataaaggttctccattggcaagcattatagcttttgttttgttttgtttatctggaataaaatttgaaagcagctctaagtgtagagaagaatcaaatctgattcccttgaataaagtagagggatatatgttatacatttgatctcattccatttcattgcaagcatcacacatatccttaggaagtccttgagtagtagcctccaaaggctagagtgtaccttagggaatgcagaacaggcactgctgggatataagaagaaaacattgaaagttttatttctcatactttaaattttttatttgaagtattgctgtggtttgactagcaataccccaaataaaaatttagaagtatgagaaataaaagttgaatattgttacaagggcaattaaatttcagcatgagtttcaaccaaaactcgtgttgaaatttaattgcccttgtaacaatattaagaggtgggactattaagcgatgtttaggccataagggttccatcctcataagtggattaattaatactattgtcaaggttcattatctcaagaatgagttccttatgaaaagaagagtttgtcacccctactttgccttctctttgcccttcaccatgagataatgtagcaggaagacccttgccagatgctagccccttgatattggacttcctagcctccagaaccatgagccaatacatatatgttcattaaaaaaataacgcatctgtggtagtcggttacagcgtcataaatagactaaggtttgatttttaaacatttacaatataacactacagtaacacatttatgtgttttttaaaccaaaacaagtcataggagaacatgaataaagaatttaggaatcactggatgtctagtatccatcatgttgtttcatgttgatacctcttaagcattttgaattggctccaccacaaggtctatttttagcaatttccatacagactgtatataggctgatgtgcttttgtggaggataaagcaactttgtcagttcatccatcactaataatcctgatactcaaaatcctcctgtaggttgtccaatgccctttggcatagtcataaatatacatgcaattttatgattataagaatttggaaaacttaatcatttcaatttgctatggctgattaattctgctatggtctatggtactggaaacagaagagtactcagatttctggctgctaagagctttcctgcctggagctgtcttcctcaaagcaacagcttggggaatacaaattttctaccactacaaccactctgcaggccacccatctgtaactattctctgggtagaacaacagttagagtaacatacttttaagttagtttttgtgagtgtaaacttataactggatgatgaaaagcaagtaaaactactttgtaatttttggtaaggatcaatgggttatatcatctaggtccagagtaatttttaactaccgttaatttccagagaaggctttcccatagtcattccattagtccaatgcttatttgaaatcttttctcttctctgcatttttctttctggtaacccttatgttggcgtcatttttgaccttgtagttctgtaatcccagaatctttttggtttgtttttgttttgagatggagtctgactctgtagcccaggctggaatgcagtggagcaatctccactcactgcaacctccgcctccccggtcctggttcaagcaattctcctacctcagactccagagtagctgggattacaggcacgcatcaccatgcccagctaatttttgtattttggtagagaccaggtttcaccatgttggccaggctggtcttgaactcctgacctcaagatctgcctgcctcaggctcccaaagtgctgtgattataggcgtgagccaccatgcccagccctagaatcacttaatagcgccttcatttctctctctgatctgtttgagccattagtgtacctaggggaaagacatagcacattcagggatttacattgaaaattctggttctttatacttgtgctttagggtttgtgcacagaattagaatgaccttctttatcttttacaaagtctctcaaaaaaggaatacatgattgggagtgggataattgcatttgtcacttaaattaaaattctgtttttatgtctgctgatgaacatacactttgtcagttgttggttacttctctttgatgtttttcacatatttatttccaatatctgtcatttataccaaccaaggtagtcccaaataaatgtcatcaagaatacagtactgctaagagtgtggagaacatagatttctacaaactaactattggattagcagtgaaattgtactgtgtgatacctacaaagccaagaacattattcagggtaacttttgttcttgtgctacatatttaaagacatgtgattcaccaggaaatacaataaatgtaataataaacacacatcaacacatttcaaatatgctggcattccagctactctaagtaggaaagttatagagcagcgctccccaacattttttggcaccagcgaccagcttcatggaatacaatttttccacagacagggtgaggaggaacggtttcattacacctcagattgggcattagattctcataaggagctgcaacctgcatctcttgcgtgcacagttcacaatagggtttgcactcctgtgagaatctaaggcattagcattaattggcatttatagctcagtatcatctacattccaaacacttaacctaaagaaagttcaatttgctttttcaaaataactcatctatcattgtgttcccagaaggaagggtatctgtggatgctatggagctagagaagacagtgattgagaaaacacagtggaatctgaagcttctatatattgtaattaaccaagtgggcttgggaagaggagatcaaagtctaaaagagcaaaagaatgatagcatgtataatgtcacatactatttaaaattttttaattttttattgttttatgagacggagtctcactctgttgcccaggctggagtgcagtggcatgatctcggctcactgcaacctccacctcccaggttcaagcaattcccctgccccagcctcccgagtagctgggattacagggttgtaccacaatgcccagctaatttttgtatttttagtagaaacggggtttcaccatgttggccaggctggtctcgaactcctgacctcaggtgatccacccgccttggcctcccaaagtgctgggatgacaggcgtgagccaccatgcctggcctaatgccacatatttaactttgctccaaagattcaggtttggaaccatttagaaaattgtaatttcataatttaaaaaatatggtatacaagagattttatgggcaagtatattaaaccctagttcttatcaaaatgaaaatgagatatacaattacattaataaaaattgtaacagactattgatgtagattataccttttgtacaccatttgatcacctagctctatgctttctataaaatctgatttatttaagaccttgttacaacactcagaattttttaaaagcctatgccttctaatatcaaagaacatggactttagaactacttagattgttttgttgagtcagattagggcccacttgtttaaggcatagctaagcaagaaatggttaattacttacatttgaaaatttatcacatgtcaaatactgcaaagtataggtcacatacttgggttcttagtattcataaaaccatatgaacttcttctgctgcttctacaggttgaataattcaacgactattctaaaaaaaaacattttagcaagtcttgctaaattagaaaatagaaatctttaaaacagactgcagaaatttgattctgttgaacagataccatcaaaaactaaagcagatttgaacaacttggactagaaactatgaacaggaatcgatagcccaggttgtctactctggagtccacagtcacaatcactgtgccattgtgtctttttttcatacatattttgatttttaatatttgagtaactgctggcatttaggaagttagaggctagtacgtaatatataatagcaaatattttaatattgctaataatagaatgccttatagtaattcattacttatatcttttaatattattagaagtattataatttctaatagattattagagttgtgtttcattacaaaattttattttgtcatttgggattaatttgactacagaatataagcaattcatctttgcttggtttattttggaaaactccactttttgtgaacataatatctcttacaaaaaggttccaaagtaatttaatactttattatctagttatttttaaagctatattttgggaatattttgctgaaagctaaaattataataaaatagagagcaaaagaagtactttaggtcagcttctctgttacccaggtgtcaaatgataaattcctagattcttctattggacatagatctaaggagtaataggattagttagactgagaataaagaataaatgaaaaaagataaaaccatggctttgagtttagagcactgagagtagtaattttacagcaaataagagggaaagtaaaaaaaaaaaagctttctttttctgaaatattacagagaagctaaatggtaaataatttttttttactataatatgtcatccaaagaaaactactttagaaaaaaaagaaaagataagagctaaggttatacatttgaatgtgatctgcataaagctggatggatcagcttaaaattacaattttaaataaggcatagcagcataagaagaatttctaggttatttaaatttacattttagggttcttttcttctacgatgttggattggaggcttttagagcatctcatccacttggaaatagcaagataatgcatagagactaacactgtgagagtatatagaaggtatatgggaattcactgaaaagcaaaggacacttcagattttagacaagagaaggtgggtgatcagcatgcatggaggcattcggctgagaaaagtaggagccccagtacatgagaggggcagagtccccctgagctgcccctcccttcccatgccaagaacttggtgcagcagcactgtctctgctccacattctgacaaatttcgaggcacttggagcacctattcttctagattaggagtttaggcccctcctttgctgtgtagagaacttgatgcagtggcagttttcatgctacaagcctgggcatatctcctggcttttggtacacctgccaacctggattaggagcttgagttgcccctcccttcccatgcaaagaccttgttgcagcagtagtttctccactccttgcctgggcagagtttttccaggcatatggcacatttgctcccctggttttggagcttaagctgccccacccctcccacgcagaggagttggtggagcagtgctctttccactccacacttagatatctctccaggcatttgaagcaactatacttcccggttaggagtccacgtcacccctttcttccaatgcagagaacttggaggagtggaggtttctccactccacacccgggcacaagtctgggtgttgaatggctgcccccggactcctcattggagctggtgcttgcacctgcctttgagatacctgtaggtggacctgcctggtccagctccaggcagctttgtcccccactctggggctgagcacagagacaaggccacagggcatagcacagactagcccattgcctgaggaaactgagtttctcatggttaacaaagatcattcatatacccatctctttcagccactgttggctcctatctgtaaacaccacctatttgtctggaggtggaactgcacaacctaatagaaaatctgctgacaagagtgctcagacttgaggaacaacataaacttgccaagacctctgctatcacagccccatatgtggcagcaagtctgctcacactcccaggacatcactactacaaccaggatttgagaaagccaccacacaaggctatctgtaaccaatgaacttatactgaatccttgccatttaaagcacccagaaccaaagccaaagaaccctgcacaacatacattataatcacatcctcaaggatgtgactcattaagaaaaaaattaaaaataagaatagacagtttctccagatgagaagaaacagataaacaattctggaactatgaaaacaaccaaccaaacaaacaaacaaacaaacaaaccgtgttacaagccctcaaaggttactctaactcttcagcaatggatcctaaccaaaattaaatttttgaaataccagataaataattcaaaatgtgatttaaaaaaaactcagtgagatccaagagaaagttaaagctaacacaaataaatcagaaagagaatgactcaggatatgaattaaaaatccactgaaaagacagctttttaaaaaataaacaaacataacttttagaggaaaaaattattgaaggaattacaaaatatagttgaaagccttaacaacagactagaccaagcagaagaaagaatttcagagcttgaagacagatattttgaattaaaccagtcagacaaaaataaagaagaatattaaaatataaacactgcattcaaaaaatatgtgattatgtaaagtgtccaatcttatgagtcataggtattgctgagggagaagaagagtaaaaaggttggactatctatttgagggaatgattgaggaaaactaccttagtcttgctaaagatttaaatatccagatacaagaagctcagagaactccaggaagatacattgcaagatggatttcaccaagacatatagttactaggcaatctaaagtcaacatgaaggaaaaaaaatactaaaagcagcaagagtaaagtgtttaatcacctctaaaggacatctcatcagatgaagtggatttctcaattgatacctcagaatacagagatcatcaaagactactagaacagctgcatactcacaaacttaaaaacctagagaaaatggatacattcctggaaacatacaaccctataaaccagaagagactgtggccctatgttcagtcttaaagggaaaaaaactatcagacatgcattttgtatactgctaaacaaggcttaatacatgaaggagaaatagtctttttcagccaaacaaatgctaaggaaattcatcactattagactggtcctacaagaaatcctcaaaggagttcaaacatggagataaaagggtgatgcttgccatcagaaaaacacacagaagtataactcacaggtcttataaaataagtatacaattgagactgcaaagcgaccaggtaaaaacactatgacaggaacagactcacatatcaatattaaccttgaacatgtaccaagtgttcacttaaaagatagagattggtgtaatggaaaacagcaacaacaacaacaaacccaaaaaacaaaaacagggttcagccaaatgctgctttcaagaaacacacttagctgataaagacattttcagactcaaggtaaaggggtggaaaaagatatgccaatggaaaccaaaagagaacaagagtagttatacttacatcagatagaataggctttatatcaaaaaacagtaaaaaaaaaaaagacaaaagaggtcatcagataatgatacagggttcaattcaataaaaagtaaaacaattgtaaatatatatccacccatcaccagagcacccagattcatacaaaaaatgctactagataaaagagatagacagcaatacaatactactgaagtacttcagcaccactaacagcactagatagatcattgaaataaaacaaagagacactaaacttaaaatggactccattgcaatgaacctaatagatgtctacagaacatgctacccaacaatcacagaatatatattcttctcttgagtgcataaaacattccccaagagacaccatattttaggccacaaaacaagtctcaatgaatttggaaaaattaaaatcacatcaaatatatttttaacctcagtggaataaaactagaaatcaattccaaaaggaactctgaaagctatacaaatacaaggaaattaaacaatctattcctgaatgatctttgggtacatgatgaaattaatttggaaattaaaactcttcttgaaaaaatgaaaatggaaacataacatactcaggcttctgggatacagcaaaaacagtgccaagagggtatttttattgtgttacatgcttacatcaaaaagatacaaagttcaaaaattaacaacatatcatcacacctgtataaatgacactactataaatggctatacattcacaacccagaaaaatctaaagaaaatgaataatttcctgaaaacatgcaacttcccaatattgaaccaggaagaaacagaaatcttaaacagaccaataaaaaggagtgaaatagaattagtaatttaaacatctctctggaaaacccaggaccagtcagattcacagctgatgccaccagacatacaaggagaatttggactgatcctactgaaactgttccaaaaagttgaataggagggattcctcctaactggtactatgaagccagtatcagcttgatactgttgccagacaagtacacaacaaaaaaagaaaactacaaaccaatatcactgattaatatagatacaaaaatcttcaataaaatgctagtaaaccaatttcaatagaacattataaagaatacaccaaaattaagtaggtttcattccagttacagaaagatggttcaacgtatgcaaataataaatgtgattcactacataaacatttgataaaaagcatctgatgaaattcagaatccctttatgattaaaaaccctcaacaactaagcttgaagtaagctatctcaaaagtataaaagccatgtatcgcaaagccaacatcatactgaatggagaaaagttaaaaacattccccctaagatactggagcaagacaaggattcccactttcatcagtactattcaacacaataatggaagtctttgccagatcaatcaggcaagagaaagaaataaaagatatccaaaccggaaccgaggaagtcaaattagctctgtttactgacagttgatcttatacctaggaaaccctaaagattactcccgaagactcctagatttgataaatgatatcagtaaagtttcaggataaaaaatcaacatacaaaagtcagtagcatttctatacatcaataacaaacaagttgagaacaaataaagacctaagttccattcataatacctataaaaacctatggaaaatgttctatgaatacatttaaccaaggaggtgaaagatctctacaagacaaagtacaaaacactgatgaaaagaattataggtgacacaagcaaattgaaaaatacctcatgctcatggattggaagaaaccccaaagcaatctatagattcagtgtaattcctctcaaaataccattattgattttcaaggaattgaaagtcctgaaattcttatggaaccaaaacagagtctaaatagcaaaagctattctaaacaaaaataagaaatcttgagaacatacatacacacacacacacacacacacacacacacacacacacacacacacacggaatactatccagccagaaaaataaaagaaatcatgtcttttgcagcagcatggatggaatgggagagcattatcctaagcaacataattcataaacagaatgtcaaatactgcatgttctcacttgtaagtttgagctaaataatgtgtacacaggggcatagagagtggaataatagacactgggaactcacaacagtgggagggtgaggggggtgagggatgagaaattgcctaatgggcacaatatacactattcagatgattattacactcaaggcccagacttcactactgtataatatgtccatgtaataaagctgcacttgtaacccttaaatctataaaaaatgaaagataaatttatagttcatttatgtaaaatgcattttgtgaatctataagttaatacaaattttataaaagtacattcaaacccacatcaaaataatcacttacattgagacttgttctatttgaaattcttctctagcaaatcattagcaaattattaaatatttttctactccaaacagatatgagtatattctatcataatccatgcatacactgacccccaaaattctttaggtattcaacattccatatttgttattttatatgaaaattttgtttcacaatttgttttaaagtccaattccatatagttattttgaaactttttggattttatatttactttatggcaatgtttaaagtttgcagcagtagaaaaactgaactccaaatgattaaaacattaactttccatttaatgtaagtttgtaggcatctactcattttcagtctgagacttttatttgaataaggatcttgcttttttaagcattagatgcacatagaatatgaatgggaatgggaccatggcagaattcaagccataatgccttatagcctggtttcagataccttagatataagattatttcctcaaatttaaggtgtgctgatttatcaagcacatttatgacatttttataatcacatctataagttttaaataacctttcatgttttaaaggacaaggacaattatatatctccaacttgtctttaattttagttgaaaacagaaccttattaaaattggagcgttatacatgtaaaaccactacagagtgtccttttactcagcacagaatacatcttagatgaagttcacaataaaatattcttacatgaacttttgtcttgttttgaatcataagtgtagaaataaagtcctgaatattttctcatgaaacagataattttaaaataacaataacaaatcaaagtcaaaaaattttctgaatttaaaaatacaaagcatcagtgctttttttttttttttaacagatgtgatactccctgatgaagttttctagggagaaagaaaattttaatagagtcactttggccttaggctcatttatatcccttctttgagacttggtagatggatcttcacatatacgtacagaccccaaactaatatctgatttataaaataaaaaattcttagggtgacattgaaggtgctctattacctgtcttcaatatatttttctatccttacctcttattcacatttcaacattcggttttctaaggaagacatactctgttatgacctgatgttttttgtctgtaagaaatgtgcttccttatcatctccccatagaggaatccttctccaacctgaaaagttagtcctgttgatttctccctgactgtctcaggaaaattgactaattttcttcactgctcccacacgtcttgttcagacttctattataactcttagtgcactgccttggaattatctcttaccataactttctttatcaaaagactaaatattttgtggcaaaagacatgcattttttttttatttccagcatattgaggagtggcacattaaatacacaagtatgttttgactgtgtgagtgaatagtagaatacacattttggtagaaaaactatgctatcacgtcttaatttgtatcatttaaaatgtatgcatctgcttaaccaatggttttatcccactcccctaactgacagaatgaatattataccactgtatcaatcagtaaataagtgggttttatgtcttctcactccacctgttctgttccttcttttactgcacagctacatctacaaaagattaattttttttctttttttctttgtgtgtgtgtgtgtgtgtgtgtgtgtgtgtgtgtgtgtgtgttttgtttgtttgtttgagacggagtctcgctctgtcgcccaggcagaagtgcactggcgcgatctcggctcactgcaagcttcgcctcccggcttcacgccgttctcctgcctcagcctcctgagtagctgggactacaggcgcccgcctaagtttttttgtatttttagtagagacggggtttcaccgtgttagtcaggatggtcttgatcgcctgacctcctgatctgcccgcctcggcctcccaaagtgctgggattacaggcgtgagccactgtgcccggcccaaaagattaatttcttaacacgtcaaacacagacatgtctcatctagtacgcacgagttatttgttgagtgtcagtcttgtgctttgttctttgctccaacagttcattgatagggatcctgggaaaaacccctttggaagcctggacattctcccatttacctcactagccactatactctcctctaaataagttaaaacttctgtgtcttggattaaaagcagactaatacaacttgattacaatgtaggggcaaatgacaacatcaaaatataagaggattattggattttgtcaataaaattgaaatttatcactactggggtactactgcttggatagcctggaacttgggtgtttggttttttttgattagagacatgactagactcaactctacaaaggaaagagtttacgacaatcctctctcagtggcaaactgaggaaacagaacttgcacccagtccatgctacaattattgtgcctatagaaatccaccagtggaattacttttctccctctaattaaggacacaaacccagttttatcattccctccactgcagtttggagtgagaaaaagtcagtacacactacatctcttttgacaacagatttcttttctttcatcaacacccagctaggagaataatgggagatggagctaaagtctatttttgttttattaaataaagagtctaccctttgggcaaagagtaatcaatttggatggggagaaaagataaaactctatcaccaatgatagtagaaaattagtcttggccgggcgcagtggctcacgcctgtaatcccagcactttggaaggccgaggtcggcggatcactaggtcaggagatagagaccatcctggctaacacggtgaaacccggtctctactaaaaatacaaaaaaattaaccagacgtgatggcgggcgcctgtagtcccagctactcgggaggctgaggcaggagaatggcgtgaacccgggaggcgaagcttgcagtgagaagagatcactccactgcactccaacctgggcgacagagcgagactccatctcaaaaaagaaaagaaaagaaaagaaaaaaaattagtctgaagttgtaatgagacaacgggtagctatcaagagatacaggatttggggctaggtgatacttgtttcaagcgagacattcctttggactcatcactaattattgtagtgtgaaatcagctcatggatttagtgacatgatacactacttatcaccacttctcttagtctatttgtacaaagtccaattaataacttatttttaggtatttgtaaatatagttttatgtacataattttacttgaaagtaattctgtagtaaatttgcctactgttctaatgaaaataatgtgtctatataaaacaaattgtataagcaaaatcatcctatttttaggcaaatataactaataatttaattacacttatgctcttagttcaacatgtaatcagttgtacagtaagtgcagaattaacactgagaggttaaaaataactagaagttctacatatatttcatagatatagataaaaatatatttaaaatcaaaataaaggaggatttaatcatctaataatccacaaatgattgcaggaattcactctttctgaattatttttaagaacaatcaagagaaaatattaacaattagcaaagagtaaaaccttcaaaaaattttgaaaataaaaactaacagttcactttataaaatgaatagtgtctaacaggacaacatattactgcttattactaccatggataacacctgtatgtattaatgctataaaaatggtcaaaaatgtctcattacaatatttaaacctttgtacaatatttgaggcaaaaaaatgttttcagcacagaaatgcactatacattttgtgggatttacctttgccatactaatcctacatttctgtactgtcattaaaggtaccaattatgtttttaaaatatattttacacttgttggaatgctgagtacaaactttctaaacaaggataatttgatgcaggccacagtgccctctgtcttctcaccccaaatagttgtatagttttttgatctttcccccatcagcatctgtacttttccactctcctttacagcttctgcatgccataaagcttctcctctctttgacactctaggctggtgaggattttcagatattatcttgtatatagagtgaccagctatccaggtttgactaatatgttcccggttttagctctataagttctgtgtcccagaaacccctcagtcctagacaccccaggagggttggtcatcctgttgatactttctacatcatagcttctgatgtaacgctgccatagagtaaaaatggcatcaagctaggttaaggcagaaagagagagagtgagtccgaagaagtctgcttctacccagtccccttttcttcaggttgctatgagaaatgacatgagccaagatacttatcatggccatggcaaagaaagctgataactgagggccaatgtgccctcccagaagacctataaacacaagctgttgtgcaggacagtcctgaatattcatcagtggatcaacaatgtctttaattgcagcttgtcagttggaagtgatgagcaggtccagtgcaaagtgcattcataaggccaagagagagggctgacattcagccagccatggatgcttcggtgggaaccctacaaagtcagaggctgactcagagaactggtaagatgagacatactgaaagaggctggtggtaccagtgaggaattgaggacactttagaacctagccattgtctccaactctttgatgtaactttctgggagaaggagtaggaaggaagtaggagaagcatgttttttgataacttttactaaaaaaattgctttaaatgacaaagaagtgactgaacatttttctgtcacatttttctaccatcagtggatttgggggtttcgtaactctacttgaattcagttagaactatctgcacaagtgggttgagacctaacaacttaaagccattgcaatattctccaggaaattggaaactcaaggctcaggagagatttatgtggagcagtgagggattaaaagacacttaccttctcaatcaagtttagaaaatcagactgtttgaagatcaatcctgaatcctgattatcacttagaatttacttataacttttccttccctgagaaactgagtcagtttctctgcatttgatttaccatctgtaaacaatggataagacctacgtcctcacaagctttttgtgaagattagcagagacaatgtatatttgaagtatacattaagtgctcagcaaaaatggtattaatgttgaatgattagtattattttatttatttatttttgagatggagtctcactctgtggccaggctggaatgcaacctctgcttcctgggtttaagcaattctcctgcctcagcctcccgagcagctgggactactggcgcatgccaccatgcccagctaatttttgtatttttagtagagatggggtttcaccatgttggccaggatggtttctatctactgacctagtgatcggcccacctcggcctcccaaagtgctgggattacaggcgtgagccaccacacctggctgattagtattaaattcttcgaggactaaagaacaaatagaaaaggtaagcacagataggacataatatatagatgtataaaatatcactttccccatgtataatatgatttatagataacatatgaacacataaaaattaccttttgggggagaaaaggagaaatattggttaagagtataaagtttcaattcgataggagaaaatattcttggtgatctgcacagcaaagtgactatacttaataataatgaatgaatgatatattgtatatttcaaaattgttaaaacagtggattttaaatgttcttaccacaaagaaatgataagtatgtgaagtgttatacatgttaattagctgatttgatcattccacaatttatacatgtaactaaacatattgtactccatagaccatataaaattagtagccaattaaaaattaaaatataattttaaaaatgactttgtaatggttgtcatttgtaatggttgtcatgattgactgctgaaaaaaagtaatgaacaacctcacttaacaagttgcagaaggcaaaagctaactactatatttttctgcactattcactcattagggactcaattcactcattacctgcacagccgtctgctagagtatgatcttaaatcatggagtccctgaaaacccaacttggagcaaatatcagttgcttgttatgtttctctgaagagcaacatgagagtgatgtaacaggaaattggggcttattcctctgcctctgttgacagtaagaaatgattaaattctacaaaaaattcatcttttctttttttctgttgtatttcttgctttctccacacagagaagagcgcacatatgcagatggttccaaaactatttatgatgtatttttacatcatgttggagaatgtaaacacacacacatgcacacacacacacacactcacaaccatggtgctcacccctcatagataggaaagtgtttaaaatttatttggtatttgggtctttttctttgcaatactgattatcctgttttatacaccactatgttattgtcttgaaagaaaacaagcatttatagtgtattgattttagcaaatctatctctagtttactttacatttgattgctctagttttgaaatggaatttatttcataaaatactctgtggaatggcatgttagaaatacattccctgtgcaagtatattaataaagttattgaaagtaacttgctgtaaaaccaaactttctgaatgggaattatgaacacaatataaaacagggtattggattgcttgccatggtcattctttaacaaaccttcagtgcttcttttattttgaaaaaatataaatatttgatataatgttaaatattaccacaggaataaatgcaaaagcaataaagttaaattttaaggaactatttttatgggtgtatcagtctgttttcactgtgctataaaagaactaactgagagtgggtattttatgaagaaaagaagtttaattcactcactgttctacaggcttaacaggaagcatgactgggaggactaaggaaacttacaatcatggcagagggcaaaagggaagcaagctccttcttcatatggtggctggagagagagacagagcaaggggagatgtgccacacacttttaaatcatgagatctcatgagaactcactcactatcataaaaacagcatgaggcaaatcctcacaatccaatcacctcccaccaagtcctttccccaacactaaaaatcccaactggagttgagattttggtgggcacacagagccaaacatattattccaaccctggcccctcctaaatctcatgtcctgacatttcaaaatacaatcaagccatcccaacagtcccccaatcttaacttattccagtattaactcaaaagtccaaatccaaagtctcatctgagacaaaacaaatcccttccacctatgagcctataaaataaaaaacaagttagttacttccaagatacagtgggggtacacaaattggataaatcctcccaatctgaaagggagaaactggccaaaacaaaggagctacaggcccaccaagtccaaaacccagttgggcagtcattaaatattaaaggaccaaaataatgccctctgactctatgtctcacatccagggcacatcgatgcaagaggtagtctgccaaggccttgagaagctcctcccctgtggctctgcagggtacagctcctcctgactgctttcatggtctggcattgagggccggaggcttttccaggcacactgtgcaagctgttggtggatctaccattctggggtgaggaggatggtggccctgttctcacagctccactaggcaatggctcagtggggacactatgtgggggctccaaccacacatttcccttctgcactgccctagtagatgttctccctgagggctccgctttgcagctgacttctgcctagaaatccaggcatttccaaacatcttctgaaatctaggcaggagttccaaaacctcaattcttagcttctgtgcatctgcaggcccaacaccacgtggaagctgccaaggcttggggcttgtaccctttgaagccacagcctgagatgtatgttggccctttttagctgtggctgaagctgaagcagctgtgctgcagggtgccatgtctcatggtagcacagggcaatggggccctgggcccagcccacaaaaccaattttccctcctaggcctccaggcctgtgatgggaggggctgccatgaatgtctctgaaatgccctggaggcattctccctattgtgttggttattaacattttgcccatctttacttatgcaaatttatacagcaggcttaaatttctccccaggaaatggggttttcttttctactccattgtcaggctgcacattttccaaacttttatgcactgttccctttttgttttttgtttgtttgtttgtttagacgtagttttgcacttgtcatcctggctggagtgcaatggtatgatcttggctcactgcaacctcggcctcctgggttcaagtgattctcctgcctcagcctcccaagtaggtgggattacaggcatgcaccaccatgcccagctaattttatattttaatagagatatggtatctccatgttggtcaggctggtcttgaactcctgacctcagatgtaccacctaccttggcctcccaaagtgctgggattataggcgtcagccaccgcgcctgccccttccttctttttaaatataagttccaatttcagataatctctttgttcacacatatgagcatatactcttagaaacagccaagtcaaatcttaaatggtttgctgcttagaaatttcttctgccagataccctgaatcatctcaggttcaaagttccacagatctctaaggcaggggaaaaatggcatcagtctctttgctaaagcatagcaagaatgacctttgctccagtttccaataagttcctcatctccatctgagaacaccttagtctggacttcattgtccatatcactagcaccattttggtcaaagccatgccacaagactctaggaagttacaagcttacctgcatctttctgtctccttctgagccctccaaactgttccagcctctgcctgttccccagttccaaagtcacttccacattttcaggtatctttatagcagtgccctattcttttggtaccaattttctatattagtctattttcacactacagtaaagaactacctaggctgggtaatttatgaagaaaagagtttcattgaatcgcagttcctcaggcataacaggaagcatgattgggaggactcagaaaacttacaactatgctacaaggcaaaggtgaagcaagcaccttcttcacatggtggcaggagagaaagaaagagcaagggaggaaatgccacacactttaaactatcagatctcatgagatctcactatcatgagaacagcttggaggaaatctgccccccatgatccaatcacctcccacctggcccctcctccaatactaaggatacaacttgagatgagattctggtggggataccgagccaaaaaaccatatcaatgggtgtatttcagatttaataaattctgaaaatatttagtaccataccttcagcttttcttcattgagctattggcactattttcaagtaattagggtcaaatatattagctaggctatgggaaaaaatgaaatccccctttttttttgtaaaataatatttgtaaaaaaaacatgccatcacacccagctaactctttgtatttttagtagagatggggtttcaccatattggccaggatggtcttaaactcctgacctcaggggatccgcctggctcagcctcccaaagtgctgagattacagacatgagccactgcactggcccctccccttctcttcccttccctgatctgcccttctcctctcctctcctttccttttttctttctctctcctttattctttctttctctatttatttatattttttatgaaaatatatccaacaaggccaaatgcagtggctcacgcctgtaatcccagcactttgggagactgaggtgggcagatcacgaggtcaggagttcaagaccagcctgaccaatatggtgaaactctgtctgtactaataatacaaaaattagatgggcatggttgtgggcgcctataatcccaggtactcaggaggctgaggcaggagaatcacttgaacctgagagacggagtttgcagtgagccaagatcatgccattgcactccagcctgggtgacggagtgaaactccgtctcaaaaaaaaaaaaaaaaaaatatatatatatatatatatatatatatatatataaaatctaacaaattgttcactgtgcccttccactgagaaacaaatacgagatgatttcacagacaaacttagagtgaaatgtattcattattttctaagtctaatatgtacttaatcatttgaacagaatttgagtattttattattttgtgacaataatttgttacttcttaccttaaaggatgctaaggagagcaaaagaataatttgtttatagtgaaaaagcataggttcagtacagtaaaagaaaaactgaaaagaagtcaattattttaagtctacagatcattgaaagttctgaagtcaaatcaaacagtttgaaattttatatgtgatgatatcactggggttaacctcactttatattcacatgagctatatatttttttgctctacaatcaaataaaggtaaaattgtattttttcctttttacattagttttcataagtgaatttaatttttaattggatgtactaattgtacatatttattgtgtactagtgatgttttgatgtatgtaatatatagtgatcacatcagggtaattagcatattcatcataccgtacatttattatgtctttgtattggaatattttaaatcctcctctagctagttgaaagtatataagatattactgctaattatagtcaccctgcagtgctacagaatgctaaaacttattcctcttttctagctgtaattttgtatcctttaccaaatctctccccatcttccctttccccatactctttccagcctctagtattctttgttctatttttctttttctattttttacctttatgatttttattttgcattcatatatgaatgagaacatgagatagataactttctgtttctggcttattacacttaacataatgtcctccagttctttccatattgacacaaataacaaaatttcattcttttgtatggctaaatagtatttaattgtttatatataccacattgtctttattcgttcatctgttgttggacacctaggttgatttcatatcttgactgttgtggatagtgctgcaataaacatggggtacaggtaatctctttgatatactgatttttttccttttggtaaatgcccaatagtgggattgctggatcatatgttagttcaagtcgtagttttttgaggaacctccatatttttctccatagtgactacactggtttacatttccatgagtggtgtatgagctccccctgtttttgcatccttgccatcatttggtatttttttgtgtttttgatagtagccacgctaactggggtgagataataccttattgcgattttgattggcatttcttgtatgataaattgtattatttgatgaataaattatcacctggagcattctaatattcccaatattaacatgaaataaaatttaaattaacctagaataatgaaaaataacaaaatagcaatgtattaaactattctgtttgattcatgtatttcaatatatttcagaataatcataagagatatttaaaagcattctactgtaaattcatattaagattctgcaaagtatttattaaaaataaaatagaacactttgagaaatttcctttttttgaaatagaaaatataaaaaccatgatgataataaaaatgatttttaatgttgccttcatgtatatatttagcaagaggaatactcacacaagatggacaggggtgatgaaattgaattctattttatgagaaatttaaaatggttgaatcagaatctgatggtatgctttagtccttctgaaaagtctattacttttttggtctttaaagaaaattattggcaaggaattctttatataggggtcaccctatgaaaggatgaaccatttcccttaaatgtgtccctggtcatatcagaaagttttattatcacttcagggtagctctctgataaattgataaagacatatttaactgaatttgcaaccataatatgagccctttggtgataaaggtacagaagcaaagctttcttatgatgtgttttggagtttgagaaaaatcagttttccatgaaccacctcaatgagcaaagccctgactgctagatcatcccttatcacaaaaagggcaggctgtttataatcatatcttctacccttccgttattcatgtctgtgaaggcagcaggagatcatgagacacttgtagggccatgacaaggaagagcctacatatcttacattgatgatgctggcaggaaaagtgttggcaattgtgtatgaatggagctagatcctgttgcttccttgagtcaccttgtggcttgtttgctacactccaagccaatgccagctagtcactttcatattaagacaaaaatagatctaattctgcaggtagaaaataagaacctacattacttttttatcatacttatatgaaaactacatggcgtaatgggacagcaactaaagaaggtgcgcctcactctactattacaggcctaaatcatttctttttaggtttatagatgttctgcagataccagctgaactgtgtgttcttatgtaaatgagtatttagtattatttttgctctaaagaatgcctaactctgtttgcctagctcaaaagcagccacagaaagacagaaataaatgagcacagctgtatttgaatacaactctatagacactgaagtttaaattttatataattttatataattttcacattattaaatattattcttgttttaaaattttaaatcataagtttaaaattgctttcccattacgctatgtaataactattgctagctcacgagcagtacaaaaatgggtgtccagatggatttggcctacatagttcccacctgtgtaatagccaatttagtgactacagacacatgtagtaaataaataaccaggtgatttaaacatcgttttataaatgctaagattaaaaagggcaggatatgattggatcacctaaaaaatgtatccagcttgatcttacagaaccacgaaattcttcctgaaggagatgaaaaactgaggtaggaaagatggaaagaaggcatccagctgaacatgagaataaggtgtcaagctaaaggaccagcattggtggaggttaaggagatcaagagagagcaaagcaagtttaaggaactaaaagtattaaagaagagctaaagtgattttgtcaagactatatctacttttcaaatatgtttctgcttcagatatgtatatatatacacacacacatacagatgtaaatatatataaatataaatattcatttattattgttggtagaaataattttttttacttctatccttatattcctttacataagtttgacaatgacttcaacaacagaaattgcttgtctctcaatctttgttttactgcttagtagattctagaaatgttttcttattagcaaggagtaggaaagcctaccactgaagtttgagagattgttttgagaccagtccctattaatactttcttttgactacctcttaaaagaattatacaagcatatttcaggtggaaaggatatgtatatacaaacaggaatagaaatggtttgtaaagaaatgaaaagttattgttttaaagaaattatatcaaatactatttgttttttgtccgctgataaaaagaacatggaaagctatataggtatgattatttcaaacagtcgtattcagaaaagacaaacaagctattctcagagtagtggtggtgatcactaattgttttaaaaacaattccaaaaggatttatcccatatgaaaatgggttaactcaccagtgtactttaatagaaattgtagacatattgacccataatggttgccagtgcttctgaggttcactgtttcactaaatttcctttaaactcaatcgtcgaaactaggtgcagctttacagtaggtgagtttggaaagactttgaaggtatgcaacatcactatcacagtcaaagtgctctttaaaatgcatcatatttctaggtgaattattattattagtagcagtattcataaaggaacctcaaatgagcttttgcatttacaaaccgaaggtttagtttgtacaaagcattttaaaaatattgaagtctgtgacattagagcccgtctttgtaggttacttccttctacagcacagcagaagtttgtacattcttagaaactcataattatgaggaataaatacttttttgatcaagagggatataatatattgcaattcaaacaagtccaaattgccaaatacaattgttttaactgagcccttgtctgtttgaaatttccttgatatttaacactgatgagcgccaattccccttctgaaacttgctattcctttgattccaggatatctctcattccataatctcattctctttaacaactattcaaattcttcacttttccttctatgctatatatataatttctcaaacttttgctatattattgtatatagtattaatttctagtctcaaatttcttatgtatctatagctagatcccctttcttattcctagtatttgtgattctcctctttctgaattgccaaatatttgcctatgttatgagacttttcaaataactatcttgtgtttttgttgataaaatctacacttttgtcattactttatatgttgatgttcctgtattatttcatattgattttgatttctattttacttaggaatgctctctctacttattttggaattaatttgtttttcttatttttctttagcttacttgctttaatttatccattataaattgctattaagtttactgcatacatttcacattacacatttttctttgtactactttgcataagtttttagtatgtagggcttcattgcaattcattcctaaacagcttataacttctgttttgatttcactttcatcttaggaattctgtaagctgctttcattttagtttgttgttaatttcatttttaaattgttttgtgttcaataaatatggtctaaaagacttctgccttacagaatttattgattatcttgtgctttcatacatgttcattttgctctgagtttattcatgtctcaaaagaaggctccctttttgtctgctgtatgcaatgttctaaatgtaagaactagtcacctcattgcattatgcagatattctgtgttcttattgtttttaatctatcttttgtattcagagagaagttcctatttgattgtattttaaacattttttcatctctcgtgtaaatagatactgctttattatttttcaaaatgttaatataataagaaatatcctgtttcatttagtagtttttcacatggaatccttctttcttttttggcattttcctgttatttttgaccaacaattaattttataaaaatatatctttattcatctttttgagaataatacatggttggtgttttccagtctaactaatctgtttttagggaatccattttggggtagactttcatacattctctcctatatcagctgtcctgtttagcatggtcttcatcttccatattggttgtttttcaaaagtttgtgaacatggttgtctaattagttttgaatatgagtatctgttgatttgtgtaagtagctgtatcagcttttcttttgaatttttgtagttacatagtttttgtatacatttatggggtacatgggatattttaatacaggcatacaatgcataataatcacatcagggtgaatgggatatccatcacctcaagtatttatcctttctttgtgttacagacaattcaattatagtctcttagttattttaaaatctacagtaaactactgttgactgtagccatgctgttgtgctatcaaatactagaacttaccacttttatctaactatatttttgtatccattaactatccctacgtactctgcctcctccactacccttcctagtctttggcaatcattgttctactccctttctccatgagttcaatggttttaatttttatctcccacaaataagtgagaacatgtgaaatttgtctttctttgcctgggttatttcacttaacattatgtcttttagtttcatccacgttgttgcaaatatatctttgttctgttggtatgtagttctcaggatacctgcgtcctaactaggaaggtttcctcaaacttcttctacatggatatggcatagttcattaggttatgtggatacagaaagaggaagagtgacatatcctttctcaacttttcttttccacttttaaattcagggggatgtggacaggtttgttacatggataatttgcatgtcacaaagatttggtgtacagattatttcttcacccacgttttcagaatagtactcaataggtagtttttcaatcctcaccctactcacactttccaccctcaagtagtccctggtgtctgttggttccttctttgttttcatatgtactcaatgtttaatccccacttataagtgagaacatgtggtatttggtttactgttcctaagttggtttgcttaggatatggcttctagctccatccatgttgctgcaaagggcatgatctcattcttttttatggctgcataatattccatggtatatatgtacattttctcaattcagtctaccagtgatgagcactcaggttggttccatgcttttgccaccgtgaatattgctgcaatgaatatacatgtgcatgtgtctttatggtagaacgatttatagtcttttggatatgctcaataatgggattgctggatcgaatgttaattctgttttaagctctctgagaaattgccagactgcattctacaatgggtgaactacattacattcccaccagcagtgtataagcattaaattttctctgcaatctcaccagaatctgttattttggactccttaataatagtctttctgactgttgtgagatggtatctcattgtggttttgatttgcatctctctaatgattagagatgttgagtattttttcatatgtatgttggccatctgtatgtcatcttttgaaaagtgtctgttcatgtcctttgcccactttgtaatggagttgtttgttttttgcttgcacatttcaagttttcaaatattttctcccattctgtaggttgtctgtttactctgttgattgtttcttttgctgtgcagaagctctttagtttaattaggtcctatttgtcaacttttgtttttgttgaaattgcttttggcatctttatcatgaaaactttgccagatcctatgtccagataatgaggtctttactgtaagactggagcatttttgtttacttctgtcaaatcccttatgaattacctttcattattacacatacttatgcattttgttttataaaaatacagaacactaaatacacaaaaactctagattctacccacgtgatcctggttgcacttctgaggctttcccaggattaatttttggggagagattggggaaactgaagataatttttcaaggtgtctcctcttatctttccttataatccctcttcttttacggaataaggaaggggaaacagcaggaaaatgttaacataagtccatagttgtaactgcaaaggcttgtgattggtattatttaatgttgacttgcagatttatctccactcaatctgggagcacacctagacctgcagagggaagggaaagcataaaggtacctgctatcaccatgcatctgcttagtgtggagtagattatagcattagctcaccatttacctccatacaccagtttctcaattcagcaatgggtcctatgtggatctgtggcttaagttagttaatagccagtacaaggacttcattttctgtccttgaacctcagtctgttatgtataaattatagttcctaaaactgaatctcctgataacatgtgcctgctgcttaagtctcagtcagccctaatctggccaatcagatagactccaaattcctcaccttgatttgaaacttcccactgtaaaatttacttttctcagactaaattttgggcccatctttccctgtaactctctcctttcctaaatttatgaccccttatctgacaccttgcctttttctgatatttgacatgcttaaatctaattctttcttctggcactaaattagagtgctataaaatatttgtatttgcaactatttcatgtttatcttacagactcgtttttgtcactagggaaaggtatttctagtgcctatcagataagtaaatagcctgtaaatagggagtgcaaactcgaatgcctagagatgtccgtgacagataatgtaaacaagtgaaactctcctgggataaaacagcaggagggggtaactgctgaaaaccttacgactgtttaaagacattccaaatcaaattatttctaaaaatcagtaaaatatgagtcaacaaacagacaaacaaaacaagtgtggtctgcattgccaccttgagtaactcctctaaaccaaatagacttctgctcatccttgcaaggccacatccagccattaggtaacttcttgtttgcctcccataaaggctgttcatatagttaatttttgacatgcttttacctcaataaaattatcctgaggcaataggatagaagataaaccttggttcaaaccccaactttgccacttaaaactgaaccaccgcacggcaagttattaaattttaggagcttcattgttctcttttataaaacgggcataaaaatgtatgtaataaattattgttgggaagattaaatataatctaagaaagagattataggaaaaaatcaaacatttcatgttaatcctcttttctgtcatacatgttctccaaatattgatgtttttctctaggccacaaaattttcttaagagtaatcctacctatagcagttggaagtcaggaccacagtatttttgaaagacaaatatttacaatctattataaaaatttccaatatcatttttgtttttatttggaaatatcttcatgaattcctattcaatattcaaaacatcacaaatatgtagaaaaggggataaacatcaaggtagtacaatatatctaattttttggttgaatcaaaaatttaaaatatagctgctagctgttttgtgttttgtttctatgtagacttatctctcagtaatgatgatgcttcaaaagaacacatctatatcaggttctatctctacacaccctttactattatcaacttgtaaaatgtatcagccaaacaggacctgctacaggattgctgatgtctataaaaatgcagaaagcactaaatcaaaacgggctgctgaaaaactaaaaatcaaatatcacacaaatcactcagctgcctgggcttagaaagagagcatttgaaagctcatatgtggactgatattgccaattgacatactcggttgttttaagcaaatcttttaaaaattcattgcttgaggagatcgagcaaacctgtttttctggccagatatgcttttcctatttccctggcttatgaagtttcacaggatgagttttaaattactcaggaaatagctatagggtatcctatttacatcataaaagatatactgacagaactgcagggtttacgccaatctataacaccagacaaagatttttcactgtgctgcaggttttataaggagacatttaaaaacatatataggaaaaatataatcctttatatgctatttaaatatattctctggctatctgaaaggctttctattctttgaaggaaaaattctattcccttttttttgctgactactgctctttgtgtgtagttatatgaaattatcagaaatattaaggctatctatatgtactatatttaaagtgggactcttctgagctcatcacatgtctcatcattagcctttcacatatatttcaaataaaaatgtaattatattagtaataatgcttttggtgcttagggaatgaataacacttgccacactgtccagttggtatcttagactaaaatagttgacacttgctgaaaatttttcctatgcttcattagcttactaagtgagacaggaacattcctgtcattgggatctttgctagatttctgatgttatgttagtttattctcatgctgctataaggacatgcctgaggctaggaaatttataaaggaaagaggtctaattgactcacagttcggcatggctgcggaggcctcaggaaacttacaatcatgacagaaggcacctcttcacaggagagcaggagagagaatgagagcccagtgaaggggaaagcccctttttaaaccatcacatcttatgataactaactcactatcatgagaacaagatggggggaacccccatgattcaattacattcaagaactacaattcaagatgagatttgggtggggcacagctaaaccatatcagatgttatctaattatatagtagactgggatataaaatagacaaggcagactgttgtattaagtggaaactctagtttatagatattaacatgattttaggtattattctttataccttagattctcaaagcacttgataaataatgaccctaaattggtggtgaacatgctgttggagtgttgaatccaataaagttaaataaacaaaagaaagaaatggcatctaaaaggacaaaaaaataaggtacttaaggctctgcacctatttttctgtgtttatagtgccttaaatatcaccctctgaccaagaagtaatgaacgggtttggggcttttcttaatgtgttttatacttgctttattgctaatatattgattagtttcctaatgagatcacagcaaagttgttacttctaaataaaagctttgccacaaaggttgcaagtaatgaacactataaactgtatgtaataaaatgtttgcaaatagtcatcctttggttcatatataaggtattctggagaaataaaaacttccatgaatttattttatactttttccagcaatcctaaatgctaacaacaacacactattttaatctgaggaaattgccatgaatttgaaaataatctcaacactttgaaggaattaataaaaacaaagagttgtgtacatattcaattccagtagataatattacagtatcatagatatattaattaagaatatgaatgtttaaggataattcttaagtttcaatgagattccaacccaattaaacaacaaagatatgtttcccttttaaattatctagttgacttaatctattgcttttagaaaaggattgttagaagtaatatgatagtgatgaataacccaaggtttcattactgccaagaatccagaatgtgtttacatatctctcagatgccagaagaacttggacaggagcgaatgccttcatgattggtgaagaatttttcttgccttgactggtaattgtctgaatcttctagtagtgatcttacctcttgttttgaagttgagaatatgaatactcatgaagagaaaaggagaggagacacatttgaattgagcttcaaggtattaaataaaatgttgcttgtccagcatccaaagaaatctgcaaaatctgcaaaatcttaggctccaagcactagtggtctaaaatgaaaataacccaagatatccatcagggttatgcaaacaataggggaagacaatctgcccttgggcattttcttctcttcttttgtcacacaggtctacccagctataatggaatacaactaagagagcttcttgttcgttggctgcttctctctgagaatttaaacatgaatctctcactaaaaaatgtggcttggtcaagagaatgacagataagccagcaactgggataacatattttcgaaacacattaactgataatgaactggtattcaaaatatacaaaaactcctaaaaaccaccaccaacaacaacaaaactacatcacaagcaaaagatcctaataaatgtttcaccaaataagatatacagatggcaaataagcatatgtagctatccacacgatttcttaaaacccatcaacaacaacaaaattacattatgtgcaaaagatcccaatagatgcttcaccaaataagatgtacagatggcaaataagcatatgtagctatccacgctatttgtcatcagagaattgcaaattaaaacatcactacatcacctattagaatgggtaaaacacaaaacactgacaacaccaaatactggcaagtatgcggagcaacaggaactcccaatcatttctggtgaaattgcaaaaatgatacaaccactttgaaagacagtttggcagtttcttacaaaagtaaacatattcttaccatataatccagcaattacactctttggaatttaccaaagtaaattgaaaatttgtgtacactcaaaaacctgccacaaatatgtatagcaggtttgtttctaattgccaaaacttggaagtatttaaaatattcttcagtaggtgaatgaataaatgaactgaagtatatctatacaatagaatatgtttcagggatggaaaaatgagctacctaaccacaaaaatgacatggaggacacttagacccatatggctaagtgaggaagccaatctgaaaagtctatatactgtatgattcttattatatgacattctggaaagaaaaaaccatggagactataaaaagatcagcgtttgccaggagttgggttgggggaagggaagaatagaggaagcataggatttttagggcagttaaaatattctgtataattctgtaatggtggatacatgccattatacattagttatacctattgaacgtacaacacaacaaatgaactctaatgtaaaacatggactttagttaacaataatgtaccaaaattagcttatcaattataatgtgtcccatgaatgcaagatgttgataaaagaggaaactggggtggaaggagggatatgtttatagaaactcttcccacttctcactcaatatttctgtaaaactaaaactgctcaaaaacataagagctataaattaaacattattttaaaatgctgtttgatagattagtgataaaatggagaggctggaactggtttagtaattactagtgctctcctgcctggggatcacctctctccaagggccaccataaatgctaacttatataaatgatgctctctagatttatgcaatacttaactacaaagagatatgaaataacaacatcttaatctcttcttaaactcaagaatgaacacaatccagggcttggtttttgtgctttttgaacatagagactagagattaatatctccatgtgaacatgagctaaataagtagatatctgggagagatcaccaatataaaggaaaaatgacatatgtaaatgaagcagattttaaatcaaaggattaaaaataaccatgtcatttagccttatgtatgtaaaggaagacactagtaataagaggctgaaataagattttatttaaatgtggatttttgacatatgaaaaatataatggttgaagaaaagaaaatggtagatgggatttttaaacatcaggattattactactgaagaaagaattatggatggagccattaatctaaacgaaataactcagaaacagaaaatcaaatactacacgttctcacttataagtgggagctaaccaatgggcacacatggacttaaagatggggaaataacagacactggggactccagaaggggagagggaaggacggggttgagggttgaacaattatctgttgggtacaatgttcattattgggcgatggatgcattagaagccaaacctcaccattatgcaatatatccacgtaacaaacttgaacacatattccctaatccataataataataaaataatcctgcaatgaaaggcaaaaaataaattaattcatctgggatagctggaatcctgtgacccaagtgaagaccatgaaatttataaaataattattaattcttgccaaaaatattctttaaaaaaattattctatagaggaattcaccattttttatttcctttcaccagtgtcttggaattattttctaagaataaattcacaggcaaaggaatgaatgtgtatatatgcttctcaaataacagtctaatgtgggaaattaagaaacaaaaataaggggataaggtttatatttctttacatcacagttgatttgtaaaattaatatgttttatattcatcgattctattgattctaggacagaggtggtactcaagactcaaggtattagaatccttgtctgtcacagggacaaattcttaccaggagaggataggaagtgcctgcagggtagagttgacagatttggcaaataaaaatagaggatacccagttaaatgtgaatttcaggtaaataatgaacattttttttagaataggtatttcccaaatatcgcatgtgtctttcatactgataagctagccccaccacagacctattgaatcagaatttgtggggatagggactaaggcatctagtttgtataaaaattcgtcagtaattctaataggcagacaaggttgaggctcactatgtttaacgattatttatcaatcaaacctcctataagatatatgaaatgacacttatggccgggcggtggctcacgcctgtaatcccagcactttgggaggctgaggcaggagaacggcgtgaacccaggaggcggagtttgcagtgagccgagattgcgctactgcactccagcctgggcgacagagcatgactccgtctcaaaaaaaaaaaaaaaaaaaagaaatgacacttatgaggccatgaccacacaacaaatccagatatggataaccctcagcccttgggcgtcatgttgactatgatattctgtgttggttgatgactgctatcaagttttcaattttatcctggttttctttttcatacattggagaacaagctacaagccccactacccccaataatttcctcattttcaaagtcatcagggaatgtgtgcaaaaataaaaataatgcctgctataaaactgtttaactactgtgtgaaaaattgaatttccaacataactcatattatgtttcctctcataaaacatgaaatggttgaagatgctaaatatggcacagtggatatgaaattgattatatcaggaaatctagtcatctgtttcctggctatgccatttaacttctttgggcctcaatttcttcaccagtaaaacgatgttttgtcttgttgactgcccacttttaaatgtctgtaagatttagtgtttacaatgtctcttggaaacactaaggttggtattcataagttattggcagatcatatgttttaacaagaatgttgtagaaacaaaatagattatcatctgtatttatgccccatacttgtcatctgagagaattcttaaatgcaattcaatgtagattacaaatttgcagtctacaattgataatcacactgtgaaccttccagaatattgaaactctattttagaggaaacaaatgtgtcttgctttaggcttacctgcagaaatagtcaataccctatttagggtcatgaagcaggcacaacgaaattttcatgaatattaattgagatttagcttgcaaaatgaacatggaaatatctctcagatactgcccatcttttaaggactgacactaaagtaaggctttcctttaaataatatttaatagactaatatactctttttccttctaatttttaagctaggataagtgcattccacattaaaaaactgttctctttaaaaaacttaactgcatatgatggtgatggatgattacttttcttcatttcaagtttattgggtctatctcctagtttatttgtatgttttaaccaatgcatctgattatattaatctcaagatgaaataaatgtgccattaaagtccatatgtaaaagaatagtttaaagttatgaaaataggccagttctcaattacatatattttttgttcaccattaagtaatttatcactggttcattttagggcacttgtatttttagtatttacgattcaagtacattacagtagtcctttcttatctggagcttggctttccatagtttaaattaccaatggtcagccatcttctcaaaatgttaaataaaaatccagaaataaacaattcataacttttaagttgcatgccatgcttagtagtgtgatgaaatcgtgcactgccctgtttagtcctgtctgggacgtgaatcatccttttgtccagtatccacaccgtaggcactacccacctatcagtcacatagcagccatcttggtcatcagattgactgtcatggtatcacagtgcttgtgtcctagtaacccttattttacttttattacagaatattactatgattgtcctatttcattactagctattattgttattctcttactgtgcctaatttatgaactaaaccttatcctatatacatatcctatatacatatacatatcctatatacatatcctatatacatatatcctatatacatatatacatattatatatacataatataattaggtttcagtactatccgtggattcagtcatctgctagaggtcttactgccatggggaaggcggaactactctactgcaatcaatttatatcttcattatgtgctaaaggaaaattaattttaagaaattcaggtaaaactatattcacgttctcttatgtggcttttcatatctaaaattattatacatattgtgctgatacataaatacaaattgtaaaatgtgtcctatgtaaataaagatggaaatcagaattcaataatatttcaatggctataccatttaaaaatacacatgtatagtcaatgaatacaatttttaaaatgctataattttttagccaaagcttttatctttcatttgagaacttgaagactgtcagcaaatttcaaaggctttaatcatccaaatttttttaacattccaaagtattaaatattccaaaagtagattcgaactttctttaccccaactctgctttaggaaccctagttcagtcaatgattctcaaaactgaaaattattttagagacagaaagtcttctttgagataaatttaacaaaaatttaatcaaaatattacttttaaatgttatctggaggggagaatatggtatgttcatgaccttacagagtttatgtacatattttgaagcttaccataaactttgcttttaattggttactatatgtgattaacatcaactatcccaacacttaagttatttttataattctcaatattatttgtgatatctttctaatcaatatttttgagttttacctatttttattgaattatctttcttttcttttttgtttctgtaaatttgtattcattgtttattttttaaatttccttccttctactatctttaaaataattgttttttcctaatttttaaattagattattagtgtagcagttgtatatactttatatatatgtccgtgatataagatctattccctataatttcatttttattttgtgaagctttattaagtttttttaaacctttttatttggtcacaaacactaacattgttgcactgtgaataggtaatatggtttgctagctatcttgcttattgtcttccccctttactggaatttaagatttctgagggcaggattttttgactgctttactcattgttatgtcctctgaaccagaagagagcctggcacatcataaacctcaataattacttgttgagtaaattatttcattctagaggtttcagctgtcttagatcagtttttatattactgcttgttgttgttgttgttgttgtttggatttctataacaaatgactgtgtaaattcaagccatcaaccacttttcacacagactggcattttcaaattctcgggttttttttccccttcacttattgcttgtgttggatagaaagttctcttaatatcagtattgctttgttctgatgtgtaaagtgtctctaggtctccagttcacagattgtacagcccttagatcagttgtattcgaggccccttttctgccctctgacttgggagaacacaagatgtcttctgtttctgtaacagtcattaaaatcctgtcctaagctggacatggtggtttgtgcctaccattccagtgacttgggagactgagctgagaggaactcctgaacccaggagtatgaggccaacctgggcaacataacacctccatttctaaaaaatcaaataaaaataaatcctgaactgcaatttcaagaaaatgttctaatgcatatttaagcctgtcactacttcagttgccagcgtttcagctaaaatatacaatctatctttaatttcctttttatttctagccctagggatttctttctttccagcttagttagctgttaaaattttccttacatgttttatctagcatttttatgtgtatgtactaatcaatcttgtttaaatctcacagtctttaagtcttgattggaaatgaatatagccaaatcttgctggcctaaaactgtttcatttctttgagaaaatgtgaacaaattacctaaggtcattttctgaaagcagccataattttcttatttcagaattcctacagctctttgttagacaaaaagattgagcaccaccaggttagaatttctcatcttaaacatatgcttccttattctcatgaaaatactctgtctttatccaaagagattgttcttaggatcccaaaataaacatatttcaccttctgaaacatatttacagtctcgacaataaacatcatgtaatagtatcataacctgatagctaccagtatagccaaaaccaagcttatttattcaacaaatatttgttgcactttgattatttgtcaagcactatttttatgatgtattgtgctagttgctggaggtataaatttaaataaagtagataaagtccttgtcatcatagatcttattttctgatagggaaaactgtcaagaatagcaaatccaggttaacccagacccaactgaatctttcaaaatgtcagtaaatacttctaaatgtcctcctatgtgccagtgtggcaatcaccaacaaaataagaattcctgttgtgtgtatcttatagtcaagtagggaataaaggcactaaatgctgcaaagaattaagtaaataatcgtaactgtgcaaagtataggctgagagaaaaatggaatattttagaaattctagcagaatataactcaggttttacaatgagcccatctagcttagctagactgagctttgacctttagacttggtagtctttactggttctacatttttttttttttttttggttttaagaagcagagggtttaataggcaaaaaggggcaagaaggaagggagaaggaagaagctcccctgtacagagacagaggggtgggcactccaaagccgagagacagaaccccaagtgtggcggaaaccagccaggtgtatatatagacgttggaagaggcagtgtctgatttgcatagggctcaggggattggtttgaccaggcatgtcattcacctagcccacgaaaaagctggctctcccaccctagtcttttaatatgcaaatgcagggcaccatgatgttctacacacatggggatatgcgggggcagtcatgttgccagcaacatgtggggcaggggcactggttctacttttttatcatgtcattcattctatctctcttgacaccataccggggtccccactgggtcatattaggtaatttctaattgctgatgttgattctcagtccaggtttacctctcagagcatctggtccaggtgttatctgtaaatcttacacccttctttaaaacttaaatgtctctcaacatgattttttaaaaaattattccttccccaggggacctgaccttggcatagcagactgtgccttggttagaattttaaccttctttggagctactctagtgataaatcctggggctggcactcagctttctctgacttcactctgaggagatgaggcccttttcatatgctgccaagagagtttgctgagtttcactcttggctttcaattacttgttaaccacccttagcattttgttatcctttttctagaggtcagtagagtttggcaatagcatgcaatccaattgctcttgaagctactatttccctcgcgcttttcaacatcaaaccagttagtggattcctctttcactgatatatcccaattcaccaccagtgaaagttgcatgattttatgagtcccttgtgccagtagaatctagactccgtgtgctcagtagtgcgttcctcattgccagctaggcaatgagaggtctagctcaaagagtagttttatcacttgcattttcagaaaactcctgacataaattaccatattttggattcattatttgattcctatacatgattgattgtttgggtggtataaaattggaaagacatttttcctaaagttttgcaagcattgttcccttgacttatgacttttgatattatacttgagaatttttacttatcctttgcatattatttttaaaaactttgtttttttttctctatgttgaaaagctcagaaaatattttctgttttcttttcatttgaaaatttgaaatggtctcattattctgattgtttccaggcctttgttgagcccttcacaatctaaaaatgaatgaactttagtttcaggaaacaataatgaattattcctttttacttcctctttcctgttatctctttctgaaatattaagaatcagatgtaaactaataatatgtctatatattatttatagataataatacatatataacattttataatatatatatcagtataaatattttattaattttctcattttctcattttacttctgtgtggcttttctttgggggagaatttgctttctgggaaatctgcttaattttatatttcaagctttctctttaattttcaatttttcctattttctcagtttagagaagctctttttctgttatctgggtttcccttttacatcatgcccctttgtaactgttgtttttaaatgggtgaatatgctgcttgtctatctgagtataataattatatttttgaagcttttttttctgtttcctacattgcttacaatttctccctcttcaatgtttctggggttgtttgtttgttttaagtgttagaagatttatccagagatctaacaatccctatctgtctgctcatacttaagaataaggaactaaatatcagattggaagttatttaggcatttacagaattttaaggatctggtacagattaagttgaccaaggagggatccggctgtttcagtaatacctccaactgttaatttttctttccctgaggtgggggagctggtcctacctacggcctggaaatcagaagcttgagtgactgtgatctggcagctgagtaggaagagaggtgtggaccttcaacactcagtgcgtagacctccattaaccccagtttccacacggcactcccatctctagtgatgcctattgttcaaaattgcaaattccttccattttaacatttccagagaaaaacttttcaaaattgtttttaggtgttcatgtgtatgtttgttgcgtgagacgtggtagaggggataacagtgcttggaatggagagtatccaggggtctaaatgcttctaacactgatattcaagtgacttcccgtttcagctccatccacacaacctggccttcacaggcagcaagcgtctccaattctccatcttttaaagagttattcaatggcagtttcattgcttcttaatttctttccctattgtcacttacttctcttgtctgcaaactaaattacaaatgggcatttttaaaaaagatgttaatacatcttttctcttgtgacttcctgtccttgtctcttctttgctttatggaattacatttttaataaatattttaatagttattttgtagtgtttgtggagtttgtagtggtaaagatgtgtttaatctgctacttgtaacccaaaacccgtaagtcacctcaataaagtgattgcaattttcaacctctcattcagcacccccatccagttattcaacaacttattcaattcaaacactggaatatatctccagtcagcccaataatctccatttcctatgctactatacaatgtcaagccaccatagtatttgacctaagtcacaattccagtcttatccacttctattttcaactgaaacaaatgtatttatctttctaaaatacaaagatgactgttattttcctccttacaagatttttaacaatttttctaattcctagaaatactttctaaactgcttcgtaatgcacacaaatcacttgagaccctgattctcagccatctctctttgtgcttggattacattcaatttatgatacatccttctgcctttcttaaccagaggaacatgaacatggggtgaagcatgcacatacacgttctctcatacacacacatgctaacatgctccatcaatattaatgtacttacaagtctataaacatgcaagaatttttttatactggactaccaaccaccaaattgtccactaaaataatgtctttctttatatttttaataccgtagtttagctgtaacccataccaaggtgcccttcctgattctgtgttagacaatatgttcacataatactttccatttatccaaaattatcattatcacattgtatcgaattctctttctccttcccctgtacaccacttcctgtgctctaacctcaagactgtaagcctttcttttttttaaaactgcaagctctttaaagaatccttgtgtcttttcctgtatctaattttaatttctgatatactacatggcacagcagatgctcagtaagtatctgataagccagcatccaatgactactacaaggaaagcgatgggattctaaagttgtatgatatatatatatatatataaatgtcaaaaagctaggggaatatgaataatcttcgttataactagtttgtggtgggaagcaatatatcattagatttgttcttttttttacgaggaagatacaacaaataaatccttataaaaacagccaataaatcatttatcatcatattgattttctcactagatttgttttttaagaaaacgtttatttgctggaagaaactaacaggaatcttttttgctttgcttttgtaagtaaaaacaagtgaaaggaaaagaataggctgtatgtttatagtcaccaaaaagactgcaaaaatgtgacagaaagaagagaataaggtctttaaatatcttttcaaattaaagagtagactggatctatgaataccaaacatcagcggcatgcaatttacccatgtcataaacctgcacatacaccccctgaacctaaaagttgaaaaacaaatgaagtataataattatttatagcatttaaatgatgaccaaatcaaagatgaattatgaattcagttagttcaatcataagacaagaaaaaaaatgtacatctaacaattagcaatcacccgataagatacagaaaaaataattaactttttatgactatttttatttcaaataagtgactgaaaagaaataaatttcagtgggatttttccagtaacagttttatgtcactaaaacaaagacaaattgcaatagaactttcactgtagattttaaataagagtaaaatcattccactttggtttcattaaggccaaatgtagacaaaggaaataagaacatgatcacattttattctcatctgtttcttacttctatgtaaggtttaacttacaaaagtgttatcatttcaaagatacgatttctggtatgtatttgaaaggcaaagtaagaacaaggtggtacattatccagaagcattattttttcttattctttttatttattttgcatttttcttaataaaagaagaatgaaaatgcaggaaaaaatttcctctctacataatttaaaaacatctttcaaattatactttagagttcatttgcaaaattatgaacaatgttttacatgcagtttttcacatgctgaaaacatcagtttttacttaatctccttatgctgtttctttcttccttcctgtagataaaagcctaaagtgggtttgcatggattacagcttttctcattctcctttcatcatagctcattgttttgcataatgtgcataaaatacatataatatatccaatccattttagcctcagatcagagcaagtattgaacttttacaagttttataaaatttgcaaatttcactcagcaagacgaaaaaatacatacattctaatgacttttaatttggtaaataaatgttgttaaaattaatgcatgcacacacacacacatacacatacattaggtgtttgttcattaagacctaaaatttgccatttccacactatattattcacacagaaagggcatcaagcacaatgtaccataaagctgtttaacttctccttaattgggaaaagtaaactcaaaatatctaaaaggcaactttatgacagaatagaaatctgctataaaagcaacattttcatgagtatttaaaattatctctacattttaatagctatttggacaggaatgtgtaaccaaagagaaaacttagaaaaaggcagcatacaacattgaatcagtgatgaattaattgttggcagcaactacaaccatttttgtattgttttgcatttaaaaatgttttaacctgtgtacaaagtgtaaactaataaatactaattgatttaaatacctgattcaatgtttcttaagcttgagacacatattaaaggaaaaattatgctatgtctcacaatattgcattatttccagaatgtcatttaaattagaatatacataaaacatggcattaatcgtatatatttatagtttttatagaaccatatgactggaacaagattttaatatacttttcatagaactacaaaactaatgaagtttaaaataatagtattattatgtggtccatagcattgttttctgaatgaaaaaccatcactcacaatataactatgatattcatcatcctagtgcaggttctgttgagctcatcttgtctgtactgcatttttttccttataatgactgactcaattttctcacacttttgggtattcaaactactgtgaagcctttattcatccattatggtatgatgtcaggtggatataacttggctccacttttagatatacatattaaccttgcccaaattatttcctattaacttctaatgatgaaagtaacaccactaggcagcaatatgatggtaagaagaatgtgtctgtaactcataatgttctggatcagcattagatcatatatttacaatccaaataatcaggaaatatttttttagacatttataaatattaaaatataaaatttagattgttactgtggagaatttttagacaccaagtttatgatcataggcttgcatttaaaaaatagtaccaaaattatacgtgctgtgacagttagttgctacctaaagttaagcagtaccaagctgtgaagagttaatttttaagattaacattaatttggagttctaatatgagatcaattgccattgaaaaattgagaaaatataacaaagatatgattaatacctaaaactccaaagcacagggaaattcaaatattttaggaagataaatctgttttcaatgcagcaaaagcagcatgtacccgtgtccaaaagttgtttatttatttggcatagtcagctattatattgtataatgttaggctaagaaagggtttccaaaggaggattcctttctgtctccctgtttcggtctctgacaatgtcaaagtcataattgttttaatttcatacgatcttgacacgtgtgtgtgtgtgtgtgtgttagatgtaacattaagggaagagctttagtaattataactttaattgttatggctgattttttagaagaatatttccaaatataaaacatatatagaaattcataattatatggaaacataatttttatgcatatttcaaaactgatgtatgaaagtcatttagctaattaatgagtcagaatctcttcctacatttgcattgttacttgtcactgtatgactttagaaataaagccacctcctagtactatttatgagaacagatggaatatgaagagtccaaaaagaaatgattctttactggatattttcaataactatgtaaatggcttaagctttgtatttattggtgtaaatcaattaattccaattgtagctagtgttagctatattccactacatgttttgggtaaattatatgctataaaatagttgaaaatcaaaaatgtaagaatttgatagctaaagtctcacaaaattttaaaaattaagtatgacctgggaggaagaatactgggcagtctttaggaatgccctaatgtcgaggatcttaagtaatagtagggaatgtaaaaacattgagttccgttagcagatgaaaaaaatgctcaaatgcatattggataattttgcctaaatgtggctttaatacatggttgtaaatttgctattgcagatgtaactagatcacatgctagacctgatcaaaatacagtaaatgttgtagctacctttttttatttacggtttcaaattcaatggcttgagtttcaggaataaatattccagtgaatatcattgttcatagttgatgtccaaggactatactaaatttcctcttcttcatctgttttattacataagttgaaattttaagaaaatgttttacaaatgtctttatgaacaattatttttccatctgtttttttttgtttgttttgtggtaagaatatttaacatgagatatactctcttagcaaatttttaagcatacagcccagcattttaaagcacacaacacaatatttttaaccctaagcacaatgtttcaggatctctagaacttatttattttgcataacaaaaactttattcccattgaacagcagctccccattttttccttgccccaggccctggttaatcaaccattctactctctgtttctacaagtttgactgttttggatacctaatataagtgaaatcataaaatatttgttgttctgtgatgtgcttatttcacttagcataatgtcctcaaaagttcatccatcttgtaacatatggcagctatcccacttcaggctatttatgcaaaggaattgaaattaggatctcaaagagaatttttttaccttcatgtccattgcagcattattcataatagcctagctgtggaaacaatttaaatgtctgatatggtttggctctatgtcctcactaaaatctcatattgaattgtaattcccaacgttggtgaggggcttggtgggaggtgactgaatcatgggggcagacttctctcttgctatcatgatagagttttcacaagatctggttgtttgaaagtgtggagcacctcccccttctctcactctctcttctgcccaccatgtgaagatgtgcctacttctcctttgccttctgccatgatggtaagtttcctgtggcctccccagaagcagaagcctgaccagagccaattaaacttcttgtctttataaattccccagtctctggtatgtcttcatagtagtatgagaatggactaatacagtgttcatcaacaaatgaatttaaaaatgtggcatatacatacatattcagcttttaaaaaggagaaaatcctgccatatgtggccattgtttttattccttgaaatgggacaattcaaataatcaattcccattactatgattttctgaaaaaaatcacaggatacataattgagataaagtcttctattataccccaccaaccacccacacacaggcacactgcccaatgctaagcatttattcttttctgtatcttggacatttatactacagggatagaaatagacattaccagccaggtgcagtggctcatggctgtaatcccagcactttggcaggccgaggcaggtggattacctgaggtcaggagctcgagactagcctgtccaacatggtgaaaccctgcctctaccaaaaattcaaaaattagctgggcatggtggcagatgtttgtaatcctagctactcataaggctgaggcagaagaatcgctagaaccagggaggtggaggttgcagtgagctgagatcacatcattgcactccagcatgggtaacaagagcaaaactccgtctcaaaaaaaaaaaaaagaagtagacattgccttttattttgaaattatacatgatatttgtgtttcctagaagtagataaagcaagcaaatatcattgaagaaacgcaagatgaagtgggtggttggttgaaaatagagaggaagtagatatcccgagtatgagagaaggaacaccattcttggttggacaaatatctataattgtttttagtaggattattttatgtttctacatatcatgccacatttttatgcagtatcaaattttgaggactgctattgggtacttcatggaattgaattctgaggaccaaagtcttgaacttcttcatgattaatctctgcatccaggattggcatcaaactttatggcatttcactctcaagggaccgtgtaaacataggtgaaatacctggaatgaccagaatattgtttcctaattgttcttgatttaatacaatttttgacacttttaatgaacttcagtgggcaggtaaactcaatggctggattttagtatcccctaatgagctgtgacagaattttagattagattcaatttgatttggagaaaaataaacacagcggtacttttttcaaacatatacatgctcagatctgctatatgtgaggacctcatccagatgtgtactgagggtttatgcattgtagaatgatagcaatctacagaaatggagagagatgcttttgagacaagagtgttgacctagttgcaggacttgcgtacgtggatgagtctacactgagaagtaactactgatttgaagtacagcactaacgtatgctgaaactaagttgattaaaaactgctcacgcatgaaacaaaataaaaacgcgtacatctggatgttattgaggcagtactgaaagaagacaatgcttctgaaaatccaacctatatccaacttacataattatttattcatgtttgcccaatcatagaagattatgctttttacatggaagcaaactatctctggaatcctttagtgcctcaaatttatatgtagctactgggatgggccattctttaagagacttacaggtttactgatgaaaggggttgtagaataagtagcaaggagagaaacagctgaccagttgcttttctactactacttccaggaagaaaagaccagcagtgtgttctaaaaacccattaaggggagaggatataagacagtcccacaggagtaggagacaggagttagagatttagtagggcaatcaaccacttaaaaatttttagcgtgaatcccaagttatttgatatacagttgagtttaaggctctgaaaataatggacacctgcttctaattctgccaatttttctggagaaatagcagaactacagggagaaatatcagaccgatacacacagacgctatattctgaggtatccaaacttccatatttggtcaagtactgtacgttgagccagaaagagcagaactgactttcctcaaattaataatgtggagttgaatatgaacatttctattacaatgaagagttgttcttttgcatatcctagacaccgtttaagcctcaggtatttttgtgtgacacaaagatgtgtgagagataccaaaacatattactgaagttcaattttacaccattcttgtaatttggggcttagggattatttagagaaattaagcaatgtagaatatttttctccggcgggtggtgaagggaaactcacatcagttatattttcattgtgagtgcttcccatggtagtcacaaacacatccatttctccagtatactgcggaatttcaaacaaggagaaaaatctgatgaagttcagctcctgcctagcaaattctaatcgggttaatcaatatcagccagctctaccttcaaaataacaaatgttgtgacatatgctatgcagagtttggcagcaaacaattgaccaagaaaagaagtaatgggatcagatgtgaggaaagagaaaaataagtatgatagcaagaatacccgtactctttaagaggtaaggcagaagaattaaacatttaaggcacagcagggattgacaaagaaaaaaaaaattgaccttcagggaaggttcccagttcggagatgtgagattattgttaacagacactttatgcctgaacagtttgttatctaaatacatttccatggacccatacgtttgaaattaaatgggtgaattttcagagaaatccttagttttcccagcattgatgtcttcccaaagcatattatattgtgttttaaaataaatgattaaaagggtatatttaacacctcatatattatatctcacctgattgaccaattgccaaataaagcttatctccattttttctgagtttaggattatacttataaaataaaggttactataaaaatttggttttttaaattatactttaagttttagggtacatgtgcacaatgtaaaaatatgtttttatttcccgtaaatacttttaataagacatttaaaataggttaaaactacagtgcctggataaaagtgcttgaatctcctaatcctccatgtaaatcttaaataagcaatatacccgtgagatctctaaatccacaaatgcaaattgtctatttatgttgccaacaagccagatgacattcagagcttcctcaatacccatgaaacacctgcttgctccaattattagattttcaaatgctatttaatatctcatatattacataaattttatggataaacctagatatatatacatatattaaaaccattattttcttcattatattctttataatcgtattaatataaagtaacaaataaatattaagtaacaaattcagaagcagatcactttttttctaaaggaatcagagagaaattttgtcacacctacatatgcctgcatagtgtttaacttggaatgatacaaaagtctttaattcatcaattacactattaattttacatattctaaaattacatactcatatctccctcaagattttcaaggttccttatcttctttttcataaagatgttaaaacataattaatggcttggtgaataattttcatccatacagatataagaagcttaggagatatcaaaaaatatgtttaaaaataagctatttatggatctacagagtccttcccatatgttttaagttactttaagcttttaattcttgaaatgtgattagattaatctaaataaagataaaaagaaagcaagcacatgcgacggatgccatgttatccatgtagttctgtgcatattaattctaaaattgactatgttcctaggcctacagacctggtttgaagattcattctgcctgtttctttgtttctggttttttttttttttttttttgcatcattagcttaaaaaacattgcattaataactcctggtgagttgaactcattgtctccagtccaagtggaggagatccttagtctccttccttccataactctcttcccacttgaactggagatgatgattattgcataaatgctcaggatatttttgcatttgaacccacataattaccccagcctaagtaaagtagtcataatagacttttcattctactcccacatttaatcaatagcagaatattttatttttaccttccaaattctctggatcctaccctgtcttctcccattatactgctttagctggactcacattcccctcaccttgatcattgcagtacttggcactttgtctctttaaccagataaacctctcccaaaaattatttttctaaaatacaaatttgaccatttaactccctcacttacaaacttggaaagttacaaacttcaaaaggaccctctctcattgtttatagaatcagtttcatcagttcagtaagcattttttacaagtctccatcctaccccacaaatactattttgttttacctctactacttttttttaatttaaatgatggttccttgtaatccatcaaatctcatctttctttacttccatttttttcttatgctttgataccaaatatatcaatgtgataagctcatcctttgagattgaggacaaagcatacctcctgttgaagccttacacaatctctcaaaatatagtaggtttaatctttattttttcactgaaactttatgtacttgtagtgtgttgttcttatatactctattccatttgtttacaagtttcactaaaatattgtaagcttattcatttaagacatttatctaatttattcatatgcctttagcatatgttaggttgaaagcatctaacaaatattcattaagtaaatagttaatttaaaaaattgatctatgtagagtgactaggccatatctgatgcaatctatacctgtgctattctgaatatatgatatatattatatctatctataatatatataagtacatatataattaatacatttatacctatgtctgtatctctctatctcaaataaaaaatgttacaggagccaaaagaaaacatttatagttttaaaatttttcacatatttaagtatctgaatatctacataaataaagtagaattggacagtttaatctgcagtttctttagagtaagcaaagtgaatgtctatttctacagaaatggaaaatactaataacattctctgactgtctttctttgtctctctataatatacatgcccacacacaaatatacaaatacattgatctttcaagttaaaaaactcacaatataatccttttatcttccaatatatcactatcaggtttatagttctgctgaactgaaaaattttgggagaagcttagaaaacttttatggataaagagaaatcaaaatcatgcttttaaaattggaaggcaagaagaattttcagctgtataaattggcctacaaaaggtattgctaaagaaataaagtatgctgcaaatgtacagatgccctgacctgtggagatacagtaattccactgacaataagcatcatgagcaattatttttatttccttactgcccaatgtctttgatgaaaaagtactatcaacctagactacagaatgtggcattaaagtttaattctcttcaatcaggtaggcagagatcaaattctgacactggcttttattgtggaagagttagaactttctgaaaatctcttttaaaccactgaagcaaaccaaaaatgttataagagccaaaagaaaacatatgcagttttttttcacatattcaaatatctccacacctacataaggaaagtataaccagagagtttaatctaatttttttttccaaaggaagctttttttttttttaaagtttagtcttgctgcttatttaactctttagattcctgtcttgtttttgcattatcacagttgtataagcaggctttcctataaattaaaacattaacagcagaaaagtaaaataccatataattccatacactgacattagcttttttacgtttttacttaaaaaataaaaataatcatattgatagtttttttgttttcaatgtgaatatgacttatgaagtgtagctaaaatttgaaaatgtagctgcaagcatgggatatatttttgaaaataatgaacaaaaggacctgaattttgaacattttttcacaattgcacgtcagattaatctgctataatagaagcacacattaagcacaataaagtatttatcagtgttcaaaattactattttttacgcccctctcatctgaatgaactgtctttctaaataatgagaagtttatctcattgtttcttttaactaattctacttcaatttttataactttatagttctgggaaatacatccttactttcaaaagggcatcacttccagaaaacatctgaatgtttaaaaaaaaatcatcattttagggccagtcataagtttaaaagactgaaaagtagcacatgtaaatttgtaaaagtcaaatgtaatttttttatataggacaagcattaagcactaaaattgatttaacgaagatacacttttgaagaaaacataagtgtttatatttttctcaccactgataactcaaatacagattaaaaaccatatcattctaagaattgctaaactatatacacagaaaaactgtatttttatcaattcattcaaataatatactatacagattataaaaggtgtggaatgtttcacatccaaagttacttacatataatttaacattttttttgtatccactttttaaaagaagaaaaagctgctgaaattgttatatactctgggttgatgataactgactctgtaaatttctacctttgttgatgaattgaacattctatagctatttagccattatgtgtttttgaatcctttttaatgtattttattaaaattcttttatttaaaatgaaaaggctaatagatgtgtcagaattatatcaaagaaagaaaaaagtacaaagaaaagacaaaatcataccataattttattctaattatttcataatcacctatgacataaattggcaagccaggcttcatgaggagaaagaaggaagtggacatggtagaaagaaatgtaccatacccgtcttaactagtcgctgaggagagattctccaaacaagtttatctttgccaatctatctttgcctatctcatgaagtcccctgccacactctgattaggttggctgtagaccatgctatttaataaatggggatactaatttgttataagagagttataacaaatttctttttctttttttttcttttttttttttttttttgagacggagtctcactctgtcgcccagcctggagtgcagtagcgcgatcttggctcactgcaagctcctcctcccaggttcacgccattctcctgcctcagcctcctgagtagctgggactacaggcgcccaccaccatgcccggctaatattttttatttttagtagagatgagatttcacctctgtggctaacacctctgtgttagccaggatggtctctaactcctgacctcatgatccatccgcctcggcttccctaaagtgctgggattacaggagtgagccaccacgtccggccgagttataacaaatttctgagtttcataaacagtaactaaacaaggtttttgagcgtgtaattctttatgttccagtacctttgctctttcttgttaaccttctcttatcaaatgaagcagacctataaataaatactgtaagatggctaacaaactgccaccaaaataaaaacaaaataaacttaattttatattatcctaatttataaaattcttttaaattgatacttcttcattcatacttcatattttcacactactaatttacctaaagtgttagtgcaaaattaaaatatgcagataagttatttttaacatcatcccttctctgttattctccattaattaataacaaactatctcaagatgaagtttaccagtgagttccctggttaaaatcagttatttgccaatttgcttcatgtaaaaagattttatgtatcatctatctatgtgtctaatcatctatcatttatcatctatctctttgtgaacatctgctgagactagactgatttgccacaattatttggctaaactgatggcagccacaagccctctggagtggctactgtgaagacaccagctgctgtggtgaggcgggcagctccaggtgctggcacaggtgctggctccatgcaaggttacaactggaccagaggtactgcacgtagctcccactgcaggcacccacatctggacgaggggaatgcagtggttcccagaagcttggagatgccatgtggtcctcagaagcttggagaggagcttcattgatcagcagaacagctcttaggaggcccgaagtgggtagttgctttctgtaggcaggttatcccaggagacccagagtgggtagctcctttccagctctctgcagagagcaaatctggagtgggtacctccttttcataggcaggttgaccctacaagtcaaggagactcaaattgggtagctcctttccacagctggtcatccagatgtctctctgagtctggctgagtagggggactgaaggtgtgtgtgtgggggggttggtttatgggctttagaagggaggaagtctgtgctgattggccatggttgggtctggaaaaagcaccatgagttctaaatcccaaagtagactccacctggaactgacagcctggccccatgcttcacgccttccctggcttgaaggtggggcatcaatggggactcacccctttctgcccaggagcctgtctgcctcccaccatcatcaatcatgttgtccaaggcgctcaggctgttcttgtggaggggcgtctgcaggtccatagggagctaccctcagcatccccttggcctccctcttgtgtttgtcagtgcccaaaatctggagggggccagggcggcagagggctggcatgtcagcatcacccaaagcatgggcacacctggccggtcctgacagtgcctgggcttggcctcaaccttgctccaaaattggagcaggtgccaggagtggggaagagtccaggcagcaagagcaggcacttccaagactgtggggccatggggtaggctctccagggcccccagagcacagggatgcctgggttcacagccatggctgggtggctgcagctgcgcccgggagggtagggctctcacccaaccgacttggaagggggcgtggttcctgcctgctccttggagtgtaaccctggctgtgcctcacctactgcagccagtgtctttgcagtggctggtccagatgggccacacctacaatcaaaattatctggaggtatgtaatttattacaataaaattgttatttattaaaggcatcaaattttgctttgagacagccatttgatatttatcagttaaaatagtttgaactctttctctagaaaattcagtatacttggtataacttgtttagtattattaaagattaactttgataggaattaacagtaaagatagtagaactggacatcaatatttacttcttttcacactctagtaaattaaaagaagtgtgacatataacaattcacttttattcttaccaaaatttaaatggtgaaccattttttactatttatcttgccacagaaaaccaccaaactcattaaccatctggtaattatgccaaacaaactatcataaatccataattattagtgccacaactctctttaatatggttaaattgtctacttttttttccttcatttttccttttggtttcaagaaatacagaattgtaattaattagtcatgtttgatcctatggatcgtatatgcgcctctttggcttttggaatctgatgacatactaaagcaacctatgtttgataaaggtgttttaaaccgtagaaaattatttctgcttcatcaaaggaaaggaatttgaatatatctgtgtatttatattttctgtgaaatagtcacaaatatattttaatatacataaaaaattcacatatttgtgattggagactaaaactaatttgtaatttttgaatggacacaatcatcctattaaaatgtatcacatacatattttcttctgctaaaatctatttataagaacttctgaaggaaatacaggtacagctatgatttctcaattttcaaattccaactgcaattttttttgtacatagtagttttccaaaaaatatttgctgaattaagttatataataattagatgaaccatgaaattaactttttaaaattttaatcttattttgaaatcaattagttgcctaaaaaatacagcaattgccaattttcagtgtaagtattatgtgtaaatcagatactctttaatgtaaattcacttggtgaattaaacgagtagtctcattttattttctacatatggcaataaagtaaccttaattgtatccccaaatggaataaacagatgtatttttaaaattgaacttgatgctgttgagcaaacactatttgtgtttgatagaatgaaatctattatattgaatgcataggctttttctgttactcgtttaaatttttgattgaacatgtgatcactaactgtggtttaccatcacatttagtatagctgacattgattttatctagaaaataatctagatttacctttcaaaaataatttgatcataaattattgctaggtattttgaaaggcaaactataataaattctcactactcaaaatatatttttatttatttatctatggaatgacacagaaaagtagaaatcataacaggactaaacagaaaaaggtgtgtaaggtattacattcaaaatcagttccaaaagttatgcaaaagctggaactatgaaaattttaatgaattctaatttattatttaataatatttatttagtaaaattatattttagattgattcaatttgttaataatatttgaaatatctgtaagtatttcaaaaattctgatttggagaactaaagtacaaaaatacataatttttaaaaatcccaaggaaatttgaaattctagtaattttatttaaaacatgaacaaagaaaaatatttagtaagcaattataagggttgtgatagttcaggaggtcatcagaaaaagatttcattattatgagatgaaattgtaaaaaaaatcttacatgtgaatataggaaaaggcctactaatttgatggataaaatataattttaaaattatgacataattactaataagaatacattaaaaaatcaaaataggttgatgttttaaatttgaatctctccatgttgtgaagtaatagtcataaatttagagtattacatgttccatcttttatttttgaaaatataatctctatttaataaaatgtcacctaaactacagctgttaaaataccaacatcattttccaagctgtaaaactaattaacttaaagctaagttgattaatgatagttgaaaatggttattgtacaatcaatatcactaccctgtaaccatcataagttacctaacttctcttagtctttattttggagttttttatctaagcatataagaaaatagcttctgtccttcctcaatatgataccagtatggattacttatctcaaatattttttttaacaatattataggatatcgtggtccctaagaatatataatttaaaataattcacttttactgattttcctgcaatctttttaaaaagaaacttgaaaatgtcaggaatcaaacattaaagcttactaatcttttaacaaataattagtgtgaattaattatgctcagttcaaggtagaaagagtaataaagtttaagtaaatagtaagggcaagaatatgaaacacttcaaaaatatggagataacgaccaaggagaatcaagtctgggaaaaaaaaatcatataagattaaagggaaatttggagctggagggtgggaaagttgtggggatggatgaggactcggtaaggcaaaggcagagagcactatggaaaaaaaaaatgcctggaacagggtttcacatattaaaaacaaaccatctttgtgtctcagtgctttgttttataaatcatttcctaaattctgtgtaatctacagattaaaaaagttatgtataatgtctttgcttatttctgtagtcctctgctgtgtgagtctaatttgaattttagtgtaatttcaacatagcttttacaggttaataaaacttacatgcattaaaatgctattaaagtgttacacatggttaataatacttatggatttctgaaagcagtcattattacactgaacaaagtcattaatgtctttaaactttgcatcaggaaataaaatacaaaatagatgtctaactgcaagaatagtcatgatatctgactataaatatttcttctctttttaccatatatttttttcttttgtatttgatatttcaaataaaatatactgtaataaaaataaatgagcaatgcattggattctggtattgaccttcccactgattgtgacttcagctttgatgactgacagagtacaaacctccttaggcctttgccttgtcacctatataataactaggacactaaaggtaatctctgtaatttccctcagccctaaaactcaattgagtttacagctagaaatgaaatcatcaggtattatattttctgaacaaaaatattttcaattattttaaataacatatatagtttgggaatggcaaagactttgaaaatcttatctattatttgtcatgtaacttttctctacttcagatgtgcatattattaaattggcatttcttcattacgtaatataaagtcaatcacttaaatgtttggattgcctaaaacatacattactaaaaataagtttaggtgtttaaaatgtccattcacttctctataaatcacctgaagtatggttatagaatgatatgttactacacacctaacatctaagtaactgtttatctaaaagaaatactaacttattttgcttgaaatagttaacttttattttatttcagtatgcaaaacatactgcctatgtatttgtccacagtaataaggagactatatgtcagtggttcattcattttactatccagagtcacattccaaacaggcttaagtccttccttcccttccttctccctccgtccttcccttacttccttcctccctccctccttccttcctccctccttccttcctcctttcccttcttcccttcttccctttctttcccttcccttcctcccttcccttcttcccttcccttcttccctttccttcccttcccttcccttcctgtttaaataatctacctatgatcacgatatagcacactaaggatttacagtataaaacatgctttggaagaattatattttcaactggcacactggagcaaggggacactgatgtagacaatgtcatatggtagcaacatcagagtttatcacattaaattagcattttatggtaacaattcaattaggcttatagttttcattgaactttaaaacatttttatagttatataacagcaataaacataatgggtttataactagctttatatttgtatatatcaaatatataatttaactgagacaacatgagatttattttgctttgaaaggagtccatatataaatcaacttataaatttacaaatctgttgcatagaaaataaattcctaacaggttcagtgtctctaaatgtgcctgagaacgttagacaagaccactgaactcaaagtgtaaaaaattatatctaatctgggtttcttggtaattttttttttctttcttcatcaaaatacaactcttctgtgttgatatctgtgctaactaccacagcaaatttatccttgccagaaaacaaagaatctacctatctttcaaaatttagttactgcatcagcaagatttttttaaatgaatactagctatcttaattatgtaccattgtcttagttctaaaataatttaaaataataaaatgttttcatgagaaaaatcagcaatgaacaaagtataaatctgatatgactctgacctggagaggtccaatactcaaaatttaatagtagaggaagatatttaaatagactcatacttgtgtagtaatttgacccttagaccctggcaaccacaacacatgtagtaaaaataggctttcatggatgttcctgtgcattaatgcttgcctctgcccagacatttaatggtgcagccttatttaaaatagtcttaaagacacagaaataattcaataaacaagagtctggcaaatagagttaggatatgaaagtggtcttcggctatatctgggtaacaaccacgaagatcaataaagccgggatataaaatgctagaaactgacacactgagtcaacttaattctgtaacaataaaaagatgagttcagctatatgaactttgaaaaaaatcaaactcttggaataaactaactactctgtaaacagaatataataatatggctttttaagtgggcgttacatttacgatgaaagaaaataatgaaaaactaaggcacattgaaaagtaaaagagattaaaatacacaaatttcagaaaaactagataaaagtttgagaagtaaataaaaatgtgagaaggaacaaaaatataaaaactgaaaaaagtgaaatacatgaaggacagagttttaagtagtgttactcacaatagcaaggatatagaatcaacctacatgcccatcaacagcagatcgataaaagaaaatgtggtacatatacaccacaccatagagtactatgcagccacaaaaaataatgaaattatgccctttgcagaaacatgagtggagctggaagccatgatcctaaatgaccaaacacaagaacagaaaaccaaacaccatacgttctccatataagtgggagctaaacattgaatacacatgatcataaaggtgggaacaacagacaatggggatcactagatgcagaatggagaaaaggagctgaagaacctcttattgggtgctgtacttacagcctgggtgatgggatttttgggatcccaagcctcagcatcaagtaatttacccctataacatacctgtgtatgtgtcctttaatctataataaatgttgaaaatgttgaaatttttaaaaaaggaagcaaaaaaattcatcaaagaaaattttttaagaagtgtgatatacaatatgtaagcaatattgctacccaaggtagactgcagaatgagtgaatcagtatcaatcatctgcataagacaaatagaataattttaaaaattcccctgacttgaagaaataaataacagaaacgtatgacaccacatattttgaataaacacttaaaactccagaaataaaaacagaagggaattaaattataagttctctatatgtcagtcattggaataaatcttttctacatggtttttaattaaataaaagtcattttaacttctgtgaaagaaatgaatcaactgaatttataacatatagcattcatgaaaaaagaccattccttggtttaattttggcaatgacggagatgaaagcaaacttgacagcacttactatatcatcctcagtcaaagataagatctaagaaatttacacttcaccaagttaaaattaatatgtgaatcttacaacacaacaaaatattttaggttggcaattaaaaaaattacaggcaattttaaagggtagcacagtctttaccttttttgtttatttgtgtaatgtcattcagcattaaatttcaattggaaaaaataattctaaaataattataagagcaagcctatggaatattctgcaggtcattaaaggctgaaatatttaataaaatagttttccttgcaagtaagacctcaggataaatacccttaaggtgcaaagttataaagttgagtaattttcccaattaaagtcaaacagaccttagcaaaatcattaacaaaccagcaacaagaatgaagacattaacttttactatgattggcataaactttgaagcaaaaatagtataaagataataacaacaaaatattttaccaggtttttaagagtgacatgattctttttgattaaatttagagaacacaaaatagaactcagaacaataagttcaattttcttctttaaatatcaaataataattttattatgattttacataaacatactatggattaacccttaacccatgaacaaatctcataatttgacttgaaaagcactaccttctatcctagaatatgagttttctttggtaagtaaactatctaaggactgtgttgatttggcaccagctctgacttctcatagtgtagcgtggagtcccagtagaaactgcacctcccaaggcattaccattgacagatcttcaggggcttttaaacacattgaatcagcaatgataattttggagatagatgactcctatttaaatacagtttgaataactttatagcagtaatgaatgcctatgcttatccctgggaaatatgccaggaaaagaagcaggcatcttcagcctgaattctactggcttcatgctgtaaaaaaaaaaaaaatcagccaagctagcctgtggataacttttccctaaaaggaatatttatacaggagcttgctatggtttaggtgtccataccaaaactcatgttggaaccttagtgcagcaatgttgggaggtggtgcctgtacacagtgaatagacctttaaaatagattaaagtctttctcatgagacgggatttgttctctcgagaaaagattagttctgggtacagtggttgtcagaaagcaagcttgcctctcctgtctggtccttcttgcattccagcttccacattcacatctctgccatcctatggtgcagcatgaaaccctcatcagaagccaaacagatgcctatgccatgctcttgggcttttcagccacttgaagcataagccaaataaacctcttttctagtctctgttattctgttatagcaacactaaatggactaagagctcttacagtgcttgatttaacaaatactaacagattgtaaaaatacacattttaggtttatgtttacttattttgataatcaatttttttattgaacaaaatgtatttccatgaattgaatcctgatttttaacactgtatccatcagaaatatacgttcaatttatgattaatgacttagtccaggcaattattaggttataaccctgagaatccttgtagcagtcattttaataattttgttttatataatttccatttgtataaaaaacatgtttactatattttatcaatctacaaaagtacgataaacagaaagtatgttcaaaacacaagatacgagaaagaaggatttaaaatacacacacacacacacacacacacacacaggtacacacacatgtctgatgcatgtgtatatcaaacaaaaatggcatgttaggcaatgtgtaataactaatatctatgtcgtaataataaataaacattgtttgcctatgctaaatgtaagttaatattcttgaacttatatgaaattagcttttatgtatgtcttactagagatacacaccaaataaaaaatacagtagataccaaaatatataagtaggcaaaacatgccctagatattgaacacagaaaatacggaagtgacagtattgtatagaaggcagaatatattagtgtcttaaaaagaaataataaaatatagaaatgataagtatactttactagtaaataactatatatcaagatatacatgataaacctgtcagtaatttaagatatatgacagaaatacagctcacaaattttaacttaacatcatcctagcacaaatgagactgaaaggaggtcaagtatgtgtgtatattttttaatacctgggttcggttattattttaaagttgaacagatagtgactaaattctcaaatgaccaatccattggatatattatataatcagaaataacaaaggaaaaaaattcatctcctaaaatgtttaaaactatacctttaaaaagtggttcaaaaatatagtgattgatagaataatttgcttttataactcaaataaaatttttataacctattaagatctcaggagataggcatagtagtaacagaaatgaatctctggctaggaattattctataaatgtgaaatattagcaaatcattcatttggtataaaatatttgagaaaaagaataaaaacccactttgagaaaggagaagagataaaaaaacaatgataaaatgagggatgatttaactgggaaagcaaaacatgggagtgatatgaatatatgatatttggaaaatataaacaatgacattttgtaattgttattttctaagttgtgcttatatatatataaggtaaaatcttacttcaaaacttagtatttacattgcagagtgcattactagtgggatgtttataagctctcctaaatatatatttacttacttgtgggtaaataaatactgacctgcagtcaaaagtatgtccaggcccatcaacacagatccctccattaagacagatgactgaattaagttcaggctcagcacaattatcaatgcttttttcacagtatgcaccagtgtatccacgtgggcaaatgcaagtaaatccatgtgctgacttctgacagaagccttcattcatacaagggattgatgtgcagtcctagattaagaaatagagaatcaaatttgattattagtataaggttgaccattttaatataattatatttttatttaaacataatctaaaaaactgatgtgcaaacttgtttgacatttccttcctctgttaattgaaatatatgtttatgacagtaagcggttttttaccttttattaccagaaagactgtcaaatattttattgctgatttaccaagaaataaaatcattattaatctttataaaaagatgtatcatgtcagagaactgcccctgcccccaataatggtgctaaagcaaatttcctctgcagataacagaattcactggcccttagtgtctaccatacctctcagttttcccaaaacagccccagttcaactctgctctcctacggtaatgattaatagtacttccattaaatttcaaaggatttctgggtttgatcacatacttagaacaaacatttcacaatgcatttatatccatgtaaaatagctaaaacatctgtaatagctgaagtttgaatccaatcataatcttttaattacctacttttccccatgcatttgtccaaatgtatgtccagcatttctgacacctgtagctgcagaagtgcaaatgtcttgtagagttagaggaatctggataatacctgttactttttaagcttaaaaatattttaaaatttctcatagttttacttacttattcaacaaatggtattttatttattgtaactacatggatgcacaaaatggtgataatatcacccacctcatatggtgtgctatgagagttaaataaaataatggcactgtgtcttaaacgtcatatgtgatcagtaaatattatctttctttcttctccactctgaaggccaagggctcagtcagcctctatttcaatcttttggcacttaatttgaacaagaaatatgtttctctgtatatttagcttctaccatatcataccatatgcttttaagtttacagtttagggtttatatatatacttacagtgtggaaaacacatgtcatagtaccacaaacatggtatgacattatttttcataatgtaaactgaaaagatttgcacccataattctgagaactaatttatggaaagttatgacatcattagtaaaactgtttattttcaagagttttacctaaagataatatcttaatgaacctaaaccaacttgaatcattttgcactctaggtcttgagttcttacattctcaaggataattccatatgcaaacataaaatacttcttcagcgttttaccttgaaaagtgacaattttctagaattattgttcattaattgacacctatgcttacaaatatttagtgactttttaaaaaagtattaacgacaaaaactcataccgacaagactattatggaagccattgcattaatatcatgtatccactggaaaattagatgatgttaaaaatcatcagagagattaattagcgtcatccacaattagaaatgaattgtgcacttcagtataatattccagtcatgcctggaacttagatagtgatcttgtacacccccaccccctacaagtgatagaactaagtatgtttttataaacaaatcctttgatatttgttccacttttgctgaaaacgtgaacttgttaagaaaaaccaagagcacatagtagactatcctgtaggtattgcagttttatttatggaatagaaatgcagaattccacagggagtggcatggaaacatgtttctcccctaactctgtttctagatatgtatagaatgatttattagaaaacattacataaactaattgaattgtatctcccatgggaaaatagggatagtttttagactgccaaaagttctgtctccagggtttcaagaatcttttactaaattaattagaaagcttaatgggaaatacaaaggcaatttctttttagaggaaatcaaattgtcatttaaagttcttgatctttcctggtttaaaaatttaaaaggatgcctttcgttttgttcatcatttatattgctttgctatattctatttaatataataaagtgctttcccaaagagttcactaaagtaatttcagaaaataaaagatataaaaggttgagtatttagagaaagagatggaagctgggaggaatcctgcagaccagggcaatctagacaacagagcttgaccccagtgatatattcattcaacgtgtactgaaaatattatgccaggaaatgtacaggagcatgaaaggaacagggcagtgatatattcattgtgaaattcttagacagggcaaagtacatactgggctagtaaatgtgacagttatctcactgactcagttagttgtgttctctctgagggatgtggtttagatccacagggttgtcctgtgatctcttaactgcctagaaaaggaaattacccaatgtcatctttatcataacatttctctcatggcatcacgttttattttttagcattggtgttttgggtagtggaatactttcctcaattaagatcttggagaaagggaaacagatacagagagaactactatttgaagagtgggaacagaacacggtacctactaagtccctaccattccctctgcaaaggcctattaaccttcacagaattccgtgaactttgtccagttctgaataaaaactgctagtgtagtccagtgtttttaaatgcgtatattcaaaatctcattaattatatgggcttttactttgcaagctgcaggattgggcaatccaaaagactgagaactttgattagacgtaactacggaatctgtagcattgtaagtgatgtggttgctgttggtagtaaaaagagtctggaaaaggaaatgcaacttctcttacccccacttgttttgctcttctgatctaggtttgggctcacttttgcatgagtcgtgataggctttccctaacttagggattcaagatttatgcaggagggcaaataatggaatagctagagaacaaatacctagagaacataatggcatttatttaaacaaaagatacatataccaataagtaataatcacattttgtcagaacaaatacgtaggaaaatatttctaataaacacacaagtatggtagggcacacacaaacaaatgagcaagagggggtcttaaaagtagtgctaattattttatgctagaaatagctagaatgaactcaaacttctgtacctaaaacacagaaagaatttttaagagcaatagacttaaaatatcttaaatatccaaaaaaggatactaattaaataaatatggtgtttccacacaatagaatattaataagaagaaagtagaacaatatatggtagtatagaatatatatataattatatataaagtagaataattttctatgattgattaagtggaaaagcaaggtactctgtgtgtgtgtaatgaatgttcccattttgcaagatcttgtttattttaaagatttgtttctaattaaaggatatcgatattctctaaaataatttgtaggaaaaagctgaccatttgttgagggagatggactccaactcaaaccctctcctggaaagcattctgatggttcaatcatttaatttcaaataaaaagaatgagaagaacttgttaaataagtcccttttaaacctgtcaaaaatcacagaacctttagagtctgtgttcaaataaatctggatacttgaaaataattttctgaatgccagaatccactatgtactaatgaaagaataacaaaaaatagaaaaatatacatgatatacatggcagacaaaatgtaaattatattaaataaaaagctcataaattacagtccacactcagagaaacacaaatacatgcactcatgtgtgcgtactcagttttttacatgcaggggatacatgtgcagccttgttacacgggtgtattgcacttgggtagtgagcatagcataaaataggtcattttttcgaaccattctcctctccctccaccctcttctagtccacagtgcctattagtcccatgtttatctccataggtgttgaatgtttagctgtcacttataagtgagaacatatggtatttgtttttctgttcctgcattaattaccttagttttatggcctccagctgcatccatgttgctgtgaaggacatgactcatttttatcactctgtagttttccatggtgtatatgtaccatattttctttatccaatccaccactgatggtcacctgtgttgattccatgtctttgctatttatacacagttttttaattctttcctttttatttagagaacttacatgagtccttgctttatgttaagtctgctcatagcaatatattcactacgagttaaagcacgaattctcttatttctacttcatctgagaaagtcacgatttttaaattctgtaattagttttttccatttcagtacataacatatatttataatttgatatcttaaaaataatactgcttccatgtaaatatacatggtgcatgagaaagatacatgccatcctcctaagtcttatcaaacttgaaagaaaaatatctgctttctatgctgccctactcactttccttttctgtttgtgtgtgcatatccagaacttaaattacatttttttcactagtcatggcatatgttctctccccaggcatgcatttgctcttctccagcattaattctaatttttaaagcttccttctaattgtcacttggacaaaaaacaaaacaaagtgtattaggtttctctagagaaacaggacgaataggatagaagtatatgtgaaagggagtttattaaggagtactgactcacactatcacaaggtgaagtcctacaataggccgtctgcaaggtgaggagcaaggaagccagtccgagtcccaaaacctcaaaagtagggaagccgacagtgcagccttccgtctgtggctgaaggcccgaaagcccctgacaaaccactggtggaaggtccaagagtccaaaagctgaagaatttggagtcaaatgtttgagggcaggaagcacccggcatgggagaaaaatggaggccggaagactcagccagtctagttcttccacgttcttctggctgctttattctagctgagctggcagctgattagattgtacccactcaaacccactcaaattgagagtgggtctgtctttcccagttcactgactcaaatattaatctcctttggcaatactctcacagacacacccaggaataatattttgcatccttcagtccaatgaagttgacactcaatattaaccatcacagcaattttgcttgtcttgctgcccatccagccctaacataaactatattatttccactcctaaggaggttcacatgtaacaccttgccctatattgacccgagtgctcttttcagttagtactgcctatctttctccatttttcttgcctctttagccttgaaaaacagttcatgaatctcctgcagagtgtgttatctaagcattgcaccatagagaaagctaaaataaatagggcagctagtaagtaagatagagagagatgtagatcactttccatgtggagctggtcaggtaggaaatatatctaatgattattatatctcaatttcttatagacattcaatatctaagatttacagaatgaatgagcaaaattacatatagagtacacttaatgtattagtgaaacatgacaaaattttaaaaaatgtattaaactataacaattattctagatagtactggtgcaaatgaaataaaaagtaaagaaacagaatcgtccaaaaactaacccatatatagaaatctattatatgaaaagtggagcattccaaatcaagaaagaattaacagaccctttgataaaatttcttggaaaaaatgattatacttaaaagaaaccattaagttagattcctagcttttatcaatcataatatattcactatgagttaaagcactaaaagtatcacgaattctataattgtagatgagaatataataatatatttaaaatattacagtgggaaggatttctttggagagcagcaaagcccagttaggaagaaaaaggtaaagaaaaatatgaaaatctcacaattcataagctgtataaagtaagagtgtccagactttataaaagatttgcattttttcagaacctagtagattttatctataatttaaaataagacatacaaatcaaaaagtaaagggcaagtaatcaaaaagtaaaagaactataagtaggcaaggcacaaagaactacaaatggcaaataatagcatggaaaggtgttcaatcttgatagtaacctaggaaaatataaattaaaataatgacaaattacattctcctcatgaaattagtcaacactttgcaaagagtgatttcatttaataggatctaggtaagcggtgtgctcatactctcatcaggtaagtgtggtcttcagtgtttatttggaatactttatagctattaaaaagaatgaatcaggactctttgcattttaatggaatgattcctaagatatacttctaagacaaaaaagtcactgagtataatgagtttgctcttatgttaaaataaaaatattaggaaaaaatctagaatcacataggtagaattttaagaattgctctcataatattggccatgtatgtatatatgtacgcatgcatatatacatacatatgtcaaaaatgtctatttactgatattttaatacaaaactaagaatatgatatttgtactattaagaaatatggttttagacattacttcaggcaatatttgcagtaatgcaaacaagatgtatggttcattcattctctactagggaatttatttattacatttccctttccacatcaagaataactttcactatccagaacaaaataaacacaatatcaacagataattatgctttttaaaactgtgtgtcagaaaatgtgctaattgttttacatgcattatctcatttaattcttgcaataacctgaggtagttactgtgattatttttattgaatagtcaaaacataatttcaaaataaatgtaaattgagaacacacagtaggtaagtagcaatatagagtttccatcttggttctccgtgaatgcatttaactactccatcacccctctctggaagggccacttactgaatagttactgtgtttcatgtacattctcacacatgaccctgtgatgtcagaactagtatagctatgttttactgacgagggagagagacacaaagaatgtaataaaatacccatggtttcacaatgacaaaggcttttagtttgtatgcttcctccctttaccatgttattgtcaatcaaaaatgatttggaagaactccccagtattccaaaaggctcacaagattctcatccaccaagaacggtcacaattctcagtcgaccaacatttttcaacaaatgaggcatcctatataaaataccatatgtcaatcacaccacatgagactcctgaagattgaaagacatatcctgagaatattaaaggtgttgcccacgtcttgatatatgcatccagtatttatattctccttgtgatatctgaattaattgaatcctatgtcatccctacagatccacagatacctctgtctcctaagaccagggaggacgaggcagatggtaaaatttaagccatctgagcaactgttgataatggatacttctaggatttagtttggtggggcggtcggcgggagggaggagaatcgtggaattttctaacaacaagagacaaagaaagaaaaggtgggggaaaaaaagccatgatttgtagttttgtttggagcagccaaagaattacacagaggaaagatgagagaacagttaaatcatcaacaactgtggaagaaatgactctgaaacctacagcaagcaatttgatttttcttttaaattaaatttttgtcatataacttgaataaaattataagacttacattaattttgatcttacattgtgtgctagtcccatctgcatcacatgaacatggatattcattaataagttctgtgcacctgaaacacagaattagaattacattttcaaataagtagatgttaaagcataacttcaagggagtttcaccatttaaacttttctttcctagttcaggtgaaaaaagcactcccatgagcaatacaaagcagagtttattcctgggtttcttatccttgaaggtgactggactgaaaaaacggatcaattttcatttttgccattttccccatggcaatgaaaagaatgaacagttttaaaagataaaaagtatgtctagggcttatgtgagaaactgaagttagctatggccagcctgcattgcaatgagctgccaaccttctttctctcttccctgcttacaaagtaggtggcaggattataaaagaaaactaacgtggaagcaagcagcatgatgcatctgtgatgcattcttctttgccacctgcatcttctagaaataccttcactctagatgtgtattaaccaatattttatccatgatcagagcagttattatacagattcatagagtcataaaatacttttcatacacatagggctgaaagaaccagtttacttaggaacattttaaatactgtgtggtattatctctccatagagcaaataatagaatgtctcatcatcttacctgctagttctattaccatgagcagttacctttaagtatattaaagtctaattaatccacatttatagaaaattactttatgctaatgaacagaaataaaagaagggcagagataatgtatcagtacattgcattagctaaaactggcagcatctgtcatcttaaatgtacttagctcttgttttatgaaagagcataattaaaattatctttatcaactttcccttgatgttaagtcttaaatattgtgagttaaatatactttcataaagctaataataaaaaaaatagctaccttccatgtagacaaggatttgaaaggcaatcattggcgtttgtttcacagtgtgttccaaaaaacccactcttgcagtcacaggtataatgattgatgccatcgatacaaactccatcatggagacagggctctgataggcattcatctagatttatttcacagttgatgcctgtgttggaacagacaaggcaaaacatgaaaccatttaaatacaaaactcttaaaagtttgttcattatggtaaacatcaccaagaaatgaagacctctctctataatgataacttggtatttggtagcaaaagaaaatatatttcaaggttaaatatatttaggtctatgaatgttcagattactaatttaatgtgaatgacaaaaacaaagcacaagcttaatctactgaggagattgtttttagtgtgatgtttgttgagaatattagtgaagtaatgaattatatcaagttgtcactgtgaatactaattcataattttttttgtaatggtctttgagagtcaaacgtttattacctacaagaattaagaatgagtttgaagttttctaaatttggctttagtgagtctattaatgggctccctgagatttctaaatgaaatctaactttggctaaatacctgggattttcaaaggccaagtagcgaatattttttaagcacctaccaagaaccacctctatgctcaactagaggtaccaagccaaaaaataaacttcctgttcacacaaaaacgtttttagggaggtaatcatttacagatagaaaacaccgagatgataacataagcagagcttaatggaaagcaagattgtgtttcgtatgtttgaaatatctggaaagagcacagaaccattgtagaattgttagaataatttctttgcccattacatccattactagcaagcatctactaataaaaactagcattgactgagcacttataggtgtgccctgcccttaaggcttcctgcacattatcttagctaatgctcatcaaaccgataggcagatctcattaaccttaactcactggtgagtattcagagtgtaagtgaaacttccaggtcacacaggccataacagcaaacaagaatttaaatcatgtttcctctgacttgtgcttctgatcattactttaaattacctaccttgcagctactctaatatgtgcataagttgctatgctgagtaataccgtggataccaattggaaaacatggttcttgtagccaatacataatacctagttgtgaataaagataagtaataagcttattacagtgaagaagacaataatgaaaatagctgacatgtgaggctcttactatgtgccaggtacactcaatttcagaggttcatgacatagttttatttcccactcactctccatgactagagtgagttacagatcctctttacattatcttcactctgagaccaatgttaatgaagcatactctacctgggatattgacatctgtgtttaagaggaaaaaagacacttccctttcatgctgggcttggtcatatgacataaaatacaggtggctcttaagtctttcacctacaaatcaagttatacgactaagtccaacagaaatggaatgggaaagaatgtttctcccacaggaaagggcacatatttgtaacaataaaattgagtacaagcataatcaatcaagcttctcacttgtaaatgagtgttacttattggtacatcatacgtttattgggatgatagagtataggcatgcatcaaaaacaacctagccaaggtctgatacatgtttaacattttattactttcaggttcttgataaaaatatcacaaacacattatatttgattagtgatttgggtggttccaaagacaccaccattctaactaggaagataagtgaaaagtctccgtatcactatgtagaatgctggcagagtcagtgctgaaattttcagttaaaaaaagatagatggtcaatttataacaaaagtgtgggggcagggacagaaagtgttaaaagagtttgggacaggatgcatccagcaatgttgggagatgaggagatttgacaaaagacacttcactctgtttttgaaatgttctctccataaaaggcaaacatgtctcagtttagctagagacagcatcatcaagattatcttaggatctttttttcctaatgttttattcattaattaaaattgtggttataatttgactttctaagtagcctccaaagaggataagaatggaataactagccaatgtgagcattttggtctctataaaccattctcatttttaacattatagtccttcagattcacacatatcaaagtcccttttacctttctaacttcatcttattttaatctcacccttgactagtctactttacttacattgacctccttatattttctcaaaagttttaggcatgctgttcctaaaagacctttgtacttttattccctttctaaaaaatctcttccaaatatttcacagtttacatcttcttcaggtttttactcaaatgtcactatctcaatgaggactattcaaccacacaatacaaaattgcattctcgtcttaatccgcaattgccattatcctgttttatgtttccctcctgtaacaagtaatctccttgtagcattccataagatgtattcatcttttttttctttttctctctatttctccatgacaagcttagcttcataaaggcatagattttgtctgtctcattcaaactgcatacattcaaatatttgttaaaaaataaatccttgtcatatacgtgtgtgtgggtttatgtgtgcatgtttttgtattttgttttacagatatctgttattttctcagaaatcccagcctcttcccaaccacgaacaaaacagttcttgagaatctggggaaactgttagtccttgcgaaggtgagagtcagaatccaatgaggcgatggtgatgcctctgaggtgcataactaaaagagttgtctgtgcagccaaggggaaatatttaatgggacctctgctttttcccaccttcaaacaaagacatgttcatgtgtgaaaaaagacacacagttgtggagggtcttggactttggttcacaatgatctcccacaaataattaccaacctattcaaactctaagttattcatctgtaaactatgaatcaaaatttctctactgtagcatagtagagagatattcataaagtgcacatatatatatatatatataaatacatatgctccctgattattataacaacaagattgtttatcttcataggataacaatgctttgacatagcacatctaaaagaaataatagtatttattagacatgatcaaagccttggctaaagtctcagtctcagttttttgcctacattgccttatataccaggtatttcctactggtcattaatttatctaatgcatatttatgtgtcaatcagagttctagactccttgcatagttcccttgacctggcatgcatcactgccacctcaatcacagcatagcagatgattttcacaaaatctaatgatttcattatggacttcatttgacaaaagaagaaccatgttctttctttttgttatgtctaacatattgttctttccacctaccctcctgcctgctttggagctacagcaatagtttatgtttgaaataattttcagcttgtggttctaaagttttttatttcattcataatgcaggcaattccttttttaagcagattggaaggttacctgtgatatttgagtttttttcctatgatcccacttatttaaaaatcctctttactagtccgcctcaacatctgcctccagattgaatattttcacataggaaattacacaatccttttagaatcaagccattaaagttcataaactgataggtttgatcagcaaaacattttcgtgcatcaacaatattataatagaaattatatatattcctattatataaatacatgattttatgtatatatatatatatatatatctgtcaatcagctgtcttttttcagactgtgtttttttttcttactttctcttcattccctttttacccaacttcttcccatttgtcagcgttacatgttttgacaagtttttcaaaatcactttcctgattcttaatttttttcatttcacatatgagaacctcaaaacatactttatgaactctccattgtccccagaaataaatgtagtctccctagcctaaaaccaaattctctgttccaatctttcctttcttgtcgctgctctgatattatcaaatactctcatctcctggtttataaacctgattgaataatacaatcaaccgtggagtttttaaaaatacaaaatcccaaatctgaatctctgagaaataggactgacaagctatatttttaaaaatctctctagatgatggtaaatcatagctaaggaccgctgctttttatcaaactggcttaaaattaaacattctcaatattttctcatatccatgttagctcctgatagttctgcctgaaatgtcatttccacatctctgtttgcagcctgtttttttatttgaggtcttacaaaattctagttaattttaaatattccttttgatatctcccattgcatatcagctaatatcatttatcagagtctctttagggtttatttatttgaattactgtcttatcttccaaactttatcactacttatttgagctcagggatcatacctatttacttttacttcatgaaaatgccaaatacaaaattttcatgtagtaaatgatcaaaatagtcagcttaactactactgaacacatctaaattgtgataacattttgaaaatgactaaaatttacataatagcatgatatttacaaaggacataatcaagttaatacaggcatacaataatttatggacttaagaatcagtgattttaaaaattcaaattcatatttctaaccattttgaattacaaaattaaaaaagtcataagagctccaaaagcaaaatgagagttttgtaaacgtttcttattatgaacaatatttaaattaaaaacaattttaactatcatgtaaaagatttccagataggcagtccagcaaatgctattctatgaggaataatctaggcaaacatgcagccatggtgtttaaaggtgtgtcaatcaaaaattatgaaatgtaaaaaaaatccagaaacaacaaaaaatggatggaataagaataaagttgacagaaaggttgaaattatcagagaaggaatttaaaataatgatttagaacatgactgatatgttaaaaaatatatcataaaaggtggatagatgactgaatctatgaggaatatcaaaagagatggaaactataaaaatattcaaatttcaatgctaggaaaataatacaagatgaagaattaatttaatgagcttatcagtggactggacataggaaagaaccaatgaacttgaagataagcaagtataaattaatcaaaaggaaacacctggaggtaaaaagagtaagaaaacagaaaagagcttctaagacatatagaataatatcaaagtttctaactgacttgcaactggaatccctaaagtaaaagggagagataatatgataggagaaatatgtaaagagataacggacatggatttgactaaattgatggaactctgtagcagtttcaggcagtatacaagctattttgctgtttggagcatatatcttagaagactctatggtattaaagatatatgtagtggaaaatatgatgcatagattttatagtagtgccagaggaagaatcatagactgaggctctggaccaaaactaaaatatatgtagcagagaattatcctgaaattgagaaatggcttctggcatgtctgggtagttgtagagatgaaacacctgaccatgggacatcaagtatccatgtggacagaactgccaatgcatttggcaagaccagtggcaatctacagtaggtagtatattgggaattgtgtatgagtatgccagagatcacagatagttgcactcctaagttatgtacttctttcgcaacagaagctcatcctaagttcatactgtttctgtctgggccctccctggtggccatctgaaggaaaaataaaaaaagtctgaggttggttcatggatgggttgacttggtatatgggtataaactggaaatggattgctgcttccttaaagccttattaagaggttacccaagaaggtaaagcaaaagggacatccttcggatgggcagatcttcagtcccatgatgtggtcataatctttgggtggaaatagcctaagagaagaatatgcatggagttataggtagtggcaaatgacatggctggactggaaggcaaaatataagactatctgggtcagggaaatatgagaaagaagcatatattggactgataggagtgggcatgaagtgtgaagttctctgcaatgcatgttaatgcagaagaggcattaaatagccataaagaaataactcagccagttaacatctgtccttctctggcatcagccaccacaatggtggtacaacaggcatgaatagagtagctagagtggcaaatatggaggcctgtgcatggacccaatgtatgggctcctctgtcccaagaattagttaggtactgcttccctcagatatccaatcttccaggaacagagaccatagccactacacacttaatggtcagcctttcttgcttctcctgccaatagatgtttggccagaataactactcaagggcttatgtagtgttgatccatcaatatgagagctctcataatatctcactggaccaaggaagccactttacaacaaagcatagtagcaatcagataacgatagatctgttggtttcatgatgtagcacaccatccaaaaactactaggtgtaactgaggtgccagttcggagatgaaagcttttggggatggaacactaaattatagaatgcggtatgcactctatatcaataatcattatatgatgctttgttcccaataggtataatatatggaattgggaaccagggggtaaaagtgagtgaaccgatgtgccatccttctttgtgaacaattgggaaatttgtgctttgcattcctgaaaatataggttccaggaatctagaggcactgattaccaggggagggacccttgcgctagagaataccactagaatccctttttgaaatgtatggttgttgtaggctctttgtgctaagaaactatcagtcaaggaaagaagttccttattgtgatatggactgaaatgtttgtgttccccgcaaattcacatgttgaaatcctaacccctaaagtgatgattaggtcataagggcagagccctcatcaatggaattagtgcccttataaaataggcccaagggaaccttccaccatgtgaggacatggctagaaggcacaatctaagtaccagaaaatgactttcactggacatcaaatctgctgccaccttgatcttggacttcttatcctctagacctataagaaataaatttctgttatttataagctacccagtctacgggattttgtgatagaagctcaaatggactaagatacaagggtaagtgatgctgataatggggaggggggaagtaggacactgttataaagtagggacaaggataaaaatatgtgacattaaggtgatctactgagcagagtcttcattgtcattcatgaacaaacaaaaaagtcatagccttactaggagattaactgtcaggcatgagtttctagattaattcaccaggtaatccagtaggccagcatattttctagccaaggatgagggtaatataatttgcacaggagaggaggaagagaagtatcagatgcagtaccaagatcaactttggtgacagaaattggagttcttcccagtaatccctgaaagtgatcttgtctatttacccaggaagagacaaattataattttgggtatctgtttccagattaggtgtacttattttagaaagcaggtagatctgagcagcacaaagggttgactataatagataaagtaatgagcattccaggtccccattcagaacagcaacactcaattccacaaatagaggagtttcctaccaagttctaagtgcaattcttccccaggaattgaattttgcttggccaaaggggtctgccttgcccaagtttgggcctcccctctgctgtgcaatgagtgaaggcgactcagtatgggtcaactatgaaggggccatccccacttcatagttcctggagggatcaactgaggcttctgttataactacatcttagctcaacatcttcctttcccagtcctacttctctttcccctcgcaggcattgctgttgaaagtagtcactgataactcacctacatgtaaattgcagtctctttcttgggaagcctaacctatgaaaaagtttcctggaaattaatcttttccataggaatgcttttaaatttttttgtcaaaaaacttaggaaaaaatgttgaaagtgtatgaagtagttactaggaaaatgtatatcattaataaaaatattggcggtatatatcaaatactggattaaaccagcatagatttagcatttgattaacaatcatttgctaatattttcattgtttggaaagaatttattagaatattatatctgttttcagaagctctccaaggaacttttactgatgctttattttcctgtctataaatatcccaggtttggacagatgcttttaaaattcattacagtagtccttagaggtttggaaaaggacaagtatcaataaatatttgatgatgaaaatgatgatgataatgatgttcatttaaatcttatttctccttatattttcctacctcttttatgaaaagaatgggggcaattcttcaatatcaggccacaattaaatgaagtcttctctctcttagactttgttaccacaagaatgcggccagttgttagaggacttcacagtttattgtaaaagttataaaaacaattactatgtcattgtaaaaaattttaaagaagacattcaaaatatccttcacaaaattgctaagacaagcaaaaacaatattctgattcatattagttactcattgtttttagatcattctaaatgagtgagtcaagaaaggtatgtgaaatgaggcgtgtgtttaattaggcaactatgttgagagctttggaaagtgagaagttgttcaaggtgaagagatgcagaatatctctaagtacaaacaggcatatgaggattgattaaaaatgaaagatattagacaatagaagtaacagtttatagatgagtcggacttctgttctaattaatacataattacttattatttgagggccctgtgtattaactctgattaacatgttaaaatattgtcaaaacttataaacttcacacattcatacgcatgtacatggctataatttatcaactaacattaatactaatacaatcaggaaattttatttcaaacaaatgattctaatccttgctaatataatgcagaaaatagctcattatttaaagtactgtttagttcctaggttctgttatgattaaaataaacactgcatgattctatctgtatgaggtatctagtcaccaaacttatagacacagatagtagaatggtggtttctagaggctaggagtgggagaaaatgcgtagttgttcaatggcataaaatttcacttatgcaagatgaataatttctagagataagctattaactatagtacctatagttaccaatatagtattgttcactttagagtattaggataggttgcatgttaaatattcttaccacaaaaaagataaataaataacacatacacacaaaaaagaatatgagaaaatttttggaggtgatgaatatgtttgttatcttgattttggtgacagtatcatggatatatgcatatgtcaaaattagtcaagatgcacatattaaatgtatgtagtgtttttggatatccattgtatctcacgaagctacaaatgaagtcttattaatcacatatacaataatgatttctacctcatagggctaatgtgagtattaaatgtgtctacacaaagttactgcaatctaagtatttcaaaggacattctttagttcaaaggacattctttagaaatgattgctctaagcttgtctaaatgagtgcctcaaatattcttatgtgcatcattgagctccaaccattagaccctgccacattccccattccaactcataagaatgagaattgagatcattaggactaattttatggcttattacatataaacattaatgcacacaactctgtttctgattatgcataccttatttcttgtacttcaataccacaatactatttcacttatatgtacatcacaatctttacatggtaaagtatttcagtaggactacactgaataggattgaaaaccagcttgccatcaaaacaattctttaaatgaataatgattttgtgaaaacattcggttttaggtaacctgtgtgtagctaggaaaacattttaattatgcttaaaatgtgaattataggacaattttgcttcagataaacaaggctgataatcagtgggatgtaccggcatgactagtgtaaaaatattgaaatgttaagtaactagccattgggtgttgctgttgctcacccttcttagcagccccaacatttcttctgtgactatgcagacttcatgagctatcaagtgaggcatagaaacatgaggttatacataggtcaaaacaatcattacataattttattattacctctgaagatacatataacaacaaaaatgtgtctcatatcagtgagctcatgtgtaaattttttgaatcaaagtagcttgtaattttttgtattttgtaacaattagaaatgaatgagtcaggctttaattgccattattagttaaaattatatttccacataaggaaagtacatgataagcactgaaatctttcttttataattaaaaaaatgtaagattgaatggcctaaaattatgttattagaagatgacaaatggaatcacttttacagaatcctggggctttgaacaaaatttgtgacattttacaatgtatgtttctcttatttctgacaactctaccaagtaactggagatcaatgaaaaattctaattttaattcttcatttgaatgggccccaaaccagggccttgatgaaatttaaggattttgtttatcctctccaggttaggcacagacacattctgacataaagactgatttaggtccaatgagtcaatcgaatgcattcaagagaaaccctttgggaaaacaaagcagacccagcagtcactaagatcaagctgtgagccagaacactcagagtggaaaataaatgttctttatcggaaccaaaaagcgatctgaaacttacaaaattttggaggtattctttaatttaaaaaaagctcatgattacaaatataaaataaggcacaatatgttagcacaaccccttctgtgtaaagaggttaaagtttaaacatattagcttcatagtaaattcatttctagttgctactatttttaatacagagctgcatgaaaaaatggaaaaaattgaaattaatataatgtctactgttctccatatggctaattccatagtttacttaagtaggaagcacactttaaagactaagtcaattttgtcatagaagtaaaaatccataattaaaaaatccagtgacctagttaatttgagatttaattttccaaaattaagaaaacatcttattggaggtgcttgctttaatccttaaatcaatagcataacattttatttattcaaagttataggcaaaggcaatggcttataagctgcacctaattcatagtttgataaaagagtattgtttctagagtggcattttaaaaatactaagtctctataatgtttaattttaaagaccaggtgaaataaaatgttaagtgataatcacaggactttctatgttgtatgttttgattaacaaacacaattcttagttgttaatttgatttatgcataaaccaacctgttaagttgatgttaaccacaggaaatagataaggctaactgatggttgtactattgagagacagtccaatatcaaataatagcaaaaataagctttgaagtaacatcttctgatttaaaatgagtggcccaatgtgtgttatgcagaaataaaaggagtttaaagatgtaaagttatagttttgtactagtaaatgtttaactggctcttggaagaaaaaaaatcaggaagcaagggcttatttataacatagtttaattcccctgatgcagtactcccatcttttttatttcaatgtcctgaaattatgtctacaaaccaacaaagtttataaaaattaatattcagctctcatgagcactattagctttctccatcacaccactggaaaggtactttcctaagtattaatttggggttgagcagagtgttagagaactagaaacatgtgcataataaggatgaggagaggcaatagagattgttgttgagggagctgttgaaatgatagaagaaagtatgtggtgtgtgtctgcatatgtgtgtgtagcagacaattcctcacaatgttatagactaacacagtcactaattagcataatgtggctgagaatttaaaaaaaacttgtggcaatattttaataccaagatgacaatacaattatttcattatcaacactcactgaatcttatgtactaggtaagcactggtgataaaagcatgacaccagacttaggtaccagttgtgtccttattttacatagcaaacatagccacaggataatatacaacctcttgaagatcaggctgttgtaaactgggttaatagatctgggtttcaacacatagagtcaattatgagaatattcactgctaaacatttgaatcaactgtgtacatattataacaaatttaaactttattctataaaaatagaatgaaacaacattgaaaactatgtgccaaggctcgagacaatgagtgcagtaacgtggtagtattatcagttcagttgtgaatcagtaagacctaaattaagatgatgatattagcaataaaaataaacgatgtataaaagacatctctacttcttttgggctaatggtcaaatgcctccctttcctccatttttattgtaaaaacatattaaaatgttttaagttgagtaaatacaagcaaatgaaaataatcgctcaaatctcataatcgtaatttttatatattacttatgttttaattttttccacatgcctccatacatacatacattggcactttctcaatgtaaaaaataattacttaaacaattataacatgtcatgttttttttcatttggtgacatggtcttcagtcatatcattttaatgattgcaaaatatatacattcttctatgaggaatacatatcatgaatatattatgatttattttatatatatatatacacactataaatatatggcaatgtattcttccatgaataatatatacagtaatctaatttcaaaataatggttatttcaacatttcaccaataaaaataactaatgaagatctttatgcatacacacacatatatttttgggggttatctctgtagacaatttatgcagggaaatatttttctaggcaaaattttcatgtcaaatgagtattttagctcactactgtttacctcactagcaggcagtaacatgcatattaaaatagtgaagcataattttaccaaaatttttttcataaaaaagataaaaattttctattgaaaatagcaatatccagtagcgatgaacatgcagtcaaatgagcacatggttacaatctcgattggtctgcaatttgtgaaaacttgccaaaatgtagaaaacggcataatttagagagcaattttagtgaaatgctgtaaataatctcttcaaatgtgataaaagacaaatataataaaaatttcacacatttctgtgaaattccacttttgaaatgtgcctaggaagatgattatttcagtggtttgaaaaaagtgagacattggaaaatatataaatgtataaactagagacacattaattatagtatagcctcatgatgaaaagtttgacagttattataaaaatgctgtggaaatttaatgaatggcatgggggatttccagaatatactgttactaaataagaattcatgtgatcaaatcctatgaactgcataaaactaataataaatccatctttaataggttatagcaataaaaaattgttattgttcactttttgtggtaggcattttgtaatctttactttttatgttttatctgcaatttccattttttatcttgtacatgtattgtttttaatgagaaaattatgttttaatgggttagactctagatgcttaaaaagcacttgatatttgacatctcttcataataaaaatcctcaataagctaggcatagaagaaacacacttcagcaaaataaaggtcatatatgacaaagccatagctaacaacatacgaaaggggggaaaattgaaatcttttcccctaagaactgaaacaagatgagaatgtccactttcaccacttctattcaaaatagtactgacagttctggtcagagcaatttggtaagagaaagaaataaaaaacatcaaaatgaaaaaagagtaagtcaaattgtcccattgtccctgttttcagatgacatatatatataatgatatgtatatgatagatatatgatatatatgatatatgatatgtatatgatagatatatgatatatatgatatatgatatgtatatgatatatatatatataggatatatatatatatgtatatcctaaagagtccaccaaaaaacttttggaatcaacatatgagtttagtatactgcaggatacaaaatcaacttaccaaaaatcagtggcatttctatatgctaatagcaaactatctgaaaaagaatagacattgaagactaggaagggtgggagagtgagaggagattgagtgataagaaattatgcaatgagaacaatatacaccattcaagtgatgactacactaaaagtctagacttcaccaccttgcaatatatgcatataacaaaactgcacttatatctcttaaatttatacaaactttaaaaaaacgaatatttttgtgtgctttatatataaccaatttgttttaaaataatcacagtgattcttacagtaatgttactatttctgcttcttttgttcaaacacattgatgtattattgcttagtcttttatttttagtgtttctgtgccatttagttttacatgtatttcataaatatagcatagtttgggatttgactgtgaatctgttcccctttctcatccactttctttttaaaataacatttaaactgatgagcctaaagattgagaactgacttatcagatcaagaaaataagatatatttgccaaacttaatgctgatgtacatttttacattaattctttgtgtctgaagatccaggaccagaagtttctaaggccagcatttcaagtggtatctggttctctatctattcttttgcctagggatgctggttaaatgagagtaaaacagtgcacacagcatttgcaggcttgctgatctgattgaaatttctgtcattaaacattttcatttggaaatttaatgttttgttagactaaatgatatgtaacaatatggctataatatagtgagtcttcctctctttctgtttctctacacacacacacacacacacacacacgcatgcacgcacacacagagctgttatttgataatgcataacaaattactgcttatgtgattttatttcattaaataaatgctatcagaattggtagacattatctttccataaatttcctgtggagttgtagaactgaaattcattcactttgtttccttatgctccacttacaacatttttgtttaatgcctgacttggttagtgttgactcaatacctatgatacaattttttgcattttaaatatgagccctaagcaactaggaggagctgcagctccatggtaaattgtaatctgtattgggagttcaatattaagaaacagtttagaaaaatatgtgacatatagaatttaaggtgcaggcttaattttacctacttctcaagtcttaccaattatatattttattcataacagaaattctgtcattattcttgatgattaacatcttgtaattaaaaacattttgctatacttttgagatctgcccttatttctgctgcattgatccaaagcaatcatactgaattaatttttgcttgagcagttcactataaatacaatgaaaatcgatcacttcattttgaaaagctagattggatacataaatttcattagtcattagataattatcaattccacatataatttttatagatcctaccagttacataataattttattaaaaatttactataacaaaaatacccaaaatttcattacatggtctttcagattttgtgtactgtgactctaatacattttacttctatataacagtgttcctttatagtacaaatttacagggaaaataagcttattaaaaagttgccggcagtaagacactgatacaaaatagtttttaacatagagagttgtatttaatttgtttaaaagtttagactaggaggcaagttttccctttttttctcctaatatgtactgtcttagcctgtttgtattgctataattatatacttgagcctagttgatttttacataaagtaaatttatttatcccaattatggaggctataaagcccaagatcaaggtgctgacaggtttggtgcctggtaaatgctgctctgttttcaagacgatgccttgttgctggatcctagaggggaggaaccctgtgttctcacataatagaagggatggaaggacaaataggaagggtctaccttccagccttttcataaggcactaatccattcatgagggaagagccctcatgatttaatcacttccccccaaatccccacctcttaatatcaccaaaatggagattaagttttaacacatgaattttgggggacattcagactatagcatatgcatatggacatatgcatacatgtaagatcattctaagtagggcactttaattttactcacgtgatgtgtagcactacatagttgtggttatgaactcaaatatggagtcaaataaacctgattaagaactttgcttttgctacttattagttcaggtgaacttaattttgctacaacacatccgtaaagcagtcataatatctactttacatattattgctataagattatcatggtgtttaaaatggtcacatactattattattatctaggaatggggtaagtaaagataactggtgcctcaatttgtaacatgtgcaataaaattaatccataaaaagtgaaataataaaaatgtaacttgcagtctatgatttctgagtgctctgcagttctaatagaggatgttatgaaaatcaataataaaagataggatttgagaatttcttcttctctacatttgaattaatgggttgattcccagctaacaggccaagtgatgggagaacattttagattccttcatatccacatgttttcaaattccaagggaaagatggcagaggacttcgaaactaatggatagcccttaaatttatgattcatttgttgtggataacactgaaccctcattgctcgttgagaactaaaggtaaatccatggggtatagaatcataaagccactggtatcaaatattttactataagaaaaaagaatgtagatggtaacaagtgttaactgattgcttaaatgatttcttttttataattgaccttaccccattaaatatgatctttatcactagaatgtaaaactgtgttgtccaatactacagttttcagcacacacatacttaaatttaattaaaagtaaattgaatgcaaaattcagttatttagtcagactagccatttcaaatgctaaatagacaaagaactacacagcacacagcagaatatacccatcataacagaaagttgtattagacagcattgattaagaccattgctcttcaaactttatttttttcttattgcccctgtacaaagctttttaaatatttttttctaatcactcttcatcatcaaattttacagccaaagatacatgttttatgtacctgtgtctaatacataaaaatagtaagatcccagaaaccttttgagaatgcatgatgtagacctatagaaagagaaaagaatcagtccatagataaacactatgaaaggcagaacaacacttaatcatgtgttcatgttcaaaacatctatgaaccacttattaaattttaccttcctaaatatgcaaataaatgtaattacaataaatgttaaggtaaatttaagagaatatttaactctattactgtattattttattaatatgcaagtgaaattaccatgaaatatttttcatgccaaatataaaataagaagattagatctgtgttatttatatttctaccatcttcttgtgaatatctcaggtgccaggaaatgtagttgatgctgggaaggctaaaggagatagaatagttcttggtcaacaaattttaaaaggctgatgtaaagataatgtaagtatctaaatttcccaatccgaaatccagaacattgtctactaaattatattgctttgatacatcaacaggaagtgatatgctgggtccagttaacactcactctcaatggccaactgtaaaatgttcaaaggttttgggagacaattggcactatcacattggtagtttaatatcagctatagtcaaaatatgtgcaccttggacatgagaaagaaaactgtgaatcagggattttagtttgctgtcagataaatgattgctaatcattcgccaacacatcactgtcaaacaccttttacaaaagaacaagattaacttctcatacccaattatcctaattccacagtcctttattaaaaccatggaaatcaagcaagtgatggaaatgtcaataagcccaatttcttcataaattccaggattagatggctttgtctactagaaaacctgctgaaaactcaccttaagtgagattttaatgatgtttggcaccaaatatcatcagtgtttgcactatctgttactctctatcagtaaaactaacatacagggcattaatgctaatagtgttggttttacaattaacagtgaactacacgaagataaatttgtcaggagcgcagaatttacataaggtctggaacaacttttcctggtctgggccagcaaagtgacagaaaaacaaaagagattgatctggtatgccattattttcttttttctgctaaaccaaatttccaataaggttactgctgataatactggttgatatggtttgtctgtgagtccccacccgaatctcatcttgaattgtactcccataattccgtgttgtgggaggtaccagtagagtggggcactgctgaaaagatacccaaaattgtggaagcgactttggaactgactttcaggcagaggttggaacaatttggagagctcaggagaagacagaaaaatgtgggaaagtttggaatcttctagagacttgttgaatggctttgacaaaaatggtgatagcaatatgaatgctaaggtccaggctgaggtggtctcggatggagatgaggaacttgttggcaactggagcaaaggtgactcttgctacattttagcaaagagactggtggtactttggacctgccctagagatttgtggaactttgaacttgagagagatgattaagagtatctgatggaagaaaattctaagcagcaaagcgttcaagcagtgacttgggtgctgttaaaagcactctgttttaaaagggaaacagtgcataaaagttcaggaaatttgcagcctgatgatgcagagagaaaaccccattttttgaggagaaattcaagctggctgcaaaaaatttgcataagtaacaaggagcagaatgttagtccccaagacaatggggaaattgtctccagggcatgtcataggtctcatggccacccctctcatcacagacccagaatgctagaaggaaaaaatggtttcatgggctgggcccagggtctccatgctgtgtgaagcctagggacttggtaccctctgttccatctggtccagcagatgtatggaaatgcctggatgcccagggaaaagcttgttgcagtgacagcgccctcagagagaacctctgctagggcattgtgggagggaaatgtggggttggaccccccacacagaacccatactgcggcaccacctagtagagctgtgagaagagggccactgtcctccagaccccagaatggtagatccactgacagcttgcacagtagacctggaaaagcctcagacactcaatgccagcctgtgaaagcagcccggaggtgggctataccctgaaaagccacaggggcagaactgcccaagactaagggaacctatctcttgcatccacatgacctggatgtgagacatggagtcaaaggagattattttgtagctttagaattttactgccccgctggattttggacatgcatggtccatataactcctttgctttggccaatttctcccatttggaatagctgtctttacccaatgcctgtaacctcattgtatctaggaagtaactagcttcctattgattttacagactcataggcagaagggacttgccttgtttcagatgagactttggactgtggacttctgggttaatgctgaaatgagttaagactttgggagactgttgggaaggcatgattgattttgaaatgtgaggacatgagatttggaggggcccagggtggaatgatatggtttggctatgtgtccccacccaaatctcatcttgaattgaattcccataattccacgtgttgtgggagggacccggtgggagataattgaatcatggggatggtttctgccatactattcttgtggtagtgaatacatctcacaagatttgatggttttctcaggggtttctgctttttcatctttctcattttctcttgctgctgccatgtaagaggtgcctttcacctcccaccatgattctgaggccttcccaaccatgtggaactgtaagtccaattaaacctctctttcttccaagtcgctggtatgtctttatcagcagcatgaaaatggactaatacactggtattacttcatctctccatattaagtgagtattttagattagtataaagcaattttgtgtatatcgtcgttcttaaatttctttttttctcaaaatagcctttctcacccagcactatgataaatgagtgagactaaaaccatgtaatttagagtttttatgctgttgggtttttttttttttgagtagaagcatagtttcagtgcttgatactcaataatgaattctttctcaaaatattttccaaatataccaatcatgagatattgcttccagaaacatttttctggtaatattatattttaaagattttctgagcaagtaaatctgtctcttatccatgggtaacatctttcttcaatatttaaatttttgtagacccttctttcacctactagttctaagtgaattataaggtttcttggttttctcctgatgataccaagctttttgaaaccctctttaggggaagctgatacttatttcatttggacaaactcaaattaatagtggaaatggatgagtagagttcctgttccaactttggacttttatactaacaaaatcatttaacattattttcactttggaaattaatgcattcaaatatatttccttctctcaactttatttcatggtaatttcaaaaaccattattttgctgtgatgttcagatcaaagtttcagcctcatccacctcaattaatttttagatgactgatattatagccatctactcattagctattagacacagacacataccctatgcaactcagcattgtaaattgttctttataaaacacctaatcaaataaattttagtgtggtggctcacacctataatcccagcactttgggaggcagaggcgggaggattgcctgagcccatgagttggagaccagcctgggcaatatagtaagacctggtccctataaaacaaatttaaaaattagacgattatggtggtatgcacctgtggttccagctactcaggaagctgaggtgtgaggatcatttgagcctgggaggcaaaggttgtaatgagccaacatagtgccactacactcctgcctgggtgacagagaaagtgcttatctaaaaaaaaaattaaaaataaaatttaaaatatataattagaatccattcttggctcttcccctttgtgtatcctaaacatactaagtttccttgattctaatatacacatcttggtcttagaatctttattcatcttccatggtgcataaaataatggtgaatcctatcattgatagcacattagatttgttgaaatataattgattttattcaagtttcttccaacaaaaaataatctctctctctctctctctctgtcattttagcctactcctaggccttttctctctccctgttttgctcccaacttcgggaatttcttgactccacatcctgtctatacaggtaactcacgaaaattcatttgaagtcatttctttcttctaagcgtcagatcctctttttgatgacttacttgaaatcccatatgattttattacttttaagtttaaaattaagtttttctccatcattccttctaacaaacatctcattctcctgactcaaaaagtaaaattctctcttccttttctaaactttcctccctatgtaaattacccaggctcaaaattgtagaggtaaattcaatttctaatacttttataagtctgctgctttaactaacttttttcctttctgttttcactggcataggtccagaccaggccttcatttttatttaaaatcatctaagaaactcttcttttgttttcttcaacttaacatatgtttccaaatttttcaaatcaatcatcttatagaggcagttcctgtaaatcgatttccttgctcagagactttcaataactctctgtttatccaaagtaaagtagaatccacatttcttatttctgattaatactggaaaagtaagtcaaaacttgtcctaccaataatgggctttgtggaaggaaaacataaaacaaaataattatgtcaagcctttcattaaaacattgcaatgtgaaagaacagctttaaaatgtgtgttctgcagggagaatacagattggtgaaggtcaatcatagttctggttattcctagaattgaatactgttcacgttctcaagactaatgggaaactgaggctctattagttacataatagaaataagaggcagccagattgaggttgcacattagtagcttttggttagataatttgagtttagaaagaggggtggagaaaaacaaatgggatctaaattatctcaagtataagaagaaaaaatttagttttattggagctgtgatagtttgaaatcatagttgatatagaatagacaatataatattattctcaaaagacatacaaagccatttcttagctttactttcagctatctgttatatattctcaaagcaattgttaattaacatttcagtgagaataattttcccaatataaaatctcattgattttaatattaaggtaaatacattatattaagaattgcttgatgtggtaatgcagtgaatttaggggaagtatttcattatctatatgcaactattatgaaataaattattgttttttattagtttactcaaaaagtaaaataaggccacataattaatcattgcatgtgttcacttgactggacctcagggtgtttaaatacctggttaacaactatttctgggtgtgtatgtgaaggtgtttccaggtgagactatcattcaaatctgtaaactgagtaaagcatattatcctccccagtgtgaatgaatgcccatcatccaatatattgaaagcctgaacagaacaaaaaggcaaagtgaattctacctgcctgtctgaaagctggaacattgattttctcctgccttgagacttggacttggattgcaacttatgccactggctgttctggtctaggcttctcatcctctgtaattgcaggagataattccttgcaatacaaaattcccctctctctcttctctctcctgccattctctccatctctgtgtgtatgtatatgtatattatgtgtgtgtgtgtgtgtgtatcctattggttctatttctctgaagaacgctaatacagattaaatgttaatgccaatcaaaaatgatttacaaaaatcctagtgaatatagttactacacttaaatgactataatggtaagcaaatattctcttaagtagttaataataattattttatatctcatatcctcatctttaattatcttttcagcagcacagtttagaaaagtctgagtaatctatgaattcttacatgctatatccaattttcctaaaataatgtcttgtaagtccatctccgtttccctggcaactgcctgagctcaccatttcactacaacccaacagtgtttttaaaagactcatcatgtcagcaatatcctttttggatttacactaacccctaccatgtctatttattttctaaaacaaacaaacaaaaaaaccatactttttttgccaaagaaattccagttattttcccttttcccaggggaaaaatgaatcttcatcacagacaaaaccctttgattcttgtttaccttcttaccctcactgtgaacaatttgtagagtggaaccctaattacatctatcaatgctgattggaaatgccacacttgaaatattttgggcgcttccttcctaccttctccaattgtgacaatgtattttcctttgaatctgaatatgtgtgccattctgtttttgcatattttcctaatacagtagtatagatagtttatttgtctataaatatgttcttatagctaccacattgggtcgaattatttatgtataagattctgagctcattacaaccctctgtctactgccccagttcctgaacacatgctgatctctttctctttaatacatgtggagaaaatgattttgattacgacagctttcaatagataattgagtgattggctcatgtaacttttcctctttccttcacattttttcttttattttttcagtctttaagaataatattatgtttttttataatttctaataacaagattatgctttgatcatttaaaaatcaaatgtttatatatatttcaatggttcctcttgaattgcagaataggtaaacagcaatcatgcagaaatttgaaaaaatgcatatgagttaagactgcttttatagtaaagctagtgaaaagcaagaggcacttctggggaagttttcagttaactgcattgctaggagattgaacagagagactgataacgaatgcgtgatgttttcaaacaatcaactcacacaggagacaaaattatgacatatagtttgtttccaatgagaatgggaggggcagtatagcagatcaggtggatgagctgaaggataaatgtcttagttgtactgaacaagcgaatgcagctggtgtaaatagcgtggtctgagtaatagtacacagaacaagtataggagagaatgataaatttagagattgccaccatggatcagaatatgagtccatctaatgttaaattcttcctatggcaataactaatatttagtgttccaaaggaagatgaaaactcaacagactgtgcctaggcaatttattcaatgttatttatcagatgagaaatttctgttatcagtcccatataaaatctttgaacaacttgaattatgcagtttgaataccctaatatttttatgctggcagaactgcaaatcatattgatgagcataaaggtagtgaagcttttaaaataatccctaaataatccctccacactattctattttcatttaccatcaaaaaacaatggttattcacatctagtgcaatatatatacaatttgaatgcattttgacatcaagcttgggtcacaatacatttaaaaacatgttaaagagaaaatgtattagcattcatgtagccaatacaatactagcctgctttacagaatgttcatgtttactgactttatatttttatatttataatttaattaatataatttttaaaatctctgagattcttagaaatatccagttggttatataagacaattctactaaaataaataaaagtaggttttattagaattatagtcagaggtaatggagtgaaaaaaatatttgaaactagaaatgtcttgggctttagtctttctgttgtcacattttagatcaaaaatatttggggagtcacttatccttcagtagatttctatttctgcatatttaagcagacttagcagcttaaacaccatcagtttattagctcacagttttatatattagaaatataagtgggcttgactctttttctccttagggtcttaccagactaaaattagttgttggccagacagatcttttctggaggctctggggaggaattttttataagctcattcaagttgtgcttagaatccagttccttacaggtagattgaacatgcacatttccttgttgagtgttaatcacaggccaccctttgttgctagaggcaacctgtgtaccttctcatgtagtgccccccatctttaatatcaccaaagaaagacttccccttatgttcaccagctggacaaaattttctactaaaaaaagaaaggtatgtgattagattaggcccagccataggagccccttttttatataataatttaatataatcatgggagttatatctcatcatattagtaggtttcactcacactcacagggagaagattacaggaaggcagtatttatggaagtcattcctacaattttgcttattacaggagccgatattttatctgaaaaaattgagattaattatatcttccatgaacaattgttggtagtagtagaagagctaatgtttagactcacttgccacatcataaacagcgaaattactaattgttctgataaacatttgaccctcatggatgcatattttatttataaacaagaatgtatgttagcacattctttctatattaactataaatctatctccttataatttcccccagcctttgaagtcaaacagataatatgtaatctctcatccatgtttattcactctgtggcattggtccagcatttgtagaaactccatttcatgtaaggcactcagtgctggggatcagtgaacaaaaatacatgacccccataatctcagagggtcctccctgaagaagtaacttgaaatgagatatggtagaagttaattaggtgaatagggaaagaatgagcctttcagaaataagcataggcatattagaaagggaaataagacagcaggaggaattaaacagctagaagactgaaaattattcaaaaagtgttacagtattagatagaaaaggtaggcagaacttgttacaggtagctgagagggagaaaagacagtaattgaaagccactaaagttttttaaaagttttttaagcatgaaggtaacataatagacattaattgtgagaataaaattattctatttactatgcagatgaaggtaaattagttcaaaagtaattaagaagaccgatcagatagaatattagactagttttgtggtaatagagatagacatgatttattttgaaatagctagatgacaaccaacataattttattgtaaatttaatatagtagggaagatgcaagggatattaggaatttcttcaagattcctagttggcatatgttgataatttgtgtatcattaactgttttaagttcaaagcccagcagtttaaacttgtgtacattgtggtggtttggcagtatttaaaatgagatatcaattagcatatttaacaaggtctggcatttagagtggagcagaaacttgagaaaataacatggaagcgactgcacatggatgaaatggagctgccaccatgcatggagaaggtggagaacctgattcagaagtcaccaaagagggttcagagttctgaacatcaagccagaaagaattattcctatgacttgaggcaatagagttttccttgatgacatctggacttgttgaaggccagtggctcctttgtttcgtgattttttttaaaaaaataaggacatccatgcctatcccaccataaaatgtcagaagcaaataatttatgttctagagtcaaagattcacatatggagagaaattttgcccaagatgaaatactcagagcttcattcatacctgatttagatgacttaggtaatacttgggacttattgatttgatgttatttagattaaattgtagacttagagttggtgctaaaatggattaaacttcagcctaaatgtccatgaataataaactggataaaggatacaccatggaatactatgcagccataaaaaagaatgagatcgtgtccttttctgggacatggatagaagtggaggtcattaactttagaaaagtaacacagaaacagaaaccaaatattgcatgttcttacttgtaagtgggagctaaatgatgagaacacatggacatatacaggggaaaaatacacagtgtggcttttcagagggtggagggtgggagaagggaaaggatcaggaaaaataactaatgactactaggcttaatacctgggtggtctgtacaagaaacccccatgacataatggtgatctgtacaagaaacccccatgaataagtttacaggtgtaacaaacctgcaaatttacccccgaacataaattgaaagtttaaaaaaagatttgaggattgttgggataaagtacatttatattgcttgtggaaagatcatgattttggggtagccacaatgtagacagtagtgggttgaatagtgtcctccaaaatctgtccatcaagagcctgtgattgttcatttcacagttttatgctgtgatggttagtactgagtgtcaacttgattggattgaaggatgcaaagtattgattctgggtctgtctgtgagggtgttggcaaaggagattaacatttgggtcagtgttctgggaaaagcagacccacccttaatctgggtggggaccatgtaatcagctgccagcatggccaggatacaaagcaggcagaaaaatgtaaaaaggcttgactgtcttagcctcccagcctacatctttctcacatgctggatgtttcctgccctcaaacatcagactccaggttcttcagctttgggactcagactgacttccttgctcctcagcttgcagacagcctattgtgggacattgtgatcttgtgagttgatactacttaataaactcccctttacatatatatgactaatacacgtctaccataaacccatgaatgtaaacttatttgaaaactgaatgtttgtagatgtaataaagttaagatgaggttatactgaaataagatcactcataagtccattgactgatgtctttataagattgggtgaagacatggagacatagatacagggagaaatggcatgtgcacatgggagcaacaattaaagtaacatgtgaaaaccaaggaacaccaaggtttgctggcacccaccagaagcaaggagagagtcatggaacagagtcttctctagacccttcagagggagcatggtccttctgaaaccttgtttttacacttgtacctaccagaactgtaagaaaacacatttccattgttttaaatcacccagtttctggtacatggttacaacagccttaggacactaacccagaaaatataggaaaagataaggcagacctacagtgataaatgagaatatttttgtttctttcttgccttttgttcacactatgaaattagagagacccaaggtattgtatgataaatgtgtagagttcagttgattaaatatagatatctctcctaaagatcctttcatataaataacaacatattataagttttaaaacttacatagaaataaaacttatgacaattatagaacaaaaatgggagagaagaaagagaagtatactcttgtaaagtccttatcttatgtgacatggtatactaatgacagtacactgtgtaactgtcatttatttgacataaatatcaaatatttgtagtatgttaaacaaaagggaaggtggaaagtctatgtgccattagataattttgtgtccagggctttctttttccatgcagaataccaggtttccaaacttcacagccgactatgagaagcttctgttatactttttttgttcaaatttgcctcaaccaattgagattattttgcaagtacaaactttaataattactaccaggattaatttgggtcttttgaaaagggaggacaattaagcaagaaaaatgctaagggttcaaacttatctcagtggagaagtaaagcagcttggtattggtaacgccgttgttaatataaagtagaaacctaggcaataccattcaggacataggcatgggcaaggacctcatgtctaaaacaccaaaagcaatggcaacaaaagccaaaattgacaaatgggatctaattaaactaaagagcttctgcacagcaaaagaacatcagagtgaacaggcaacctacagaatgggagaaaatttttgcaatctactcatctgacaaagggctaatatccagaatctacaaagaactcaaacaaatttacaagaaaaaaacaaacaaccccatcaaaaagtgggtgaaggatatgaacagacacttctcaaaataagacatttatgcagccaacagacacatgaaaaaatgctcatcatcactggccatcagagaaatgcaaatcaaaaccacagtgagataccatctcacaccagttagaatggctatcattataaagtcaggaaacaacaggtgctggagaggatgtggagaaataggaacacttttacactgttgctgggactgtaaactagttcaaccattgtggaagtcagtgtggtgattcctcaatgatctacaactagaaataccatttgactcagcaatcgcattactgggtatatacccaaatgattataaatcatgctgctataaagacacatgcacatgtatgtttattgcggcactattcacaatagaaaagacttggaaccaacccaaatgtccaacaacgatagactggattaagaaaatgtggcatcatggaatactatgcagccataaaaaaggatgagttcatgttctttgtagggacatggatgaagctggaaaccattattctcagcaaactatcacaaggacaaaaaataaaacactgcatgttctcactcataggtgggaattgaacaatgagaacacatggacacaggaaggggaacatcacacacgggggcctgttgtggggtggggggaggggggagggatagcatttggggatatacctaatgttaaatgacgagttactgggtgcagcacaccaacatggcacatgtatacatatgtaactaacctgcacattgtgcacatgtaccctaacagttaaaatataataataaaaaaaagaaattgtatttctctttcacttaccttcaattttttttttatatctgacagtctatttcaagatacaggtttctgttggggatcatactgtttctggaggaaaaatattaattaatttgttgtgaagtgatagtctgatgataatgaatcctttcggcctatttttcttttgaaagatattttcatttagacttttgtgttgacagtttttttaaatatcattacttttaaggtgtcactattgtcttctggtttacatagtttctgacaaaagtcaactgtttttattttagtttttattataatgttttcatattctctgtctgccttcaagattatctacggtttgcatcagttttactatttttatttagcactctgtctctcccccatcccccaccgcgtttgtgtgtgtgtatctgtatgtgtgtgtgtgttgtactcatcctgattgaggttctctgagctttgtggattggtgtatgttttttaccgtttttgtagaaatcttggcctttatcttttcaaaatttcttcttccttgttttctatttttgctctggaactccattcatatttatgattgactgttttatgtcttttcatagctcttcagtgttctgttcagttttccttttctctagtttttttcttatttttcgcttttattccaaaagaatttttcatctctgatattgttattttgtattgagtatactatttttagaacagttttgtattagttttagaacagtttaggggtttacagaaaaattgagagataccttatttcccctatacatattttctcctattatgaatgtctaatattagtgtggtacattaaccacaatgatgatccaatattgatacattattaagagttcatagattatattagggttctctctatgggttgtatagttgtttgggttttcacaattgcatgatgtcatgtatccaccattctagtatcatagaaaatagtttcactactctcaaaatcccatgtgctttaccactttcctcccctcccacatttattcctgatccttttacagtatttataatttgccctttttcataatgacataaagttagaatcatacattatgtactctttccagattggccttcttcacttagcaatatgcatttaatgtagctccagttcttttcatggtttgatagcttaatttttaaatcattgagtaaatttccattttactgatgtactggtttgtttatccatgcacctattataggatgtgttgggcttccagctttcaacaattatgaataaacctgctatgaacaattatatacacaattttatgtgatacacatttccaactcatttgggtaaatactagagaacattattgttggactgtatggtaaaattatgtagagctccataagaaagtgccaaactgtcttccaaaatggttgtgccattttgcatctccaccagaaataaatgagagttcctgttgcttcacattttcgccagcatttggtatcatttggtatcaaaaaaatatcattggtatttttttttcccagaaagggtctcactctcatcacccaggatggagttcagtggcacaatctcagttcactgcatgctcaacttcccaggctaaggtgatcttcccatctcagcctcccaagtagctgggactacaggcgcttgccaccatgcctgggtaatttttgcatttttagaagatggcgttttgtcatgttgaccaggctggtcttgaactcctggactcaagcaatccacctgccttgacttcccaaagtgctgggattacagctgtgagccatggtgcctggcctgcccatttttaaaggactttttttcttattctttcatttaagagttatttgtgtattttgaatataagtttcttaacatatgcacgtttcacaaacattttatctcattttgtgcttgtctttttagtccttcacaatctcaaacaacagaagctttaaacttataagtttccaacttatgtttttttttcttctctcatggatcaagctctagttgctatatttaaaaacttcatgccaaccctaggtaacttaggttaataaacactaagattaatatttctcctatgttaattttcagaagttttatatttttgtgttttacatttagatctataattctttatgagttaatctttagaaaatatgtaaagtttatatctagattaattattccttgtggatgtctagttattcctgcatcatttgcttaaaaaactattttattgagttgcctttgctctttgtaaatgatcagttgactatatttttatgggtctatttcttggttctctagtctgttccattgatttgtctatacttccaacaataccataataaagtatagtaagtaagcttagattgttggttttagatccttttatctaatacatgcactgaatgccatacatttccctataggtactgttttcactgaatcttacaattttttaaatccctctctccttttgcccaacctctggtaaccactatgagttcaacactttagattccatatgtaagtgaaataatgtggcatttgtctttctgtgcctggcctatttcgtttagttctccagtttcatccattttattgcaaacgacagaattctctttttaaaaaaaggttgaatagtattccattgtgtatgtacagcacattttctttatccattgatgaaattcattcatgaagacttaggttgagtccatattttgtctatcatgaataatgctgaaatgaaaatggagatgcagatatacttttaacatattgatttccattctttcggatatgtattcagaagtagatatgctggatcatatggcatttctatttttagtttttagaggaacctccataccattttccatatggatttactaagttacattcccaccagcaatttacatgagttcccttttttctccatgtccatgccaacattggttctctttcttttttgttttaaataaaagccattctaatgagagagaattaattgtggttttaatttgcatttccctagttattagtgatgttgagcattttttcatatacctatcgaccatttgcatgtcttcttttgaaaaatgtctgattttatttcccatttttaaattaggttgttttcttttgtttgagttgtttcagtttcttaaatattttggatattaactccttatcagatgtatgattcacaaatattttctcccattctttgggttgcctcttcactttattaattagttcctttgatatgcagaaatttttagtttgatgctatctcatttgtttatatttgcttttgttatctgtgctttcagagttatattaaaaaaattattggccaaaccaatgtaatggagattgttggctatgttttcttttagtaggtttacagtttcaggttttatattaattttcaaaatttgttttgagttaatttttgtatatggtatgagacagggatccaatatcattcgtgtgtctggatagccagtttttccagcatcactgattggggagactatcctttctctattgtgtagtcttggcacctgtgtaaaaaatcgcttaagcataaatatgtgggcttttttttgggttttctatcctgttccattggttgatgtgtctctctttttatgctagtaccatgctgtttttattataattgctttataatgtgctttgtaataagaaaacgtaatggtgtcagttttgttattgccacttaggatttttttcctattcagggtattttgtagttccatccaaatttaagataatttttttattttcatgaaaaacaacatgactaattggtatttatgctgtttcaagtatggttcaatgtacacaaacaataaatgcaggataccaattaaataaaattaagaaaaattatatgaaatcatctcaatagatgccaaaaaacctcatgttaaaattcaactgcccataatgatcaaaagaaaactttcaaaagattaagcataaagggaatgtacctcaacacagttaaggtcaaatataacaaacatatagctaacatcattctcaatgatgaaatgttgaaagctttttctctaagatcaaggataagcatgtccatcctcaccacttctttttaacattgtattggaagatgtagccagagcaattaggcaaaagaaagaaatgaaaagtattctaatagaaaatgaagaattgaactgtctctatttgctggcctggtaatctcatatatagaaaatgctaaagattccaccaaaaaactattagaactgataaatgcacttagcaaatttacaggatatactttcaacacaaaaaatcaataacatttctatatgctaataactacccaaaataatatttaaaaatatttatatctaatatatttatatttattaaatatattaatatatttatatttagttttataaatagatttatatttataagaatatttaaatattcttttggatagttactataaatcccatttacagtagcatcaataaaaatattacaacatgtatatttaaccaaggaggtaaaagacctgtatattgaaaactttaaaacactcatgaaggaattgaataaaacaaaaataatggaaatatatgccattttgatatggtttggctgagtctctacccaaatctcatcttgaattcctacatgttgtgggagggacctgatgggaagtaattgaatcatggggacaggtctttcctgtgttgctctcattatactgaataagtttcacaagatctgatcattttaaagaggagagtttccctgcacaacctctcttctcttgtctgctgccatgtgagatgtgcctttcactttcccctgtgattgtgaggcctccccagccacgtggaactgtaagtctgttaaaactctttcttttgtaatttgcccagtcttggttatgtctttatcagcagcatgaaaacagactaatacaaatgttattgatagaaataattaatattgtgaaaatgttcatgtgactcaaagccatctacagattcagtgcaagccctataaaaatttcagctttcttttgattagtcttagcatggtatatctttttatatctcttctatcattcacttttgaaaacattaatctctctcattgaaacaataactgccaaatttgtagcagttttctatttgtggcagtttttctttgtttcttacttttaaaaaacatattgtcccttttttctgtgtcttctggatccagtggtgcatcttatataactccatttgatctctctttgtgtatactatccttcctttttgaaaaatattgattgctctagagtttgcagtatgtatttacactaatccaagtgctatggaatccttgggctgtcactttgccagccagaaaactctgtggccagtggtgccattgcccaagtcttggtcagggccactgggcccacttggcatggcaggctgtgctcagctcatgctactggcctagatcccatgcctgccaaggttgagcagagtggcaagggttttgtcagcaagcgagtgtggggtcgggccactgcacacagccaggcacactggctgtggcagggctggaagctccaggcaccagcactggtgtcagctccctgtgtggttgtgactgggccagaagtactgcaagcagcttccatggctggtaccagggaatgcagtagcacctggaagttggatacaccaggacctgcagagccccaaagagggtgttgcagccctagcttggggagctcctaggtccgggctccctgaagggccacagctgttttctctttcttgttgcctgcaacatggtgagcaaggggtgtttttcagccctgtttgtgttacagctctttcagctctgccactcagtgggtcctgagttcttgtcccatgcccaggaagaaagaggtaggtagacaagtggaggatgagcaaggtgaagaagagctttattgagcaatagaacagctcagaggagaccaacagtggatagctcctcttagcaggcaggtcgtcccatcatgtcctggagtctgattgagttctgggtttccgcctgcctcagaggaaaggaagtgtgtgctgattggactatgggtggctatgggcaggcccagaaaaagcaccatgagttcctgctccggtctacagtactgacaacccagaccccaggcttcaggccttcctggcttaaaggtggggcttcactgggtacctgcccctttccacccaggaacttgtctgccttctgccactgttcatggtgtccaggctgttcatgcccaggggttctggcaggccagtgcggaactgcccttagcccctgcctcagattccctcccatgctcgttggtgcccaaagtccagagggggctgaggcggcaggggactggcatgtcagtgctcccctgagcatgcccacacacagctgggttgcaacagcacacgggcttggcctcaactcaactctgctcactggagggggcacaaggaacaggaagaagccaggcagcaggagcaggcacctctgagccagtgaggtcaggggtgcttcccagtcccgagagtgcagagatgcccgggtccacagccatggcttgggtggctgcaggtgtacctgggaaggtgtggctcctgactgctcccagcccccaagagctcagggatgcctgggttaacagccatggctggacagcctcagctgcagctgaggaaggcaaggcttccaccctgccatctcagaaaagggcagggcttccacctggtcctaactcctatcacaagtccacttttaaataaattttttcaaagggattttctgaaccttataatataacattcccacttcctccctctcatcacttattacattgctgtcattcatttcacttatccacaatgtacataatacatctttgctattattaacaattttaagactttgaacacttttaagaagatattttgttttaccttcatttactcctctaatgcttctttctttacatagattttggtttctgaccatgcttctttctttacgtagatttcaatttctgaccaatatcattttttcttctctccgaataattttttaacattgtttgcaaaatagtttactggtgacaaattatctgctttattatttaaagaaagtctttatttctctttaatttttgaaagataattttgctagacagtgacttctaggctggtgatatttttctctcaacactttaaatatttcatctcactctctttctacttctctgatttcgcatgtgaagtcaggtgcaatgcctattcttgttttcctataggtgaggtggtctttcatttccccctctgggtctttttaagagtttatctatgtttttctgtaatgaattctgcttctgttcagctgcaattctctgaattcattggtttctctagttttgtgtatgaaggtttgtcttgtcacctcaattatctggtggacttcagttgtttttcagctattcattttgttgttgtttcaatgattatgggagtgatgacctcagctttttgtgtaagagcagaaaacaatttttgatattgctcaatatttctaaattttccatttgactctttcttattcctacatttctgctataattgttcatcttttcactcatattatcttttgtttccccaaggtcttttaatatattaattatagttattcttaacttcctattaaatagttccaacatatggagtaatcattcagtcttgttctgtggattactcctcctctgtgcaatggctgaggtttttaaaaattattattatttttttgcaacttctatttttactgaatgccaggcattcgtatgtaatggcacagactgaggtgaatactcttcataactgaataagaaaatatattattcaattttctgctaatttacattgtttctgataagaaatcaaagttaattctaagtgtttatatgtatatattcaaatataatttggctacttttaagatagtttccttatcattgatttccatgagacttcgtgatacgttctctgtatttattccatttaaagttgtgttgggattttggaattctggatatgttgttttcagcaaatttagaaaaaggattggccaatagtttttaaagtacttcttctgctctaatattttaatcctctcaaatgttaattccattattcttttattagctcatgtaatattgtcccataggttactgggtctatacatatttttaactttttcttctctgtctgctttaatttgaaatttgactattcaaattcccacatattttcttcgccatgcattgtactattactttcatccattttagttttagaaagcatattatattttcattatcaagaaattcttctgagttctttccctttctctgttgagacttttacctatttattcattattcccactagtttctttacatttttaaacatttttgcaatatctgttttaagtagcacatggcaattcaaatgtctatattctctgaatctgtttctattatctgttttacttcccagatatagatcacactttttttcttcacatactttttaaaaaaatttatgctgaatagtaaagatatcacagtatataaggtttgcatattttattcctttaaaaatcgttcagtttgagctggtgggctgttaattgctagtggcctgacttgttgcttatcaagcctcctttgggtgcacttagaatagctctcattatatagcaatagtagctttatttttaagtcatgatcatctttcaactctggctggtcagatattcatctttcaacactctgtggactctaaacctgccatttatctcatagttttccaggaattttctgaaaacccttatagaatgttgtctatgaaagtgcaggtttgcattcaaccaaaaatctagggctcgtgcatattttaaattattatttttttcctgagaagctgcctcctttctaataccttccctgtaagtccaactttccaaaatttccaaatcaaccctgcaatctgatctctattatctgtatggattctaattccctatgctacattttggaaactagcttagaaagcaaattggtttcaatgtgacagtcatctcatgtgtttctcttgtgtcacacatcagtttgtaggtccattgaaaagcctttaaaatatattttatccaggttttatttgtatacagcagaagagtaagtccaatgactgattatcaattggatccaaaagtctggttactaatcataagtcatacatagatctattaaatgggattttgctaaatggaaggatatgtttttgtgacctcatccactgtcccccttggtactggctaaattatatttttagatttatattaaaagagagtttcataggccaaatcagagctaagttggcacaagtgctattgagaaggcaaaaataattttgagaaatacagaggtgctataccttctttttttttttttttttttttgacagaatcttgctctgtcaccaggctggagtgcagtggtgcaatctcggctcactgcaacctccaactccctggttcaagtgattctcctgcctcagcctcctgagtagctgggattacaggcacacgccaccatgcccagctaatttttgtatttttagtagagatggggattcaccatgttggctacgatagtctcgatctcctgaccctgtgatccacctgccgcggcctttcaaagtgctgggattacaagcgtgagccactgtgtctggcccagaagtgctatgactaatggactcatctgagattgagaattttaagttgacttagaaaggttaataatggggcaggcgcagtggctcacgtctgtaatcccagcactttgggaggctgaggcagttggatcacctgaggtcaggagtttgagaccagcctggccaacatggtgaaaccccgtctctactaaaaatacaaaaattagctaggcacagtggtgggcatctgtaatcccagctattcaggaggctgaggcgaattgcttgcacctgagaggcagaggttgcagtgagcctagatagcgccattgcactccagcctgggcaacaagaaggaaatcctgtctcaaaaaaagaaattaataatgttatttgcagatatcaagattctctatagacccaacttttctgtcttaggatattggttgctttataacaatctatatatttattcaaaagccaattatctagggatatttctgggctgtgaacaaaaatatctttctactttcaagtaactcaaataaataccaaggtgtggaaataaaaaattgcatatatatacacacataaagtctaagaaatttgagattatggtaagtactgttaagaaaataaaagagatcatataatagatattaaatcagtttataaagaggaaggactataggaggtgatttctaagaaggcaatatatgagctgatgtctaaagaagccaagtatgtgaacgccattagaaatgcaccccaggcatagaggagaaaaaacgaagtgttttctaaagagtgagtgatttttagatatgttacaggaaacaaacaaaataaagtttaatataggtgtgcattggaatgcatatattgaaaaagttgtcagtgtccaagtcttataagccttttcagtcatgttaagaaattaacttttattttaagcacagcaggaaaatcactgaagggtttataggggtaaagttatttattaaatgtatatttaaaattatgttcatttttttctgctatctggaaaagggaaggtaagaatgtagaaacacagatatctgttgggaatctagattttaggactcaatgaaggataatgataccctagactgatgtagctgcaataaagggaagaagtaaactaattaagattatttcattgtgtaaactaatagaactttgtgatggattggatgtgggaatgaagtagagatcagaatcacatatggttccaagatttatggtgtggtatttatggaagcttttactgaagtggaacagaaatcagaaattttaaaaaattaattacagacagtttggagattctttaaattgaaagtgttaagtaaaagattatgatttattaccagaaactacttcttgtctattttttgattctcataatcttatttttattaccatattacatttagcaatctgcttaaactgtatcatccattctttgcatgttcatgaaaatacatgcaatctgtctggagagatgataaaagttaaatctttatcatgattatttggaatttactgatactggatttctttcactttaaagaaaattgcctctttctattttagggaaatatttaatacagtcctactacagttgattaattgcatcctataggcaacaacaaatttgaatgtctctcttagaccttgagatctgtttcaatcaccaaaattatttggttgtcattttataaagtagagatataagaatgaatagcttctcaggttttttctttaaatttgccaatataggtcacgcttccctatggtttattatttattcaacagcctttaaaatatttaaagcaatagaatttttctgcctgtattgaaggaacattaaatgtgctcaaaaggcctctagttagatataatttttatgattcccaaactgttttttattttttagttatcattcctgctattagagttctaccattgaattgttattagataatatttgtagttctactttatattaataaaatatatttttgtccaaatatatctttaaagatgaaatttgtgatttttttcaatgacaagttctgctatgaaacaaatactttaaagttgctccactgtcctgagaatattaattttccaatttcaataaaaagagcagatggttaacattaagagtgatgaaacaggagatttaaatggttttacaataaaaaatgaaaacaaactcagttcatcattagttaaaagttacacaattgatctatcaccttcatattccaaaaatgtatacatatgcctggtaagaaggtaaatttattttctgggtgtggaatacagaagaacttttaaagggagaaaatattttagaaaggagaactcactatgcataaataaatttagaacatagctatcattcaataaatgttaattaaatccagatatttaatttgaggcataaaaatatcaaaaagaccatgtgtcttattttatttccagctttagatgaccgatttcctacaaacttattaaaagtttatagagaatttgttcatttgtttttattttagttttctacagatgaattatgtttcagaaaatgccaaacctgaatttcagtctcaaatcctctaccatctttttcacctaatacaacttatttaaatttgtcctgtcttctcaagtgtaaggtggaaatatgcttaattcagaatgttgagatatcaaatgacaaatgccttcaaattggtccacagtaggaactcacaaacattctatctttttcctattgcttttcttgactaacctatcaggcaggtgatcctatgacacatagagcaaaaatctgtccatgtcctcaaaaaccattatcaatattccattgtcaatgaaatctgagttctctatagatgcttatcttcttagcctgtttatcttatctttgatggcaggagttatgttctagatgttacttgtattattatagtatgtggtccaatattcatttactaaaccaagctgtttttatctctgaattttctgtaatattgataaaaacttcctttgcttgaacttccagaaaattccaagtctatgttagaaagccatacaaaattaaattctacttttgaaaataagccttcagactaagtgaattgtaattatttgtgtatatttcctggtcttttatcttcaatcaacacttgttataaaatgaactttcattagacaactgacattagacaagcttcactaaaagtatcattaattttgattttatttcttaaataaaaagcctgtggataattaaaacccttgtatatcatttagaagaagctctaataccatggattgttcgaatactcataaaatatataaagaaaagatggcatatttcaaaatcttgaaaacattgtctttattaattcatttacatatcattttaatcttatttaaattatatttttattttaaaaaatcacttcaagtcttctgatgttagtatttgtttgtttatttttaaatacttattgaaccctttgaatgtgacaagtgtggtttataatcctggaaattcacttgtgaataaacacaaatatttctgtactcatgtagaattggatatttttttctcattttcatagtgacaattttttctaacttattaaaacataaatgcatgttacaaaatattaatggagaaagcatgtaaaatgccactaaatgtaaattttctgttacagcttcgttatacctaaatacaaagccaatgtttccaatgattatgtaatcttatataactccatcatattcaattaactatgaattataccctaatctatgacttatgtggctagactattacgcaaaacatttaggtattattcttagaattaataaatttttgtattggttacttgataaaattcttgctgtatcaactaagtgggttggattgattatacataataaaccagagaaggtctccatatggaaggaggatattcagaaaagttcaaagatgggggagaatactattttctaggaagattaaacattttgtcatttcattacaggaacatatttttctgaaggtgttgattaaattatacaaacaggccatcaggttaaaaagaattacaatttgagtactacctttggaatttttctatcattctttacatgattactacaaacggacttgcacgagactttttaagctcagtgttctttcccttttgattttccccagtaaataataatatttcactgtctaaagacttccgactaaatatacttaattgaataagtaagagccttttaatcctttaaactgtaatttattaattaggtaatatgctagaaattgagttttcttagatctcagttgtgacttctcagttatcattttatcataccttacacttcattttatattttatatgaaaggattctcttatctacttatcactcagatacatcaagggagtggctctatgtcttgtgagcttaacagaaataactaccatgttccataaacatgaacatttgttcagactattataatccatgctcagttgtttttatttattctgaattaactaaaaatacaagttcctcaatctcatctaattcttttttgttttcaacaaacatgttttcagcatctcttttatatctggaccaggggatacagggaaagtccctgccctcatggaactttgttctcaagggaagaactaacaatcaaaataataaatgagataattacaaactaaggtaatgaatgagaagaaaatttaaaaaaaagatgacatagtgaagtaatttggggttatttcatcataaagagttcccttttaagagaaaaaaaatcttagttgagacctgaatagaaggaaatggccatgtgcacatctgaggaaaggatatttctgtagaagaaacatgatgaacaaaatctccaaaggaaaatagtgtagcatgtttgagaaataagcagcagctcgtgaacttgcatgattaaagagataatgttttgatataatgttgagagacaagccagagataaagcagattataaaagatcttgagaattaggttaagttttgactttattctaacaaaaatgagagggcattcaattattttaagtggggagttataagatctttttttttcttttttatgtaagacaagtctgtaaagaatttattggagaaaggtaagactagaagtaaggaggttgactgagaatatcactgcagtcatacaaaaaagagatggctattatttcaactgaagtgattaacagtggagaaaaaaaagacatctaagatggtcttttaagttagaactgaaaggatcaggcactaaatacgagggtgagagtaagaaaacaatcaatcatagtttccatgttgttttcttagatcaccggatggataatggtttctttacacaagatgagtaggaacatataacactgaaattccacttttaggtatataccaaagagaattgaaagcctgcatacaccccaaatcttacacataaatattcataaaagtgctattcataacagctgaaaatgtgcatattagaaagtgattgtgaatactcaaaagtcacaggcttagaaattacttgagaagaagtttacaacttagggtgatccttgatacagagtcagcttacaacaattaaaaaactaaaaataaacaaaaacaattacccccctcctcccccctccaaaaaaaaaaaaacaaaaagctgggaagtgggagaatctgatttgcagatttacaacattataagatcaaaatatccacttttcaacaaacatcacaaggcatagtgaaagaaggaaacaggaaaagatggcccattgaaatggaaacaaaaaacataaccaacagaaccttcctgaataatacctcgtggcagatctaccagacaacaattttaaaataattttcttaaagatgcttaagaagtaatagaggatgtggagaatgtaaagaaactatatgaacaaattggaaatatgagtaaagagatagcctaaataggaactaagagaaattctggagctgtaaactacaataacagaaatatgaaattcactggagggacttaaaggcatatttgagcagaccgaaggaaaaaaatagtgaatgtaaagataagacaatagaatttatgaattcagagaaacagaaataaataaagtttgaagaaaagtgaccaaagcctaagggacttgtgggataccatcaagtggaccaacatacacactgtggaagtctcagaagaagatgaaaaggaagggacacagagaatgcttgaagaaataatggcttaaattatcttacattcaactgagtaaagtcaaaaatatgaacatccaagaagctggcttatttcgctcaaaattaagtttctacgatttttctgctgttgtgtgaattacaattattgtgattatacaattatatagacatctaataaatatcttttacataatattatttgcataacatgccatttgcataatattcaatgttcccattaagaccctaatggatattttaaggaacaggccatcattaaactttttttctgctaggttttctcacagttgcttctcaaaaaaaaaaaaaaatcttgttttggtcacagagtggaaagtacctgtagatctacttaatatcccttttgaaaagattaggagggcattgtggtattggagttaaatgtctctaactgactacaggtaacacatgttttcttttaggcctgaaattaatgctatgtttatataacttcctaaatgaaatacaatacttttgggataaaaataaaagtcatctcttgctcttagagaggacaacagagtaaaagaaatgttctgagctgataaataaaggtaggtaactatgtctgctctcttggagtcaaaattttctctaaaggtcaacaccatactaaacacaatgctaaaaacacaattactaaaatgctagtcagctcctcccaaactctgtacaaattttgcagatgcagctttgatttgttttattcctcttgagagaaggtaggtttcaccagagtatttttgtaaatagtaattttccttagaaaattaaatctcagatgtttaaaggttaacagggtctttctgttatggctctaaaggataagccaaccaaggattgacaacaaagaatttgaaaaagaaggcaaccattcatttgccaatgaaaagagcagaaggctgagaggtgattataaaagtctttatccagaaatagataactctggacaaaagtagcaaatgaagggagtggatatattaaagatggagaatcttgtttctactgtcctctgaagttatggtggtagcaaattcaaatttatatagtagccaggtaaatagcctaaataagtacagttgacaactcatatgaaagggagagtgtatgtcccatctcaaggaggtaatgactcctcatagccagcctgttgttaccaaagtgaaatgtatgcccaatgtttacaggtcttctacattgtaataagaagcaaaaattaagggtatcatgtaatgatctaacttataaatattatctcacctttataaattatcttgcccaacaaaacagatccagactatattcaacctgtgggccacatttagcaagctgcctaataattaattaaatgttgaaaaccaatggtgcagtaagtcaaaactcctatcttctgatgatagaaaatctggctggctggcgatttcttgctgaggacataggatccagcccaaagtttctgaccacaacacatggaagtggaagtcaagatgcagaagaaggagaccatctcttatagcccctctgcttccagggagtggtagttgactcccctgtgtttagagatgagaaaatgtaaatcaatatctcacctttccttaatcctcacccactttaaagcctcagttgaaatctagagttccagcatcatcaaaattatgatagtgagagtaaacacaggaaagctagattatcttagagtctcaaaggaacataaacagcatgagtcaggaagtctaacatgttctttgcaattcccccagtacctagacaagttggcatgttgtaggagctccataaatggaccaggaagtataacaggaacttcaggagtgcagtcacacttagtaaagtgtgacttgatcaatatgctcacatgattaaatttgtttcagccagataacagtgggaactgttatgaaaaagactaagagatgaaatgctaaagagactaaaacaaggtaagatctgtaaggaaataacaaggaactaaaatagagcattgtattagactgtttttacactgctgataaagacacatctgagaatgaatgggcaatttacaaaggtaagaggtttataggacttactgttccacatggctggggaggcattacaattatggcagaaggtgaaaggcacatctcacatggatggcagcaagcaaagagcttgtgcagggaaactcccatttttaaaaccatcagatcttgtgagacttattcactatcatgagaactgcacgggaaagacccatccccatgattcaattacttctcaccgggtccctcccacaacatatgggaattcaagaagagatttgggaggggacacagccaaatcatatcaagcagtgaaattaattttccactacaacaccagaggaaagaatcctttcaaacatgggagacacttttatgtgaaatccaaagagttgatcccatagaaacagagagttaaaaggcagttgccagaggctggaggaaggagcaaggtggagaaagggatgatattgatcaaagggtacaaatttttaattagaatagaggaatatgttgtagtgacttatcacattttatgggtgccatagttaataataatgtattgcatatatcaaaattgcttaaaaatagatttttaacattctcattacaaaaaaaattatcagttagtggggagatggatatgttcattagcttgactgaatctttcaacaatgtttacataaataaaaaaacatcatattgtgcctcataaatatatacaattactatgtgtcaattaaaaataaataaatacataaattttacaaatgaaaaaataaatgtggcacatttttttctttttgcattagaaatattagggccaagatttcaaattgcaaatgtcttcaaagctctttgctttctaatggattatatttctatttattttccccattaaaagccacaattaaatggcctggtagtacttcaaaactttgatttttaagtgtctttaagatttctttaaatttgaccagtttgtatgaaaccacagcacatttcagctgaataatgacagtgcagaaaggcactttgttacagataaaaatcattgactttcggagatgccatcaatagtcatttagactagaatatttcagtctcaaaagtaaagatattttctcctttataggcagcacattgcattttacatggttgttaagatttatagattcattgtctagcttccataggtgaagtaatttcagactcacataaccaaaagaggtagaatttcattgtatcgaattctcttttcttccctttctactcaattagtgaaaaatctgtttttcaaattgtaatgtctcagatactgacagtaaggatttccatactttaaaaagtatgcagtatgctccatacctgggctttgggcaccttcactggattccttcctgttttgatttttaaactcattattttagtttggattctgctgaaatcagaacttaagatgggggcttgtgtgcagtaatgcatttggtagatgattttaggaagtaaaattgaggagctcgggacatgaaatcagagaataacgaagtcagtagaagaaatcttattatggttactatttgggcaatgactaaataattacataatgacctttagaaagttaataacatataatcaggattatccataagtaaagctggtgattagaatatttataaattaccttccatccctagttgtttgaagggtgtcttaggagcactgacttcttgtattttgagcctgaacgtgcctgtatgctaaggtagttcacatcgtgtatgaaaagatcctcaaagggagcaaagacttgatataaggaactgccatgatgaggcgagctgagatcactcagtacagctcattccaaatgcagtactgctcattccaaatgcaactgaaatcagaggctgaccaagaaagaggatgtagcctggagcaccagagtcatttgctatgtttactgcaggaagtatcaaggcctgctttctagaaatatacctgtaggtctgcctccctccatgtactctctgatcttccccattcaattgaccccaatcttccaagaagccagttgtgtatattttgcttggaatgtgctttgtacactcaattcttacctcaatttgcaccaatttgtgtgtgtgtgtgtgctgaggaagttggagaattaaaatgttcatgctttgggacataggtattaggtgtgctcttcataataactttgccagaaagccctgcactttgggaattattgagcttttgtgattacatatggcaatgtaatcttgtattttgagttctcacttatggttagaacttcagttgggtgctccgggctatatcttcttccttgtccagcctctgatatcagttgcatttgaaatgagcagttctgagtggtctcaactcacctcataatgaaagttccctatgtaaagtgctcgctgagtctttgctccctcttgagggtctttttctatacataggagccatccatgtatagaaagaaactatgaacaactgaagaagaagaaacactgaacaactaggaataacaaccacatcagagcctaacacattaaatcatccaataactataatttttggtaccactggtctttaattaggtcattctaattaaaatgttcttacataatttgttctgtaatgttaaaagtgtattttaatgttctatctattatatataatttatctgaggccaattactctaaaatatgtgatgccctagaaaactaaatataggtggataatgacctataaatatatgataattgatgtgtttttaatagacattacttaatctcaaatcattatcttattttgtagagtataaaaattaactgcttcaagattattttatattatataaagaatcaccaatgataaagttacttgtcttaatttgctattggtttcaatttagaaagatttattatgagttagtgaataatataaaaagtctaaattttgtgttttacttcacctctagatttactataaagaacaattttactttgtaatattacatcaaattatatcctatctgaatttaaaattaatgttatatactcacatatattgtattttaatttagaatgaacctgattcacagggttgtaaaaaattatctagattgtttgccacagtttcaaaaagtcagcattttaaaagtcagaattttatttcttattggttactaattttttaaatgttttttattggcagcatgagaagaaaattaaaagagaaaacactttatgaaaaactataatcactaagcagttacatgtgttaacattcaaaaagtttaaattgtatacaattaaaaaattaacttacttgaagtgaaatatgattttattttaaaaatttttgtgtgcctttaatgtcctaggcactcttgtaggtactgcaataaaataatgaacaaaagagagaaattcctgtgttcaaggagatttaattcaagtagtaagagagaaaataaacagttaagtgacagacttattaggaagtgctaattgctaggaagggaataaaaggtaattgaatagagtgacatagtgttatttttatataatgtaggtaggcttgtaagagaaacttctatacaaagcctgataaaataatacagaaaagcatgctatcagagggaagtgatacacacccagatagaatagcagaggccaacactgtggaattgagggagaaattagattagagaggtagctaggggccatattatacaggatttagcagaccaatgtaaggagtatgtgctttgttcaagtattttgggaagctacggaagattttgaacatgggagtgaagtgatatgctttaattttaaaatgatcactctgggtgctagatagtgaatatattttaacatcagaagagggaagatggagacaaattaagatgtcatatttcaggcaagagatgatgggggcttagactaggatcattgcaatataggttgtgaaagtggttgaattaaaatgtattttgaagatgcagccaatgggatttgctgatggactgcatggagatgtgtgagcaaagagttaagaataactccacagttttggcctgagaaactgggtaataatgatgccatccactgaggtggacaacactaggcagaacacagttggaataaatcctcagtactaatcagtctgaggtattatatggatacctgaatgaacatgttagtagttatttgggtatatgagttgagagttcaggggagacacaaagattcatagaacatatttgggaattattagtatatttatggtattttttaaatggttgaaattcctcaatcagtgaacatatctaaaaatagaaataatgatgatctaaacaattatgcgatccactaatagtaagagaaaacaatgatgaaattgataattgcggaaacatggagtgcaagtttacaaggtattttacataaacaaaataggtaaaatgctactgataatatgaccacaatgtggaaagaaaatggcaatggagaataattagtgacctccaacaagaagaataccattttaatcttgggattaaagcatgattggaagtgggattgaaagagaataggtagtgaggaaatggatattcaatagacagcaggtttcaaaattcttttttttaaacaaatcgagtagtagtttaacactttttacacattgtagaaagattcaaaaacaaaatgaggaaaaggtaaatatttattcatatgctgatagcaagtgatatagtatggagagaataatttatgctggagaaaataaatgcaggataaactttccttaacaataaatgaggctgggtgcagtggctcatgcctgtaatcccagcactttgataggctgaggcaggcagatgacttgaggtcaggagttcaagaacagccttgccaacatggtgaaaccccatctttactaaaaatacaaaaattagctgggtgtggtggcgagcacccgtaatcccagctacttgggaggctgaggcaggagaattgcttgaggtggaggttgcagtgagcagagattgcaccactgcactccagcctaggcgacaacagcgagactccatcggaaaaaagaaaatatgataataataatggagagaatccatacagcagtagggcagtagggttgacaatagacaggaatgtggaaaaacagaaaatgtagtctatgaatgcagatgcgtatagtttggtagttgttagtgcgaagataaagaagctttcttctgatggcttttattttctcagggatataagaaacaaagacaattgaaacttcaatagagaaaggattgataatggtgtaaaaagataaagctagaatagtaggctaggatactcggaaattcaattgattcagaagaagcaggattgtcaggcagcaccaagggctttcttgagatttgtggtcaagaaatcaaggtaagaacattcattctcattctctctctctctctctccctccccccactcataatttttctctgtgtgtgtttgcgtgtgtgtgtttctttaagcacatgcattttttttctgacaagtaagagtgattttaataatgagtcctataatgtaggctgggaacatgggaaataaggatttttttttttaacaagagtcaaaattggcagcctgaaaatagcattaatgagcaattcttggaagacttgtattttcctactcacctcttcagctaatgtcatgccagcctcttggtcattgctctgtgcttctttcctgctgcaacttctatcctcctggtgtttattttgccctgtgctagaaactgcattgatattttactctctgaagttccattaacacgcatttttgtttgcattatagaatttcactaagggtttgaagaaataatttagagcacggtagaaaaaataagttgaattttatgtgttgcccttttagcaatttgttggcttttttgaacagaactatctaactggcccttaggttctggctcaccaaatcttgtcaaatctattttctcactgtgtatgtcctcacctctatctccacctatcatttcctatgaaggggaaaagacccaccaataatgacatttcagctttctaaaatacaatagctggctttgatgctcactcacaaatagtatcaaaatcaccagtcaggcattcccattcattcagatttttcagttagcattttgatggttctctcttagacattaaccgatattcaaggattttctcatattaaagggatatctctaaataaatagatacataaacaagaaaatagcacatacacgcagaaaaaagaaattctgaaacactgaggcaaggcaggaaaaaaacatacaaaaagcttcataaatattattttagagaaaatataagatattttgtttgtgaacattgcagaatgcgctaaaaatattaggtaagatagacagttttggggaactgaaatgaaagctaaatattaacaatgtaatagaggcactggaaaagaagatgtaagtaaatcctcaaatgagcaaaaaataaaattagagaggaatattgatatatttacaatattattgacaatgacttctgactaataacatttttgatataactatgtggggaggaaagagtaagaaaacatatttggttagggggatagggataagctaagttttaattatccatagaaacaattagatatgtgaaacacagaagagaaaagttcaagaaatggtagtataattgtgccatttagaaatatagaggtaaatatcagaagtattaagagtgttgaaagaagttgcttctggaagcaggtctgctgtgttttatattattctcccacctcctcactcctgctttatacaggcaaatcataccttttccagagctgtcgctggtataacacctctttcttcctagtgtcattatagaattagttacctgattctgtaactgttaagcatagtcattgctaaacacagggccctcattacacacaggcggaaaaagcaaagcattttgaggaatctgtgaatttgtaagtcctttaaaatcagattagtctttgtacattgtatattttttcctaatacctcaagactgcaagactgctaactatagctaaaattctgaggtgcttcccctatttaatttatgatatgatggtgcttttttatataattgtatatacatgctatgaagattctaatgtcccatagacatatcaaagcttcttttttgctttactctcttcttctaattattcaattacataaaaatgtaaatatcagttagtaaggaactatttcatctttatatgtaattaagtgtaattttggttcttgatctctctctacctctccctctctatacacatttgtatatctgtgtttgtaccaatatattataggcatcttgaacccaaacctaatcaactttttccgtagctttcccttaatgttccatttaaattcacttccccaactccttaccttcatcctggtccccataatcatttgtttttaatttctttttagaatttttcctgtggaaagttaataccatataaggcaattaagctattatatctcatatatatctatatatacatatttatatatatttatttataggtttgtgtttatattttacacacatacttatgtataagagattttatatatatatatacacacacacatatatttctatacacacgctctagtatgtatattatactggccttattttatatattatgtgtgtgtataatatataaaataaatgtgaataaattttttttttgatcatagctttctgtcagaactttgagagttaaatcctccaacccttctaggaagtagtattgccattctctgacacacctggcctgaattgatgcctgaatcaattcagaatttactacatctattgagacactttgtccatcctgattactgcataacaagttcacctcatgtctcatgctagtgcattaatccaggtgcaaaaactaccccctaacaattgtatgtgagctgggtttttgtacccttatcatcatttttttgacattaaaaagaaagctcatttctttcaatatgagaagcctaaaatagagttaactgaaagtcatacacatgagaacaagttattgattgtagtggcaggagactaagtgccgaatgatgttgtataacagattcactgtgccaagtctaaatgtctggaatatcatctgtgggaaaattcaacttcttattttagccactgtattttaatattttagcatttttttgttagcaaaggtaatcttatctggatgaatatattcagttatacatttttttcatatctttggaaatatctccgattactttacatatttagttggattttgttcaatatctctctttaccgtaacataagctcctttagggtagggaaccttctctgttatgttcaccagactttactgagagttttcaacaaggcttgggatgtaagaggcacgtacacatttgtgacattagcaaatagaaaatgcaattgcattctgcgtccattcatggttataactcaataaaataagatattggctattaaaatttgcatctggatagtaaatctagaatataaatcttcaatgtaaactctgtaagttttattccttctttgcaattgttcctcttgccatttaagctgatttaagggcttacttaaataaacattgttttaagaaaagccaaggacagtctataaaataagttaattaaaagtactattaatgtttgtaattcaatgatataaacatcatttttcaaagtgcaatttcaatgtgtaagatccagcttttgataaaagagaaatggatttgcgagttctaagtgataaaggcaattttataatgaggttttggatttcaaatgaggatgagacagcttggacatagtaagcaaagcccatggaagagaacatggacatcaagagtctataccagtacacagtacccaaataccagggacaatgtctttctccattgcgtccagattaaacagagcaaaagagtgacggatctctgaataaaaaagatattcaactccaaaactgatataactgaattttgtcttgaaaaagtcacacatcgacttggcacattgacattttcttctgttagatgaaattttacccatacattatatggaattcattatgacacaaataacatatatgtttgcacatttgagttgtgaaagtgaattttaaatcttgtcacataagggaaaagtggttgagcacaattcagttgcctgtttaatgtagctcctgcctacattaacagaaaaaggaaatggtaaatgctatgttaataatgttgctgtcgttgacaaaaaaaaatgattactattaatctaaagctaaatataatcaaataccaaatattttcctaaatgtttatatctatagacttatagttatcaatcaaacaaaaaataaacactaaaccctttgtgtttaaattattacagatgcataatgtgtaattagaaatttgaagttgcttttacatcttttatttcccattcaattaattatctttatattctattttaatatatcttgttaaactaggaactcagctgacatattgtaccagagtagactaaactttgatggagagaagagataaaatggtgagcaagtagatttggggagtctcctcagacgaactgataattaaatcagaatttcacaaaactataagttcagtggataaaatgggtgatatagaagaaaataacagaagccaagagtctaagaaaagattcctatagaaagttgcatctgagttatggtatgaggatcagtacttgcaataggataaatggggtattttaggcagcagaaacaatataataataatatctttacaataaccaaaaatgtacaattgatcaattgtccatattttcccaaactatgcttctttatacatgtactcaaggcagattgttttacttcttatgtagattgggcatttggcaaaaaatgtattcagaagacagcttagttatctcaagcagaaaatattataactgaatatagtcatacgtttgcatgtgtatatgaaacatatccaagaaaaaatgtgcatcgctttgaagcaaacataattatattttattattctgaactattgaattgtatatgttttctacatggcattattatcaaagttattatttctgagataggacttaggcattttaaaaatatttatacttttctagtagatatataaatattaatatagatataaacacaaatgtagacatgactacatgtaatcacatttaaagtccttaagcacaagttcataaacttttatctacagattaataatatataatcgtgtctagttaagaggagacttcttgctaaatgagtgaatattttagaaagcaatataaatttatttatattcatctttcctatatttaaatcactaataattaaaactcaaattcgtaagccaatattctttaggaaagacaaagttagacaacactgcaaatctactgataaactgatttatatcttttgcaagataaaatgcaagcctttgatcatatgccatcacttgtgtacttcctgttcattaaattcagtcaactcactaccactacgtgtgtaaatttggactctgtgatagtgtttaattaaaaatactctagataaattaattatagaatggctttaaatagtcaactttgtaaatgtttattatcttcttccaattctagataccacaagtcttcataagaataagaaccatgtcagccttgatcatcacaaaacctcaacagctaatagaatacaaatcataaaatgaagaagtatcgagttaatcactgatagcctgtgtacatattatttaatgtgttcttcaaagaatgctctgatttagataattaagaatcataaactttcctggtcagagtcttgaaaaatttatatccttaataacttggttaaatgtattcataggtgtaggcaaagctaaatttttctgaataatatatttggttaccaaattttaacacatttaatattgtatttaatgttattttaactttcctctctatcactaataccattacattcaaattttgtttttttctgatggagcaaagctagagtagaaataaaactggaattagagagggatgtgtattttggttccggctctgtcactaccagatgtatgatcttgaaaaatatacaaaagtataacatccttgtgttttaaagtttaagattctttaagtaaaaccttgcagtgtcatgactctcttgaaatggaacaacctaaaaatgaatagatttgaacatctcacaaaacagtaatgctttaggagccttgaaaaaaagatttccagagaaggctaagaaaaataaatgctattaagtgtctgagaataagaaaaagctttatctgtccatgtatgaaagagaaggtcaatttgaatgtcaaaagagtatgtacagaaaaacaaatacatgtaactttcttgagggggaaaacttctttttgaatgtccagtcatgtatctttcttggtttgaaaccaaactgtaacacatatttcataatattttttctatattcaactgtaaattctgaaagtggtacacttttaatttcttatcttccactgaacctaaaaatggacatgtgagcagttttgctcagtgacatattagcaggttttgattgttattctaaaaaggttctccttatagaaagactcaatacagttagcaccactcttttcctttgactcaagtgtagaaataatgacttaagtcattgcagtagcaattctgaatgcatgaacctataatcatgaattaaaaactaagaaaaccattaccccatcctggtactgtcaagtcactggaccaacaaccattagctgtctacctacagaattcttattatgtaagaaaaaatgaaccctatctattaaggataacaattaattgagttttcttttacttgtagctgtaccaatatgcaaacatatattaaaacatcttaaatcatgtgccactggtaacatcttagataatatcattttaaaacaatgctaagtaccatattttgaaatgaaattaaagaggttatcaaaagaaaaataaagaacatgttaatctttcaaatgttgatacatttaaaatatcagagcaaggtgttataacaaataattttacaaaatgtgtttcttagtcatgttgagctcagtgtgttgtttcttattttaatacttctagcagcagtaacaacaacaaggtgaatggcattgctgagtggatatatatggttctacattgatagctcaataattttgaagataatgggcaatgtgaaacttagaaagtaaactgttttatagttgaaatttaatgtttcttgtatattatatgtaatgaactttgcagaaaatgatactttttgggaaatattaacttaatctgatagtttttgtgtatatgagatttgttaccaagattacctctgaagccatcaagatttctcaggaaagacaccttcatatttctttttaaggtcacgtaactttctctcaccttttgattacttattctctggaaatacttctagttcctttccatttttgcttgccaatataatttccatgtgtctagtattattttatccctgctggcagagaacctaatattagatgtatttaactactcatccctcaggatagaaatccatatgattttagtgctgcacaaatcagatgttaataaactgagatttgagatgtaaatacattattgtaatctctgtgggaattgtctgaaaaaatacatatgaaacaaaataacacaaaaactatattattgttagtcccatatcattaatactagtatgccaaaactaaaacaatatagctatttgtattttgtaaatgcaatttctcaccagaaatttagagggctaatgcctctaccttctataagctccctgatgacttttgcctttatgtttggataaaatttatgctgtgaaataattgatactgacagctaatgccaatcttcttttgctttacatttaaattcacaatggctgtctttttatgtaaatatttttaatgctaagcatattctagaaatgacagttttgtaacagatataataatgttatttctgttagattacccatacagaaatacttttttgtatattatagccatgcaaacttactaaagatacatttactgtaaaagataaaaatgtaagataacttaaaatctaatcttaggatttaataaattgaagataaaacacataattttacttcttattaatttcttttataagagacaaattatctcttgacatttttgccctgtttgcatctggcagattatttcaggttttggagtataaatatgaggtttctatttgcttgcagacagaaatatgttgctgcacatgggacagatatggatttacctgtataaccaggggcacagaggcagttgtatccatcagtcctgtagacacaattttcttcatctagacaaggtgagattttacatttatttacatcaagttcacagaagggcccatggtactcaggttcacaattacaaaaaaatctggagaaaagtggagaaatgaggaatagccatgtaacaatgataatcatttattatatatgattcatatttatattttaaattcaagacattcaacttaattgaaataaataatatatgtatttcatttttttctttgaaaaaatatagcaattctccttgcaaaattttgttctgctcaaatgttctttatgtgtgaaattttgaaaaacaatgtgttgggtaaataattactgtaacctgataaatactagtatcaaaatatagatgaggtcatgtcctttgtagggacatggatgaagctggaaaccatcattctcagcaaactatcacaaggacaaaaaaccaaacaccgcatgttctcactcataggtgggaagtgaacaatgagaacacatggacacaggaaggggaacatcacacaccggggactgttgtggggtggggggaggggggagggatagcattgggagagatacctaatattaaatgatgagttgatgggtgcagcacaccaacatggcacatgtatacatatgtaacaaatctgcacgttgtgcacatgtaccctgaaacttaaagtataataataataaacaaacaaaaaaaaagaaataatttccaaaggagatattaaactgatcgaaactgtatacttagcaaaaatatctcttcatagtttttccttttagaagtctagataaagaagctttagcaactttccataaaatgtttttgagctagatttctatttagattttttaggaaactcttcctaattaacttcactcatcattttataaccacagaagtctaacattccccatgctcctccttttacttcttcaacctacattaattaattgagcgccagacattagtcatgtacccatattcaagtgtaaattaaactagagcttgcttttgaaagtctcaggaacaggacaggaatacagatatgtaaacattacagtaaatacatgtcaattgagacaggtcctgttaaagcatggctagctgctagacaagaggtgacagaaaaggtcttactcagtattaataaagaaggagcaggatcagtgttttaaaattctgaatatgaatgaaaacatgcagtatttttctttctgtgcctggcatatttcatttacaataatgtcctccaggatcatgtatgttgttacaaataacaggacttcattctttttcatggctgaagagtatttcattgtttatgtatactacatattttttattcattcatctcttaagtaaagtaagccagacagtaggggagaggggataggaaagattgattgatgggtgcaaaattacatgtagaaaggaagaataaatttggtgtcctattgcacagtacggtgactgtagtaaacagtaaggtattgtatattcaaaagagctagaggagaaaattttgaatgtttgcaccacaaagaaatgatgaatgtttgaggtgatctctatgctaattatccttattcgttcattacaaacgaatgaacaaatgtgctgtaatacaatgtattatgtagtataatgatacaatgtattcatgtatcaaaacaacacaacaaaacaacacataaatatatcaattatgtgtaaatgaaaaataaaattaatagaaaaagaaagagtaaggaatctttgtatcagttggacagaaggcattaaaatgtcatgtgcaatgggatactgggtgaaagagtagagtatttcccaagagctcttcatgtgactagggaattgactataatcacctttttggagtaacactaatccaaatactaacttcttgaatttttgttcaaatagtcaaactgtttttctccattgtattcattttgcgaatatctccccatctagtgagaagtaatgtaatgaatctgctaaatgtcttactaaaatcaagatatgtttgttaataatactgtctttgctactttgtgttctcactgaattaatgatgatcccaaggaatcacagaatagagagaaattggacacagaattctcagaaatagcagtgaaaggtatctcaagaaatgatttgtttcatactgacaaatttaaaaatgttatattactataaaaacaatgactttcatttcaatttatgtatttctttcatgtacttctgacagttctattatatttttagaagtttcaaaatctactttgtattttgaaatattgaatactagaaaattatttggtgatatcttgctttttcagtgatttatgataatcaccaccaattgtttcaattttttttaaacagtagtttactacttaatttatagaattttctctctctctcattttgaaaatcagaaaatcataacatcccttgtcttttgctccccaaattttgttttcggtgattttcattatcttaaatatacttacttacttgttgcataagttaatgggaaatttttgtgaaatgtctttttgtcatgatgaagatgtgggttttgctgagtattaatttttttttgtctgtatagttatcttgaagatacatgaaaggattcagattctgacacctacccataattcttgttttttcaattatgatttccttctgaattttgccttttgaaccctttgttagtttttactaaatgttattgttgcgggaagtcagggaccccaaatggagggaccgactgaagccatgacagaagaacgtggattgtgaagatttcatggacgtttactagttccccaaattaatacttttataatttcttatgcctgtctttactgcaatctctaaacataaattgtgaagatttcatggacacttatcacttccccagtcaatacccttgtgatttcctatgcccgtctttactttaatcttttaatcctgtcagctgaggaagatgtatgtcgcctcaggaccttgtgataattgcattaactgcacaaattgtagagcatgtgtgtttaaacaatatgaaatctgggcaccttaataaaagaacaggataacagcaactgttcagggaataagagagataaccttaaactctgaccgccggtgagctgggtggaacggagccatatttctcttctttcaaaagcaactgggagaaatatcactgaattctttttctcagcaaggaacatccctgggaaagagaatatgcacctggaggtataggcctataaatgccccccccccccaaggtgtgcccatctcttatggttgagactgcaggggtaaaatagaccccagtctcccatagcgctcccaggcttattaggaagaggaaattcctgcctgataaattttggtcagaccagttgctctcaaaaccctgtctcctgataagatgttatcaatgacaatggtgcccaaaacttcattagcaattttaatttcgtcctggtcctgtgatctcgccctgcctccatttgccttgtgatattctattaccttgtaaagtacttgatgtctgtaacccacacctattcgcacacttcctcccctttgaaaatccctaataaaaacttgctggtttttgcggcttgtgaggcatcacggaacctacagacatgtgatgtctcccctggacgcccagctttaaaatttccctcttttgtacgctgtccctttatttctcaagccagctgacgcttaaggaaaatagaaaagaacctacgtgaatatcagggcaggttccccgatatgttatattcatttttttgcttccatgcccatccttcaaatgtatttactctaatttaagatgaacttctcaaaaagttctgcttttttgtttgctctttaacatttatcatgtaacttattttatgaatctcaaatatgtaccttacgcttctgattttgaaagtgatatcacacagtaaataaacatacatgtattatctcaagacttatggaagtttatttttctaaagtttttggcatacagacaactatgtgaagaattgtttttaataatatgaatcataatgatcctttcttctaagaatgctttgcttctacttcaataacctctctttcctttttgctttcaatcaagaccattattttttcttactttctacactactcctgaaatctgaacttttcaacattgcaaaaatatgctttacttttacataaattccaaacattattaaatttcaagaatctgttaaaccacagatgcctgttcaactggaatgttgggggtccctgctttgttaataatgatgcaaaaaggccctgggattctagagtccatttggacattttctgaatggcatctaaaatttcatagagattaaaaaaaaaaaaatcatcgacattaacagcagccctggtgaaacagtttacagaaaatattcaacttatatttcttactttccaccacactaaacaatatgagggcaaatttgtgcgaaaataacattttactctacaacagagcaactacctttaatccttgtctctgctttcccagaaaaatttaaatgtttttattttctcttcctcctttcctccctccacctgccctgccctgctctcttcccgctccctgtgtctaataggaagggcaagcacaatgctgagcacttgggacgtttttactttgcacttaacgttggcccttcaaaacgttaaaaaaataaaagtgcctagggtatgtctgaaaagatcctcatcaaatttttcccctcctggcctctggctatagtgtgcaattctttcagctttggtattttcctttcgctattacctgctgagggtccctttatgctaaccacctctaataaggctagagaaaaattaaatgtaaacctgatttttattaatgtcctaagtgatccagtcaaatgtacagtcagtactgcattttatattaaaggtccctaaagtataccttcctttgataaaactcaatattcatagcttttaaaatatacatatataataatatcttctatcttgagagaacaattaagaccatgaaatatgtatttttgatgaaataaaaatttctcatttaaataaaaagcttttacttcaaaagttttagaattaaacttaaatatattgtcaaagtattgaaataattcatatttttaatttgacattgccctaaaatttttcaaataggtgttcaagatactttttcaatcactaagatgcattttaacagtgacttctgaagaaaattcaacatattaaaatagagataaggaagagtaactataatttgcataaaatgatatctccaaactataaaaagatggaaaaatacaagataatcacatgaatttatagcccccaaattagccacgattacatttcatttacattattcttatatactttttcttgtattccagatgagagaggaattaataagtagatgtattatttgtatgcttctgaagttattttaaaatataattattaaatagattgaatagtattacaaaatccaaacataacacagaatgttttaatgagagttttgattttaaaatgtgtttgcaataaaattaaatcatacttgtttcagtagatattttttaaaagcttacattcaaaataagaaaatgaaaccactggtgaaactttctgataaggacttttaagcctatgttaaagtaattcaaattttgaaagaatttataatgtattttaaagcatttctacttttttcttgtgatattataactgcattcatgaaccacacttctttacaatgaatgacaatttttacttagaatatgaataatctattttatatttgcaacatgtctttattatgttatatataaatatatgtctacattatttatcatactcacaacatgtctttatatgtttttattataattgcatgtgggtgtgaatctgatttgaaacagtgatgttatcgtaaattctctagtagaataaacatcattcggattgatgactgtttctaggcaaacaattacagaagagtaaacagatttttgtcttttggttaaatgcatattaaccaatcacttttaaatttgtaacagtgaagaattgctaaacccgtgaacatcacaaactgaatggtcacaatatgcttgttggtaatgatctcgctatgataatcacatcagccaggcacttggaacattttcttctattttttctttaaatgcactagccactgttattgtaattgttcttgcaaattctatttagttgtaaattttcagtagatggatactattgtgagtgacctaaatgaactagtagcaatgacttgaaaagacattagttgcatgggataacatatgctatcaagtgtcagaaaaatgtaaattccagtgttcacttttgcagtggatttgtatattaattggggctgtcattcatgtgccattatatctcagcaaattcatctttaaatcatgttactagaggtaagtcttaattgttgcaggccacagtttcaataaccataagagagaatagaatagattaaaaacatgaatctaaccatgaggcatgtatgtagtaactactgtttttaatacgttttttgtttatgtgtctacagtttaatttactttgaagtaactataaaattattgcttttaaatgagttggtagattacttgaaatatttttagtgagtactttatcaataggttaagtttttcaaaaaaataaaaattactttaagaagagataagacaatcaaatgtgactacttcattttcagctgctaattgatttttaatctgtgaaagattttaattcattgaaaatggcttttattataataatttacaccaggtaattttctaagaatagaataatcaacacctgtatgcccatcacccatatttaactcatcttagtattgtttcatgttgctgaaatatttttaaggaaaacacacaaaacatatttgatctgtcatatatatatatgagatgtcataaatatgtatgcacacacatatatgtacacacatttcatacacatatatgtacacatatttacacatatatgtacacacatttcatacacatatatatgtatgaaactcctatgcatgcattcaattaattatcctccattcctctctaccaggagaaaattactactcttaagatgctatgtatttttcaaaatatgttttaatacttcactaaatatgagttacatatcacattattctgagacttattttttcagtcaatcatacattttaataaatatttaagtgatatacttttatataatttattcacagtaagtaatgtatagatgcttatgattaagttgcattgcatttgttttgttttctaatgtttaccaatataaagatattggaaaggcatcaccttgttcatatatccttgctgacagtgctggatgttgccatggaattgggtttcgtgatgttaattacaatagatctaagaatgcatagactattggatatgcttgacaattagatgcaaaatgagcaaataaacatataaatcagagaaacagagtggacatcagtggactgattcacagatatctatggcagaggctaactgatgacggggttttagaaatgaaatatataaacagtctacttacggtgctgcctcatgtatatagaatgaaatgtatagttctggaggacagagacataattcagtttggctttgtagggattctctgcctctttcacaattccaaaacctaagttatgtcacagactcagtcactcgaaggtcaggttttgcctccttaagaggaatctttaatagagtcacaggtattttgtgtatctttttgaagacttcctcagaggtatctgaggctatttaccagtatgactgttctatggtgaaagaaagatattcagacattttaggagttgctgaatactggttctgaaagtatacttatctctgcaatgctactgatccaccagtagaaatataagattattgaggtcagttcaggtgaggccacaaatacatcttctctttgattttgtttttttttacccacaattcttgaatatacagtgtagttgatatatttagtaataggacaatttttacattggggtaagagctattatggaggaaaatccaattggaagatcttgtcatgcccctttagaccaatggagattttaaagtgacagcaattctctattcctgtggtacttgtagtgattggtgtccccttgaaaggactgaaagttgcaggggtggtgattccaaacatccctacttacctcaccagattggacaatgcaaaagctagaaagggcacagaaaataagatgaatgatagaatattgttggaaaattaaacaggatctgatgcaaatttcaccaattctaaaggttggatctctatgaagatagataaacagagctcctggtacctgagtccagctatgacatagaaaattaattattttgtgttctaattagtgaagctccacttgaatttgtcagaatgtctttttaaagatattttgaaagacctaaataaatagatatcaatttttcttaaattggcctacccattcaatgaaattccaatcaaaattgcttgtttgaatgtatatttatatagaataaagttgattttaacagaagaaattgccaaaatatctaaagctgcctgaagattaaatagccctactagtattgagatatttcaaagggaagtaattaagatgtatgacactagcacatggatgagtaactgaactaaagcaacagaacagcaatagagaaatagacatatccatatgtggaaacgtgatctgcaaccaagaaggcactacagatcagtgagtgaaagatgaacttaatatgtagcagacatggcttatttatataaaaaaataagaatctgagtttattttttaagtgtgcaaagaatgagataagaatactttacacccatactcatacttatacatacaatatacctgatgcatctacatataaagaacataatcttaattattttaaaaggaaatatagggaaaaaatcctttcatcctagtgtaaagaaaagttaaataagatgaaacttgcaaaccatatactaaataataaattaattcaagtatattaaaattaagttttagtacatataacttataaaggtgaagtgtctatttcaatcagaacttatattcaataaatacaactaacaaagatattttaaaaatcatatataaggattcttacaaagccataagaagaaaaaacattaaagagcagatgctgactcagcaagatggcagaataggaatagctcaggtctgcagctcccagagagacgaacgcagaaggcaggtgatttctgcatttccaactgaggtacccagttcatctccctggtactggttagacagtgggtacagcccacggagggcaagcagatgcagggtggggcactgcctcacctgggaagtgcaaggggtcaggggcctccctcccctaaccaagggaagcccagagggaccttgctgtgagggatggtgctatctggcacagatactatgcttttctcatggtcattgaaacccacagaccaggagtttccctcaggtgcctacaccacaagggcactgggtttcaagcaaaaaactgggtggccgtttgggcagacattgagctagctgcaggagttgttgttttttttttttttttttcgtatcccagtggcacctgaaacaccagcaagagagaacccttcactccgatggaaaggggtctgaagccagggagccaagtggtcttgctcagcagatcccacccccacagagcccagcaacctaagatccactggcttgaaattctcactgccaccacaacagtctgaagtccacctgggatgctggagtttagttgagggaggggcgtctgccattattgaggtttgagtagggagttttcccctcacagtgtgaacaaagccgccaggaagttcagactggtggaggggggggccaccacagtgcctcaaagctgccgtagacagaccgcctctctagatacctcctctctgggcagggcatctctgaaagaaaggcagcagccccactcaggggcttatagataaaactcccatctccctgggacagagcacctgagggaaggggcggctgttggcacagcttgagcagacttaaacattcctgcttgccagctctgaagagagcagtggatcacccagtacagtgctcaagctctgctaagggacagactgcctcaagtgggtccagggctcccatatctcctgactgggagacaactcccagcagcggtcgacagacacctcatacaggagagctctggttggcctctggcaggtgcttctctgggatgaagttccagaggaaggagcaggcaacaatatttgcctttctgcagcctccactggtgatacccaggcaaacagggtccgcagtggacctccagcaaactccagcagacctgcagaagagggcctgactgttagaaggatatctaacagacagaaagcaatagcatcaacatcaacagaaaagacgaacacgtgaaaactccctccgaaggttaccaacagcaaagaccaaaggtagacaaatccacaaagatgaggaaaaatcagtgcaaaaaggctgaaaattttaaaaaccagaatgcctcttcttctccaaaggatgaaaatttctcaccagcaagggaacaaaactggatggagaatgagtttgacgaattgacaaaagtaggctttagaaggtgggtaataacaaactcctctgagcgaaaaaagcatgttctaacccaatgcaaggaagctaagaaccttgataaaatgttagaggaattgctaactagaataaccagtttagagaagaacataaatgacctgatggagctgaaagccacagcacaagaactttgtgaagcacacacaagtatcaatagctgaatagattaagtggaagaaaggatatcagagattgaagatcaacttagtgaaataaagcaagaagacaagattagagaaaaaagaatgaaaaggaacaaacaaagtctccaagaaatatgggactatgtgaaaagactaaacctacatttgattggtgtacctgaaagtgacagggagaatggaaccaaattggaaaacacacttcaggatatcatctaggagaacttccccacctagcaagtcaggccaacattcaaattcaggaaatacagagaacaccacaaagatactcctcgagaaaagcaaccccaaggcacataatcgtcatgttcaccaaggctgaaatgaaggaaaaaatgttaagggcagccagagagaaaggttgggttatctacaaagggagcccatcagactaacagcggatctttctgcagaaaacccacaagccagaagacagtgtggaccaatattcacattcttaaagaaaagaattttcaacccagaatttcatatccagccaaactgagattcacaagtgaaggagaaataaaatccattacagccaagaaaatgctgggggattttgtcaccaccaagcctgccttacaacggctcctgaaggaggcattaaacatgaaaggaaaaatgggtaccagcctctgccaaaacaagccaaaatgtaaagaccattgacactacgaagaaactgcatcaactaatgggcaaaataaccagctagcatcataatgacaggatcaaattaaacacataacaaaattaactttaaatgtaaatgggctaaatgccccagttaaaaggcacagactggcaaattgtataaagagtcaagaaccatcagtgtgctgtattcaggagatgcatctcgtatgcaaagacacatataagctcaaaataaagggatggaagaatatttaccaacaaatggaaatcaaaaataaaagaaatcaggtgttacaatcctagtctctgacaaaacagacattaaccaacaaaaatcaaaaagacaaagaagggcattacataacggtaaagggatcaaggcaacaagaagagctaactatcccaaatatatatgcatacaatacaggagcacccagattaataaagcaagtacttagagatctacaaagagacttagactccaacacaataatagtgagagactttaacaccccactgtcaatattagacagatcgatgagacagaaaattaacaaggacattcaggacttgaacgcaactctggaccaagtggacctaatagacatctacagaactctcgaccccaaatcaacagaataaacattcttcttagcaccacatagcacttattctaaaatcgaccacataattgaaagtaaaacactcctcagcaaatgcaaaagaatggaaatcataacagtctctcagaccacagtgcaacaaactagaactcaggattaagaaactcactcaaaacgacacaactacatggaaactgaatgacctcctcctgaatgactactgggtaaataacaaaatcaggcaagagaaagaaataaagggtattcaaataggaagagagaaagtcaggttatctctgtttgcaaatgacaggattgtatatttagaaaacctcatcgtctcagcccaaaaactccttaagctgatgagcaacttcagcaaaatctcaggatactaaatccatgtgcaaaagtcacaagcattcctattataatagacattaatagacaaacattaatagacagagaaccaaatcatgagtaaactctcattcataattgctaaaaagagaataaaatacctaggaatacaacttacaagtgattgatgaacctcttcaaggggaactacaaatctctgctcaaggaaataagaaaggacacaaaaaaatgaaaaaaattccacgctcatggataggaagaatcaatattgtgaaaatggccacaccgcccaaagtaatttacagattcagtgctattcccatcaagctaccattgactctcttcacattattagaaaaaaaaactactttaaatttcgtatggaaccaaaaaagagcccatatacccaagacaatcctaagcaaaggatcaaagctggaggcacaatgctacctgacttcaaactatactataaggatacagtaaccaaaacagcatggtgctggtaccgaaacagatatatagaccaatggaacagaacagaagcctcagaaataacatcacacatctacaaccatctgatctttgacaaagctgacaaaaacaagcaatggggaaaggattccctatttaataaatagtgttgggaaaactggttagccatatgcagaactctgaaaatggaccccttccttacacattatacaaaaattaactcaagatggattaaagattaaaacgtaagatctaaactcataaaaactctagaagaaaacctaggcaatatcattcaggacataggcaggggcaaagacttcatgactaaaacaccaaaagcaatggcaacaaaagccaaaattggcaaatgggatcgaattaaactaaagagcttctgcacagcaaaagaaactatcatcagagtgagcaggcaacctgcagaatgggagaaaattttgcaatatatccatctgggaaatggctaatatacagaatccacaaggaacttaaacaaatttacaagaaaaaaacaaacaatcccatcaaaaagtgggcaaaggatatgaacacacacttttcaaaagaagacatttatgcaggcaacaaatatatgaaaaaaagctcatcatcactggtcattagagaaatacaaatcaaaaccacaatgagatgccatctcatgccagttagaatggcgatcattaaaaagtcaggaaacaacagatgctagagagatgcggagaaaatgtggagaaataggaatgcttttacactgttggtgggagtgtaaattagttcaaccattgtggaagacagtgtggtgattcctcaaggatctagaactagaaataccatttgagccagtaatataattactgggcatatacccaaaggattataaatcattctactataaagacacatgcacacgcatgtttattgcagcactattaacaatagctaagacttggaaccaaccaaaatgcccatcaatgttatactggaaaaaaaaaatgtgacacatatacaccatgaaatactatgagctataaaaaagaatgagttcctgttctttgcagggacatggatgaagctggaaaccatcattctttgcaaactaacacaagaacagaaaaccaaccactgcatgttctctcttataagtgggagttgcccaatgagaacacatggacacagggaggggaacatcacatactggggcctgtcaggggttggggggcaaggggagggatagcattaggagaaatacctatgtagttgagtatatatatatatatatatataggcagatgccataattaggcatttctaaaaaggcaaaattaatcatctcaaaatgtacataaaattgttaaacttcatattattataagaatgcagggagactacaataagatataactttacacacagcctaaaatggaacattctgaaaatgccaataaaaacatttattccctgctaataatacaaaaattgtatttttcaaaagaaatgagaaaaatataaatgtgatttagcaaatgtgaccatgtttacccaatggttcaacaattctacttctatgtatgtaacctcggacatactagtacttgtgtatttagagaaatatttgaaaactttaatatcattgtaggtaagacaaaagaagcaaatagtccaaatatctataaccagtagaatgataaatgttggtatatatttaatattaaatattgtataaaagttaaaaatgagcaacagatacatgcatcaacaggaattacaaaatattatgttcaacaacaatttcgggagactctacacaatattgttttgcttataataacatggaaactaaggagcattttgctcaggcacacatacaaatagcactataaactaacagtaagattggtaaataaaaatttgagatttttgacataagtgattggatgggacaaatgaggatgtgctggtacaagcacaaatgtatcagtggtgatcagctgccttagttacataatgagcacatgtgtgctcactttcttgttgaattacacacatcaaataattaatttaataaaaagtagcttctcacctgtttgtcagatccacacatgttccattatttttgcaaggttcagaggaacattcattaatttcaatttcacacagagatccagaaaacccaggtctgcaaatacaccttttaaacaaaaaatttagtaactccattagtatatatgtataaaatcaatgcttcaactaattgtagcatggcaagtttttaataattataattgttgcttaattcaccaattaaaattctatacctgtatacatctagacacataaacatgtatctagatactttttaagttttctgtacctgaaattgttgaccatatcttcacagtcaccataatcctggcaggaaaggaagaggcagtctttcacatcaatttcacagtttttaccttcaaattctgcaaagagtatgagatgagtatggatgagcaatccttgttatagagtaaaaaaatcagaatcagtggtagtctaaagaatacactcataatggaggttaaaaaaggaaaaagaaaataattactctcaagcttctcataaaactccatttcacataatgtgtgcataaaaacatgccagtttctagattaatgagtttaaatgaaatattcaagggaggaatactccactaaatcccctgagaaggtagagatgttgctaatgttgctgttgttttaaggtatttaaatgtttgaacaagaagaattgaaatgatctggaaagcaaatgaattaatgtgatgaccaatcttaaagtaaaattgagcttcaatgatcaaatttattcaaggcagttagcagatgaagcaaattatttaattgctttttatatccaagtgattcaaagaaaacaaattattttgattcacagctacataatcagtcatccatttaaacacatgccagttatattaaaaaaaatgaacatgaaagaaaattatacaggctgataaacaagacagttgcaattatttcaacacatttgtgtcagaaaaaacctgcatgatatcactttttaaaatacaatgaaatatattaatatttataataaacagttaaacaattctatggttatatattaactaagtataacaaaatatatgtgtaaaaccatttttcttgttaatattttttctgtactagttcaaacatgtaagaaacaagatttccctttattttgctttttcagtgatattaccaagcactaaataagtgcagccacattacacaatattctaaatgtcagtatgcaatcaggctaatttagtttgaggaacaaagagtcattcaggttactttaagaaaactgtattcattgtttgcatacacatagactggaattggaactaagaagcatttaaagggaagcatagtctagctacccaggaatagctgtcttccttttacagtacatgtcctttatccttctcatatcactttttcttctctttctatcacaaatatctcagcatgttcagtttcaaatcacttgtaatgttggcatgcgagtgatatagcacagctttcttggtctctatgtctatattatgacatttcagcttcagcacctactgttcaatgaaaaattccctcggtattttctcactcagattcccacgatagaacacggaattgactgacctatttcatcttttcatatcataccatgccacagtcaatgccattctctgtggtgtctaccattggatcaaactgcaaacctgcctcccgttgcaatttaacagggagcttggtgttacaccttataaaatctggctgcctcttcggtagtatataatatggaaaactaaaagttacttaatccaaaagaaaacagaaaaagaaacaaagtacagatacaacaaatagaaaacaaatagctagaaggtgtatttacagccacacatatcaaaagttatattaaatatgatttttaaaaacgccaatttaaaggtagaggcagactaaataacagaagaaactacaagatatctaaaagaaatttatttaaaacataacaacaatgataggttaacatttaaaagatggaatgatcacacactatgaaacactaattgtaagtaagctgccatacttatggggctagcagaccaggtagtcttcaggacaagcaatatttttaatttgccttatttttcttactcaattctcagagcctgcaaatgaatctctgaagttacatttttgtaattcgttcatacgctaggtgttgtatcctcagctttaggaacaaaattaaaatgaattacttccaagttattatggctctcctcattttaggtgagcaagttgtaattgttccaacatgcttcatcattcttcaatcgccattgctgttttctatatttaggttgtaaatgccatagtacagatataaacaacttagattctattttcaaaagatgtttaattctttaagtatttgattgaggttagatttttcacaagttaaaaattgagaaagttgagtgtatttcaccatttctactttaagtctggttagttttctctgggaggcagggcattttgacactaaaatgattcttagaaatgttcttttgaggcagtggaactcaggggcactgactggctataaagaagcaccagtgagcctccatgatttcagctgtgctgatgaatcagaacactcagggcccaggaccttgggtagctcacaggataaccttgtttcctgtgattttgtcatatttattaagtttgacatttctgagatggagttttgttaccagctagcaacatatgtcaatgggttgaggaaatgagattgccgaaatgcagcagacattgggagaaaacataacatgtggattgcattcaatataaagcaaagctttgctgagatagcctatgttttgggaattttaagagcgaagtatgcatacagtcacgtgctgcataacaacattttggtcaatgacagaccacatttctaataacaatgatctataaatattataatggacctataaatgcagtaggctatctcatctaggtttgtgttagggcactctatgttgttcacacaacaaaattgcctagtgatatatttcttaggatatatccccatttttaagcaatacatgactgtatacttaatcccaaactacatattctataatccttaatgttagaagttgatattcatttctgtgaaaggtacttgttttgaatatatgaagttacaggtaagaaactgcccaaacagaaagtttgttattactaattttatgctgttcccctgttctttattcctactcagaactattcggttggccgtactttgttaactgcagggaggatctttacatgcataaaagtgaagcttcttaaatggatactgtcttgatccttttcttacactgtctcgtctgtgtatggctataacaaatacacacgaatggtcagtaaatgatatttttatacttctgcactcgttcctccaaaatacacaaaattgatttttaaaacctactgctcaaatgtaagatctgcatcagtctggattgtaggtattattttttaaaatcacttagtattttctcttttctaacaaattcagcctttttgcactttattgctctagaaggtaatgtatggaacagagtacaataatgaaattttcataaaaatcattttacatagcattttatcattcaggactatattttaacaatctccacttcatatttggtattagttggaataatttgaaatgaatgtaaatagggaaaaaaactagtgtataccatagcatgaattcacacaaggtagttaaaaatcatatatttttaaataaaaactcaaacacttaaaaatgtttttctttcaaaagtattaaatgtattatttctatttattcttaattaaataatctaatttctctggatttaaaagcttgataaaaagaaaacaaaaaaacacctcagaagtttttcttagcaagtcagattttttaaaaaaatattattttatttaaaaatatttgtattcaaatattaacattttctaaaataattaaccaatataagaaattctttaaatttaactttaaaaactatgaaatatgaatatacagaattaatatttccaatagtctctaataagatttttaacatctatttttaaagtgaacttaaaaaaaagaagagctaatattttagaaagtaataaatatttaacatgttttatgtttaattatgtatgtattttctttaaggaattttctaaattcaaatttctacagctattaaccttaacaggtatgtgctacaacatgggtacatgtttttaattgtcaacaggagtaatttctaatttatacaaactattttgtcaaatgacacatttatttggtgtttgtacttgtataccttaggtaatgtggaattaacataatgatagtatatatactggagtaatagacacatttaaatgcaactacttgtctcccatgatactgcaattccatcaagcgtaggatcccaattgtaaatcaatagcacatgtaaatgatctgattctgctctcactgcagctccttgtgaggcatctttgccacattttaatcctgtcatttaaagaaacttctgttcctttcaccttgaagacatacaaagtagctattttagaaactaagctctttacattaaattaagaagtatttgatagggtaattttttgcctataaactgagaaagtggagtaattcaaagtagaaagataaagaaccattcataaaaagaacattagaaaagaaattatttaattcttgacatgtatttctaggctagacacacacatggtaacataataattctactctatgctacaaacacacacattctcatgcattttatttgaagtcgtctttaccttcttaatcttcatgtggttttgtggtatttattattattattttttattattagagacaaggtcctgctctgttgcctaagctgaaatgcagtggtgtgatcatagctcactgtaaccttaaactcctttgctctagtgatccctcctgctttagcctcctgaacagttaggactgcaggcatgaaccaccacgcactgctaattttttttaaatttttttgtagagatattatgttgaccaagctggtctggagctattggcctcaagcaatcctcctgccttagtctcccaaagtgctgtgattacaagtgtgagctattgtgcctggccctcaagtgatatattttatatttgatttctaccagcttgaagttgaaaccagtttattcaacctttcccacttaattaactctttgccttcactatatgttttagccattactctaatggccataaacatatgaataaaaacatgaacttagttaagaagtgagatatattggtaacccagctgagagggataccagacagttcacaaaattgaagaaagaactgtaagttctgccaggattccttccccaaacacttctatcctactatatacagatcatctccacatgaagagaacatggtagttgactgtactgattgaaaacatctggcagaaagagaaggcctcttctctcagcatcaactctaaagaaggggtctgaatgccaatattccactcacatgcatgcccagacataggtaaatcatagttaccatggggatggaatttactatgtgtcttagcttgggttgttccaaaaataaaataaaaaaaaaagtctgagataatgattttctcacaagtagtttatttgagaggtgatcccagatcccaggaattattgcaagggagtggaaaataaagcagggaagagagtggtttaatgagcacataattgtgggcaactgaggcttcatatgctggagactctcttataaatcatgcgaaacataactaaaagttgtcaacagaaatgagaaagcagtgctatgtatccacaacttgtcatcccttgtgcatatttctggcataaatgtggaagtgatgcaggatttttctcagcccgtttggcagactcgtgggagaggtgccccatctacttggtctattatgctcaagcttttgggggagagagcacatatgccagcaagtgcaggacctggctggccactccagatgccgaaacaggagcaagctccacacgggcccccagcctgaccaggtgtgttgccttggcgggaacatggtggaacccaggtgagggtgcctgtgacactgaagccccagaggggattttacagtgctcctttagttccaccattcacagacagcagtgtgttagcagctcagttggtgccttgcctcgtcacatggggtggctgccctttgccagggagggcaaagggctggttggacggcctttctgggtacccacactcagtgggtcccaagctcttgtccagtgtccaagaagaatgaggtcatgcagatgattgaagggtggtgaaggtggagaattttattgagtgatgaaaacaagtctcagaggagaggggagctggagagggtacaggaaggacaggtcgtcttcctgtacaacctgaagtcaggctgtctcttcccgaaagtcaggccatctcatcttctactgactgagtctggggtttctatagacacaggatggggagtgcttgctgattggtttgtgagtgtgcaaaagttaaagtgaagacaagactcaaaggtgggtacaacagtgtggaaaaccaattaggaaagggcaggtatatgtaaaataggtgaagggtggggatcaatcagaggaaagcgcaccaaacaggaagacaagttctcaatcctgtctgagaatttaacttatagcttggctttcaagctttaaactggcattggcttggaggtgatgtttcaccgggtacccacccttatctgtctaggcatttggctgcctcctgtcactatcaaaagcttttaccgcattgtactttaatggttaattaactggtatgtctctcccttaaactttcaattccttgagggcatatcttcaccatgtttaatttttccagaacctatctcaagacttgacacatcataggaaatcagtatgtttgttgaatcagttaatatttttaaaatttctagaacactaacaacaagcagttacaagatagatatgtatttgtgtatggagtacagtttatagaggcaaaaaaagttggttacaataaaataaatttctaggtgtgtaaattcattacatactaaataatcaaagctaacactattgaggtgtcaaaaataaaacccatttgtttatagaaatctcataaaatgtgccttcctatgtgttatttttctatttattaaagctaatttcttacagatattgtgcctattttcttacagatattgtgccaaactaataagattttatataaaataaccatattgaattattactgtcacatgctcttttgcctcctcattttcctgtagaaaatgttcattattcatagagacccaattaatcaccgcagttttagtcagaagacagaagctttgccctttatttatctcacaaagcaggatcacaatagttctggtgcttaactataccgataattttttaagtagcttactttgctaaaaggattagattatttttactatatatatattttttactatgtatatatttttactatatatttcaatcacactaaccaaaatagcttacctgctaagcatgcagtctgacgtaaacccaaaagtatcagttattctacttgctggtccttcagagtgaatttgaatgtcatttctaatatagttttctaacatacagtcgcattgttactctggctgaaattttacctatactcatatttatctagtgagagaccctacagactgactaaaaactgtgaaaacaagttcagaaatacatacgctgaatccttagcctaaagccttaaatttctactcttacgacctgtcctattttagtcaattgacaaacaccaacaacttacaaagagatccagtggagcttccaaatcatatctgtagatgttaagtcttggaattctttgtagttctaaatgttgatacttgtgagaattaaatttgataaaatgttttcttttaaaaacaatatactggctttgacatagaacctattttaaataaagctattaaagtaacccagtcaaagcttctaaaatgttgcatagtcaacttttgaattttctgaggtggtttttaaaagcaatgttacagcctttaatttttcatctgctacagaacttaaaactactaaagacacgttattacagtattcagatctgatttacagaaacatactccacaattaggtttagaaaaacatagatgcaaattagttaaaaaatgatgtgcatttcaagtatctctttgtactgaatcacaatcacaaaggaataaacacataattcactgtgtttacctgccactctagccaaagctctgatttggcttacgtacaataataaaatactaaggggaaataagattacatttatttaataatagtgaaatctaaattctccccatgacatctttgtcaatgttcaatgggacagcagatatcattactagttcaatatatgactagagggttttaaaatgtttccaaactttctttccctaaacccgtagcaggaaagaaatatcactatattttataaatttattaaatgcacttataaatagcaaaagaatttttaaaatattaaggtttgaaaacaatgcccactttgcagaaaattatctctggtgaaaacaaaggaagtttgtctaaagtgaataaatatactatggcctcctcaataaatatttatattctgagattttttttctattttacttagcctacttatactctcagaaataataatatgtttcttacattcttagacatgtaagtaggctaagtaaaatattctacgtagtagaatgtttagaattgttctagtaaataaattagcttcactgatattgaataattttcaacaagtttcactctcagtgcttgctaaaaggaaaactatttacttgtttgaattatgttcttcataattactaaatttttctgggcatcaaatgctccccttgtattttttcgtttttttcttctctatcttgtttttcctgtctcattcttgaaaatattctctcatatgctctataaagcccatgctatttttgcaaaatcaattactgatggctttctagcttttagttttaatccttcagaaggcccagaagtttctgtcacgtatacaggttcaagaacttgcttcaatatccttaaaaaacattaacatcttaaggaagttttaatgcaaaacaaatggaaatagctttgaataagatgtctgtttaactaatgtcatctaagctgacttttttgaacagaagagtaaataagtgatatccttattattaagagactcccttaagggccagtgagaggcaggaaaacatgaaaccacagtgagtattagaaaataaattgcagttttgggcctccaaacacaatgtgttttttatattatgcttatgacacatctagttattctgaaaaccggccatgtgttttggagcagaagcatttccactgaagatggtaattgcttatgagtagccattgatacatgaacagtgaacatgtacctaaaccactgtgcattaataagactttcttcgcttgcatatgaagagaccccaatcaagaaagtttaatgatataagcagagttattggctgatatgacccagaaagccagaaatatcctggcttcagatacggctggatccaggagctccaatagtattttttgaactgctcattctttcttgcataggatttctctcttgagacaaagtagccaccaaagttatgtgattgtaactaaacaatctaagtagaaagaagtaatattttgatagctccagaagaaaatgtacaatagggcatttcattacccccaattatacctatgcccatctctaactaactgctattgtcatgaacactacatgaacaggattgttcagaaaagagaaactgttattaaaggagagacaacttctgaaagaaaaaaaaagggccaaaaagctataaagcttcactcttttccctcttcccaatggttaattcttagattaactcctttggtgcatttctctaatacatttttataactggatttgaagttagatagtcccctacccacaatgtacataggatttttccaacccattttaggaggccatcatcccataggcacaataaatacacaaactaattaagtaattatttaaaaacaataaaatccatattagctcttaccttctctacaaatacaatgctgatttgcgtctaccaaagctaagcatgttgagttgtttctgcaagggttatgaagtaggtcacaaaggttatagcgttggtggcaaaattgtccagtataaaggggtgggcacagacatacaaattgtccagggatggtagattcatgacaaagacctccattcatgcatggatcagagtcgcattcatttatttcttcactacagttctgtccagtccatccagatgtacactcacatctgaaataaaatattaaaatttttagaagtgtgaactctttttcaagtttattttttgtatttttaattactcccttgaactaatagtatgtggtgcttttaaatttataacaggactaataaataatacatagttttaaaatattgtttgcctaatttcctgtgacagtataatatatattaccataaaacttaccaccttggctgaaataagattttaaaagcattaacaaatttctaacatagttaggcctctgagacatgtcagagaacaactattgacctaaatcaccaattgagcaaaattttcctatgaattatttaatataagttttacagatgagatcactatttataagccttaaatgctatttaattcagcgtccttagcaatatgtgaaattcttgtcatcaccagagtatataacaaggtgttactttatgttaagcatctgtttttggctttgtgtgtgtgttgaatcacttgaaatgcatttttaaaaatatattttcttttttaaaaattttagattcagggcttacatgtgcaggtttgtaacacagatacattgcataatgctgtagtttgggcttttgttgaacccattgcccaaatagtgaacacagaacccaataaatagattttcaacccctacctttctccttccctgctcacttttggagttctcagcctctattgtttccatctttatgtccatgtatacccattgtttagcttccacttgcaagtgagaaaatatgatattagattttctgtttctgcattaattcactaaggataatagcctctagctgcatccatattgctgcaaaggacatgatttaattcttttcatggttttgtaggattccacagtgtatatgcatcacatattctttatccagtccaccgttgatagacagctacgttggttccatgattttgctcttgtgaatagcactatgataaacatatgagtgaagttgtctttttggtagaatgacttctttttatttgggtggatgctcattagtgggatttttgggtcaaatggtagttctatttttagttctttgagaaatctccataatgctttctgtgggctgaactaaattcgtattaatatttgaataatgtgcgataattgaagggaaagcaaacaaataaaaaataaagcatttggaagttatctgtgtatcacaggcttctagctcagtctagtcctccatccagtatctgtcattatcttcaaataccactttggctagtcatcatccatgaaacgaggctagtctgccgtgaagagaaaaattctagcagacaggagggggaaagtgttttacacacaaaattctagcagacaggagggggaaagggttttacacacaaagtgtccatttgagggaaatggaaaggttatagtgaagcctgcagatagagagtaaatgcaaatagagagatagagaggtagtccatcagctgggtaagtggaaaacaatcacaaactgtaggtgtgttcaaggagagaacttgtgtcaatttgtgggcaaggtagatttccaaatcttgagcaactttactattatgcaagttatgaatcatgaaacaagcacaggaaatattagaacaattattttcaaaaagtgtatttactgatagattagatttttaagataacttgaaaaaagtcatagtgctgaaataatgtaacttactttgtgatacagaatatcttactaaaaggaggggagcaaagaggaaggaaagaaggaagaaacaaagaaaagagtcacctaatttgcagtttcaaagccccagatatatcaaggccctttataattataaatacataggataccaatatattggaggagataattgaacaaatgacttgcaacaacatctataattgaattctaaatcgatatagttaccattaaaataaaaaccaaaatgaataattggcaaaatggtattagacataattgactaataaagtgtttactagttcaataagtttaaatccaatgcattgtaagccagtggatttcacagctgtctaaatttttttttaattggctgtgggtagaaagtaattgctatcatgataattgcacatttctttgtgaagcatgctagcacaagacaaaatttatgactgaaacaattcataccttcacaatataaaaaatatatacctaagggtatgttatttacttaatattttattttcttctcaaaatcaaaatgctctaattattttggtgactttccatcctagtttgcctggagagacttggttcagtttgttgttctgatataattttcagggcatccttttacttataaaagtttctaaggtgctttttttaaaaatctttatctcctatatcccattactgaaattgagtatctaaaaaacaaaacaaaacaaacaactatacacttacctatttactaatcctacaaattatttcactttgctctaaaatttgcttgccatacactttaggaactcatcatatatactatcttgtgttaaaatcatttgcatggtttgcctccaccattaaacttctggttcctgaatgtctaagaatgatctgaatctccacattatcatgtcaacacaataaatgttgacaatactataagaattgatataaggtcctcagtgttgaaacagatcaacttatctgcactctttcatttaggaagttgaggatcagagagtttaatgaaattggtaatctcagagaattgttgtaaagattacatgacatgatgaataaaaagtatatatagtgcctggaatctgcattgcctggccacctacactgtttactagatgctgtcacagaagttttaagaatacattttctgacctatgagcctaaatacaatgtgtatctcagcaatgaatatttctttagcttttagtagtacttctttttaatgtttgatcatcacatcacattttaaaattgtcaaatatattatccaatttgatactttcaataaagctttgaaatatgtagaagagatattctttttctcactttacagatgagataggtggaagttcaaaggataacagtgatgtatcctaagtcatgtggttaagcaaatggaacttagaatccagatctcctcctctcaagttcctgtttttcttttcttttctttttttaaacatgctttaaatctagtatcatttctttaaacattttgtgaaataatgttaaaattgggtattacccagtcttaagagaacttcagtgtatttattttgcttgaaataacatcactgtaaatataactattcagtcatataatgggactcagttaatatactatggcaattttaagaggagaaaagctagagaattaatattttctaaaatcatggttacacaggtcctgagggtattgcacaagtatttatgtttttctctttattgtattctgagtacataatttcaacttggttaatttaaaagagtttcctaagaaaaaccgacaattcttgcctatttggcatatgtgctgaaggtttgttttatcttctcacataacaggtggcctaagacctcatgtggtgtcattccaaggatccaatcctcaggaaagaatgtggctgtatgtcaagaggactgataatgccaaggctgagttctatggagataacatggatgttttatagaaaataaagttccgaggaacaaagtcactactagtgactaacaatcatacctacaggtttacatatttgaatctgcttccgcacatgtcagagaagctagtgtttgatgggtgggaaaaggaaaacatatttgatgtgagggcttcaatcagattctaagtttgctccatgaaataatttcaggatttagtggaaccaggcagatattttcaaactcacagctagaagcagagtctttatggattaaaaaaaaaatgcaaagcacataccgtgtgactttttgagtgtacaatttctggtagtaaacacttgaaaacaagtaagtgcgtgcctaaagataggttaatacattctaatttgctcttttccctagtgtgagaaaatctaaattcattggtgtaaaatacattgaacacttctaaggacaacttttcaaatcttaaatgctgatttaaagtactaaagctgataatagaaaataaagtagttatcatcgttaaaaagtggaagaaatactactcattaaggtgcgttggctcacgcctgtaatcccagcactttgggagtccgaggcgggtggatcacgaggtcaggaaatcaagaccatcctggtcaatatggtgaaaccctgtctctactaaaaatacaaaaattacccaggcgtggcagcacgcgcctgtagccccagctacgcgggaggctgaagcaggagaattgcttgaacctgggtggcggaggctgcagtgagcagagatcgtgccactgcattccagcctgggtgacagagcgagacttagtctcaaaaaaaaaaaaaacaaaattcactagcttcaaaaatcttaataaatgtcaatttctaatgactaagcattctatatgtttaccttaccataaacatttatttgtaatgacaaaggatcgttcagcaatatgtatctgtgtttgaatatattttgtatattaaggcatataggcttttttggctctaaatttattaatacaaacctaagtgtatatgcagtttaaaagaatattttcttataaaaatcagttcacttctcttagaagcaaacagtaaaatgttgtttatcagctactgggaggtggaggagatcagtggagatgttggtcacaggatacagttagatggaaggaaaaagttcaacaaaccaattgtacatgatcatgactatcattaataacaagatattgtgcacttaaaattttttaagagagattttaagtgctttcttcatgaaaaagataactatgtgaagtaatgcatatgttaattagcttgatttacccatttcaaaatgtatgcatatatcaaaacattatgttatacaacataaatatacacaatttttatgtgttaattttaaaaattagttcattatttcctgcaatcattacatatttgaaacacaaaatttcaaccaaaactgctaggtgaaaaagaaataatgaccgttaataataaaatagtattgttatctttttagtgtcctacaaattggggacataggaaagggaagaattttttttaatgagctaccgaattaaataattcattcattattttattgttttgtctattaacctatttacacccttaggtgtacataccatcaacaaaattatattcataccgaattataacatgaacattactaaactcttaacctctgcaatcttcttcttggaaataaatgtggaaaatcacttagctcatttagacggaaaaatctattgtaaaaaatatttgtaaacattaaaaatagaatacaaaattaaggaccactttgaataacagcctgaaaatgttagtatgtaaaaacatatgagaagattgatatgggtaaaatgaaagtgaggaggtagcctaaaaacagtaatagcaaggcaaagttgctgaggattgtgaaaactactgcaacaacaagaaaagtaaaattaaggaattttgactttacccttgaagatatttaagggttttttgtttgtttgttcgtttgtttgtttctaagcctgggagtaacattgattgttatccagtagatggattaacatagggacagcttggaagcatgaagatcatttaggaagctattgtttcattactgataagagattatgagtactacacaaagggagtaataaagtacatcaaatttgagatatatttctgatgtaggacagagaagatttggataatggttagtaagcagatgaggcagagtgaggagtgaggactcagtgggcttcacattcactattggaaagataatgatgccatcaggtaggagacagatgacaacgatggaaatagaagaaaataagatggcactgatgcttaatatgtaacaacttaaatcaaataaattgcatgatttcagatgctgtcctgcatgtattgaaaattcaaatatggagctctagaaaaaccaaggcatgcaataaaaattcaagtaccattctaacaaataatactaggaataaataaatttaaatttggccttctctgctgaaatataaatttatgaaacatatagaatcctcttcattatgatattctgcagtattttatagaatcttaggtacatatgtagattctttgaaaagaaataggcaggaaagagttctactaggcagattagagtaagcatgtggtcggatagacagtaagcaagatagatagtaagcaaacctttctttctttaatttttatttatttattttgagatggagtctcactctgtcgcccaggctggagtgcagtggcgcgttctcggctcactgcaacttctgctgcccgggttcaagcgattctcctgcctcagcctctcaagtagctgggattacagccctgccatcgcacccggctattttttgtatttttagtagaaacagggtttcaccatgttggtcaggctgggcaaaccttccttttttatgtttttctttttttcttttttttttttttgtgaggctgaagtttatggagtatgtattctaaatgaactcaagaatttctgttttaatattaatagaaaaaggatttcttctatttaggccatcaagcatcatttcatatattttttcaaaaaaataaattcagacatataatttatttatacacataatttataagtcaattatttcaattggaagaattataatctatatttttcatacattttgatgtaaatgaactgtatggataattccttgatataattctcttcaaattatctgtttccaatattctatatgatttaatctcctgtgccatgtaaaaagacaactggtcaataatctttttcagagttatttaattcaagctgctttgtaggtcagtatttctaaaaaacaattcaaggctttttcaagattcagaatattcctcgtttcatagaagaaagctaaaatgccagacaagcagaggcagataatgcattgggtcacgcctccagtatattcatatttaaaatctgaggtaaatctgatggaactcatgctgtattttgaagaatacccaaagttaaatacatttgaatctgggactagaacagcaaagccaaacatatgccgtacagtgagatgccatatagtgagattagtttcattttttttttttgtcattgtggtcataatacagaaaccatgagaatggggtattttaccacttggatgatcagaatttagatttttttgtaagcctacaacaagccctaagacatttatgttgaaagatgaatctttcaacaacatcttgaataaagctgaaagacaacacttgctcaaaaaggctgactacataagatagttgaagctactattctgtaagtttacctgttgagtcaagaaaatgactagtgttataaacatgagtaacatgaacaattatgtgatttagctttgaacataaacctagtttaagttactgtctttaatttcttctattttatttttccttaatggtgtgtgtgtgtaagcggaaaattgatgatgaatcagtttctgagcaagtaagtattacttctggctcctgtttttttccaaaaaggatctttgtagcaagtccaagtaagtctgcttttaaatataatgctttatatattcagaagaattcatagttgcatctttttcaatgcttaaaaatgtatgtaagtatatgtctgcatgtgtatatgcaagtataatatccatacctatacccacacattgtattcaaattatacttgaaaatgcatatataatctttcaaatacagtttaaaatgtataaagatcctatatacctacacatatatttttattctttcaggtacaatttgagtaggaggcagaattttaaatacaaaagcaggatacagagtgttacataagcaaagtactaagatatagaacttaaacaaatttataaacattttacaaaataattcataaatcttcagcatgtcaggtgtttcatatggagaaacattttaaactcccagtttaataagcattacacttgaagtctcagaagaaaatcaactgagctagcaaaagccaaaggatttttatgcatatggaaatattacaagcaatgaggaaacaaaatagtctttgtttttttgttaggactggcattataataaatgctatatctgtttcatactccttaggggtaacatgtattaaaactatatactctaattactaatcacacatacttagttcagactatatgcatataacaccattaattctgaaatgtaacataaattcagttagccgatgtaaaaatatgcaaaaataaacctattgaaaatgaacactaacatatctttccacatacagaattattaacccattattttattaaaatttaaaattatagaacatgtccttccttaaaaatttaaataacactcaaattgtcttattttttaataaaacagatggaactatagaaataaataaggatagcagagataagagagaaatggaaagaaggaaagagaagcaaaataattattttttaaaatgtcactaaagggtcacctgtctcacaggggttatgtggaaagtttattatctatgatcctgcttcttgatgagactcttcctggtacttagtcaagccggagtccaagtgatattcaaaaagcctttaaaattcactaagccagaacttcaaactcatggaaagaaaggataaattcaaagtagaagagatttatctttgtaaagtatgaagtaaagtcaccagtgcctgtgtctctctgaatctaactcaatgtgacaaagaaaattagaaacagaaaataaaacttcatcctcaataaaacagttatcaataatcccaagccaaagcacaaaagaattagatgacaaatattgtgaaaggaccaagataagagcagatatgaagagcaggtaggtgcctgctgctggagtaagccagcagaaagggcacaaaaatagttctcagagtaggaaactgatgaaaaattttaaaaaacaagaacaaaaattaaaaaaaaaaacttgcttgaaatataaggctgggccaattttccatcaaagagtgtttggggtagaagaaaagacactggcagaatttggaatttcagagacatgcaacattgagggcccatgaaggaaaatcagcagtcctgttgctactgttattcactggggtgacgaaaaataaatccattctccctctctcccacctctgtcacacacatacacatgcatatgcatatatgtgttcacacacaagcaattgaaaaaccaatattttcctctgagccagggaagattctgcttgtttctcattgacaaggacattgtgttgactcacacacattcccacaaatactaaggttttgaagaactaaatttaaagataagaaaaacttagaaaggaattagtgcaaaatagactgttgtgtttgtgtgcaaatgtaaatgtaaaaataaatgagtatgaaaagagccagacatcttatataagtattattttaccaagcatattaaaattacagctagataattttaagacaagtataaatattactatacaacaaaatatttaaggagatataaaagactcaggatatatattagttaataaaatgagaggaatcccaatggcagaattccagaaaaaatagaggataaattaaatgccagtattcactggcccttttgtttcctctccatgatagcagtgcaaatgcactgcttctagtctgccatcttgacccaacatccctttaaatgtattttctaactcattccctagcttctagggtgtcctggcatcttagctatggatatcccagtacctgcaggtcacaaggtaacagagactatgacagtcatctgggtctcctggaacggaggacacagagcagtggagatggaccccaagctctaggtggagtaagagacctactttgaattctttatccagcatcccaacatttcattttgtttaggattcaagatccagtattactatgctgatttttttctcatctggagaaacacttcttactcttgtttactttttttggggtgggacttttcttgaggatgtgcctatgatgtatgttgagtaaggccatttggctttgcttctgggtatgtttagtggctgtattagtctgttttcacgctgctgataaagacatactagacacgggggaaaaaaaggtttcattggacttacagctccacatggctaaagaggcctcagaatcatgatgggaggcgaaaggtatgtcttacatggtggtggcaagagaaaaataaggaagaagcaaaaggaaaaacccctgacaaacccatcagatcccatgagacttaatgactatcacgagaatagcacaggaaagacctgcctccatgattcaattacctccccctgggtcccttccataacatgtgggaattctgggatatacaattcaagttgagatttggatggggatatagtcaaaccatatcatttcacccatggcccttccaaatctcatgtcctcacatttcaaaaccaatcatgtgttcctaacagtccctcaaagtcttaactcatttcagcattaactcaaaagtccaaattctcatctgagacaaggcaagtcccttccacctatgtgtctgtaaaatcaaaagcaagatagttatttcctagatacagtgggggtacaggtattgggtaagtacagctgttccaaatgggagaaattggccaaaacaaaggggttacagggcccatgcaagttcaaaatccagcgaggcaatcaaattttaaagctccaaaatgatctcctttgactccatgtctcacatccatgtcacactggtgcaagaggtaagttctcatggtgttgggcagctctgcccctgtggctttgcagggtacagcccccctcctggctgctttcacaggctggcattgtctgtggcttttccaggcacatggtgcaagctgtcagaggatctaccattctggggtctggaggatagtggccctcttctcacagctccactaggtggtgccccagtagggactctgtgtggggactctgaccccacatttcccttccacaatgccctagcagaggttctccatgaggaccccgccccttcagcaaattttgcctgggcatccaggcgattccatacatcttctgaaatctaggcagaggttcccaaacctcagttcttgacttctgtgcccccagaggctcaccaccatgtggaagctgccaaggcttagggcttccaccctctgaagccacagcccaagctgtactttggtcactttcagctatggatggagcatctgggacacagggcaccaagtccctaggctgcacacagtatggtgaccctgggcccagcccacaaaaccattttttgctcctgggactccagggctgtgatgggaggggatgctgtgaaggtctctggcatggcctgcagacattttccccatggtcttcggcattaacattaggctccttgctacttatgcaaatttctgcagccagtttgaatttctccccagaaaaagggttttttcttttctattgcatagtcaggctgcaaattttccaaattattatgctctgcttcccttataaaactgaatgcctttaacagtacccaagtcacctcttgaatgccttgctgcttagaaatttctactgtcagataccctaaatcatcattctcaaattcaaagttccacaaatctctagggcaggggcaaaattccaccagtctctttgctaaaacataacaagagtcaccttttctccagttcccaacaagttcttcatctccatctgagaccactgcagcctggaccttattgtccatatcactatcagcatttggggcaaagccattcaacaagactctaggaagttcaaaacgttcccacattttcctgtcttcttctgagccctccaaactgttccaacctctgactattacccagttccaaagtcacttccacgtttttgggtatcttttcagcagcaccccattctactggtaccatttactgtattagttcattttcatgctgctgataaagatatacccgagactgggaagaaaaagaggcttaattggatttatagttctacatggctgggcaggcctaagaaagaatcatggtgggagatgaaagccacttcttacatggtagtggcaagagaataatgaggaagaagcaaaagcgaaaacccctggtaaacccgtcagatctcatgagacttaatcactatcacaagaatagtgcgggaaagaccagacctcatgattcaattacctccccctgggtccctcccacaatacatgggaattctgggtgatacaattcaagttgagatttggatggggcacaaccaaactctatcagtggaatagactctgtatgatttctttggttatacgtagtcttcatgtggtggcttctcaaatgctcattgtggtagcgatgtgcctggtgtgtcagcaggcccaaggcctcctaatgagcaagggtggtgtgaataatagtggtagcagaggtcatatgaggctaccttcccaaatgctgtgtacttgtgtcagcagatactgaaatgggctatgaagtagatcttaaggccagaaagtggtgcttataggtgagagccagatggcatggtcactagctctctcctgtaagatgttctcaccttgtctagatgatctctcatctacacccaaaggtgtaatctaaatgaagttctcaggttcccaggtggtgggttgggttgtagaacattcagtggtccttgtcccccactttgcctctgaggacagaggcagcatagctgggaactgggccaagcgagcctgcatgtgggcccctaatggtgggtgcaagcaccagccccagtagggttcggagtcagttctcgggtccctagaataacttcccaatgaggagcagaataatcattgctgggcctaagacccaggatggggaatgagagatggctcaggctctacagactagcaagtggtagtgggacctgctgtgctctcgtactcccaacctaggagggctccctcctatagtctgactctggcagaaacttagaacagttagccaaagcactcctagtttgccttcaggcagacctatcccaggccacaaaactttctgctggggtcaaaaccacacccactcatgtcctctgaagagggagcacccaagtactgtgcctgtggctggagcacataccacatttgcctctcaattctagccccaggggcttctcccctgctcaagatcataaatctctgacctgagactctccagaccagtaactgccacttgtgctggctggcaggtttccacatagctccctatgagctaggatacagaatggcctcattctattgatgcccagttctaggagagcatgcaggataatttctagggctgttcctgctcatagacttctgatggctccccaggttagatccagagcttggttgggacaaggatctccgttatagcctggattgcccagcttcccagtgggaatgtgcatcatggaggcaatcactctctatctcatgcactggggattcactcacaattttctgctggagcctgccacatgagttgttacctgcattttttttctaagtgcccaaagttttctttaactcttatgttgatctcccgtgttcctttttgcacagaagttcacagtgtgaatctttacacacaattttgctatttctaagtaggtgaggtatactaacaaagcctccaattacccatctggtgaaagaaaggtgtttaaaaactttgaaaaagagatagaccctaaaatgtaggtatttgtaaagaattcctataccaagacatacgttaattgtgatttactgtgaaaagcaagagcaaatataaagactatacaggcgatatacgtcatgatttttttacaaaagaaagcagagttatattttctcattctgaagtcaaagaagaattttatagctgaatcttttagtataggacattgggaaacatgatggaccatgtcttgatgtatggctttgcaataggtatagaaatgttcaaatgcacatcttttaaactgattctgcatgaaaattgaaggcaaaatgtaacatgctaactttgtgtggaaaaaaaaggattattagctcgaataatgtgctctagacacagatctaggagaaacacataaaatggattccttagttttatgtgagctctttttgtttgtcagctggcttatcattttgaaagctgatagttactcggggcatgcattggaaatacccacagattattgagcaaaacaacattgatctgagaagaaagccctctacaagaaaagaaatatccctaaatcaaactagcaatacgaaatcttacttacctagaaatacactaataaaagttattgattacttacgtgatcaattctatagactgaaacaatttagaataacaaatacagaaataaaactttttaccattaaatttatgtcaaaactccccagcataagaaaaaccacaacactgaacaaccctttcatcactgatttggcaaggagttacaggtgacaataaaaaataatgtcaaatcttaagggttctggtgtaagaagtcctaaattctatatctcttctgctaataacatgtcatttgaaaagccaactgatctatataatttttttatatcctcatataagaaacaaacataaataatatcagtatatcatctggccatagttataataaaagtcaaattaaaagtttctatgaaacccctttattaagataaacatagtaaatagataatttaatttacatttaaagatttctcatgctgaaaaaaagtatcgatgttttgaaatagtttatcagaaattattacaaaaggaaaattttcaaaagcccaacaaatagggtataagagggtggaaatgaactgtgaatggggcacaagaaaactttctagggtgatggataagttctatattttgggttcagtggtagttacacaagtaagtgcaattgccaaaactccttaaattgtatatgtaaaatctttgcattttattatgtgtaatcacaataaaaaatgtccaaaagctattgaataccttatgaaaagtctatttctctaaaaacattgcctcccccttccccataaaaagaaagagtaagggaaaaagtctacttcaaaacataagaaaaatgcaggaccttaattatatcatttttttaagaacttaatatcaaattttgattatctttcaaaaaaagaaaatacagattttgcagcaaataatattctcatgtacatttttcctttatttccatatgtgattacctttcttccacagttcaatacaaataattttactcacaaataccataatcctaaatttcacattttgtgtttgttatagtcatggtcattgccctcccatgcaacattgaatctgaaacaaacagtaactaatggctttcaattcatttctaatgagccattgctgaatatgtctgcatcattctggttttgtttcatggtattatgtttttacatttttcttaaattttacagtttctagtactttgcattaaaacaattcatcatctttaaaaacaaatgttaaaaaagaagaaaacaagcaaaatctattcttagatatagtactttttaaaagtccatttttttttaattttagtttatttttaattgacaaataataaggcaacacttttaatctgaacctggtattatggttctatgtgaaataatgagataacctaatacggaatgatttttttctaactacacctctaaacaagcaaaattatctttgaatatgtttctatgcagttctgtgaataaaatttaaagattttatgtatggctatgctaaattataatcttctgggcttcaataaccgtaagatatgttttcataactgcactcaggagacatcagaaggtgttggggttgaattgtatctccccaaaagaccttgaggtcctaatcaccaggatctcaaaatgtggccttttttgaaaatagagtatttacagtgatattcaaatgaaagtgaatccattagggtggaaactaattcaataggaccactgtcttttaaaaaggggggaaattttgacacagagataggccctcacacaggaagaaaactacaaaaattgaaggctgagatgagggtgattcttcagaagccaagggatgccaaagattgtcccggcaaagtaatacagaaggtatacagggagctttttacaattactatgatgcctgataaaactgtctcttcctccattctttcaactcagttttggtgaaataagagagttcatttattcattcaaaataaggtctttaataccttttctgtttatcactgcctgtcttcaaataatatgccacttcctgtaaaacataatagccttacaacaagatactgtgctttccccttttcttcctttgtgctactgttatcaaaaagcaattttacttaatcagttagttctaaggcctatttgtacaataattatttgaccaataattggtggtaggatgtatttatctgtcaaagaaagtatacttaactcctgagttactcctttttgataaaatttgaactacatgaggttccaacttttccagtgagaaaataataattatttagtctttcacaaatttgttaaaccttgggaactgagagatatcatacatatcaacatatgttgccactggcaacgtatgtatgattatatactataagcaggatcagatgatgatgatctcaaaccattgatgtggagtcacacctgtcttgttctggtatttagatttactactttttaacactgtgatttctgcataagttacggaaaatatctaagtttttgttctttcatatataaaataaacataaataaaatctgactaagagatttgctcaagaacaaaatgatacaaactgtaagtgtctgctatagataattgctttaattacttgtgtgaatttactgaatctgtccaaaagataatttgataaaaactactcgaatatttaatgtagacacactttgatccagcaattacacttatagtaatttattctacaaataaacatgcacacatatatacagaggcatatataattcctcaaataatagattataattgtaaaatattaaaaattccctgtgtctgttatatctgtaaactacagtgtagctataccataagaggatgagtgatctacctacccacacatattttgttcaaacctccggtttttgtgaaggaaaaatcttttaactcttaaagatagatattgtgccatagattgctattgcctgaactaaaattttgtcatggctttgcttttatattagcacttaggacttctatgcataaataaggtaaaaaaaaaaaaaaaaaaaaagcaaaacaatatctctggtaacacattaaaactttcatagtttttatttgatgtgttaagatatacataaataatcacaagtttttaacttattaaatgtcagactttttcagttattatatccattaaaaatttttaaacatttttataagagatgaaaattttaatgcatagtgcttcatgatttaaggtatttatttaaatactcataaaagacaaactaaggaaaaaaatgcttacagtcatctgggagcaaaccttcacgttgtctgaaagtcagctttgtagtgtccataagaaaagcaggccaaagcatcaacacaaatgccaactgcacaggcagcaaagagccagatgctgttggcaaaacatgctccagagtgtggcatctgggtccaataatggccatacagagccccatctgtagctaaagctgttgactctgctttgggggaagaaaaatcagaaataaagaaggcagttaaattttaaaccatgccaggaatagcagaaggcaggttgcagtcagcattcaaattacatcgctagcccaatttgctttttaatgtcttgaaactgtgtaaacactaaactatgttaactccagttgtttagagagatgagcacatataggtagttcagtaacttaggacacacaaatcagctaaatagatttgatattccatcagacgttcatttatctaatttttttctcaaggaatataagcatatggtccatgaaatgcaattctaatttgatctattaaaatatgcaattttaagtgttcattatggtatataattttcttcaaatagcataaaatttaagactcttctttacaatgtttataatattttattagaataactcttcacaaagttaaataggatattcatgtatccttcactgagactccttaaagttttgatcagtggaaatttgtgggaaagctacaaagaaccttaagctttaatcaaataaagtttttcaaaattataaagagatgatcaaaataatctctttttagtgttcttcatttgttgtacatataaatatataaaatggaattagttgatatccagatgattaaaaagattcatcatttataagatgccacactaatcttatctatgcatatatttttgaaaacaagatcaatgttttaaataataaaaactaatgatatttacagtgaactatatataaaaaagttaactaaaactttgtggacagaatattatttatcaccataaccctgagacattactattgttgattctactttctagctaaggaaactggaagcttgcaaatgtaatgtaaacttacttatcccaattcacacaaacccttagagacagaatcaaacttaatatgcagacactgcagacactgtgattgtagaacccatatttattctccttctccccaataagatgaaaataaaatataacttgatagaatcatttctgtaatagcagaggaagaactagtcaaacatacactcttccataaaagaaacttgtacattgataaatatagttaaaataagctgtttcagaactgtgtaaatgaactaaaggcttgaaacaatctccgtgtttattcaagaaaaatgattgaatctcataagcctaatcagcttcgtggttgtaaacaaccatccctctctccccagctcttcaatggacttgaaatccaatatcattgcaataatggtagctgagaaaccagcaacctaatagccagtggagggggaggggatagtacaggtatgcatttgactcaaaagacccttcccaaggaatgtcactatttcattggtttgacagcactctgaaaaactccattctcagggactgactttatttgacctgactaaaaattcactcttataaaaaaccatatatctagggaatttgttaaaaataatcagtggcaattgcttaatatcacagtgtttgaggcaataattccagttgagggcaactctaggttgatcaatataatcaaagatttaataactcgggaattagatgtacctagaagtctttgaaagctagaaaaaatcctggaaaactagaaaacatcacagcatgcaagtctataaacaggcctaagaaagatataaacagccctaatctctgatctctgactaaccttgaggctctatacaagcaggaagtaaagaataaagtacagttgtaaactgcctggctgagcattgaagacatgtctcaacacacacacagagtcctttagtaaaggctggaagatgttttagttccaaaaatctaagaaaaatctctgtgaaatgattcattttagctgaccactaagttaatcaagcagagactaaaatggccacacatggtaaagaacaatcccagtgaaacactagacaaatagtagaaacaacaaaaacaaaaacactagctactaggaaagagcaagatttgatttccagatgtaccaagttatgctatttaaaatgtcaagttaccagaaaatattataagacatacaaagaaataaaagtatgggccatgcacagaaataaaaccagtaaatagaaactgcctttgaggacacccgaatattggatttacttgacaaatatattaagtcagctatggtaaacttgttcaaagggaaatataaactattatataatcaattaaggaaagtaggagattgatgtcttaccaaatcagtaataaaaataaaggaagcaattattaaaaaattaaaaaacaaatagaatttccagagttggaaattataaaaactgaaaaacaaatgtaaaagagaaaaacaacgtcatcaaaaagtgggcaaaggataggaacagatacttctcaaaaggagacatttatgtggccaacaaacatatgaaaaaaagcttatcatcaccggtcattagagaaatgcaaatcaaaaccacaatgagataccatttcacgccagttagaatggcaatcattaaaaatcagtaaacaacagatgctggagaggatgtggagaaataggaatgcttttacactgttggtgggagtgtaaattagttgcaccactgtggaagacagtgtggcgattcctcaaggatctagaactaaaaataccatttgagccagcaatcccattactgggtatatacctgaaggattataaatcattctactataaaaacacatccacacgtatgtttattgcaacactgttcacaaagcaaagacttggaaccaatccaaatgcccaccaatgatagattggataaggaaaatgtggcacatatacagcatgaaatactctgcagctataaaaaaggatgagtttatgtcctttgcagagacatggatgaaaatggaaaccatcattatcagcaaaccaacacaggaacagaaaaccaaacactgcatgttctcactcgtaagtgggagttcaacaatgagcacacagggaggggaacatcacacaccagggcctgttggggggtcagggggatagtggagggatagcattagaagaaatacctaatgtaaatgatgggttgatgggtgcagtaaaccaccatggcatgtgtatggcacatgtagacctatgtaaaaaacctgcacattctgtacatgtatcccagaacttaaagtatattaaaaaaaaaaagttattggaaaaaataaaataattactaactgagcaaaacaagagacttaatttggcagaagaaagaagtagtgaacataaagataagtttattaagataattgtgtctgaggatcatcagaaaaaaaataaataaatgagtagatcctcagagatctactcacatatgagttccaaaaggaaaagggatagataaatgctttgaaaaattaatggccaaaactttctgaatattatgaacaaatgttgatctatacatccatgaacctcatcaaactcaaagtagaataaattgaaagagattgaaagttaatcatgatagtcaaactgtaaaacacaaagagataatagtgatagcatcaagaaagaaagtgatttattacatacaaggatcctcataagaataacaattgacttcccatcagaagccaccatgtagataagaaagcagcagaatgatatatttgaagtgctaaaagaaaaaaaaagactatcaaccatgaattctatatcctacaatgctaccttctaaattaaagcagaaactaagacattttcagataaacaagaacaggaagatttcataactagcagactaacatataaagaatagtaatgatagtcctttaggttaaaatgaaaagaaactatagaatcttaattattcacacataaaaatcatgagatccagtaatggtaactatattagtaaatattaaaaccagtataaatatgttttgttcataactcttttctctgtatatgatttaaaagatggagcataaaaccataattataacagtttgttgatgggcttataatgtataagatataatttgtatcacaataataaaacaagggagtaaaaaaaggggagcaatggtggagcaatatttttgcacagtgttaaaaataagttgctattaatgctgtgtaattgctttatcttaagaggttacttataatctataggtcaaccattaaaaattttctaaataatacaataaatgtaacaagggtgttaaagtggtatatcagaaaaaaatatctatttaacacaaagtaaggcaataatggaagaaggcagcagcaaaagagaagaagacatatagaaaacaaatggcataatagcagaagtaaactctaccttatcagtaattacagtaagtgcaaattgagtgaacattccaatcaaaagacaaataatggcagaatgtgcttaatgaaaaaattgttcaactatatgctatttgtaatagttatactttgtattcaatagtgaaaactaaattcatagcaaaaggaaggagaacataatgaaaattaaagcataaattaataaagcagagaataaaaaagcaatagaataacacaatgaaatctaaaactggtactttccaaaactgaaaaaccattaactagaatgatcaagaaaaaacagagaagacccagattacaagaatcagaaatgaaagagaagaaaatactacactcttccaaaaacaaaaaaggattcaaagagaatactaaacaattacacgctaaccaattataaaggctaaatgaaatagataactttacagaaaggtaaaaccacggaaagtaacccaaaaaaagtatagcatatcaataaacttacaataagcaaagagatttagtaataaaaatgtgttccacaaaataagtacatgagtagattgctttaccagtgactttaccaaatgtttacagaataatgaacaccaatccttctgcaactgttccaaaagagaaggggaaaattcttaacatgttctatgtggctaatattacccagtctaaatccagtcaaagatatgacaaaaaaagaaaaatacagatcaatatgccttaggaatacagaccccaaattccttcatgaagtactagcaaatggaattcagcaacatatacaaagaaatatacattatgaccaattgggacatatattagttctgcaaggttggttttaaaatagaaaaccactaaatgcaatatacaatattaatagaatataagacaaattacacatataaacagcttcattgacagcatttgaaaacattcaacacattttataaaaaacaaaacaaaaaaaacactcaacaaaccagaaacaggagggaatgtccaaaatctggtaaagtgtcccatgaaaaatctacagctaacatcatactttatggtgaaagactgcttgattttcttttaagctcaggaacaagacaagcatatttagtctgtcatttctaagttcaacattgtactggaagttgttgggataattaaacataaaacagaaaaaaacgtatcaatattggacaggtaggagcaaaattgtctccattatcagatattaaaaatcctaaggaatcgaccaaaaattattataactaataaataagtttactgatgttgaaaaatacatcatcaatatacaaaaatcagtgctgtctctatacactagcaaagaacaatctgaaaatggcatgaagacaattccatttctaataacataaaaagattcaaattcttaagaatagattctaagaagtacaagtatacataggaaacaataaaatattattgaaagaaattaaagaagattcaataaaatctctattaaagttatggctgccattttcttcagaaagtaacaagctgatactaaaattcatatggaagtacaaggatcccagtttagcaaaacaatgatggaacaaaaaaataagttggattcatatttcctgacttcaaacttaccaaaagctacaataagagggtgtggtattagaataaagataaatagaatagagggtctagaaatccttacaagtttgtctaattcatgttaaagttaccaagataatttaatatggaaagaatagtatttttaagaaattatcctgagacaactggatattcatgtgtagaagaatgaggctagacctttacctcacaccacacacataaaaattaactaactcaaaatggattatatctcaatataagagctaaaaatataaagtttatagaagaaaatacagaaataaaattattgtaatcttcagttagacaacaatttcttagctatgatatgaaaagcaaaagtggcaaaagaaaatgagtcaattggttgtcctcaaaattaaaattgtttgtgcctgaaaggacaccatgaagaaaaagataactcacataatggaagaaaatatttgcaaatcatatttgataattggcttgtatccaaaatatataaaatttcttacaactaagataaaaggtacataacttccattcccaaatgagcaaatgatatgaggagatattctcccaaaaagagatacacgaggtcagaaagcacatgttaagatgagctgtattattagtccttagggagatgaaaatcaaatgtgcattgaaataccatttcacacctactagaagggttaaaaagacaaacatcaacaaatattggcaagatgtggagaagttgacactctcatacactgctggtggtactgcaaaaattatacattcactttggaaaagagtttggaagttcctctaaaagttaagcacagagttactctatgatccagcaattctactctagttttatatgaaaaataattgaaaatatatgtctggacatgtattgcacatgtttatagcagcgttattcataatagtcaaaaagttgtaataatcaacatgtttatcagctgaaaaataaacaaatttgctgtaactttatgatgtaatgttatctggccataaaaaagaaacaaagtccttataactgctatgacataagtcttgaaaatattatgctaagtcaaacaaaccagtcaccaaaaaacatatattgcatgattccatttatatgaaatgtccagaacagacaaatcctagagatagaaagtcgattagggggactttatttatttcaagggggaagaaggaaatggggagaggctatggtaatggtatgagttcctttggaataataaaagtattctaacattagatagtggtgatccttgtacttctctacgaatctactaaatctatagtagttctctccttttccatggttttgctttctggtttcagttaccagcagtcaaccatgctctaaaaatagatgaatatagtataataagatattttgagagagagagagagagagagaccacattgacacacttttattacagtatgttatgatttttctatttaattagtagttattgttgttaatctcttaatgtgcctaacttatatttaaacttcaccatagttatatatagaaaaatacataatttatatatagatggtccccaactggtttgacgtgatgtcttgtctttacaatgggataaaagcaatttacattaagtagaaactacacttcaagtacgcttacaacaattatgtttttttgctttcagtggagtattcaataaattacatgagatattcaataatttattataaaataggaattgtgtttttctccaccggtaagttaatgtaggttctgagcatgtttaagggaggctaggataagctatgatattcagtaagtatattaaatacttacaagtacatttccaacttacaatttttgtcaatatacaatgggtttatcagaaaaataaccctattgtaagttaagggatatgtgtaaccctgtatagagttcggtgctatctttgattttcagacatccactgggggtcttggaacatatctcccttggaatagtaaagggggactattgtactgaattgtacacctaaaaaggtgaattgtatggtgtgttaattatgtctcaataaaattattatttagaaagataactaggtaaggaaattcctaagttgtaagtcatcctatttatatgcaacatatggaatacatacattatgctcatctcattaatatagcatatttagtgactgctcttttctctttacaatctagaaaagccaatatgaatataatgttcatattaatacattatctttataatcacaaaggagaagcacattcagaaaatctgattcagctaaactttaaattttatagccagataaaatgcaacaaatatctgaaatatgaaaataaataaagcaaataatatatcaaaaatcttaggaatgatgaaatgactaagagtttgtcttaatttaggtaacaaaatctcctgaaacatttatacatttaaatcactaggagttcacaataagccatgtcagggttatctagaaagactgattatgtatcatgaatattaaagtattttgaattaagccttgtagatgttgcttattttgttttcaatttttatgacgtctatatcaaatgcgatacttttatttaaataaaattaataccatgttggacaataaattaatatttgagtcctctcattttgttgggatatataagaatattttgaaccaataggtggacaaacataagtgatgtatttcatacacacacacacacacacatacacacgtgtatttaactcatatgtataagacattgttttgggaaggagcaaagtagcttctgatagccaggatattcaggagctagccatatagtataaagcaggtttagagctaggtgtaagtgttcttctgatgaccatttcaacaatttcatagaacatcagtatcagacatggctaatctatgcaaatgagagatcacaaaaactaggctaacttataatcatatcaaatagagacaaaaccaggaacatcacccaaacaaaagactaacaaaacaatcccctgtcatggctaatataagtaattgctacctcttttgaaaacattggctttcacttctttcttgtcttttcctccatcctcctaggtaagacttaccataaacctaataataaaattctgctcccttcttgacaacttatccagagcaaagacccactctttgaaaccatcccccaaaatacaagtagcaagctcaagtcggtaagtcctttctaacatccttttatttagatatccctgtggatctacatgatgtgttttctcccttgttgcaatgagttataaacccaacttttgcaaccctaggtgtgttcccagtggtgtttgtctggtgactgccaacagcatcaacacacacatacagaaacgcatatacaagttatcttaagaaattataggaagagctaaatgccaaaaaaaggatatatcagagtctcaatgaaagaaatactagaaaatttatagtacatattataggttataattaattaatgtaagaaaaataaaacagataacaattaatattatgtttttagttcatcaaaagtttattatttctcctaatatacaggtggaaaggttattaatatcaatttgtgttcatacatcaacttactaattgctaatgtcacaaaaatgtctctgggtctttttatttttatatatctttaactaatcctaactactggcattgtgagttttcctatattaccaaaattatttatttatcttttttttgtcacatagtatctatgccattattgccagctattgtggaattcaatttaataaagcaaactgcctactgttgaacagtctgcaccttataacccactttaatcaccaaaaaattagaaacatttgtgaaaagttttacaggcatgagataatccagaattctcaaccttaatcacaaggcaaaagagaatgtatgatttattttggaggacattctgaaataattttaacattttcctttgtaaaataatcatctgagtgtgtttgtatgcaattcatctgcttctgaacaagaaaaggatttagttatgatatacttgattatgcatctacataagagatgcaatgtatgccaaacaaatctaggattaaaaattatttaccaagggcagggcatggtggctcatgcctataatctgagcactttgggaggctgaggcgggcaggtcacttgagatcaggagttcgagaccagcctggctaacatggtgaaactccatctctactacaaatacaaaaattatccaggcatggtgtcaggcacctgtaatcctagctactcggaggctgaggcaggagaattacttgaacccaggaggtggaggttgcagtgagccaagatcatgccactgcactccagcctggaaaacagagtgagagtctgcctcaaaaaaaaaatttacaaatatatacgtggttattaagcttttggaataatagcaatagctactaagaatttctttttcatgtgtatgcatcattttagatttagggagtacatgtgcaactgttacatggatatactgcatgatgctggagtttggggtacaaatgatcccatcacccaggtagtgagcatagtatccaacagtcagtttttcaacccatacttacctccttcccttcccactctagaattccccagtgtttattactgccctctttatgtccacgagtacccagtgtttagcttccacttataagtgagaacatatgatatttggttttatgtttctgtattaattcacctagaataatggcctcaagctacatccatgttgctgcaaagaacatgactttgttcttcttcatggctgcatagtagtccatggtgtatatgaaccacattttctttatgcaatcccatgttgatgggaacctaggttagttctatgtctttgctatggtgagtagcgctgagatgactacatgagtgcatgtatctttttggtagaatgatttatttacttttggatataagcccagtaatgggattggtgggtgaaatggtagttctatgttaagtttttgagaaatctccaaactgctctccacagtagctgaactaatttatatcccaacaacagtgtttaaacgttctcttttctccaatgccttatcagcatctgttggttttttaactttttaataataacaatgctgatgtgtgtgagatgttgtctcattgcggttttgatttggatttctctgattaatgatgttgagcatttttttcatatgtttatggggcacttgttaaatgcgtatctcaaaatgtcagaaagatatcaaactaatgatccaatatcatacttggaaaaccagaaacataagagcaaactaattccaaacctagcaaaagaaaagaactaaaatcagagcagaactgaacaaaattaagaccccaaaatccagggaaataatcaacttaaccagaagttggttttttgaaagcataaacaagattgataaaccactgtctacattaacaaagaaaaaacgacagaagatccaaataagtacagtcagagatgacaaaggtgacattacaactgatctcacagaagtagaatgattctgagagacccttatgaacacctccatacacataaactagaaaatctaaaggaaatgggtaaatacctggtaacacaccacctctcaagattgaatgagaaaaaaattgaaatcctgaaaacaccaagttttgaaattgaatcagtaattttaaaaaaacaacctaccaactaaataaagccccagaccagatggattcacgccaaattttactagatgtaaaaagaaaagctggtacccattctactgtaactcttccaaaaaaaaaaaaaaaacaaaaatgaagtcgaaggaactcctccctaattcactctatgaaccagtattatcgagataccaaaacctggaaaagatacaacacaaaaagaaaactacaggccaatacaccttatgaccctcaacaaaatactaggaagcctaatatggcagcacatcaaaaagttaattctccaactaagcttcattcctgggatgaaactgtttcaccaaacacaaatcaataaatgtgattcactgcataaacagaattaaaaacaaaaaacacatgatgatcccaatagaagtggaaaattctgctatgaaattcaacatcatgctaaaaatcctaaatagactaggtatctaagaaacatatctcaaaataataagagccatctatggtaaacccacagccaacatcatactaaatgggcaaagtctacaagcattcccctggaggactggaacaagcccagcctcacaacttctattcaacacagtaccggaagtccgagccagagctatcaggcaagagaaataaataaaaggtatccaaaaaggaacaaaataagtcaaactatctctccttactggtgatatgattctacacctagaagatgctgaagactccaccaaaaggctcaaagtttcaggacacaaaatcgatgtatacaaatcagtaacatttctatgcaccaataacattcaagctgagagccaaatccagaatccatttacaatatgaaatctcatttacaatagcacacacaccaaaaacaaaaaacaaacaaacaaacaaaaaagcaaggaatacatctaatcaaggatgtgaaagatctgtacaaggagaactacaaaacactgctaaaagcaatcagtaatgacacaaacaaatgaaaaaataccccgtgttcatggcttggaagaatccatatcattaaaatggacataatgcccaaagcatgcacagattcaacgtatcaacctacgaatgtcatttttcacagaattagagaaaaactatactaaaatgtacgtagagtgaagaaagagattgaataactaaagcaatcttagagaggaaataaaaaaagatggaggcatcatgttacctgacttcaaactatacgtaagtctacagtaaccaaaaacagcatggcagcattgcactggtaaaacaacaacaataacagacacacagatcagtggaacagaatagcaaaaccagaaataaagcaacatactgacagccatttaatatttgataaatcaacaaaaataagcaataagggaaggaccccctattcaataaatggtgctgggaaaattggctgtccatatgcagaggactgaaactggacccttaccttttactatacacagaaaagtaacccaggatggactaaatatataaatataagacctctgactataagaatcctaaaagaaaacctagaaaacaccattctggacatcagccttgataaataatttatgagtgagtccacaaaagcaactacaacaaaaccaaaaattgacaagtaagattaagctaaagagcttctgcatagcaaaggaaactatcaacagagtaaacagacaactgacagaatgggaaaaataaagtggagtattctcccaatgtgatagtctgaaatatagtctgaaaccaggggcacaatgcactgtggaaagccgtagggacctctgcccttgaaagcggggtattgtccaaggtttctccccatatgatagtctgaaatatggcctcctgggatgagaaagacctgaccgtcccccagcccaacacccttaaagggtctgtgctgaggaggattagtaaaagaggaaagcatcttgcagctgagatagaggaaggccactgtctcctgcctgtccctgggaactgaatgtctcggtataaaacccgattgtacatttgttcaattctgagatcagagaaaaaccgccctatggtgggaggcgagacatgtttgcagcaatgctgccttgttattctttactccactgacatgtttgggtggagagaaacataaatctggcttatgtgcatgtccagtcatagtaccttcccttgaacttaattatgacatagattctattgttcacatatttgttgctgaccttctccttattatcaccctgccctcctactacattcctttttgctgaaataatgaagataataatcaataaaagctgagggaactcagaggccggtgcaggtccttggtatgctgagtgccggtcccctgggcccactgttgtttctctattaaaaaaaaaaaaaaaaaaaaagaatgggaaaaatagtcacgatctatgcatccaataaaggtgtgatatgctgaatctataaggaacttattcaacaagcaaaaaacaactccattaaaaggtgggcataatacataaacacctactcagaatttctatttggagtttcttcagaattctcatctaagaactaattaatacaattgaattatggaatatgtggaaaatttatactataaaatatatcaaaaattttactaaaataatccaaaatcacaataatctctaagtaaaaaattggaagttttaatttagcggactcactcctttcttgtcagagtgtggtagttctcatactgcatggaaaggtccaaaacaatgttaagatggcaaaaacatgttttgaagaagtaaatgcatttgtatcattaccatattggaacattgcattttcaagttaaaatttgtttatactttgttgacatctgcccttcagtgttttcaaatttcaaatgattgcgacaccatcttgtcagtaaatggctcttcattgctggatggttattttaattaaatgtatctaaagtgaaaataatgtctggatgtatcccaaggacactgagcactccaagtaatttcatgaagaaagctaaaaatatgttactcaccgatagcttttgtaaaggtcagtacaggtggaattgttcttgcaaggattcattttacactcattggattcttgttcacaaaaatttccttcccaatcagataggcacacacactggtagctctaagagaatatgaaattatatatttttaggctatttcttactattaagcctataatacagatattactcctggccattttgatatctctgtcaatttataatttttttagttttatagaatgccaatactccccccaaatgacttttaccacatttttaaaagcgtgtgaacagtattctttagtatctaattaaataaagttttgtagtaagtcaatagattctacagaaggtattaaagatttatgcattatgctcacaatgtagaattatcatctttgttaaatgttttaaaagaaaaatagcatgttagtcatatgatggtagatgatggagtataactaaataactaattaaacaactcagcaactagctcacaagttaaaaatacaagtataaataaggaaacttttgacagatttattgttacagataaatatttaaaataaattaacagacttttggtcaattaaaatcgtaaaacttttcatggtgtttttctgaaacagagagttgccctatgacaatgtaattcagaatgctagaggtaaaattttgctttcctagtattgggcaaacaaacaaacaaaagaaacactttaaattactctgtgaaaatactttctatatgaaaaatatttttgaagaatagagctcttgtcaaaattagattttgggcttttgtctgtagagaatctagatatagcattataaaaacggtaaaatcaatgttaactgttatttaaatctgcacttttcaatacagtagccacatgtggctataaaacattgaaacatggctagtaccatttaagatgtgctataaatataaaatacatattgaatgttgaaaagttagtattaaaaaaggaatgccaagtatctcactaaaattttttattatttactttcggttgaaatggaaataattttgatataaagagttaaatgaaacgtacgatttcaattaatttcatttatttccatagctttttgtagtggctactagaaaagttaaaacacaaacagagatctcttttaatttctactgaacagaggtgagagttgagttagataatgccagcccagtttctccatttgtggatagagttaagaagtctatatacttataagcacaatgtgatgagtaggagccctgagattacagaacgcatcttagtttaatacatctcaacatcctgtacagatctagcaccctatgtttaattaatgttgattaaataaacagaaaaaacaaacatgatatgaccaataatttaaaggttgaagttagtagccaaaacaaaattcaaaatgatccttcatcactttggtacatttggacagcaaattttttttacaaacataacaatgaaacatgataaccagaagaaaaataaatgcatgctccatgtatgtgcatttagtttacaacagtttaaatgtataagaagttctactcagtactgtgctttggttgaacagggccaattggttttccatgctaggtattaataactagcttaaaagcacaagaatgagagccaccttttcaacattgtgctttattcttgacacatatactagtctccactcagaataatctttaagggtactccagttttgctggattttagcagatttttttttcacataccatgctccctacattgttaacttcctccatgagtgtggtaacatttacagttttcattggttgcgtttggcttattttttctttttttttttttttgtaaacattaaaagaggacttacataaaaattgaatataatgattatattttgttttatgaatgtgctatttaaaatgaaagcaattccacaatagtcaagacaacatcagctgtggtgaatgggagaaaatcatcccactcagtagcataaatggcatatgcataaaatcttcgggacatgcccattcgttatgttctgaaatttctcatattatggggtataaattatttatgtaaagacaaatgcataagcacactgctgatttttattttgatgcctcaataatattttgaaacaaatttagtgagtcaaaaattcagtcaaatttttcctattaaattcatatatttcttaaaagctaataactattggtattttcaataacttgataattagtagaaaattgtcaatttcagggtatcattatcattaaagtatcaggtactatagcagtgaattccagatatgatgaactatatacaaaaagaaaacataaaaggatgaagaaaatataatttaaaaaattaaaatttaaagatgtaaatgatgaagagaacaaaagtgcatagcaactaaaaataacccagagtttgagaatttttattcatcagtatcttacttgattcaaaagcattttcctcaatttagacattcttgctgcaaagcagtttctcattcaacattgaataattgattccagtaatttaaaataactgttccttaaatttgcactggtcaatacagtggccagaatagtattaaataatattaaatattgtatttaatattattaaatattaaatattaataactattaaatattttaatattaattataaaaatagaaattatattccactagaaaactgaaatataattaatattaatatttaatattttaatattaaatattaagtaattattaaatattaaataatattaaataatagtaaatactagtattaaatagtattaaatagtattaaagtaaaatactatttttaaaagcacattttcagccaattttgatggaaaaggaaagtattattaaaatgtgtttaccaaaaggagtaaaggtttacattatttattaaattagaatcttatcattttttaacttctcactacaaagtagacattactcttcctactaaacttggataaaacagtagtttgaaaatatgcatgtgacaggaaagacagatgataaaaacacaggtctacaatattgaactctgcagccagtgagaaaaaaataaagacaaagctgtcaagtttgatagttgtaaatgcataaactatatagtagttcactttttcagatcaacagccagatattttaaatttttcttatcagtaacagatgtactaaagtaagatggatagcataattgtgaacatgaattttcaagttagagagattaaacaatatctctgatgcttattaaatctctagacatctagtatattagttttctcttactgcctaaaagattactacaagtttcgtgtcttaaaacaacataaatgtattgtctcacagtttcaataagtcagtgtacaagagtcagtcacctaaatcctttgctttcggtctcaccatgctgaaatcaaggtattgactgggatgtgatctcacctaggaaatggagttctcttccaagttcaatgattgtagcagaattcatttcattctgcctctaggactcagatctcattttcttgctagctaccaggtaaagactactctcagcgtttagaaggtatttgcaggtccttgacacatggcctcctcctctcacagcatgccagtttgtttttttaaggacaacaggagaatctctgctgttacctcttgttttgttaaaggcccatttaattagggcagcccatgtaggacaaccacatgtttgattaaataaaagtcacttattgggggtgttaataacactgtaaaatctctttctacatataatataatcatggaagaagtatcatatttacaggtttcactcacacccaaggggagattttacagggcatatacaccaggagatgggaatctcgaggatcatcttaaaattttgcctttaatatctactaatctacttaatctttccaagtaacctactcaagttctccaagcctcaggtgccttcatatgtaaagtactaacaatttatacttcataaatatacttaagccttgaaggtagtaataactataatattcttagcctagcgacaaataattatcattaattagtagtagccattacctctaggcaaaacagtctagatctaacaacgtcaaagaataattgacagaagtaccacgattggctcaaacctattcatcaatacattacttatttttataaacatttaagccatgtaataagagataaccagactaggaaaaacaaagaaggaggaagagcaagagaatccagcaatatgtaatttatgaacacagacttacatgaagtggattaatataagaaaatataaatgaggaaaatgtattcaagatgaaatagaaaatcacactaaaccagtagacatttaaaaatataccaaaggagggagatttgctaacatagactcaaacaaaattactcccaagtctttatttattctcttatgccacataggtgaagagaatagaaaaacaggaaaaactactcaaattattttttgagactatcaaaacctagctaccaaattctagcaagcatataacaacaaatagaaatttagccaatgtttttaggatcaaaaagtcaatttttttcaaaaaaacataaatttagatagtcgaaaacagtaatgtatttaaaatacattatatagtttgagctggaaatatgccagaaatggaaatatgcctcaacacaagaaaatcttttagagaaagaaaaatggttttatcatttcagagcagaaaaatattttataaaattcaatacacattctaaaaatttcttttagcaaatgaaaacaaaatgggaatgtacttacattaacaacaactacctacaaaatgatttaaaaaaaccctgccaaacatcagtttatcaaaaacaaatgtagaaactgaataaaaaatatatacacatatacatatacatatatatatatatatatatatatatatatatatattgttgaattgttacaagaacaactgaagttgactagatcttctaaagctaaagagataagaagcaagcaaagttaagactacagagggctctgcttttcaaaccaggacatctgcccatttgcttccagataagtagttgcatctagataagcagaaagtagtagctggagtttgcagcagcttctttgaatgaaaagaaaacactagcattcagcttggtcaaggagattaggtccgtgaagagaagaacagagaagtgagcccacaatttgatcagccctattctatagaggcacttgttccctttcaaccttgtatttatagtatgaaattacacagaagtaaagcattagcagtctagtagtgcaaggaagataaaagttggagtttagggccagcaatatcttacagtcttgttaaacacttctagctttcaatgaacacaacagaggggcatatcttgaagaaaaaccagcaaaaaaacaaaaacaaaaacagctttaacggcatgaaaaccatacttgcctaaaatgtgatcatgcattcctattctgtctgccagaaaaataaaaataaaaaatcctctttggaagatgttaacattagatggagcttttcaaagtttgaaacaaatgtctgccattcaataaaaaagtttcttaaatgctgattaccaaatgtcaagagacaaactgacagtagaaatatactattgagatactgtgattattggatagagatttaaaaatacttatgatgaatacatataaaaatatagaagacaaatagggaattccactagaaaactgaaatctataaaagagacaaagaaaaactctgagtttgaaaattataacctgaaatttaatgacttaatatattattttaataatagacttattagacagaattaataaacttgctagtaaaagatatacagattgaaatatttatataaaggatataacagtcataaaagaaaacgaaatatgggaactaatgaaaatagccattatttgtttaattggaatatcaaaaacgaaggtagagaaattgggcaagaacaatatttgaaaaattgctgcctgagaattttcaaaagatggcaaaaagagagtgaccacagatttagaaagttcttgagacctatgctggatacataaaaataaaactttatctagattaaaacttctgaaaatgaaagacaaggagtaaatcatacaggcagccaatgaacaaagacatattatcttcaaagggacacaaagatcacaacttactccccagtatcagaagcaagaacccagtgagccaacatcataatggagtgaaagaaaataactgccaatttaaacttctatacccagtaaaaatacacttcaattatgaaagcagaacaaactcactttttacaaaaacaaaacctgagaacttactgcaatgtttaagattgtgggaatttgttgacagatgacctggatttaaattcaggctctaagaattatgacttatataattttaagcatgttacttaatttcaaggcacatcagaaataatgctacctgcccaacgagggtataagaagtacagcactgagtataggacgtagtgtaatatctaacatagtaagacaaccataaattttaactaaaatgttctcatatactgtgacttgtccaggtaagctaaactacttctcagtctctgtgatgtttgtttcctttactttcttccacttggaatgactttgtctacttccaccaatccctgaccatactttccaagttttatccacctgcaaatgtcaaaacaagtgccacatagtacctgaagctttgataatttccttcagcataccttctcttacttactgttttagattttatgatacatttaaagcatgttagttacttatgtacatataagctgtattctgcttagtgcttattgtatttaaaaatatcttaattatattattgcgtatttctctagtttctaaagtataaattccaagagggcagaaactttctttactttgttcaacaattatcatcaataataacatctggaatagtgtctaatgtttgactgaataggtgctagagattggaacatctataatgatattcattggtactaatatagtcatggaggatattttatttatcatttctagatatttaataatcttattttcctaacaagaaaaagacttttttaaaagaattcatttaaataattatttcattacaatcaaccaaaagcagttctataaatgaaggattaaaatccccattgaaagaaaacttggattgcttccattttgaaaagtttttatacattagaattattgtattttattcagtcttagccacaattttttactaacatgtgtgctttgtgaaactttctattagattactgaaaatgtagatatatactgaaaaaaatagaaatttcaaattatagtctctttctgatcattatttatgtaactcttgaaagaaggacaaatatttttctttgctttaataaaaaaacttttgaagtaaaatttgtaatgaatttaatccttgtaaaaataaagggctctccctattgacttattatctcttttatttaaatgttattttaagttttcactttaattcataaatacttatagagttggctatagacacaaaggtttccaaatactgaatgctgatactcaggattatacataaaaacactaatctttatttataaaaacaaacagaactatcttaatatgatttctttcagcaagagaaaatgatttatcttggtgctttaaatctaaagtaaaataatatgtattattctgacagaaagtaaatggaatatttagaaacaatttctataaaaagttacaaacactgaatttgattgaacatattttgaaataaggcaaagaaaatacactttacaatgagtgatactttcaaggcaaaacttgtagaaaaacacaatttcttttacttgggaaaatgtaatacaaatacatgaagaatatgaaaagtcacatggtagaggaagataatatagagtataaatcaagctatactggattttgaaaacattttctaaagaaaacataaacctctaagaaacttagtcattgttcccatgtgattatacttttcattagtaacaaaaaaaaaagcaaatggtcattttagtgcctaatattccaaatgagaaaacaaacattaagtataaatttccactggttttatttcctatatctagtaaatctactatcaaaataacttcagctgtttgtctactatgctattttcaatttatagtttttattagtaatctttacttataatttagttctcttacggcatgccctaccttcataaaccatttgtgatcctttttaagggttcctttacctttaatgtcggtttaaaaaaaaaaagaatttaaaactagaataaagaagtttagactaactgtaataaaccatgggaaaaaataactcatctgtcattgatgtgtactgctcaaacatatttattatgttttgaatattatcttccttattgactcaatttgacaattagagatatagtctaatacccaaagctttttccctagtacacaaataataagaatatagaaaatataatcttgtatgagatgatcacataaagatgacagtatataaatgtaattctgcaacatatagttttggggagcattacatgttttggtctgagagccaaatgacaataataatgcaagtacaccatggactaaaaatcacttgtaagttttgaaccacaagtacaaaactcatttccagtattatgacctcaaagaaaattagcaactgaggcagagcaagatggtggaatagaaagcttcgtcaatttttcccccacccctggcaagggcaccaaattaacaactatatacactgaaaacaccttcataagaaccaaaaatcagtacatacaaaaatcagtagtatttctatatgccaaaagtgaacaaactgaaaaacaaatcaaaaacataggctaggcatggtggctcacacctgtaatcccagaactttggaaggctgaggcaggtagatcacctgagatcaggagttcaagactagcctggccaatatggtgaaaccatttctctaccaaaaatacaatacaaaacaaaaaattagccgggcatggtggcaggcacctgtagtcccagctactcaggatgctgaggcaggagaaacacttgaacctgggaggcggaggcagcagtgagcagtaattgtgtcactgcactccagtccagcctaggtgacagagtgagactctgtctcaaaaaacaaacaaccaacaaaaaaaaaatcttaattccatttacaatagccaaaaatgaaattaaatacctaggaattaaccagagaaaggaaagatcacaataatgaaaatatacgacactgatgaaggaaattgaagaggacatcaaaaaaatgaaaaaaaaattccatattcatggattagaagaatcgatattgttaaaacatccatactattgggagaggacatagttagaggctggctacacacacagagagggagagtcttgggagagaggcagtgcgcatggaaacacactggcaccacccttgtggtgtagttagcaggaaaaaatatggttaagaacttcctcttataccaggatgtttgctcagaagggatttattgtgcaagcacaataaatcaactaaatgtcctgaatatgacccagagctaattgtaatatcatcggcattgcagttttggctccctatcccatgggttttgcttaggcattcttgggtaataactacgatggagtcactatggtctactccagatatgcatagatgcaacgtccccgggggagcgggggaactttactcctcctattaaggcagaacctacgaaaggctttcttatttttccccacagaaaaaatatccccagcactcagaaccatttctggcaactcgctttgggtcccctctcactgctaataatttttctattgctttacaaattctgctctgccttactcactctctggtgtccacatgccttattcttctttgtcctctgacaagaactcagacctcactaaattaaggaatagagaaactgcaatactatgcaaagcagtctacacattcagtgtaatctctatcaaaatatcaatgacatccttcacagaaatagaaaaaaaaaattccaaaatgtatatgaaaccacaaaagacccaggatagccaaagctatcctaagcaaaaagaatgaaatggaaataattacattacttgacttcaaattatactacagtgctatagtaaccaaacagcatgttgctggcataaaaacagatacagaccaatggaacagattagagaacccaaaaacaaatccacacacctacagtgaactcatttttggtaaaggtgtcaagaacatgcactggagaaaagacagtttgttcaataaatggtgctgggaaagctggatatccatagacaaaagaatgaaactggatgcctatctctcatcatgtacaaaagtcaaatcaaaatggattagataattaaatctaagacctcagactatgtaactaccacagaaaactggggaaaatctccaggacattggtcaaatatttcttgagcaataaccacaagcacaggcaaccaaagcaaaaatggacaaatgacatcacatcaagttaaaaagctcctgcacagcaagggaaacaatcaacaaagtaaagagacaatccacagaatgagaggaaaatttttgtaaattaccaatctgacaagggactaataaccagaatatataaggatctcaaacaattttataggaaaaaaactctaataatctgatcaataaatgggcaaaaaatttcaacagacatttatcaaaagaagacacacaaatggcaaacaggcatatgaaaaggtgcttaacatcactgattatcagagaaatgcacatcaaacaatgagaaatcatctgaccccagttaatatatccaaaagacgcaacaacaaatgccggtgaagatgtggagaaaagggaatccacttatactgttgatgtgaatgtaaatcagtacagtcactatggaaaacaatttgaggttcctcaaaaaactaaaaatagagctatcaaatgatccagcaatcccactgctgggtatacaccccccaaatgaaaatcagtatatcaaagagatatcttcacttccatgtttgttgcagcattgttcacaatagccaagacttgcaagcaacctaagtgtccatcaaaagataaatggattaaaaaaatgcagtacacatgcacaatggcgtactattgagccattgagaagaatgagatcctgtcatttgcaacaacatggatggaactggagattattatgaagtgaaataagccaggcacagaaagacaaatcaaatattgcatgttctcacttagttgtgagacctataaatcaaagcaattgaattcatggacacagagagtagaaggatggttaccagaggctgggaagggtagtggatggtttgggagatgtgggaatggttaatggataaaaaaaaaaaattagggagaacgaataagatctactatttgatggcacaacagggtgcctatagtcaataacaacttaattgtacattttgaaataactaaaatagtgtaatttgattgtaatttgttgtgtaatttgtaacacaacagatgaatgcttgaagggatgaagacctcattctccatgatttgattatttcacattgcatgcctgtatcaaaacatctcatgcataccataaatatatacacctattatgtacccgcaaatataaaaataaaaataaatgcaacctccttcatcaaaaaaaattagtgcctgtaaaagtggaaaaatcgtctaggctttttcacagcaaaacagagacaaataccaaacaaataatatggtatttgcttattgtttttaaatattttcaatacctacttaaatagttcatttaatcacctggtaaaataaaataaaatgaccaatatgagataatataaagaaacgttcaactgtattttagcctatttgacagttttatgttctgtaaaacttctaatattttacatttattaggatttttttctgtaaaatggttttaagtttgaactgaaagcatttttatgtaattctgtatatatatcacacataaaatatatttgtataattatacatacacaatgtattacatataattataaatatacctagtatatataataacatacgtatataccatatgttgtgtgtatatgtatataacatcaaattttggctgggtgcggtggctcaggcctctaatcctagttgttcgggaggctgagacatgagagtcgcctgagtccgggaggcagcggttgcagtgagcgaaaatcgcgccactgcactccagcctgggtgacagagtgagactccatctcaaaaactaaacaaaacaaaacaaacaaatttaatgtcatctgaatctaaacctcactttcacagagattaagaaacaatcttcaggccgggcgcggtggctcacgcctgtaatcccagcactttgggaggccgaggcgggtggatcacgaggtcaggagatcgagaccacggtgaaaccccgtctctactaaaaatacaaaaaattagccgggcgcagtggcgggcgcctgtagtcccagctactcgggaggctgaggcaggaggatggtgtgaacccggaaggcggagcttgcagtgagcggagatcgcgccacagcactccagcctgggcgacaaaacgagactccgtctcaaaaaaaaaaaaaaaaaaaaaaaaaaaaagaaacaatcttcagcaaatatacatactgtaatcaaactgtggtgtttctttacattttatatttcataaacataataatttcttggcaattggtaagaggaattctggaaacattacagttagacacacaatcattggagtgtaaataatataaactggcttcatatcccaggaccttaacaattattgaatgacttgtatatctgtaggttatagttccttgataagaggactattttgtcttatggttagccattatgattttgttgctggctgatagactacctgctttgcattagaaaccagtaggggtaagatgggggatataaatactcagtcgtagttgtggtaaccatgtaagcggcaggtgagaagggagtagaacaatgtaagaatacttagaaaaaatgtgagctacaatttcgaatatccctgtcatcatcagcatgttggaattccataattcctcaataataattccaagaagcaaatttgctgtaaaactcattaatttatgaaaacaagccctccaatctgtgttttgcattgtagaatgtgttattattgacataatcattactcctctcctcagagtaatcagggatatcagaagcataagtgtttttttcttttccttcattattctttattttttgaattcaggaatgaaggttctgttgtcattctatccacagataccataaatattttctacacacattaaaccactcatgatattgacttaatgtgaatggagacatgggtaaaatgccctaggcagatgtcagggtatttgattctggtcccagatgctatgacatgtaggctattgaacatcttatccaattggtcataactggtcttaattttaaatcaacaaatttgaactcagtgattttttttactctttcaattctaaaatgattatatttttattgccttatttatagtttctaaaagcaccagatattaacaagaactgtctctctattgtgccaagtattctgaccagatgtctaaggtgttcctagtgattggttaatccctgagtaacaaaactatgttgtaaagtttcagctgcaaacacagttaagtagttcacgactcaggattttttttttttttttttttttttaagaagaaccactgttaaagtttgtctttgttgccaatcacttaccacagtgcatgggcaaatgtgtgtttaaaaacttgcagagagaaatttgtattactgagtcacaatgattgatgttttacttaccaagcacataagtgatattagtcttaatgcctttcaattgaataaaatcaatggtaattttcaggtatagaaaaaaagtggagtctctaaggctaagtttgacttgtgatttgaagtttacaaatagttttccagatattttcttaatcctgttaacaaatatttataatgagaggaaattactaataccttctcattataaatattaatatgaacaataaaagtaatctttgattatgtagaatatgtaaatagttactttatagtcatatgtcatataatcattttcttgtaaaataagggataattttaagcaactgtcttcaaatgttaagacaaaaatgattttgaaaggatttttccttttacctttttaaattgctgtcaataattttttaacaatgtagaacctaggtcactgaatacagtgttttgtataactttgttttttccaatatatattccaaattatttataggttttccttttcattttctacttttagaagagccaattgtgattcaacttatatctacaattctgagtctgttcccaaaatctttgatgtcacaaaataaatccgtgccatcttacatttggcatttctatatttttccttctttttaacttttatattaagttcaggggtatatgtgcaggtttgttccatagataaacttgtattatggtggtttcttgtacagaatattccatcatcaggtattaagcctagtacccattagttatttttcctgatcctctccctactccctactgccacccaccaccctctgatggtccccaatgtgtgttgttcccctctatgtgtccatgtggtctcatcatttagctcccattgacacatgagaacatacagtatttggttttctgttcctgggttagtttgctaaagataatggcctccagctccatccatatccctgcaaagacatgatttatttcttcattatgactgcataaaccatagtgtatgtgtaccacattttctttatccagtctatcactgatggtcatttaggttgattccttgtctttgctattgtgaatagtaccagagtgaatatatgtgtgcatgtgcctttataatagaacaattgatatttatttgggtatatacctaggaatgggattgcagggttgaatagtggttctgtcattacatcattgaggaatcatcacactgtcttccacagtggttgaactaattgactttgattatggaatgtagccctttaaagacgtgtttcccaaaggaacattttggtcagtggtgttgtatgtatctgttgttgtaaactattaattattcaaataaattttaatataagtaaatgaaatcctattatgatcatctaactgtagtgaacaggaatgaagtgatcagttatcctttccaatatatcatatatatatatatatacacacacaatttatatacacataaattgtatatttgtatatacatgcatatctgtgtgtgtataattcctcttcctctttaaaatactcaacagctacactgttcacctctcagtcatttataagctaggaataatgtttttcaaaaaatgcatgcttcatcagtacaatggaataagtccagagggaatttataaggcattttcatgtattctattcattttattacatcattaatcctctcccaactcacaatcctaccaatacacctttataatgctcagtgcacttgagttgcaattcagcttctgttttgagcccttatgctattaggcaatttacttagcctatctttttatttataaaactagaaaaataataggaaatttgggggagataatttctgaagcggtttttctatactcatatactaaaaattcataatttatctatcatcataattattttattgatccattagtattttaaaattctcaatccagagttttcattcttcaactctagtgaagtcaccaaaaacataatcataacttcctcacgtttcccctaagaaattttctatctccaaaacctcaaattatgatattctgttctttgtcactacttcttcagctttatcactcctaaccctgcacttctattctagttgctattcttctcagtatttctcggttagcacacttgctttctagccattagttctttctcttcacttttcagcataaacaccatcataagggggtttccaaaaactacaccactagtagtaaatgagatggtctgataaacagaggtttattttattttaaactttatttatctagttgtgttaaataaaaataaactgtttatctaatttatctatgtatctctttatctctctctttatctaattgtattagatagataaattgtgttatttctttactctaaattgtgttacaaaaacagaacaagtaggtggggcatggtggctcatgcctgaaatcatagccctttgggaggccaaggcgggaggatcacttgatccagcagtccgagaccagtctgggcaacataggaagacaccctatctttacaaaaaaaaaagaaaagaaaaaaaaagcttgtcatggtgctgtatgcctgtagtcccagatactcatgaggctgaggggctgaggcttgagggacgcttgagcccaggagtttgaggctgcaatgagctgtgatcacaccattgtactccagcctgggcaacagaataagaccaggtctcctccccaacaaccctcaaaaaaagagagagagaaatatagaacaagtgcaccaaattctgaatagattaccgaagagtaagtatatcttaattaaaaaatgatttaggtggtataaacatttgtatcaagaacacaaatttctataattttgattagctcgatgaggcttaaaaatgtgtgcccttagtcctattatcatatctccttgcttctgtattactgtactcaggactatttgaatgatattttctatgtagtttaaaatgttttgaacttttatggtaaaagatatgcatatgaatgtgtgcgtgcatgtattattctgagtgtcactctacagacaatggtttatctttctttagcagaaaatctctctctaggtgtagtaagctagtgttctgattagaaagcccacattctaaagatagttactgcaaatacttcagttatctttatctctgaccaacactcaatacttttgcaaatagcaaaatattaatttacaaattggatttcattagcgaaattattattaaacatatatagacttagtaaatattttacagccattcttagttacttcttgaccaggatgtagtgagccctatagtcattagccataggaatggcaccctaggtttgataatttaattatcctttacctctcccttcgttcaggaatttcccattcttttgactctgaaagatgttaagataatccaacgacttgaatattgtcaacagtgacctactgtgaaacttttatgcaagcaatttctgagaccaccaaaagatagagaacagagacctcattgatgcaataaatgtgtgcacgatagcataatttggcctatggcttgtttttgataaccaagtggtaaattagtgaggaaggaagcaactcatacaattttagctattcgtagtgatagagacacaccaagtagaaactaataatattatctatgttcaaacagattttagtcaatttccaaatccttaagtacatttctattcattttgtcagatgagtgaaataggagtcttttgtatatcaaaagttcactgaacaattaataacatacagcacatatataaaatgctgaccaacagcaaaatatttctttagaaaataaactcttttaagttgtaatacataatatagaattacaatatattatgttgtacttttttattaggtaaaacacacatgaatacactacctacttttaagcaataggggttaatatttcctgttagagattagaaagcaatggttatcaactggattttataaaaccttacatctataacttctcaacaaattttaccttttatgattatcactattacatatttttaataaacacacacttctcacactatttgaaaataagatctatatcatttgggtttaagataaaagtagctcaaattttagtgagattttaatatagggctctcgatatgtattcatgtaaattatgaaggaatttttatttcctctttaatttggaaataatcactttttaccatctgtctgacttccttcccttcaaaagttttcatacaatattctttatgattaaatggatattcagcattccttattccttaaaggaaaatctttcaacttttataaatgattttatttaattattagactttttagctttatgttattactataatgtgtcaatttaaaatgtcatatgttaaattacatttttctttcctgtccactgagataattcgtatattctaattttagtcaatatttgttgataaaatatcttatgtttgttaaggtgaatatttgggaaatttcctgtcacagtggcggcaccagcaagcaattcatcaaagtatgagctatattctttgctctttagcggatgcaaaataacataaaatatgtctttttgcctaaaaagcaaaagtatggaaagtttctattaataacattaataaaattgagttcattgaaatgaattctatataggctgggtgcagttgctcacacctgtaatcccaggacattgggaggccaaggcaggcagatcacttgaggtcaggagttcaagaccagcccggtcaacatggtgaaatccccatctctactaaaaatacaaaagttagccaggtgtggtggcatacacctgtaatcccagccactcaggaggctaaggcacaagaatcacttgaacctgggaagtggaggttgcagtgtactgagatcacaccattgcactcctgctggatgacagagtgagactccatctcaaaaaaataaaaagaaattaattttatataaaacaatttaccctcatgcccaagggtaataaataaatgctattaaattatatcatcataatattaaaactgcaaaattgaagcacagaaaattcatgtagtcttttttggataccataagtatttgctaaatatgtattaaatgatctgcatcctaggagtttgaaatactttagcgaacagaattgacaaaatattcctgcttgaatgcttgtctgaaaattactataatgtccatataggaagatcatagtattgaccataaatgatcataaaaagataataaaatagctattgtttataggcctttttgtccaatatattatatatgttattacaatgtaaatgtatatatattttattttttacatataggaaagtaaatgcattgatatatttgtaaatgtgctgattaacttgtcactaattgaagaatcatataaatgaagatcattcagacttttcattcttcattataaatgaggaaagcaaaatgacaaaataaaagaaaaacccaaaaagggaaattttctaactcatgagtacccccatgagttttatactttttatatagcatcatccctaacttttttcatttattttatagaggttatcagatttattacaaagtatactgaccattcaattggttttatatgctccttgattgcttgcttttttatagtttatgagcagaaatattttagatacatatattaagatacagctacctacaaactattactgaaaacagaatatattttatatattagagatacatagattgtgaatcagtttatggcttgaaatttgttactgaaagttctgtcttttttaaaaggcagcgactttaagaagtgtttggttgcctaatagctgctgaaaattgtgagtgtgtgtgtgtgtgtgtgtgtgtgcgcctgtgtgtgtatttcgaagtctattcaaaatgcttgtccattttactgggttgcgaaatgggtataaagggtacagggaatttaatttaatctggttaactgaaagttactccatgcctttgagttggagaaaagacaagttgatttcttatgagtgaattatttgttattaaatgtatgtttttctgagttgttgctttattatttatatagataagtatcaaaatatgagaaaaaagattcatttgtcctatatgctaatggatagattatttttagctatgagaaaagagagcctaaattggtttgttagtatgttttgtcaaaatctagaaagaaattggtgttggggggggtattgtttaacttgttaaatgtttaagcttgttaatgatttggcagtcctgatggtttaatttaaggattgaaatatgtcatattctattaaaattaccatggcttagaattaataactgttgacaagagatgtagagtataaagccaaatatctgcttctctttatgtgaggacgaaaacaggttaggtggtcactctggggataaaagatatggccaccttcaaggggctttaggggaaaatctgttccatttccttttctagcttctagaactgctttcttatcatccttggtttatgcccaccttttccttcatctgtaaagacaacagtgtaacatggttgcttcaatcctcacatagcctttttcttctatcttcaaatctctttctgcttccctctgataaggatactcctgattacatttaggacacacacagataatccaggataatgtcctcaatatccttaatttaattgcatctgcaaaatccctattaccatataaagtaactttcacaagttccacaggttccaggaattggaacctcatctctttagtggccatcaagtctaccctttgatcatctggctactctctggcattctatatacaaaggtagccctccagttagcacatcaaaaagccatggttttcaaattaaattccattgcattcttaaattatattctactaattacatgaaattattttttctttgaagtttctttctaatcaactaccactaccttattactgggatattatctttagcttcaattatggcatccattttccatgtaatctgcctgtctctaaccatactcagtcctacttcatagcagccagaattacttttctaaaaattaaacacagctatgttactcagctccttagaaagactctgcttatttttaccattcatgggacaaaatctaaacttacactttggaataagctgttcactgtagtctgagatcaaaactccattttttttttttttaagacagagtctcactctgtcccccaagctggagtgcagtggcatgatcttggctcacttcaacctctgcctcctgggttcaagtgattctcctgtctcagcctcccaagtaactggaattagagcaaccacacctggctaatttttttatttttagtagagatggggtttcgccatgttggtcaggctggtctcgaagtcccgacctcaggtgatccacctgcctcggcctcccaaagtgctgggattacaggcgtgagccacagtgcccggcctccattgtctttcttatcacccacatcattccattcagtacaccatatgctcccactacactgaggattaacactactttacaaatctgtactataaaattaactccagtattttgcttggaaatctcccatttatcattcaggaaggcaggtgctaaatttcataacgatttttctcccttctgcaatgtataaaaatggctgctccatcttttgggttttcacaattcagtcttatttcttgtataatatttgttgtatggtgttaattttttaaaataaccactctatcccctcaacatgaatttgggcatgtgaaaagtactgtgcccagttcatctttgtagtcccaaagcctagaactcagcagaaagaagacattggacaaatgtgattagttaaatgaatgaggccttcagaggcaagtgaaatgaactagtgcccacaatacaacataaaagacaaatttgtaccctctcttcaagattacagccatatataacactagagtcctctcaagaaataatctttgattaaacaggaaattaacttcgatttttaaaataaatatgggtatttattattacttacagaaacagtaaaaaaatgtatataaaacacatctgttaacacttgacccaagatttttttttatgggaagtttaaaattactcagtgatgcagttgttctataaattttccactgccttgaaaactatggcaattttatattttcaaaacttgtttaaaaaataattttgctgatcaaataaatgtgttattctttcaaaatatatttatatgagtttcttcatttacaaattaaattttaaaatgtttgcaatttttctgatctaaaacctttgtatattcactcaaaaatacttttctccaatcaatctctttctccttttgaattgttacctgagagggtctgattgctttatatagatgctcgaagcagtattatttttttcagaaaataaaacaatcacattacctaggaccctcaatttggcttccaaaattctgcttgtcaaaagctggattgcctactccatgtttattttctttactagtcaatagccccattggctgtttttgtggttgccatggtgtgcccccagatctgtcttcatagctgaggctctcttagccccagcttcccagactgttggcagttgaaaactcatagctgagtctttgcctaggacctgtccttacctgaaaggagatgctttgctcttcttccaaccccagaccacatccaatcattgctttatatgaaggtacaaagaccaagctcttttccctcaattcaagatatctctaatgaggtaccccagctcaagcactttctgtgggattgcccaagatctctgttataattgctgttcaaattgtctatttctctttccttcactctctcacagacattgttttctgagtatttcacaatcaactccttgcgtgaaaaaaaaaaaaatctcatttcctaaaacttttcctggggaatctcccttaaaagagttggagaccggcatggcctaggacatggactgtaaaatgatgctttgaagctaaattgtcagctgaaagaaaaaagtctctgtcagtggttgcaggtggagtgtgaatggcccatagcatgctgtagtagggcaactgttaaaacttgctactagctggggactggatcaggataccagagaatgtctttgcaaatgcagtatcacacacatttgtgaggaacagtgggagtggaaatcacaataatgtaatcagatggctcttgctgggtatcattaaggcattgaaaaaggcaaagattaagggtgaataatcaccattttaaagaatgaaacttagggggtcactttggaagcatttagactccattcttggcagccacagatctgtaaaaaatgagggccaggtccaggacttacttctaaggacagtagagcccaaattccctggaacccactaggactgtagaagaagccacttcttttgcttgaagatggtgcagacatctctgcattccaagataataacatgaaactgctctccctaggatttaatcccacatagctagtgatgttaagattatatgataagccttccaagcaaagtcttccttcacacagaggttactagcctatctccacacatacaaaggcagtaaaaggtctaaacaattgtaccaaatgtgaagtctcaaaggcctagtagaatttcaccttggtactcttcagtctgtgaccccagatgttacctaaactttccaatctcatactatgtaaaattgctttagattgtcataccaatgattataaaatctgtggctttaatacagtagctatttctataataagaatgtaatacagttgttccatgaacaacacaggtttgaaatggacacatacatttataagcagatttttttcaataagtattgttggaaaatttggggtagatttgtaacaatgtaaaaacctcaaatatgaattgccaagcctagaaatacaaaaaaaaaaagttgtgaaaaagttagaaatgtaatgaatgcataaagtgtatgtagatactagtttatcgtattattcactaccataaaatatacacaaatccactgtgaaaagttaaaatttatcaaagactaagcaaacaaacacagatcatacatagtgctcatacatcccgagtagctgggattacaggcatgggctcctatgcccggctaatttttatatttttagtagagatggggtttcgtcatgttggccaggctggtctggaatccttgacctcaggtactctgctcaccttggcctcccaaagtgctagaattacaggcgtgaaccactgtgcctggccactgcaataattttataaccacctcctgtagctattgcagtgatcccaagtgttatgagtagccacttaaaacatcatgtgatgctaatcatctccaagtgagcagttatctctccagcaaattgtgcatcacagtaaaaagtgatttttcaaagttcttatagatttttcttcctgtttagtacaatacgtaaaccttgaataacaccactgaacccatatgaagtgccactagtgatgctgcaagtgctcccaaagagcagagaaaagtcatgacattacaagaaaaagttaaattgcttgatatgtaccatagaatgaggtctgcagttgctgccattttgagataaatgaattcagactaagaaccattgtgataaagaaaagaaaatttgtgacaccatcactgcagctacatcagcagatgtgaaaactgcacttctttttgtgaaatatatttatttttaatctcatatttaaaatgcagcttttatggagattcaggattgctctaaggaaggcataactatagactctgatataatgcaagaaaaagcaaaatcattatatgataacttagagcaaaatgaaggtgaaggatttcaagctggaaaatttaatgccaacaaaggatggcttgataattttaggaagagtttggcttaatacatttcaagataacaggagaagcagcttctgctgcccaagaggcagcagcagagttcccagatgccaataagaaaatcactgaggaaaaatgatatttgcctgaacaaatgcagatgaaagtgtcctattctagaaaaaaaaaaagccacaaaggacattcattagcatggatgaaaagtgagcatcgggacttaaggcggtagagataggctaactctactgttttatacaaacacacttgggtttattatgatcagggctgctcttatctataaagctgctacacactaagtttgaagggaaaaaaaataaacagcttccagttttttggttgtaaaacatgaaggcctggacaatgagaaacctttttctgacttggttccattgatgctttgtttctgaaatcaggaagtacttagcaagtaagggactacttttaaaaattcttttgatagtggacatgcccctagccactgacaaccccttgagttcaacagtgaaggtgtcaaagtgctctatttgttcttaagcacaatgtgtctaattcagcttctacataggggatcataagaatatttaaggttaattacacacagtactctctagaaaggattgtcagtgctggaagagaatcccgatagagagaacatcatgaaattgtggaagaattataacattggagatgcctttgttgttacagaaaagtaatgaaagccatcaagcataattaagtaagttcttgctgaagaaaactgtatccaaatgttatacaaaacttcccagatttatgatgatgccaatccaggaaatcatgaaagagattgtggatatggcaaaaaaaaagaataaagaaaaaacatggtcagggggtaaagcgtttctagcaatgtatcttggagaaattcaagagctaacacacaccacaccaaacaaattagcagaagaccacctgatgatgatttcttatgaaccagtgccagaagatgagaaagaagacgtggaagaagacatagaaaaagcattgccagaaaacattttgacattaggcaatctggcagaagagttctgattgctcaacgttggttttgatttcttttaggacatagactcttctataatacagctactgaaactaaagcaaatggcaggagaaggattggtactgtacagaaacattcctatagaaatgaaaaagaaaacagttatgacaaaagttactatgtattttcatgaagttacagaatgtgtctctctcctgcctctccttccacctcttccacctctgcgactcctgagacagcaaagccaatccctcctgttcctcctcttcctcactctagccaatccctcctcttcctcactctactcaatgtgaagacaataaggaccttaaagatgactcaattctccttaatgaatagtagatatattttctcttccttatgattttcttataacattattttctctagcttactttattgtaagaatagagtaatgcatataatatagaaaacgtgttagtagactacattactggtaagtcttccagtcaacagttggctattagtaattgtttgaggagtcaaaagttttacatagattttgactatttcaggggttggtgcccccaacacccacattgttcaaatgcaatttaacatgttacctaccaataaatattaatactaggcattataggtcttatctctaggtatgttctttagagtaaaaagcctactttcccaattcacctctaatgtatatgaatccaaattaaattaataagtgattgagaagaatcacaggtagaaaaatctgtaggcattttaatttttcaatatctccactatatcaggtatcattttaaaatataatttataataaatatggatctgacttcactattattttgtactatatgatttatagccctatataccgaaaggactagaaatactgttatttttataggagcataattaagtaaaattgcccaatattctttgacaaaataatacacctaggagaatctcagcctttcagaaaacaaatctataggaaagacatcttgttgattcacttaacagatacttactgactacccttctatgtactaggcactagccactgggcaaataatcaataagctatatcacatcattactcttacgtcataagtaagacatagatgtcttccttatgtatgtgtatataaaatcatcatagtctgtgctgtgaagaaaagggagtgttaaaacatacatctaacaataacacataatttagcttggcgggttatgtgatttttttatcacactttgtggtgaaaatagtttacttttctctctctctaagagtcccaaaggaagagattgtgtattgtttaccattctatattcattttaaagcacagcattgggaaactttattatttttgaatgagtgcataaactaatctagaaaaacaaactgagagcacataaagtcagtgattcatggagcatttattaactgaagatagtgctaagtctttcctaagtcttaaagactcaaagtgtaaactgcagtataattgtggaaaccaaataatggaaaattattctttggaaatattacctgcatttttcgtaaagcaggcattatttctcatttttaaaatgggctttattataatttccaagtcaaaagggtgaaattcctttctgttttagataaacatagataagtcaaattaaaatatgagacaaaatatacagaaagataattcattttttccctcaaaagcaaaggaagttttaaataacttaaataaatttagaaaacattcattgagaaagagaatatacacagcagcatgaaaaagcatttcacattggattccatcattacatttatgagcttctaagaattcacagattataagcacattatcaaagtaatttcttaaaatcatttgtttatatatttataaattgccttaaggaacaaccagagacatctattcaaaaatcgtatgtacagcataaagcactaagcaaaagaaatagattctggccaagttaaccaaaataaagaaaagtatgaaaggggatataatgtatttgaagactattgggttaacttacaataaaataagggaaaataaaagccttctcatgtaaaatccaaggtacttcttgtgattcaaacggtcatttttggcagcttgatctgaatcacctgaggtgcttgttaaaaatgatggattcttgagttccagctcataattactgaatcagactatctagtaatggcctccaggaatctgcatttttaaccccatcaggaaggataattaagcattttaatatttgttcttagagtgactctgctccaaagtttccaaatacaatgtttttctacaaatgtcaaaaatttgggggagattaaactacattttccactccaagttgcagaaccgtctctatcttcatgtccttataggatacatattatattacactgtcaatggcattatttgtgtggatacttctctcttaagttttccataatttatgagcttatttagactagcatcttgatagtctgtgtataccgcacagcacaaagaacaaggacttttcacgtttatgtgcttaaatgttacttgaattgaatgacattgataacatacaagagtaatgacagttttatgggtaagaatattacattgaatggacttcttggtgtgtgcataaatttaaaattgtaaaacttattctgagtcttattagttcattttatacaagagtaaaaaatgacagcaggctcatggttaaatttaatggaaaccagaggtccccagagaatcaaagtcataatcaatcatttcttttctcatatatttagtaaaatataccaagtttcaaaatctttttatttctctgaaaattgcatttgagattgattaggtcaggagctgcacacatttttaaaatcatttagctgctcatcctgatatctctctgagaatttctgatattgattagaaactgcaccacttattgaataagatataaaaacgataattttgtttttgacaacacccgcctgtattaatttatgtgcaaaaagacagctttccttgttaaaaaaaatacattactataaatataaataatgtaaaattcaagactcagagcaaaaactccttctctctgtgctgtaacttaaaaataattccccaggaggaaagggctctggttatttggacagtatatgtgagatgcagacatctgttaggatattttttcccttatttttttaaaaaagtttttgcattgtagttccaatctctccaatacgtgtcatattcacatgaatagctgtctttgcaaaattaaacaaatgaataaataaagccctgaagactcattattaacaagtgaccatttgtttcaaatattgtttagctaaaatagatatcccatataaactaagagttaatagaatcacaggggcctttaataaaattctgtaagaacttttgctggaaaagctgaatctcctaaaaatcccttcttttgatttttataattcataaattttcttttgatttggtaagcaaacattatcatttggtaataattattttgaaaataaacatttttattacatgttattgaaaatatatgttaaatgaaatgcctatttaaataaaactaaatactgtactaaaaactggaggcctattttatgtgatttttttaaaaaaagctaatttgataaaacattttatactatattttcagtaatatctatagagaaatagctgcagtaagttcaaataacattttaaaataaactagtttgactgaaaatatttgcctaactttattaaatgaatctattataatgatacataagcatttttaaatataaatgaaatgaactaagaatacaattattactgaaaagcaagtgacagtaaaagaagctatcaaactttacattgtttgaatatattgaaccgcctcttttttgacttacattgttcaaatatattcaacagcctcttttttgctgaaatttcttggcaagagttcattaataagtatgtgatgaatgtaaaataagaaatattcaaagtgccatgccttactattttacatattggcctattttataattcagagtggtgtttggtttattcaggctgctattaaaaaaaaaaacatgaactaagtggtttataaacaacagaaatttacttcttataattctggtgactgggaagttcaaaatcaagtttgctgacaaattcagtatctgctgaggcctacttcctaaatcataggtggccatccttctaccataactttacatggcagtaggaaagagaggactcccccttttataaaagcagtaatctcatttattgggggctccatgatctaaccaccttgaaatgctccacctactaataccattgctttgggggtaggattttcatatatgaattttaaggggatataaacatttagaacatagcagccatttttatcaagtagtgtttattatacatcatgaaattcatctccattcaagacaaaagagaactatgtttctgtcactaatttattggcataacttattttattgcaattcacaaatattgagattttttttttgcaaagggaaggtttgtgggaatcctgtatcaaatatacttatcagtactattattttttattattttttttgagacggagtctcattctgtcacccaggctggagtgcagtggaatgatatcggctcactgcaacctctgcctcctgggttcatgtgattttcctgtctcagcctccctagtagctgggattagaggcatatgccaccacgcttgcctaattttcgtatttttagtaaagatgggattttgccatgttggctaggctggtcttgaactcctgatctcaaatgatctgcccacctcagccactcaaattattgggattacaggaatgaaccactgcacgttgccttatcagtgccattttttctaacatgtgcatacttcatttctctgtgatacattttgttaattctcacaatatttcaaatgttttcattattatatgtgttatgttgataagtgatcagtaattttttatgttactattgaagttactttggggcactattaatcacacccatacaagatggcaaacttaaataataaatgttgtgtgcgtctgactacttcaacaactggctgttctctagctctctccctctgctaaagcttccccatatcctgagacataacaatattaaaatgaggccaattaataaccctacaatgacctctaagtgatcaagtgaaaggaagagttgcacatgtctcactttaaatcaaaatctagaaataactaagcctagtgtggaaggcatgttgaaagccaagagaggctgaaagctaggccttttgcaccaaatagtaagccaagctgtgaatgaaaaaaaaaaaaaaaaacttgaagaaaatttaaattgcccctccagtgaacatgcaaattgtaggaaagagaaagagaaacagccttattgctgatagagtgaaagttttagtaatctggatagaagatcaaataagtcatgatagtccagttaggcgaaacccaatctagagcaagaacttgactctcttcaattctgtgaaggctgagagaggtgtcaaagctgcagaagaaagtctgaagctaggagaggtgggttcatgagttttaaggaaaaaggctatctctaaaacataaaagtacaaggtgaagcagcaagtgacaatagaagcagcaagtgactgtagaagctgcagcattattcagaagatctagctaagatgattgatgaaggtgactacactaaacaacacatttccagtgtaggtaaaacagctttctgtcagaagaagatgctatgtaggactttcacagttagagaggagatgtcaatgcctgaattcaaagcttcagaggacaagctgacactctggttaggggatgatgcaatttgtgacttgaagttgaagccagtgttcatttaccattccccaaatactaaggcccttaataattatgctagatccagtcttcctatgctctataaatggaaaaacaaagcctggataacagcacatctgtttacagcatggcttactgaatactttaagcccactctttagacctactgaccaaaaagaaaagattcgtttcaaaatattactgtgctttgacaatatagatgatcatgcaagaattctgatgggagatgtacaaggagattaatattttcatgcctgctaatacaacatccattctgtagcccatgaatgaaagagtaattttgactttcaagtcttactatttaagaaatacaattcataatgctatagctgctgtagatagtaatttctctgatggatctgggataaataaataaaaatccttctggaaaagattcacaattctagatgccattaagaatattcaggatttatggacagaggtcaaaatatccacattaataagagtttggaagaagtttattccaatgttcacagaagactttgagggattcaatacttcagtggaggatggaactgccaatgtggtggaaataatgagaactagaattagaagtggagcttgaacatgtgactggattgctgccatattgtgatcaaacttgaatgaatgaggaattgtttattatggatgagcaaagaaagcggtttcttgaaatggaatctacttctggtgaagatgctatgaccattgttgaaatgacaaaatgggatttagaatattacataaacagttgataaaacagtggcaggatttcagaagatttacttcaacttaaaacaagttttactgtggatgaaatgctattaaacagcagcgctataagataaatcttttgtgaaagcaagagtcaactgatgcattaggaaaccaaaaactgtatgactcgctttattgctatattcgctttattgcagtagactagaatcaaagccacaatatctctgagttatgcccgtattttaacaattttatgaagtaaccaatgcgaacttaaaacaagatgaaaataaatttttcctacacagaaatgaaactatgttagtgtactagctaattaattatattattagttagtggcataaatctcaagattatgagaaacttgatagaactgacctaagtagagctaactgcccacctcccgtgggaaaaaaagaggaatcataatggctttcctgattacatttaatagcataattctgactgggaattacactttgcactacttttctttgtcttttttgagcagagcaggacctgtactctggaagcatctgactggaatgaagaatgaggagagaaagcaaagatcagttgttgacaggtagattaatttatagctgtaatggaataagaaatgataaggggaataagtaaaataaataacccaagagaatcaagatttaaaaagtcaagcaaaacacttattgctaacatataataaagataaaggactgttagttatgcaagagaagtgtttaagcaatatagtctcctgaaaaataaaggatattttaaaagatatactattgtatagattaattagccaacatgattaatattttttaaaattcccactaagttattgtgagttggacaaattatttttagtagatgataaagtaaataatattttcaacattattctgggatgtcaccacaataagtgatgcacaatccttggagacactaccaaactctttgttccaggtgatggtgtataatagaatctccttccagtaaaataagtgacatccttttagtcctctattgctaaatttttttaaaagaaaaggaaagaaatacagtaagactttctactctgaactgggcaataataaaaaatgtgctgcaagttttttctttccttctctataaaaaaaatggcaatgcaaattttattgttatttcaacatgccacaataatgtacaatcattatgaagaaatgatctcagtttaaatgctacttccccctttaaggcattaaaatagcacagaaaaatttcagaggaatcaagttaaatctaggtcatcaacagaatatatggctggtttcatgaaatggccccaatttgtgataagattgatcatattttaaattagtctgtagcctcaagataattctccagaatgccacaataaatatatatgtctttatatgctgtatatttattgtacattagtaaaacatgaattattaaatacatatttctataaatagcagctgcatttatattacagcatgtctgatattagctaatatcattgctttaatatagctgtattaatacatatactttgtgttcctatctccttcatattgaagaatgatgtaggtttatatgttgtatatgctttgttatgttttatggtgagacaatataagaatatcaagggaaaaatatgtttaaaatcattagcaatgtcaaactgaatgagaggacacattctagttttataaaactaatgatttctcaccaggcctaagactttaatagttgagatgtggtttgtcatcttccatttcatttaaaaatactttggaaattgtccatttgagtgagttaagataaaaaaaaacctttgaggcttaaaaatacccttaatttaaaactggatatcttaaaagagaataagacttttcaggaaggtactgctctcattttaaaacaaaacaaaataacaaaactgaggcccagatttaagtcgctgtaattcaatcataaaattcacttagaaaaggtttgatcaataaatcaataattatagaatttgcctaaggttataaagcctcggtggatgagcaattcattcctatatcacataattattaagcattgattttaatccaggcaatatactgggttttatagattcaaagataaataataaacattcctggctttcaagaactgacatgagaaaaagaatacgtaaagctactgaattagaatgcaaggtaatagagaaacccaagaaaacctaaaacttaagtcatattttgtcatattgctctttaaagtccttaactgacttccctctttttagagtaaaaatcaaagtttgtatgatagcctaccaggtctttcatcagctgcctctatgccttctttctgaacaaattcacttttgttcatgtttttttcactggagccacccttcacctccatttccatttcttgacagatcaaacatgcccttcttaccttcttctaaccacctggcaaaaatcatcatttcttctcttactatacccatatattttatcatattggtcaggtaaccgaagcatagaaagatgacataatttcctcaaaattatagatcctgtacatggttgagccataatttgcatacgggagtctggtttcagatccaacatcttaactgctttattttaaaccattttgttttactgcctcactagtaggggaatccaaaaagaaaagaaaatgcagaccatttttaaatggtttctctcaagaggtttcctccttggctttgggttagaagggaataattggatacaaaatggagggagagggggttgtaagtgacaatatggaaaacagagtttggccaagcttagaactactgccagatgttaccagtggctgtgtctccaaagaattaaaaaccagtaatatgaaagtacctcactgtaggaagggtcccctttttaaacgaggcaactctagatttcaataagaccaggccacaatagtacttgtagcaagagaaatcaagagaagagaaccatgccagcattaatatctttcctttccctctacaggattggcttaattagtgggtgtggcaaatgtaaatataatgattcagtaagcacaatcaatgttacactattcccatttttaattatgtatctctgcatggtacctttttcatgttggtcagcccattaaatcaaatatttaaacaaattgaagatagcaacaaagttttgaattactgtagtagaattaattcaaagaaaaaaagggaagacaaagcaagtttaattatagtgtattcgtgaatcaattataataacttaaatatgccaacactttagattactaataatgcaacattaagaatcatttatttactgtgttgctttttattctacattttatgtgtatgtttataatttaataacttctattagtaggatctgtcatgcacataatttataaattacatgtattttggaaatatatgaacaaaaccttgtattgaaaggagatcaaaatcaaagaagtttgaaaagtgttggcagaaggctgactaaatagggacatagaatcaattgtaattgagtcctaatagagacacattcaatctatatagatatatatgactttgaaaatgattttgagtgcttttaaaacacttaattgtattataatttaataatttaaagtagttatctcctatttgagttgatagatatcagaaaatattaaagattttgtttataatttaaacaaaaactgattttgttgattgtatttatgcttaaccttaataaagtggcaacttctgagtgaaacccaaaatacagttctaaaataatatttttgtatatgatttgtacagaatcgttacccttcagctgtccagtaacaacatttaaatctatacaagaaatctttgaaaataaaatccttatgatgcttgtcagtgcctgagaaatggatgtcaagcataaatctattaaataaatagatatcatggattaaacggttcttattttataacattatgaatttcatgtcggttttatttttcctccacactgatattctcgattttaaaaagataaagcgttcatattacgcatcatcttttgatttactcatagagtaccactgaataggaattagctttgaaagaggtcatctatgggcaaaatgtcaacaggattgctacactgcctagacagaataatgtacaatatgaagtaagtgatttaattaactgaaactgtctcagtagagtgcacttcttatctagtgaagacataaaaaagatagataactgcattatgtcaattaatctactcatatttcagggtgaatataagaaatgcgggagcatatgagctatttgtgtcaggataaatagataataaatatatatagcttcactcaattgagtcaatacaaccagttttccccccacacaaaacttatacttttgatgtttccactcataaacaatgatgcttccaacataatatttttaaaaactcttattacaatttttaaaatcattatttaaagatatttggatactattataaagcccatttaaggatttctcctactttttacttctgttgtactagtatgtgttaatggggttactatgaagtggatatgctgatttaacaacaggtgctgaacattttcttgatgaacattttctaggtaattttttttttctgctaagttttaagactcaattttgtggttatttctccctgttttaaacatggtgagataatctcctgtacgctagtccttaaacagaaaagtcataaaaccatgagtctaaagaagaccagtctttggcacaagtttacatgactttgtagcatttaaccaccaagctcttaaacacctggcatagagcatctttatttagcaaagtgaggaagcagaaaagtagagcgctgtctaaagtaggcagagactactcaactccaggaatcctgtttgtattagaatcccgtctggaattacgagatctgattattcaaaagaaaatgaaaatcctgattcttatatgatgaaatgtgtccattattaaattttgaaaaatgattcaaacttaaaacattgtagaccaactaatgaaaggcaaactggacttctgaggtcagatatagtctctgggccctccagataaactacccttgacatctcccttccaatcatgtagaagcagagatgaccccattacagactgattctcccattggatggcttttcttctaaaggagcagagaggttaccaaactatcaactgaaaactaaaagacatatgataatattttccacaccatttttgtgaagaaggatatactgatgatgactgtcttggtagtaagatttgaaattactttttaaaaaattttaattgtatttgtccatatctttttaaactgcctacaaaagaacatgtattagtttttcactcagatttttaaatgttattaaataattatgtaaaaattaaaaaaggaagttcaatgctctgtaatcaattttcgtgtacaagaaaaacaaggcagtggcatcatttgaaaataagaaagaattagctagctatacattattgatagacgagactattttaaattgtaaatttatttatgatgggtttgtaatatgtcctacccaataaagacaactgaactccctctgccttacagtgcagccagggacatatcttcttagtgaacttatttctgtgatacgatccaggttttattcttatccatccctccagcagccttactgtagcaaaatcagtttcttgtaacagaaataaaagtttctttcttagcttccggaaattattgactttcaagaatttttgagattctgcctccctttaacaaagtacaaataaacctctttttaacattcagacaatctaaaaacttgctgaaaatcagacaatgaatacctattggagcctcccttgacatatattaattttctggtacaatcttttgtaaatatttaataattagctcctgttttatgaatatgcagatgtaggacaagccttatatgaataggtcctggttgtagcaattgaactgatgcaatcacatgtcatccctgaaaacaaaagcagatgccactgaagaccatccttgtcaaaatatttccacaagcctgcgaaaggtcttaacctatacaaatgttatgactttgcttagggctgtaatttcttctttttgaactcaagtaacaaaaagaggatttgtcagttgaatgaataagaagaagtagcaaattatttggggatctgactaattaagcctatcaggaagtacctcaggcagtgtcattatttgtttagctaaattgtcagtctagacaatgagggagtaatgccttattttatttttcctcctctatgatattttgctcaactgcatattctaagctgctctagaagaattcacttagaacaattctatcttcttttattgaaattaagtcaaactctaagtgaggtctaaaaataaatttaaaaaaccttttttacaaaaagataagaataacagtcatatagtgactgaaaaaataaatttctttaaaataaagtctgatttaattagggttgttagacaaactattggacacaatatgagtttcagagaaaaactgattcttttactataaatatgtcccatgcaatatttggacatctgtatttttgtttgctgaatctggcaatcttagactgaatttatgttccggagaaagtgtagagtaagtatgtttaaaagagggttcagaagatttgtataaaaactaactgtggaagtcggcctcagctctttagatatatgcctgttctgccacaactgtccagcagtctgctctactcagctgcttctacttatcacgttttccagaatccagctacgttctgtcacagctctccatactcatatctcaatgtttactgagaccaagttttgatttatcattatcatatggaagaatctatatcagataacttttttaaacttgtttattctatttctcaatattcaagcaaataaagggttttgcaagcctatattcccatccacaaaggaattgaggtataccttaatttccattataagaaaagaataacgattaaaaaagaatatagaaaaaaagaaaaacttttatcagaaggtgccaggcttattattcaaagaaatcttgtttcatttcctttgctacatctatcttttttctataattttcatctaatgtagcaaataaaatatacacatatgtaaataacacatacaaattcctatgtcaatttattgtataaatatcactcacagaaaggtgaatgaaaaggcagtacaaaataaattcactttatttcacaattttaacttgactgccttgaattattggaagatcctttaagatgtatactgtaaaggcagtcctatgcaatttttttttttctaatacttcatggtgtttcctgcaatgtttcccagatatctacacaaaaattataataatacttactatggtttgtttttactttttgtttctatgtattaggttcttcattcatccaattgtctcctcttagaaacaattataagggccaaattacagttagactaatacacagtaaagttaaaatgttttgcacattatatttcttcaccatttcatactattaattttaaattttagttaaaattgatgtattttagaaatgtttttagtttgtctcagaatatatatatatatataactcagaccaaaaattctagtgtagttgttctgtctattccatttattatatttaagcctaaagaaaaaccttggtggcaaatgacagaaatctgttgattaagctcattgaattggcaaaccttaagaagagagtactctctttttccattagaacatcacctttctgatggtaaaagtgcagtaattgatactgtttgggagaagtgactagaggtctatatccttaggaaaagatttcaaaagctttggattctgttatgttttattatcaatatatttagaattctagttctaaattcccttcaactccagttattctggcgacaagcagcttttacttgtatttcaatctctgtggctaagtcctatcacctgttagcagatgatttccggaatcatcaggttcttgctacacctctcagtgcaagcttccatgcagataagcattggctgggtgcagaatgctgcgtataaaatgcttagaaacataaatcactgtggctatgcacagtccaatacttatgcactatggctctgcaactgaattctctgtgggggatattaaaaacacagagtctcaacctcaccttctattcactaaatcagaatccccaaagcgggaataccaaatatgcatgcagtttataactggcacaggtgattctggtgtattgtagagactctgaaatactgatttgctcttggaatccttgtccttccttgttttgtgagtcctgtgggcagctgaactcaaggtctgatactttcagaggtacagcatatgtaggacagaaagggaatcttgggggaggcatgacttgtgctgtatattccccgtgtctccttgtgaaacttgcttcacttctatgaacattacatttttctctgtgaaatataccttctatgatataccagtgaactataaaagacatcctggaaagacacacctcagaacaaagtgggatttatattttctgaaaagcaaactagtccttgattgtatatagtaataagaatttaaaaaagcatagaattggtaataacactctaaacccacatgtatgtgtaaattcattttcatatttaatacacttgtgtttaatatagtgttatatttaatatacttattgtattaaatatattatgtttaacatgatatttaatatactcatccacatttatatccacaccaatcccattggtctcttttgagtttttgtttcaggcttttttaagaatgtagggcaaagttttggtcttggtcttttaagcacagcagctacaggaagggagattttcttgctctgagagggcaaaaaaaaaagaccagcaacttaaaccaggggaactgacctaaaaggctgtgccactgataagattcacttggacttagccagattagaggcttgatacctggagagagagagatcaggctgaggtgttttgctttgtgtctatcagatgcagagcatttcagcagaaatgcagcaatctcacagcaagccttaaaaggtggcccaagagcctcagcatccgatgatatcatgtcaaacaaatgctatcatgtcaaacaaatgctatcagcatctgggaaatctctggaatctgggcatgagtatagactctgtgagtttcttactctatgaaaaaatctaaaaaaagttaaaagacgtacaggtaaacacctgaccattcatttcttctttccttcctttctttctctcttcctccttccctccttctctccctctttctctctctgtctctcactcagcaatctgcaatgtttcaggcattgtcataactcagccttgaggatataataattttaaaaaatattatagagcataacctcatcctcaaagaattgacattagtggttaaagtaaataattaaaccctgacaaaatattgttaagagttagcagtcttcataataggtattttattttgtactttcttcaaagttttcatgtaaaaatataagcttatatattatttgatatgaaaatatattaatatcaaaacacatgatcagtgaagaaattatttttaacacaaaagtgactgaattacagctcacttccatacacttgaataaaataccctggcttggcaaatcagtgtaagagctttagttcaactcagagaaacactaggtgcaccatagttaaatcattataatcataataaaacatggtatatatctattaatgccttgtatgggacaggcattatgttatagattcaacataaagtaaaatacatgaagcattttacatttaatttgtgtaacaattccacagagtacctgctatgaatatgtttattattaaaattaactgactgaggcttagaaacgttaaatgacttgttcaaggtaacacagctggtgaggccaaagctatttatcccaaaggccctcttctcttctataagcagacttttggttttaaagagcacactacaaaatttaaccctactgtagtcaagatgatgccatagatcattctctatcagttcaaatcaaggttcttcatcaatttacaggaagaggctatttactggctagctgtaatatatatatatatatatatatgaatatatatgagaaacaggaagaggctatttactggctagctgtaatatatatatatatatatatatataagaatatatatgagaaacatgtaatacataaaattataatatatattatgttataatatatcatatattttatatttaagaactatgtaatgtataaaaattatattatttaatttaaattaaataaatataaattaaatataaattaaatacataattataaaaattatattatttatttttatacattaaattttatatcttacatatttcttatgtataaattataatataattttatattatatataattgtatacattatatatttcttataaatataaaaatatataacatagaatatatattcatacacacacacacacacacacacacacacacacactcacacacactataaccaagacaggtttattgtaggaagtagctggtttcagctcaagagcttgattttagaaaggtgttaagctctatttatcgtaggatggttggcagaagactaaagaacagagatacacatattctctatttgtgtaggtacacacaaatgtacaggcatacttgcacatgtgcttgtttacacatgtatctatcaactcccaaatcctaaatttcctatttattttttacttttaataaactacctacagacaaatgaggtggttagaaataaacagggacttagaacacaatggagttatttactgaggctattaagttaataaattgctaaaatcaatctgttctgaaagaaagtgtgattttatttctctatgaaccccttaaatgcatgatatgaacacagtgtacacaacacagcggtttttagaaccaatttttatatggtcaactaattaaaaatggtatctaaatggcatataaaatgttttctaggaaaaaaagtggaattcctgtagaatgtaactattgattgatttctcagaaataaattgtgaagctcagagatgagtcccatttatagttatgtaaatatcacaaataataacggtaaagtgcagtgtttgttttgaaatcagcttaatttgtctcataattctttcaaaataaattcatttctttatgcactttggctaatattggaaatggaaatagtattcaatcagttctaaatcattttttaagctagataatttctggaaagtgctgacttttgttagaaaatctgaaaatggaaaattcctctcagtgatctgctatgtcttcacatattatttatgaagttaatactgcttcatggatttcttaaatctcaaaattcagccatctgtaaacctctcttctctgtaatgaatcttggaataagaaagaagagaaaatatgttttagcttccagaggagatttctgaagtccaaagcattaaagctcacatacttgtttactcaggtgaatcaacaagtctttttctcaggttctgtttgcttttattttgcatgtaatcctgataaatttaatcagtttcagagccatcataggttcaaaacaatagtttaaaagggaagaaataaggttgcttcagataggcatagtaactatgattaaaactgacaattgagggggaacatattaagataattatacaggtcatcagatgagggaatttaagttctattttagtcttacatcatacagggaaaagaattccataatctagtttattgtagaaatgacagaaagctgacctctatcatagttaaccatagttataaatgtaacattaaattatgttcaataaattcttaaagggaagattggtataataaaaagtagagatctgagtaatacattgtaggcagattttattctatataaacatagcaggctgtttaaaatgggcatgaccaaaaaactttattttgtgttacctagtcactgcagtgcctcttttaacaataggttttgaagttagctaatacatcaaggtttagttcaagttttggctacataataactactgatgatgttgcagcaagagatttaataacagatttaagtgaaccttttggatatcataataatcaatcagtcattgattatttttaatatgctcataatgatttcaaacattatatccagcctctaagagaagctataatttcatgtatggattttctgattagtaaatgccaatacatagggagactaacacttcactaatttattacaatagtgtggagaaaaccatatattattatctctcccacaaaagaattggaatagaataaatagactttattctgcttgtcttaaagacaaaaacattaaaaccgaaggaggaatccacaagaaaatagtacttaatgaaggaaagatgctatgaaatatgctgttaaaaacagagaggatgaatcagttttatcattttccaaatttttcagatcatccattatttcctctttaaggtactaaataaattgtgaattatcaatacacatgaaatagaaatctctgtgctttactcagaatatcacaggaatttagagctagagagtgctatctagataactagttcaatgattttcaaatagaagtacacatcaaaatcacaaggcgttataaattatctaaatgcctggacccatcatctgaatcagaattttaagcacgtgtcttttcaaaagcaactccctattttagaacaattgagtccagctcctacattttatggaagaaactgataaacaaattaaaatgtctaataataggtatttgcttatgcatattttgacactaaaataaaaaggtatatagtctttaatgtaataaaataaattggtatatagtaaacttgtatgaatactataagaagttttcatttcgttttatgattctaataaattggctagttgtgaatcatagaacaaattcatgtcaaagctagacaatcttcaaatgctgtctctgctcttttaagttctctaagcttacaagttgtttaatctaataaaaataaaaaaagttaagaaaatatttattcttagaagtttaacattttagactaaattccatagaaaccattacttaaaagcaatattaatataaaatatatccatttaaaggctatatataagagctaagatatttcaggatggattaattttgtcacactccaaagtatctgagaaattaatgagaactaaatgtgcttttgtctctctttttgctacaaaaattgaatttttcctttctttaggcatattcagatggctgtttgtgttttgagaattctggaactccggagctctgatatgagtcagattctctgtgttaatttccaacaaatgtgattaagcaaatctttatagagaaggaggatatgaaagaaatgaaggctttagtatttggacagagagcagttggattgattccgcactgatggggagtttgtattcctggagaaagaagagaacctagaggtttttgtggttccaacttggtatactgaagggacaactgggacctgaccactgattagctaagcatcatgcccttgaaggcaagggtacagagaaggtcctgggagccacatttggtatgcaaggattgaaaccatttcacagattaacatatttttgaaaggagcatggagataccatataggcattttattaggagccaagatgaactgtatagcaaaggctgttccccattaattctggattgatccacctccagtgtttactcaaatcccaagggaaggaaataagcgactctcaaataattgacatgtaccacattttcttaatccagtctatcattgttggacatttgggttggttccaagtctttgctattgtgaatagtgccacaataaacatacgtgtgcatgtgtctttatagcagcatgatttataatcctctgggtatatacccagtaatgggatggctgggtcaaatggtatatatacaccatggactactacgcagccataaaaaatgatgagttcacgtcctttgtaggaacatggatgaagctcgaaaccatcattctcagcaaactaccgcaaggacaaaaaatcaaacctgcatgttctcactcataggtgggaattgaacaatgagaacacatggacacaggaaggggaacatcacacactggggtctcttgtggggtggggggaggggggagggatagcattaggagatatacctaatgttaaatgacgagttaatgggtgcagcacaccaacatggcacatgtatacatatgtaactaacctgcacgttgtgcacatgtaccctaaaacttaaagtataattaaaaaaaaaccaaaataatgaaaaaaaaattgacatggattttcaaccatatggtggatgaaagtaaaggtagtttttttttttttagaagacatataaattcagtttgtttttgcatctgaatgtttgggggaaaagttaaacctgtagtatacgtgtgtgtgtgtgtgatgtgtgtgatatttatatatatatatttatatattgcagagttgttccttccacattagttctactgcactatttttgtttcccctgctgttatcaaaaataagcattcattattcatgtaagataaagaggaaaacgaaactaaaatgagaggggaaatactagattaatttgatcatacatatttaaataaccacaagaaatagttattctcaaatatacataacaaagttacactagggaatagatcttactatacacattcttaacatttgtattttattatatgctagactttcaaaagattattttttcctcctattgttttcttagatttactgaaccataaagaaaggaaaagaagaaaactggctcattgttacaaatcacttcctactgtggatttgaagtcttcttattttctgcttttcatctaaattcagcatcatgatgctgcaatacaatcaaaagaaaatgctgtaaatataaaaatgttaatttaaagctatacacataccaggttcaaagaagatgcaagccacatgtcagtgggattgcctgggttcatctggacagtccagctcatacaacaagcaggccggtgactctttaggcaaatgcgaatgttttatagattaaataaatcatctttctgtttttttaaggttattaaatattctgcagaaaaatccaactctgtgcctttctaattttctcttccacttcaaatccttcacattttatgttttttcttttaccaatgagttagtaaaagcaagtaaatataaaactcaaaaaattatgtattatgtctaatccaggctttattttaaaaatatgaattttggctctttttatatgacttagtatctttgtactatttttgttttattattatagaatgcattgttttccaatagtatactatttattcatacacaaaaaggcaatatttaacaagacatttgagcaagaaagcattaactcaaaattcagggctcaagcctacatatattccatcggaaggaccggccctttactggctcctgggagataacctctgaatttggaatatcctgacagataataatgtctttgatacctgagacctcgagctgtgccaaatagtttatgctaattagatgtgatttatgcttgcaaccctttttttgtatgcctagggctttggggcatgctgcatcagcttggcccctgcaggagctggagactgattagctaaggtcagttatgcaggtgcttcatgtcatcatgactgacctacagtgaaaaccatagacaacaaggcttatgtgagcttccttggttggttacactttatatatgttgccctacattgtttctgagaaagtattttaagtacttttcatgcaactccaatgggagaatacacctggaagactgtacctgctttatcttagactttatcttatgtgtctttccctttgctaattttaatctgtaacttttatagtaataaatcctagcaaaaagtaaaacagtttttctgagttcttcttatacattatcaaacctgagggtagtctttaggccccagacacaatatctgaaagctatgaaatgctttgagctttaatattttaagcaatttgtggtctccataacaccatttcttggaaggatatcaccagtatgatgacatttctgttcttgaagttgatatatgacttacagttaggagttagataatttcaatagtctccttatgttaaaatatatttaaaccagttaataagatgagaactttatctcttcttcaactttgcttctttctgcttcccccccgccccatattcttattatcacaatttctggaaacaggagtcaagattttaaactatactacagttagttggaatagcttcttagtggcaattcataaaatagataaatgagacaagaatatccttggaagttctgttatttggtataaggcaagatgtaaagttgtactccttgacttgtcaaatgactggcttaatgtcccacagaatatctgtggcagtgtcaggtctgaaagtggaatcttatattacaggtatggggttctttcttctgtaataaactcagattattcctgaagttactgccaaaatcacaacctaaaataaagcgtaattacattatggatgtgtacattagatgatttacctgcaagtaaaaggaactctgacttcagtaatattaaacaagaggccataaggatcaaatatattaggtccagaggttgggcaggcaacctgagaggttcagtcaagagttcaacagttgaccacaggccagatttcttttatctctaatctctgctgttttcaggacactcactaataatagactaatagtttattatattattatttaagtagttaatagtgatagtctaatcaactatacccccccatcttgctttagggcctcaaaatggtaacagcaactacataaatccagatgttagaaggtataggagaggtcacgcatacttttcctcacattctaagagcaggcgacgaaatctttcctcagaaagaatgcctcccttgcctcagagaccagcatagtgtcacatgtccacttctaaaggaatccccaagagtgggatgtgattaacatgactgccttagataaagcatgagacatggaccaagacaaagcaaccagacaaccacaaatacttgaaaagtggctagacaacctctggagtaactctgtttctggtcatggatatgtaaatgcgagttacagttattccattaggtatctgcagtccttgtgggaaaaaacagtttgccacaaatgttccttctattgtaaaaacaatgtcagtgcactgacagtcaaaatatgtggtggctgaaaccatattttggcttttcaaaggtttgcttttaaagctttgttttctaacttcaacaagtatagtcttcttgcaaatatcagttctgttgttaagtaacaaactataagcctggattagtattgtagccctgacttgtgttgtatgttgcttattttctgaagccagtcagtgagtgagtccaccttgagtaggtgtttttatgtcaggctttgtgagaaatgaggagccggaggggatcccaaatcaattgccaaccatgtcacagatcatttaaggcagaatggaacatgcttgtgacaaaggtgatgacaaatgaatatgtactgaagggacaacaccaacagatgagtgaaggaaactggaaatatgtaatatgagatggaggtcagagtgaaatgtaagataatgataatgaaatacatgtgtgaatgtaataccatgagttagataaaaataggtggccgttaagactcacacagtgcctttcagaataaattctgaaattttacacaaattcaatattgccacaagttgtgaatccaataagtgaacagtttgttatataatatttaaaccaacctgtatagagtggagaatagaacatgttttactacctttaagttaaaaaaaaaaagttgcttgagtttctgttttctaaccttgagaagtaagcatatgtaatatatatactaacctaacacacaggcaaaaactcactctatttgtacataggtgttaaattatattagtccacatttaggtatataaaaagccagtggatactaacgagatgcaggtctttgcaggtagaattgtgctcacaggcattcaggatgcagtcatcaatgtcctgttcacatcttatcccaacatagcctggattgcataagcaggaaaagccatcaaccactggaaacaacagaaaagagaaaactcttaacattcctttaaccttagtacaggtaattataattagtctaaaattctataatcatttatgtagttcacttttaaccaaataaagtaagaattattatatttaatcgattacatagtcatctacaatattttctaaataaccatcttattcagttctatttaacttaaaaaaaaaacttcagttagttgaaataagaacaattactatggacatttggtaatagtttgcaaagcaacaatgaaaatatccaattttacttgctctctcttgtttttggcagtacacaatatatatgataaataggttactcttgtatcatttaattttcccaagttgttttaggtttaataaacaagaccttaactgttcagttgttaaagttctatgtatgacagaatatattaaagtgcattgtgatctcaaagttgataatgagctacttaagccttagttaaaaagagctttcacgtttcatcaaaatctttgtaaaataatgatcacaatttgttcttcattttaccattaatgatgaaaaagaatggtgtctgaagcatctcaaggaagtagtgacagtatgaattgcagttggagcaggcaccaatttataactacttgcagtcagtccctgagtccttcattatccctgagatttaccatgaaatctatactcccattatgcctctctgcatgtacttgctattactctcattaaatgcttaggtcttcagtggcaacagcatttttaatgcactgtaataaatgtatctagcttctggatttttgcagccatgttttgtacaacatgtgtaactagggcctctaaggagaacagggcagtcatagacatcaacaagagacaagtgaaatacacaagaataggcagctccttagacaggattttacttctgttttactttccttttgtatctagcacctagtttttaacctctcattgactacaaattgttaataaataaacagatgtaattgtaaatgaattaatgtgataaaatgtcagtctgtgcttctatgttacacatggtattttttattttaacatattaaaaccacatattatacaatatataattaagacattgtggagtgtcatcaatcataacaatatttaaaattatccttatggttattatttaagttgggatactgatgcatactgacaagtaacaactggagtcaaattaactttcagcattgatgttacgtgttctatgaagacaaattataaattacattaaacgcaaaggacaacaaaaggtcactttgaacaaacgaagtgtctggaaacagattgttaaaaaaataaagcatgcttttattgtcaataaatgtgtttctaacatagattaatacagacaaggaatgtgtttctaacactttattctggaataaaaattaataaatggactaagtgccagaagagaacctagagaactaaattggataccaaagggaaatcggatactgcaaagaagatagaaaaaaattaaatatttaaaacaaagtaacaaaaagtagagggtttttctcatatgtaatttgttaaccacggggctatgtgataaccaataaccatttcacaggaaagacatgttatacacatagtcttgctcttgattgttgttgttgtttttaacagaaaatctagtcactgtgatatggaagtgctggaatgggaagagtgtggtccctttaaatgatacagaagggggaagggaagtgctgggtagaggagggcgtggtccctggctagggctccacccccatggatctacgtgaggacggcactcctgcctttatgccagaatgttgcatttcccaagaccaccctgtcccaccctgcccacatcgtgtgcctataaaaaccccggagaccctagcaggcagacacacatgtggctggatgtagtgagaaacacatcaggggaagaagacacagtggcacctggacattgagaggcacacatcagcagaggaacacacaggtggctgcacatcaggaggaacgcactgacaagcgccggcacgctggagctccagaacaacatggagttttgccagggcagtcagaggggagcccaggacgccgagcaccccaactccaagggaaaaccacctcccttctggcttgcattgtctgagagctacttccacccagtaaaaccttgcactcattctccaagtccaggtgtgatctgattcttctggtacaccaaggcaagaacccaggatacagaaagccctctgtccttgtgacaaagtagagggtctaattgagctggttaacacaagccgcctatagatggcaaaactaaaagagcaaaactaaatgagcaccctgtaacacacgcccactggggcttcaggagctgtagacattcacccctatgcactgcggtggagtcagagctccacatcctgcctgtctatacgttccgctagaggaatggggcactgaagaagcgagccactccccctgtcacacaccctgcaagggggaaaaaggacctttcccatttcaactgcattggtattagtctgtgtttataaatatttcatactactattttgaggccaaattttcttaaaataggccttctatgaatctggatgtattattcattttatgcttaaatgtgtaccagacatcatatatactggttgtactgaatgaaagtttgtaatgtgacaaaactttttggtggaatatacagaggtattttaaaactgtaacagcaggccaggcaggtggctcacacttgtaatcccagcacttcgggaggccgaggcaggtggatcattggaggtcaggagttcaagaccagcctgatcaacatggtgaaaccccatcgctactaaaaatataaaaaaaaaaattagccgggcttggtggcacatgcctgtagtcccagctacttgggaagctgaggcaggacaattgcttgaacctgggagacagaggtcacagtgagcctagatcgtgccactgcactccacactggaagacagagcaagactccattaaaaaacaaacaaacctgtaacaacaaaatggtgaacaaccgtataatggtgttcaagatttacagactcacacacaaacacacacatatatgcagtgatttctcatatattgtcctgtaataaatactattgacatgctagagttccctgatccctctcgcaggacatgcgacaggggtgtggctggcctgctcagttgccgcagctgctgaaaccccttgagggagggggaccacgcagataggcaggtgcagaggccagggcgagtgctttgggctctggacctgtggtagtgtctaggggtggatgcctgcaaccccagtgttacaatgctctcagccttgctgtccgcagatggctttaagggttaaccagctgaatggaccctctgccttttcacaagggcagaaggccagtatgatagctatctgtatcctgagctcttgcctagcgtcccggaagattcgggtcacacatgggcttgaaggttgaatgagagatcttgagtggtggaggtggctctcagcaggatggatggggaagtgaaagcaggggatggagtgggaagataatcttcccctggagttgggccgcacagtggccaaactcctctctgaccactcccaaactcctcttggtattcagatgttcctcctcttctctctttctctgcggaagagtccgttggtctgcctgtcttacctcttcaacttccggttcactctggagtctgaggttcagcatttatctgggtacgggctagggagcatggcaagccaaaaggcaactttttgggtggaaaaacaggaatgcctgttctcatttatggctacgggtatccaggcttgaggatgcggcctttgccagggcatcttgtaccttcttctacccagtatttccgtgtcttctgtctgtattactattaactagaattcaggaagtttagcttcccaaaccattttatttcagagaaagtatgaagaatctagtgtcttagtttcattctgataacattctacatgtgtgatataaattttaataaatattttggttgcctggtagctaaatatccttagatggggtccaaaatatattatgaatgattatattatgaaatacattaatatattaagtattcaaattttacatttcccataatatattatggtttcaaaattttaataggtagtattgcattataagtaacattataaattgcattttcatatcttagaaaaaatcatatattaaaatatttatgaagaacttttaaaagtcaaatataatacattgttaatcaatgtgaacaatttaaatttaaattgtctattataatcattatagtagggctgcctacatatttcaaaaacaaaaaatctctaacttctctctcagccatgcgatattttaaaatgacatgaatcttttttaagtatcattcctcaccagacacctgtgggtttgagctcagaaatgatacaatactgacttacttcaaggtaatttgagaatttcagaaattttaaaatacaatcttggaagtgccaaaatctggaacaaaaataataacttggtgatttatatcaagagcagcaaaaatatggcatatagtccacagaactgttttgctcagctggcacaatgttagaaaattaacgtgatattagtatctatacagatatttcagtttgctagggccccaccactaccttttatatctgggttcttttatatctgggtggcttcacccaatttacaaaattcaattgccttgatattggcttttatttgcacagcacttgttttgagaaacaaatttaaaatttgagttaaatcctactgtttctaaataaaaagacaataacataactttctattgaaatgaggttttatatgtaattttaactatttattcatatattgaggtgttgtgggaagtcagggaccccaaacagagggaccggctgaagccatggcagaagaacgtagattgtgaagatttcatggacatttattagttccccaaattaatacttttataatttcttatgcctgtctttactgcaatctctaaacataaattgtaaagatttcatggacaattatcacttccccaatcaatatcctagtgatttcctatgcctgtctttacttcaatctcttaatcctgtcagctgaggaggatgtatatcgcctcaggaccctgtaataattgcattaactgcacaaattgtacagcatgtgtgtttgagcaatatgaaatctgggcaccttgaaaaaagaacaggataacagcaatgtttaggaaacaagagagataaccttgaactctgaccgccggtgagctgggcagaacagagccatatttctcttctttcaaaagcaaatgggagaaatatagctgaattctttttctcagcaaggaacatccctgagaaagagaatgtgcacctgggggtgggtctctgaactggcccccctgggcgtggccatctcttatggttgagactgcaggcgtgaaatagaccccagtctcccacagcactcccaggcttattagaaagaggaaattcctgcctaataaattttggtcagaccggttgctctcaaaaccctgtctcctgataagatgttatcaacgaaatggtgcccgaaacttcattagcaattttaatttcacctcagtcctgtggtcctgtgatcttgccctgcctccacttgccttgtgatattctattaccttgtaaagtacttgatgtctgtgacccacacctattcgcacactccctccccttttgaaactccctaataaaaacttgctgggttttgtgtcttgtggggcatcacagaacctaccaacatgggatgtctcccccggatgcccagctttaaaatttctctcttttgtactctgtccctttatttctcaagccggccggcacttaaggaaaatagaaaagaacctacgtgaatatcagggcaggttacctgatactgagggatcatgtagaaatatattttaaaggaggtgagataaaaccaaataagatagttttttgcaacacccttctagacctttgtttatttctgtttctcctttttatgcctcagccacattctgtatataatgtcatttcgttttctgtgtctcaacaaaattacccattttaggcatgttcttccacagaaaaatccatgtttccatcttacttttccctctttccttcttttcttcctgtctttttcctctataaatttatatttttttaggaatataaatttcagtaggaagaagtgtgagtgtgtggggtgatatatgtataaaataggctaaactaatgttattttgaatactgtaaacaatgctttctcatgcctaagggtgaatatttttaaaaattctaccatttcaaataaaattgcaaaggttaattctgacactagaaaggaaaagtcacatttcattagatttcctcattcgctgcacttgtgactcacaaaaatataaatgaatttgtcagaaattgggggtacttagtgaagataactgacattgactttgatgttcaagccaggctaaagtcagtaaataatcatggttatatcctaaactctcccattactatgttacattctacaatggtctgctctacaataattgcagccgctgaaggaactcactgtcatagcaatatccatgcaggcaagggctggaactgcactcattgacattgatctcacagcgtggacctgaaaagctggcacactggcaccggaactcaaggggaaacatttccaaatccattttctctccacgcacagctccattctcacaagaatcactagctttgcaaggtccaaattcacagtgataacttggaaaagaaagaatcaaagtgccaatgcttattgaatgaaccaattcttacaactgctgtcattcacctggcatatttcagcataaaggcatccaatttattctctattctcttccatattatcattgtgactctctctctctctccctttccctctacattacaatttaagaaagaaatgttatttatgatttctatgcttcatctaacaaagtaccagcaggtagcaatgataagtgacagcatttttaaaaattatattttgtttcttcatacttcccacttcttgttcaacaatgttctctgaagacattgcaattaagaaagtagattattgggcaaccccctttgggtcccctccctttgcatgggagctctgttttcactctgttaaatcttgcaactgcactcttctggtctatgtttgttatggcttgagctgagctttcgcttgccgtccaccactgctgtttgccactgttgcagaccagctgctgacttccatcccttgagatctggcaggatgtccgctgtgctcctgatccagcgaggcgcccattgccactcccgatcgggctaaaggcttgccattgttcctgcacggctaagtgcctgcgttcatcctaatcgagctgaacgctagtcactgggttccacggttctcttccatgacccacggcttctaatagagctataacacttaccgcatggcccaagattccattcctcggaatccgtgaggccaagagccccaggtcagagaacacaaggcttgccaccatcttggaagcgggtcaccgccatcttgggacctctgtgagcaaggaccacccggtaacattttggcgaccacgaagggacctccaaagtggtaatgttggaccactttcgcttgctattctgtcctatccttccttagaactggaggaaaataccgggcacctgtccgccagttaaaaacgattagcatggccgctggacttaagacttaggtgtgaggctatctggggaagggctttctaacaacccccgacccttctattggggatgttgatctgcctggagccagcttccactttcaattttcttggagaagctgaggaccgactagaggtagaaagcagctgtcccgaactcccggcagtagccggttaagatcatggcacagccagaagtctctacccagcagtcgcccatgcgtgcacccctacctttccttctgacccacacctcctgggtcccgaccacgacttttttgaaagtgtagccccaaaattctccttacctctgaatctacttcctctgatccctgcctcctaggtactaatggttcagactttcatttcttctagcaagttgtatctccaaagggatctaaggaggctctacactgtgtccttaggcacctaggctataacccagggagtcttatccctgttatccctcctgatttaggtatacagctgtctacatgggcagttacgtgggacccgttccccaccacctgtgccagggccccaagtttgtaatggctaagagagagagacggagagagagacaaaaagggagtcaaagagaaaaagaaagaaaaagatattaatagttaaaaaaaaaaagtgttccctattcatttaaaagccagggtaaatttaaaacctgtaattgataattgccactttgttgtcagtgtaaataagggcttagcaaatccttaacccagtaacccacagatgggccaaatgcattcagtcagtcggtagggacaactgcttcactaaaagtagaaaagtaacttttagaggaaacctcgttgtgagcacacctcaccagttcagagttattctaagtcaaaaaaaaaaaaaaaaaaaagcaaaaaggtagctttctaactcaaaaatattaaagtatggggctattatgttagaaaaagctaatgtaactccaaccactgataattcccttaacccagcagatttcctaatgggggatttaaatcttaattaccatacaaaggtccgaccagagctaggaggaactcccttcaggacaggatgatagatggttcctcccaggtgattgaggaaaaaaccacaatgggtattcagtaattgataaggagacttttgtggaagcagagttagaaaaattgcctaataattggtctcctcaaaggtgcaaactgtttgcactcagccaagccttaaagtacttacagaatcaaaagactatctcaatccagactcaaaagttttgctacaccctctctgaaatgaatttgcataagaactgttgtttacaagaatgcatcttgatggggcagctgggttgttgtgaaatactcagaaacccagcccagctctaggactcaccctgagtgcaaaggcaatgttaggcatgctggtaaaggaccactagaatccagcatcctggatccctttttttgtggtcaagagaggcgggtaaaacagatgcaggactgctacataggtgagtgtaactaatcagataagcagaggtccatgggtggttacgcacctagaaaggaataagcattaggaccatagaggatgctctaggactaatgctcatcggaaaatgactaggggtgctggcatccctatgtccttttatcagatgggaaacatttcccccaaggcaaaaatgcccctaagatgtattctggagaattaagaccaatttgaccctcagacgctaagaaagaaatgacttatattcttctgcagtaccgcctggccactataccctcttcaaggggggagaaacctggcctcctgagggaagtataaattataacaccatcttacagctagacctgttttgtaggaaaaaggcaaatggagtgaagtgccatatgtacaaactttcttttcattaagagacaactggcaattatgtaaaaagtgtgatttatgccctacaggaagccctcagtctacctccctaccccagtgtccccctaactctttccccaatgaataaggaccccccttcaacccaaacggtccaaaaggagataaataaacaattaaccaaagagtgccaatgttccccaattatgccccctccaagcggtgggaggaggagaattcggcccagccagcgtgcatgtacttttttctttctcagacttaaagcaaattaaaatagacctaggtaaattctcagataaccctgatggctatattgatgttttacaagagttagggcaatcctttgatctgacatggagagatataatgttactgctaaatcagacactaaccccaaatgagagaagtgccaccataactgcagcccgagagtttggtgatctctggtatatcagtcaggtcaatgataggatgacaacagaggaaaaagaatgattccccacaggccagcaggcagttcccagtataggccctcactgggacacagactcagaacatggagattggtgccacaaacatttgctaacttgcgtgctagaaggactaaggaaaactaggaagactatgaattattcaatgatgtccactataacacggggaaaggaagaaaatcctaccgcctttctggagagactaagggaggcgttgaggaagcatacctctctcacctgattctattgaaggccaactaatcttaaaggataaatttatcactcaatcagctgcagacattagaaaaaaaaacttcaaaagtctgccataggcccggagcaaaacttagaaaccctattgaacgtggcaaccttggttttttataaaagagatcaggaggagcaggtggaacaggacaaatgggataaaaaaaaaggctaccgctttagtcatggccctcaggcaagcggacttcggaggctctggaaaagggaaaagctgggaaaattgaatgcctaataggccttgcttccagtgcagtctacaaagacactttaaaaaagattgtccaagtagaagtaagctgcccccttgtccataccccttatgtcaagggaatcactggaaggcccactgccccaagggacgaaggtcctctgagtcagaagccactaaccagatgatccaccagcaggactgagggtgcctggggcaagcgccagcccatgccatcaccctcacagagccccaggtatgcttgaccattgagggccaggaggttaactgtctcctggacaccggtgcggccttctcagtcttactctcctgtcttggacaactgtcctccagatctgtcactatccgagggggtcctaggacagccagtcactagatacttctcccagccactaagctgtgatggggcgctttactcttttcacatgcttttctaattatgcctgaaagccccaatcccttgttagggagagacattctagcaaaagcaggggccattatacacgtgaacataggagaaggaacacccgttggttgtcccctgcttgaggaaggaattaatcctaaagtctaggcaacagaaggacaatatagacgagcaaagaatgcccatcctgttcaagtaaaactaagggatcccacctcctttccctaccaaaggcagtacccccttagacctgaggcccaacaagaactccaaaaaattaaggacctaaaagcccaaggcctagtaaaaccatgcaatagcccctgcagtattccaattttaggagtaaagaaaccccatggataatagagattagtgtaacatctcagggctatcaatgatgccattgtccctctatacccagctgtacctagcccttatactctgctttcccaaataccggaggaagcagagtggtttacagtcctggaccttaaggatgtctttttctgcatccctgtacatcctgactatcaattcttggttgcctttgaagagccttcaaacccaacgtctcaactcacctggactgttttaccccaagggttcagagatagcccccatctattaggcattagcccaagacttgagtcaattctcatacctggacactcttgtcctttggtacatggatgatttacttttagctgccctttcagaaaccttgtgccatcaagccacccaagagctcttacatttcctcgctacctgtggctacaaggtttccaaacaaaaggctcagctctgctcacagcagtttaaatacttagggctaaaatcatccaaaggcaccagggccctcagtcaggaatgtatcctgcctatactggcttatcctcatcccaaaaccctaaagcaactaagaggttccttggcataacaggtttctgccgaatatggattcctaggtatggcaaaatagccagaccattatatacactaattaaggaaactcagaaatccaatacccatttagtaagatggacacctgaatcagaagtggctttccaggccctaaagaaggccctaacccaagccccagtgttaagcttgtcaatggggcaagacttgactttatatgtcacagaaaagaacaggaatagctctaggagtccttacacaggtccgagggacaagcttgcaacctgtggcatacctgagtaaggaaactgatgtagtggcaagggttggcctcatggtttacaggtagtggcagcagtagcaggcttagtatctgaagcagttaaaataatacagggatcttactgtgtggacatccatgatgtgaatggcatactaactgctaaaggagacttgtggctgtcagacaaccatttacttaaatatcaggctctattacttgaagggccagtgctgcgactgcgcacttgtgcaactcttaacccagccacatttcttccagacaatgaagaaaagatagaacataactgtcaacaagtaattgctcaaacatacgccacttgaggggacattttagaggttcccttgactgatcccgaccttaacttgtgtactgatggaagttcctttgtagaaaaaggactttgaaaagcgaggtatgcagtggtcagtgataatggaatacttgaaagtaatcccttcactgcaggaactagtgctcagctggcagaactaatagccctcactcaggcactaaaattaggagaaggaaaaagggtaaatatatacacagaatctaagtatgcttacctagtcctccatgcccatgcagcaatatggagagaaagggaattcctaacttccgagggaacacctatcaaacatcaggaagccattaggagattattattggctgtatagaaacctaaagaggtggctgtcttacactgctggggtcatcagaaaggaaaggaaaggaaaatagaagagaaccgccaagcggatattgaagccaaaagagccacaaggcaggaccctccattagaaatgcttatagaaggatccctagtatggggtaatcccctccgggaaaccaagccccaatactcagcaggagaagtagaatggggaacctcacaaggacatagttttctcccctcaggatggctagccactgaagaaggagaaatactgttgcctgcagctaaccaatggaaattacttaaaacccttcaccaaacctttcacttaggcatagatagcaccgatcagatggccaaattattatttactggaccgggccttttcaaaactatcaagcagatagtcagggcctgtgaggtgtgccaaagaaataatcccctgcattgcaggccatacatttcaatccctgtatctttaacctccttgttaagtttgtctcttccagaatagaagctctaaaactacaaatcgttcttcaaatggagccccaaatgcagtccatgactaaggtctaccgcagacccctggactgaccagctagcccatgctctgaagttaatgacattgaagacacccctcccgaggaaatctcaactgcacaacccctactatgccccagttcagcaggaagcagttagggcagtcatcggacaatctccccaacagctcttgggatttcctgttgagagggggaactgagagacagaactagctggatttcctaggccgactaagaatccctaagcctagctgggaaggtgaccgcttccacctttaaacaagaggcttgcaacttaattcacacacgaccaatcagatagtaaggagagctcactaaaatgctaattaggcaacaacaggaggtaaagaaatagccaatcatctgttgcccgagagcacagcgggagggacaatgatcgggatataaacccaggcattcgagctggcaatggcaaccccctttgggtcgcctccctttgtatgggagctctgttttcactctattaaatcttgcaacagcaaaaaaaagaaagtagattattaacaatttgatgctccctatattttctttctggtaccctggaggttgctatcactgtaagctctgtttgaaggatttgttgctattctcaaaacaagtaaatgatggaaaaagaacattgtaataaacatctaatcttaatagaaatacttcaatcctgaaaaattttttatattttactcagaaaatgtaattatataaagtggttgccattgtgtgaaatgtacacaagtatttaagaaataggattatttgattcaagagaaaccatatcagacaaaaagcacagtataagcagcacaaactttttcaacaaagcaacattattatttgagtgtcagttttcaaggcatagtaaaaatatttacatgttacctatttggaaagtacttaaaaataaggctacttattcactaaaatgtacagtacataggtacaaacataggttctaaaaacgcctggctgaatactttaaagcagaaaatatacagtcatcattaagtccttgaactgcttgggttttctcagtaatttcacaactacagggataaaggtataacacaaagacttaggataagggataaaggtttcaaagttgagaagtactatagttgtttgagaaattacaaaagccaagtgtccctgtgattctcccagttctgaccacaagaaaaatagtaagggggactgcctagaagctgctgaggatatcagcaatctgtagagtaaaggcagcaaattgatatcattagtgtccataaaataagagcaataaaactgtaccaaaatggagatgctcaggacttcactttccaagtacagcaaaaaaaaaaaaaaaatgaaaaaaaactacttcacaagaacataaaaataaaaatttccttcaataaaaaaaaatctatcaagtggctactttttgcaatagcaatgcttagtagtatagagaattcaaatagaaacaagatctttttctgaaactattatgagattgaaatgtattataagtaatacatttctggatactattttatcataatcaaagtttttgtgaaataatggaaattgcattgaacaaacatctactcatgcagaaaaaatgaattgtctttaatgaaaagttcccatgcataccctttctttctaattacctactgctaaatatttaattgtgacactaggtgttttgttttgctagtgggaagttaatttagctgttgctttgtaaataattttgtatattataatctattacatagctgaacaacaatgtatatgagaaaatactcatgatattttcttttgcagaacacacatgaattcactgtacccccatatcatgttgatttgtacatgaattcattatactaatatgtaatgagcccttgtcctgtggcaagcactgtgctagacgcgggaggtggggggcaggtgtttaaaagaacaatgatgggttcaaataggcaagtaaatcggtgcaataagtggtaaacatgatcaatttccttgctaaagagtcattatgtaagtagaattccaatatggtttccaagatccccaccactagtgtacataccccatgtaattccctcactttaaatgtgggtgaggctgggtgcagtggctcacaactgtattcccaggactttgggaggccaaggtgggaggattgtttgaggccagaagtttgagactagtttcagcaacatagtgagacccctagaggtggtgaagagatggtgataggcacacctatagtcccagctactacttgggaggctaagatggaaggatcacttgagcttgggaggtcaagtctgcagcaagctgtgattgagccactgcatttcagcctgggaaacagtgagactctctctcttaagtaaataaatcaatgtgggtaagatatgtgaatatgattgaatgtcactccgtaattgtttactttatatggaagaaaagattgtggatataattaagtcccagaatcataagggagtccatcaaaagacacattatcttgagtgggtctgactaaatcaggtaagactttaaaagaagtcagaggcattatcctacttgcctcaaagaagcaaatgaaagctgtgttttataaagctctatgagatagggaatggcatctggtttgcagcagccaagaacactctagacagccagtaagaaagaaagaccagagttctaaaatcacaaggaagtaaattttaccaacagccagtgagcttggaagagaaacgtgagccttagattagctcacagtcctggccaaccttttgatttcagtcttgtgagaccatgagtagagaactcagttaaaccattcacagatttttgacttgcagaaattgtaaaataaaaaatgtgacttgtattaaatctataagcttgtgataagttgttattcagcacagaaaagtaatacagtcaaatataagggccactaagacatcttcagtgctattggaaagcctactgaacaggtgatatttggagtgagccctaaggaatcatcacacattatcgaggttaggcatgtgggatacagaaggggatggggagagttttctagaaggatgagggccagaagatgagaaagttcaggagattgaaaacaaatcaatatgaatggaacacaaaatacagggaagaaggagatgcattaccacatttaaggaattataatatgccatcgattttaagggagtttattttatgtgccattaagggtagcatggtagaaaaaatgatgccctcccactcccttcactacctccctgttgaagatatccagctcctaattctggaaacctgcgagtgctatcttatgtggccaataagaatttgcagatttgattaagttgaggattttgttgtggtaagcttatcctattttatctgggtaggccctaactataatcataagggtcttccaagggcctttataagagagaggcaagaagtttaaaggaggaaggtgacatgaagatgaaagctggagtttggattgatgcaaggaaggggtcatgagcccaggaacaaaggcagcctctagaatctagtaaaggcaagaaaatagaagtcttcagaagcaacacaaccctgcaatacctacctcattttagactttggcctccaaatatataaaataataaacttgtgcagttttaagtttgtgaaaattagttacagccattataggaaactaataaagagagcaaaaactgccagttaaattctgataaagtatttaagacatcactattgtgaaaaactcatcccaatttcaaagatgcttgtgttaatatgtaatgtgttagttatcacgctaatttgtgatgaaaattgggatgtgttaaatgaagttcactaatttgaaataacatctccataggctgggacaagatcctacaagtctttgtgatctatagaacataaacctggtgtgcattgaggaactgttgaaagctttcctaaaaatggaataaagtatggttggtctccttacagagaatcacattgtattgtatttcttagttgtatctaaaaatatatataatgctgctttatttctttgaagttttattttgctgaaaactatattctcttaaattaatgttaagaagctaaggcacattttatctgcatacatatttggtaggaaaaattaaaaacctgttttttattagttttttacaatgatgtcatcaattcagaaaataaaaaatgctgaggttcccactgaaattgtaccaccgggtgcagtggctcacatctgtaatcccagcactttgggaggcggaggtcgatggatcatgaggtcaagagactgagaccatcctggccaacatggtgaaacctcgtctctactaaaaaaaaaaaaaaaaaaaaaaaaattagctgggcatggtagcgcacccatgtagtcccagctactcaggaggctgaggcaggagaatttcttgaacccaggaggcagatgttgcagggagctgagattgtgccactgcaatccaggctggcagcagagcgagactccacatcaaaaaaagaaagaaaagaaaagaaaaagaaaaaaaaaaaaacaggcgccatggctcacacctgtaatcccagcactttgggaggccgaggtggacaaatcacccgaggttaggagctcaagacccgcttggataacatggtgaaacctcgtttctactaaaaaaaaaaagtatatatatatttttcctctaattgaaatttgcatcaaactagtacgttactttcaaatgtatggatgacttttgatatcaagttcattatgataaacttcatatgttcatatgttaaacttcttaaagaacattgcagttttaagagctgtaagtggatatagatgtttacaaaaatgtgaaaatgctaagcatgtcttcatatgagtctagtagcttgaattttagtttctcatgatttagataaacttaaaatctgctgtttaaaatgtttaaagtgataacaaaaattcagatatttagagaaacatagttaaaaagtgagtaaataatagggtggagataatctttctgtgcaagaggcatcatgtaggatatgtaaattacagaagtctttagtgaaatccactataaagttaaataaagtagaatcaagtcatccaacttcaataatcagcaataaaaacatgaaaagattagactggacagtataaattctgtttctgcagtaatatcaaaggacatatagcaggaaaacagttctttatggagcatacctcaacatattaaagataagtcctaattctctttatattttcataaaactcattattcatatactaaagttctatgaaaagacagtcctttttactaaacagaagatctagctaacactgtatatccttaagggacattaagtggtaatggacattgtatatctttaagggacattaagtggtagatattttgtgcattgtaaaagaccagagatggttgctgctatctatcatctagaaattttatgtaaaccaaggaagtctgagtgatgaattttatggggagacatcattttttccctctccctatcccattccctcccagcttcctagactctatttacattggacaaatttcttctcaaatctaacaatgattagtgagacagaaagcaatggaaataactccactttccacataacctttagaaataatatgctaatggcaaatcttatagatgcattttacaaatattgtcataaattggaatatattattaatgtacttattttactctgagaaagcaaattcgctttccaggttgaatgcaaacatatgaagtcagttattttcattttaaatttatgacttacacttttaaataattttttattgttttaaaaagcataccttcaagtattaataaataaaacattaatatccatgttcatgtatgttctttcttgacctcattaaatagcaaatgaattgatttttatcacttcttcatgttagtaaaatattttgtgagtaattaaagtgagagtcaataaagcagccccgccagtatcagctaagctggactggctgcataatcggaccctggtgcttttcttttgagcgtaaacaattttatggatcaccaaaatcagacaaggtctgtgctcatgaaggaacaaaataaaaataatatcactccacactcatatctgagcacagacaaaaacaataaagctgtctaaaccacaaaatggctaacattcatctttcctatctcttctatagttctttacaaattaaagctttagctttatttgtaataggtaatgttattaccttttagataacaattttcgtaatactcccctttgtaacctcatagagtagaggccaaacttcctggaaccacctccagagtcactaaacccaagcttgaatctcaagcctctgttgaaaccctcttaacaaagtgctcccaaattcttcatggtatggagccaataaactcaagtttgtctaatgacaggtgaatttatggtggtctttaagtggagaatgccaataaagatacttctacttttgactagaaatgagagtacttgtgtctatttttctgtgatcgataaaaaaacacactgcattctcacagatgtgtaatatatgtatgtattggtatgctagggcaaccatatcaaagcaccacaaactgggtggcttaaacaacagacagttagtgtttgaccattctggagtctagaagtccatgatcaaggtcttggcagggttggttccttctgagggctgtaagagagaatgtgttccatgtctctcctctagcttcctgtgtttttctgacaatctttggcatcccgtagttgtagatgcatcaccctgatctctacctttatcttcacatgaaggtctctctcaatatttgtctgtgtctaagttttcccttttgttaaggacaccagttatattggattaagggcccacctactccagtatatcctcattttaatttaacaaattacatctgaactgatcctatttccaaataaggtaatattattacaataaagtgctaagtaattaggacaacaatataattttgggaggacacaactcaatcaaatacaatgtgttttgatgtgaaggaagcataagaggtttttctgtatgttggtttttgttttttggtttgtttgtttgtttagaagtttttttttaaaagaccatgttcttctaattgttctctactaaaactttctcatatttcctctaaggttacctttagtgaagcctatatgcataccctgtgtgcatatgtttgcttgttgtttagtagttctgaattgtattgttgttgttgtttaaatatagctagattgtgctttttgcaatcttagcttaaataatattttaaaaatcataggtacaaaaaaattgaccttactgtatgacatcattttggattctagaaataaaaataaagcttataagattatctcaatgaacacaaaatggggaccagaataagtggcataaatgtagaacgagaaagactgggtgccatattttgtatcaatccgatgatttcaccacttggattttatttttgggtaccatatggtttagattaagataaacccattgataataatttcagtctaataggaaaattatttctttatattaaaatttttgtgaatctaggtaccaccatagaagcacagactaaacattcttattctttttacattttttctcacgtttctaaaaatatttaattgaacattatatctcttaaaccactctcactgccacttccaaaatccttgtcctgttatttttctgtcatatctattttataaaaattcagccattcacacaagacaatgtgtggctaacaatgtggacacaacattccaaagagcttggatccaaacccttgcttgatccttaagtagacacgtgatcttaggcatatgacatttccatgcctctgatttctgatacctaacatagagataataacatcacacaactcataggtttgtagtacaaaataaatgacataaggtatgttaagcatttcaaaaagtacctgccaagcaccatattaatttaagacattaatatcattatctctgtccatttgcctagcttgctgattatttctggtaagacaacaggaattatctcaaaatcaaaatttctaactccaggtaggcacccaactcttagtaattgtattagtccattctcatgaggccaataaagacatccctgagactgggtaatttgtaaaggaaagaggattaattgattcacagttcaacgtggctggggaggcctcaggaaacaattgtggcagaaggggaaacaaacatgtccctcttcacatggcggcagcaagaagtgccgagcaaaatggggaaaagccctttataaaatcatcagatcttatgagaactcagtcactatcatgagaacggcaagagagtaacccacccccatgattcaattacctcacaccaggaccctctcacaacacatggggattatgggaactacaattcaagatgagatttgggtggggagacagccaaaccatgtcattctaccctggcccctcccaaatctcatgtcctcacaatttaaaacacaatcatgcccttacgatagtaccccaacatcttaactcattccagcattaactcaaaagtccaatccaaagtctcatctgagacaaggcaagtcccttctacctatgagcctgtaaaatcaaaagcaagttagttacttcctagatacaatgtgagtataggcattgggtaaatggacccatttcaaaagggagaaattaaccaaaacatagaggccacaggccccatggaagtctgaaatccaatagggcagtcattaaatcttaaagttccaaaatggtctcctttgctccatgtctcacatccagatcacatcccatggctttgggcagctctgtccctgtggttttgcagggtacggctctcgatcctagctgctttcacaggctggcattgggtgtctgctacttttccaggggcacggtgcaagctgtcagtggatttaccattcttgggtctggaggactgtggctctcttctcacagctctactaggcagtgctccagtggggattctgtgtgggggctccaaccccacatttccctactgcactgccctagcagatgttctctgtgagggctccacccatgaagcccacctctgcctggacatccagatgtttccatacatcctctgaaatctaggtggcggtttccaaacctcaattcttgtcttctgagtgcctgcaggaccaacaccacatggaagctgccaaggcttgggacttgcaccctctgaagccacagcctgaactgtacatttcccttttttagctatggctggagcagctgggatgcagggcaccaagtcccaaggctgcacacagcagtggggcccgggacccagtccagcaaaccatttttcccttttagatctccaagcctgtgatgggaggggctgccatgaaggcctctgacatgtcctagagacactttccccattgtcttggtgattaacattctgctcctcattacttttgcaaatttctgctgctggtttgaatttctccccagaaaattggcttttattttccagtgcatcatcaggctgctgcaaattttccaaacttttatgctccgcttccttttggatgctttgctgcttagaaattgcttctgctaaatatcctaaatcatctctctcaagttcaaagttccacagatctcaaggacaggggcaaaataccatcagtctctttgctaaagcataacaagtgtcacctttgctctagttcccaacaagttcctcatctccatatgagaccacctcagcctcaactttattgtccatatcactatcagcattttggtcaaagccaatcaacaaggctctcagaagttccaaactttcccacatcttcctgtctcctgattccttcatgtctctaagaagttccaaatgttcccacatttttctgtctttttctgagccatcaaaactcttccagcctctgcctgttacctagtttcaagctcaattccacattttcgggtatctttagagcagcacctcattacccagtagcagtttactgtactagtacattctcatcatgctaataaagacataattgagactggggtaatttcaaagggaaagaggtttaagtgactcactgttcagcatggctgtgggagcctcaggaaagttacagtcatggcaaaaggagaagcaaacacatccttctttacatagtggcagtaaggagaactgctgagcaaaagaggggaaagccctttataaaatcatcacaccttgtgagaactcactcactcactattacaagaacagcagcatggggtaataatccccatgattcaattacctcccactgggtccctcccacaacatgtgggaattatgaggactacaattcaagatgagatatgggtgggaacacagccaaatcatatcagtaataatttaacatatatttcttcaatttctataatggtgtgttttagctgcctagcgtctatccattagcatccagattttctggtggaggatttcttttttctcctaagtctgtgcttagctgaaagatcatttttaaccttatttatcccactgcctacatagtgctacagaaccccaggtgactagatgcttcctccatttgctctctggcttaccaaaagaggcatattatgccagtttatctaattggataaaaagaaagcttcagaaggcatgcttattgcgatagtaacaataatagctggtgtagcattggtggtgttaggtggattttaagcaggaagaggagtactgatgatgacatcttggctaggctgttatggctatttctattctttctgtagctcttcccaaataagcaaaaactgatcaaatttattgacagtggatcaaccctacaaggaatactaaagggaatcttctggctgaaataaactctcataagacagttacttgaatccataaaaggaaataaagagcattgataaaggtaatacacaggtaaattttaaaagaagtacatatataaaactaaatatattatatattaatatatattattttttaaacataaatacaatatatgtaatacaattttatttttctatttaatttaaaaggcatctacataagtcagtatttataaaacttcattgttaaacttataatgcataaagacatcatttgtatgacatagtacaatggagggagggagagaatatagagatatgttgtatcaaggtttttatatactattgaaattgttaacattaatttgaaagaagtcagtcacaaaagaccacatattgtacaattccatttatattacatgtccagaataggaaaatttataaagaaagaaagttgatcagtaggaagagaggactgttaatgggtatggcttttattttggtggtggtgagatgttcttattagattatgatgatgagggttgcacaagtttgtgaatatcctaaaatccattgaactatttactttcagtaaattttatgaattatatctcaactgaatattgaattttatctcagtaaagctattaacttatagtaagttaatattatctttttaattatattaactgcggtcactgttaaatcttggttagtctcagttaccttatttattgcttgtgtcagaaaaagttcagataccacatgcaataaaaaaaaatccaattgaatttccaaatgattatttttctccaccactggaacagatataatactctaaatataaagagatttttaatttcaaaagctaggcttcaagggagaaaaattgttgaaattgttttcattgtagtgtttgttttgtgtttttgttgttgttgaagtggcgataattgtggatttcctgccgttgacatatgttaatccaaaataagaaaaatgggagaagaaagaggaaaaaattcatagttcccacaatttgcagtaagaaaaaggactagaattttttaatagtctctcttttatagtgagaccttccagttttgaaaccagttgaagcagcacaagtggacacagaaatttcttccatagacagaggagactcgggtttgcttgcagcatgaaatcgcaagagcagtcttacaggaaagtatgcacgtgtagtgcagggcaataataaggtaggaatggcagtagggtagtcaaacagacgttgatgtaacttgccccttcatataccaccacctagtaagctgagagaagatgctgaattcaaattctaggttaaacatcatacatagcagtccaataaattaaatgatttcaagtaaaaaatggtttgtgaggttaaaagtttggaaaacagaacgtactagtcaagatggaaggagtctcctactacatgccatagccctcttctttaaagcaagagcaaacctcagtcttctgggtggtctggttttgtcatcactttttacaaaactaactttaacttgagaaaatagtaattcatgtaaatctgtagcctctgtaaacttctatcattgtgaatacatatagcaatgcaatgaaaatatagctggtgctcatatgtctagggagcttttattcacgaaggaggcccacaagatttaagtagcattcatagcaatgacatgatttaatattcataaaaatggcaaaaccttacaacttaaaacaccccaggtactattttaagtgatttctataaccaagtcattgtatcctcacagaaaaaccttagtaggtattgtagtcattcccattcttccctgaggaagtggagatgcagggcgatgtctgtggggagccaggcttctgtccaggccctgaatctatgaattcaacctcattacagggctgagtgttcttcagaatgcccatgtgcttcagtttttcagaattcatgcgtcacgaatgtggtttacttcttcaaaattgtatttttgtttaacttgaagatattgtaggcattttcatatataaataaattccatttttgctttttattcaatcactaagttgccaaaaagttggaaataataggttttgataaatatgattccattgtttaattcttcagattctttgcaagcaatatattcatgtagctttaaaaaaatcccaaatattatgttctaggaactaacatttgatattgtttgagagtgcttcaaaatgatttttttaaataaccgtgaaaaaggtcagctatacctctaagctttcactgaggactatcatcagtcaaatgattagtttcagcaatttcatggcataaatccacaactagggtgattaagggtagtgaatttaggtacaagcctaaaattgaatcaaatagaagcagataaatacctctaccttattctcatataatgaaactcttcttatgtatgaaaaacatcactatattttgagaaatgctaattcacatttaaatttccaagaaaagtgctcttctgaatattttaaagattattcaatagactttacagagtatatttgtacctatcataaaattaaaaatcaatatgcattacccacaaaagtgtacagttgataaaccatacttagctatagcagattttaagagttctgacttccctcaaatccattacattaaacacttcaaccagctaatgtcaaaactggagcaattgcatatcaccccacttaaaacaatacagcaaaatgcacatatcatgtctactaaaatctctgcaataatgaaaatgaattgattttaaacaaatggattttagtgaatgtataaatctgaatcctttgagatatgctaaatgtttaactctgtttttgtattaaatttaatttgcatttatgcatttagagaatatatgttattcaagcagtaaaaagattgaaaataattattttgttcagtaaataaacagtaaagaaacatggtataagactggtactctggtagagctatgcattcatcccagctgcgcaagaggctgaggcacgagaactgtttgaacccaggagggagaggttgcagtgagctgagattgccccactgccctccagcctgggcaacagagtgagacatcatctcaaaaaaataaataagaggaagaaaaacaaaacaatttcttgcttcctgaatcttgaattttaggtaacagaacagatgtctgtcagtgagagaaatatgtgttttaatgatgttctataaagggtacactgggatacaaaggaggaccattagaaaaaactccccagggcagagaaacttccacacaactttctcaagattaatacagtgagtcactcatacaagagcttattttaaaactcagtccataaatacaaaattcctaataaactgtctgaaagtactctaaattgccatatgtatttttttattcaattctgtgtcagtgtctctcattcttcatcagtcattacttttctatgatcttctagtaattcttcagtccctctcttacagattgaaaaagacttcttcagtcgcttattttatttatgaaatctttacatagcctttctaatatgacatggtttatattaactctatccactgttagtttcataaatgaaacagggttattattaggcaaacataattaattcaggtgctctaaatactgtaggctggaactgcactgtagacattctccagaaaataactaaatgaagattgtttagaatttaacaattagagttgttaattgttgaattctaaactttcttaacagaagcataaaagtaataggaaggaaatgcattccaggccaaagggactcatgaaaaaaagaccaggggtatgaccagaaataaaacaaacatgtaggaaggcatttatgcacagatgaatgggctacaaataagggaggggatgttatatgggcctgcgttgccttcctgtgtcagaaggtgcattaggagagcacagtccaaagtccacctagcattttggaaaatactgtcaagaaacaagtaaagattcagatattggccgggcatggtggctctctcctgtaatcccagcactttgggaggccgagacaggcagatcacaaggtcaggagatcgagactgtcctggctaacacagtgaaaccctgtctctactaaaaatacaaaaaattagctgggcgtggtggcgggcgcctgtaatcccagttacctgggaggctgaggcaggaggattgcttgaatccgggaggcagaggttgcagtgagccaagatcgtgccattgcactccagcctgggcgacagagtgagactccgtctcaaaaaaaaaaaaaagattcagatatctctgactctaaacagtcaaaaagtcaccacatgatttgttctacccttttcctcttcctcttgcctatttgtaatgtgtgttttttttttttgacagtgagaagcttggctaccatttataatttatttacttacttgctgaactctacttttacatgtaaagtagtttcagagttgtgcatctatacctcagtaagaaacaaatttaccccaaagagtatgatgtttttgtacagttattttagcttttaccttaatgtcgtcaatcaaaactcttgtttctaaagttatttagatcagttccttttctttccacatcatttagtgatgtcttaacttttctaatgtcatacttttctaatgaactagttctaataaacttttctaataaatctgacttcattagaagtttttgtgacagtcttcattagcagatttgtgacagtctgctttctgttattggaccctcctacatcctggttgatgtttttaatttgtgtacaataagttattacttagggtagagctctattgattttgacaaacatgtgtaccatcacaggactggattaaacaattacagcattctaaacattctcttcaatgcctcattaaaaacaatcccaatctcaactttctgtcaaccactgatctgctgtctgtcctgatatttagctctacattttcctgaatgctgtataagtggaatcatgcaataggtaccttttgtgtatggcttctttcacgtaagaaaatgcacttaagacttatcagtattgtattaatcactttgttcctttttagtgccagatagtatatcattgtatttatgtaccagaagttatctgttcatctgttgtaaggcatgttgtttgtttgcatttattggtgaatacgtataaaggtgaatatgaatatgtataaatgtaccctataaacatttgcatatataacaaaatctttatttcacttgagtaaatacttgattgctggattgtatggtaaagtgaatacttaattaacactaaattattatgccggatttcttttcaaagtctgctttactatcctgcattcccatcatcaatgactacactttgagttcttctgcatcacaagcatttactattgtcatttgttttgtgtttatttcatttttatcttactaagaggtgtgcagtgctcatcatggagtattaagatcaatttctgttaactttttatttttatatagcttaaagcttacaaacaaattaaaatagtgcaagaaactccaatgctttactcagagtcccaaaatgttttgggatattttgctataattgccttaatattttatctctatgttcacttatctatattatatgcatttctacaataatatatattatctatatcatatataattctttttgtgaaacattttagaggaagtttgaaatattatgaacctttatccttaattactgcagtatgtgttttctaagaacaatgttatttcttacatcatcatagtacaattacaaaaaccaatactattgactatagttaataataatgtatacataaaatttgctgagagtagatttttagtatagttttcacataatagtctagtaattttgaaaagtgcccttcaattttggtttatctgatgttaccttttgattcaaattcaggttttatataactttgaaagaagtacaacagaagtgatatgttatcctcagtgcatatcagtggacatttttagttaggttgttctaatatttgttaacttattccagtaaaaaatttatgtaatttatccccttggacttaatgaataattttgttatttaagaactataaacatgtatttttgttaaagaatctttcacccactagtttagcaatcattgataattttccaactccaccttactttcatgtatatgttgattttctgctataaggaagagctttgcctttatacctccctaagtatttgtctatttttcaatttattatacatttatataagaattgaatcatcagttattatattattcagtgaattataatacattaactttattatttattttactgctgaaatttcctcctacttagccagtggaaaacctgtagagctgtcccctgtgtccttttgatttattctcctttttctttgagtacttctttataatgcaaaaaagatatttaaggtttctcttttaacttccttgctctaggcttgaaatttatcttttctgtaaaaagtatggttcctttaagtagagaatgatattaagaaatcaagatctaggtgatcagagtgttctcttataaagggaaagagttaggaaatatgtgcatgtgtgggtatgtatgcatacatacatacacatatgtatatatttatgtctatatattgatatacatacatttatatgcagatacgtactttgtaggaattatataaatacacatgcacacatatacactcatatcagatttatactgataaaccattgacccttgaacagcataggtttaaatgacatgggtctatttatatgcaaagtttttcaataaaatttacatggagtgtgcctgcctctcctgcctccccttctaattccttgacctcttctgcctctgccacccccaagacagcaagaccaacctctcctcttcctcctcctccgaggtctattcaatttgaagatgatgaggatgaagaactttacaagaggagaaggagccaagatggcctactaaatgcagataggaagagcatctcccagcaagagaccagactattaagaagactggcacactgtgtgaggatctttggaagaaaggaattcagagcggatggaaagaagatggatacccggggctgaatggggagcaatctggaatctcttcattggcctgctgagtatgagggacgcattcctggtgccagtgggtcctggggaaggggtgagacaaataagcgaggatggcccactctcactatggaacaccagaatgctagcttcaggacacctcatggccaccatggacatttgagctgacaagaagagctgtttagagaggtcagacctccagcctgtgtggattccagagggtttggctcaagaacagctggagaacagctagggatgtacatcccccaagtctggccacattccccgaagtgtctgtagcctttgatgactgtcagacctggacaaagcagggtgatcttgccaataagatggatgtgacctgagctttcccttctctgccagccactcctagggtccctgcttggctgatgctgcttgcagcacagtgtcagatgcccaaccaggtgcttcctggtggccattgccataggtcctttgttgacagaccctccctaaccatcagagagcttctgcagacagactactgccagcatgcacccaactacgcacagcatccccacactgcagcctccccacaccactatgctggcacacattcacctgtagcacccccactgatttgctggcacctgtgtaggcagaactcactgcatcccctgagcaccctgtccacatgcatgtactccactgtaccactattgctgctggcatgcatgcacaagctgagatcccactgccactgctccagtgaagcatgttggctgacagattccatcggggtattgttgccagtggacagggcataccttgattcctccaacacagcaggtgcttaacgttgagagggtcagagaaaaaggccatggacctgttagtagcccttcaggggctgctttatagtgtcaatcaagtctgcgtaacaacaaacaacaaaatgacaggatcaaatccacatatcaatgttaaccttgaatgtaaataggtaaatgtcttagttaaaaggcaaagaatggcaaggtggataaagaaataagacccaactgtatgctgtctttaagagacccatattccatgcaatgacacccatagcctcaaactaaagagatggagaaaattctacaaggcaaatggaaaacaaaaaagagcagaggttgctattctaatttcagacaaaacagattttaaaccagcaaagataaaagaagggcattacacatgataaataggtcaattcaacaagaagacataaccattctaaacacacacacatttatacatattatatataatattttatattttatatatatatatatacacacacacgcacatacacacacacacacacatatacacacacccaacactggagcacccaggttcataaaacaagttcttagagatctatgaagagactttataaccacacaaaaatagtggcagactttaacacctcacttaaagtattagagaggtcatgaaagaagaaaactaataaggatgtttgggacctgaactctacacttggacaaattgacctagcacacatgtacagaacactccactcaacagcaacagaatatatattcttctcattggcatatgacaccaactctaaaattgaccatgtgataagacataaaataattgttagtaaattcaaaaaaacaaaatcataccaaccatgctcttggaccacagtgcaataaaaataaaaattaataccagaaagatctctcaaaaccatacaattacatggaaattaaacaacctactcctgagtgattttttgagtaaacaatgaaagtaaggcaaaaatcaagaaattttttgaaactaatgaaaacaaagatataatttaccagaatctctgggacattgtgaaagttgtgttaaaagcaaagtttatagcactaaaggctcacatcaaagagttaggaagatatcagattatcaaattaccatcacactcagagggaccagaaaaaaagaacaaacaaacctgaaagttagcagaaaaaaaaataagcaaaatcagagctgaactgaaattaatacatgaaaaatcatacaaaagataaacaaaacccaaaattggtttcttgaaaaaatatataagattcataatacactaattagacaaattaaaatgttgaagatccaaataaacacaatcagaaatgacaaaagggacataaccactgaccccacagataaaaacaaaaacaaacaaacaaacaaaaacaaccctaagaaactattatggacaactctatgcacacaaactagaaaatctaaaataagtgaataaattcctggatacatacaacctcccaagattaaaccaggaagaaactgattccttgaacagagtaataataatgagatctgaaattgaatcagaaaagcctaccaaccagaaaaagcccatgaccagatgtattcagaggtgaatactaccagacatatataaaagagttgtgatatagtttagatatttgttctgtcccaaatctcatattgaatgaaatcctccatgctggagggggcctggtaggaggtgttttgatcatgggggcaggtccctcattgcttatgctatctctgtgatgatgaatgagtttgtatgtgatctggtcatttaaaagtgtgtgacacctgacctaccactgtctctttctcttgctcctgcttttaccatgtgacatgcctattcctctttcaaattctaccataattgttagcttcttgaggcctcccaagaatctgggcagatgccagcaccatacttcctgtaaagcctgcagaacggtgagctaatgaaatatctctctctttttttttttaaataaattacccagtcttgggttctttttatagcagtgaaaaatggtctaacagaacattggtactgaagagtagaatattgctataaaaatacttgcagatgtggaagcagctttggaactgtgcaatgggcagaagctgaaagagtttggagggctcagaagaagatgggaagataagggaaagtttagaatttcttagagattggttaaataattgtgaccaaaatgctgctaatgacatggacagtgaagcccaggttgctgaggtctcagatggaaatgacgaacttattgagaactgaagcaaaggtcacatgtgttatgccctagcaaagagcttgactgcattctgttcatgccctagggatctgtggaggtatgaaatcaagagtgataatttagaatacctggcagaggaaatttctaagcagccaagtgttcaagatgtggccttgctgcttctaacaacctagctcagatgtgggagaaagaaatgacccaaagttggaagttatatatgaaagagaagcaaacataagagtttggaaaatttgcagcctggtcatatggaagagaaagaaaaagctttatcagaagaggaattcaagtagcctgtggagtaatcactttctagagatgtttgcataacaaaaaggagccaagtgccaatagccagagcaatggaaaacatgcctcgaaggtatttcagagaccttcatggcagtcactcccatcacaggccaggaggcctaggaggacagaatcgtttcataggccggtcacaaggcccttttgaagttgctccccatgttctggcctctctagcttcatctgtggctcaaagggacccaggtacagctccaggctgccattctggagaatgcaagtcaaaaaccttggtggaatccatatggtgttaagcctgtaggggcacagaatacaagagtgaagaatgcttggcagcctcctcctggatttcagaggatatatgagaaagcctgggtgctcaggtagaagcctgttgcaggggcagaaccctcacagagaatcactactagggcagtgctgagggaaaaagtggggttggagccttcacacagagtcccaaattgggcattgcctagtggagctgtgagaaaaaggtcactcttcttttgaccccagaaaggtagatccactgacagcttgcaccctgtgcctggaaaagctgcaagaattcaattccaatctgtgagagcagccctggtgctgaatactgccaagacaaagctgtggagctactcaaggccttgaaaacacaccgtttgggttccctgccctagatgcaggatatggaggcaaaggagattattttgaagctttaagacttaatgtaattacttccctgctgggttttgaacttgcacggggcctgtagcccctttcttttggctaatttctcccctttggaacagcaatgtttacccaatgcctatacccccattgtatcttggaagtaaataactaggttttttcaaaaaattcattttacaggatcacatgtagaagggacttcccttgtctcaggcaaaactttgtactttgagttaatgaaatgaattaaatctttgtgggattactgggaaggatgattgtattttttgatgtgagaagtacatgagatttgcgaggggccagtggtagaatgatatagcatggatatttgtctccacttgaatttcatgttgaatggcaatccctattgctggaaatggggcctggtgggaggtgtttggatcatgggagcagatccctcatggcttgttttgtctttactatagtaagtgagttcttgtgaaatctggtcatttaaaagtgtgtggcacctccccctgactctccatattgtttgctcctgcttttgccatgtgatatccctgctccaccttcaagttcttccataattgtaagatttctgaggcctccttagaagctgagcaggtgccagccccatgctttctactaatcatgcataattgtgagctagttaaacttttcttctttataaattacccagtctcagatatttatttatagcaatataaaaatagcctaacactagctactacaattcctactgaaactattccaaaaaatttgaggagaaaggacccctttctaactcattctatgaggccagcattattcctttaccgatacctcacaaagaaacaacaaaaaaagaaaaatttagaccgatatctctgaataacatagattcaaaaatactcaaaaaagtattaccaaacccaatttagtaccacatcaaagagctaatccaccacagtcaagtaggccatattcctgggatgcatggtttgttcaacatatgccaatcaatacatggaattcatcacataaacaacactataaacaaaacccacatgatcatctcaatagatacagaaaaggctttcaataacactcatcgtcacttcatgttaaaaaccctcaacacactaggcaatgaaggaatatacttcaaaatactaagatccatctatgacaaacacacatcatactgaacaggctggaagcattctccttgggaaccagaacaagacaaggatacctacactaactactcatattgaacatagcaccggaagtcctagtcagagcaatcagtcaagagaaggacataaaaggcatccaaataggaagagaggaagtcaccatgatatgattgtatatacagaaaattccatagtctctacccaaaagctcctagatctgataaacaacttcagtaaagtttcaggatacaaaatcaatgtacaaaaatcactagtatttttatacaccaatgatgtccaaactgagaaccacattaagaatgcaattgggttcacaatagccatacacaaaaaaaactagaaatacagctaaacagggttgttaaaaatttctacaatgagaatttcaaaacactgctcaaagatatcagaaatgacacacacaaatggaaaaatgttccatgctcatgaattggaagaatcgttgttaaaatggccatactgaccaaagcaatttacagattccaatgctctgtcaaactagcgatgacatttttcacagaattgctttggctatccaggctcttttctggttccatataaactactaataatttgtattattaataatttgtttgtaatatatattatatatttttatattatagtgttatatattatatattacatagtaatatataataatttattaataagtactttattaataaactattaataatttatatggaaccaaaaagagcctggatagccaaagcaatccttagcacaaagaataaagccagaggcatcacagtatcagaatttgaaccatacaacaaggctacattaaccaaaacagcaggcactggtacaataacaaacacatagaccaatggcatagaatacagcatccagaaatagagcggcacacctaaaaccatctgattttcaacaaagtcaagaaaaagaagaaatgaagaaaggactccctattcaataaacggtgctgagataactagctagctatacgcagaagactgaaacttgaccccttacctttcaccatatacaaaaatcaactaaagatgtattaaacccataaatgtatcacctaaaactataacaatcctagaaaaaaaactaggaaataccattctgaaaataggccatgggaaagaaaatattttcattatgatgccaaaagcaattgtacaaaaccaaaaactgacaaatggcacttaattaaagaggaaactttcaaccagataaacagataccctaaaaaacgggagtaaatacttgcaaactatgcatctaacaaatatctaatatccagaatctgtaaggaacttaaacaaattagtaagccaaaaaaaaaacaaaaaaacaccattgaaaaatgggcaaaggacatgaacatttgtcagaaggtgacatacacatgactaaatctataaaaaaaagttcatcactattcattagataaatgcaaatcaaaaccacattgagataccatctcatacccactcagaatggctatccttaaaagtaaaaaaataacagatgtcggtgaggttgtggggaaaagggaatatttatacactgctggtgggaatataagttagtcctgccgtggttaaaagcagtttggagacttctcaaagaacttaaaacagaattatcatttgacccagcaatgccagtactgggtatatacccaaaggaatataaattgttctaccataaatatgcatgcacatgtatgttcattgcagcactattcctaatagcaaagtcatggaatctatctaaatgcctatcaatggtggagtgaataaagaaaatgtggtacaaatacaccatggaatattaagctgacataaaattgaatgagatcatattctttgtagcaatatggaaggagctggaggccattatcttaattgaattaatgcaagaacaggaaaccaactactgcacattcttacttctaagtgggagctaagcgttgagtacacacagatgcaaataagagaacattgataagaggacctacttgaaggtcaagggtgggaggagggcaaggatcaaaaaactacctatcaggtactaagcttattgcctcagtgatgaaataatctatctgtacaccaaacctccatgacacacaattttcgcacgttatatacctgcacatgtaccttctgaacttaaaataaaaactggaaagaaaaaagacctatatgataactttcacttaataaaaagtaaatgtattttctcttccgtatgattttcttagtgttttttcttttctctaggttactttattcattgtaacaatacgatatttatacctataacatacaaaatacacatatgtgttaatcaactgttaatgttatgggtaaggctcccagtcaagagtttgttattagttgttaagatttaaggagtcgaatttatacataaattttcaactgtgtagttttagcacccttagttcccacattgttcaagagtcaactctatacaatcttatccaatcatccaaagtgttaggaatattctagtatcatatgtaaatacatgcatgtacatatatttatatttatgtttctatgcctgtgtattaaaaaacatgagtttatactcatatctccaatttataaacaatacctcagggtgccttttacttctcctttccgtattagcagttcctcctccaacagtgagaaacctagcttcattaatttcaacaatatctacaaatttgctcaagtcaagaatgcatggcaaaaaggtttagaatcactaaccaaaaccactaataattaataattaaacaaatctaataagaaaacaatttatcatcctgttcttagctaaaatgtacacataagtgcataatcctaaacgtatgtagattagatgggttttaaaaatgcatacagttttaaaactcacattttttaaagatataatacattttcataaacagaaaattccttctgtccccttcccaatcaacactgttacttggggtaacaatttttttaatgtttttccttatttttgaaataaaaagtgaaatcttataataggtcccttttcttttatcttttgtttagcataatatttgagagagtcttatgtcagtagtttgatccttccttcactgagtaatagtccattgtacatacatatcactaggtccttatttattttcatgttgacagatatttttttgtttccaaatctgggttacaatcaataaaactgctataaacatgcttgtaaatgactttttatagaacaatattttcatttcacttgtttatataaattgttattcttagcataggtgtatgtttaattttaaatataatctgcaaaatgtttttcaaattttttaaactttcatttgattccctatcaacaattttatctttttaccaacagtgtgtgagactttgagttacttcacattttcaataatttttttattaactttagtctctggaggagtattcacttttggttagttttacatttttctgatgattaatcataagaattttttacttatctttcaatgaaaatattttctccagttatttgcacaccgttttagtgttttgttttatattagtgaattataagcgctgtctggatatattctgctttatgtcctgggtatgtgtttgtaagtattttctctcatgcttattcattttctaaatagtatcattggtgagcaaaaattttaaatttggttagtctaaattatcattttttctttaatgattattgcttattttacatgttctaatacaaaaattcctactccttgataacaaagaacttctacattttctccttcatagttttaggttttacatagagaatgatgatcatctaaaattagtgtctttgtgtatgatgtgaggtagaagtcaatgtcattttttccgtatgaatatctaccatttccaccatcattttttaaaaggcttttattttcttattgaattgctttggatattttgttgaaaataaattaattgtataagtgtggttctatttctgaaatttttcactttcattgatcaaaccgtctttttatttttcaaattaaacactttcttaagctgtaaaatcagatggtacaatttgtcaactttttcttgtatttaatagacttattggccattatatgtttatacatttctatatcttaaaacacatgtcaatttttaaaaaaaactacttgcattagaagagggattacattgaatctatgaattatcttaaccacatttattcttccagtatgtgatgtgattacatttttccattcttatatatttaatttctcttcgcaatgttttgtatttttctgcatattttcctttttaaaaatattaaccataaatattttatggttttgcagattttataaaaagatattttagaaagtttaatttataatctcaacctaagtcttatgctatgatggaggaagacttttggtatcttagtaaaaaagggtgtattttgcatgtaagtggaatataaataatcattgctagatagcaaaatgtagtaaaaagtaaatggataaatagacaaacaagaaaataaataaataaaataaatattacctcatttttgaatctggatggactctgaaatgtttgcacgatagaatcttgcagaagtgttactttgccaattttggcccacggatcttaagagacttgcactttctgattctttcctcttaaaatagttgctccttaccaggttctcaacttcaccattaatgacacttttatcagataatttttagttgtatgagacttcgttactcattgtaagatgtatacagaatccctgacctctaccttgtatttgtgaggctacgccaaaaaatgggttgtgaaaacaacaaaaatttattgtttcacagttctaaaagctagacatccaagactaaggtcttggtaaagttgattccttctgacaactatgagagagaatctcttccatgttcctcccatgttttccagtgctttgttgataatgtctgtcattcgatggcttgtagaagcatcaccccaatcactgctttcatcttcatatggaggtctccctgtgtgtctgtgcctaaattttcctttttgataaggacatcagtcatattagattagaaacctatcctactcaagtatgacttctccttaactaattacatatatttgagatgactttatttacaaataacattacattgtgatatgacctcactgagggttagaactttaaaatgtgaatttttggaggaaaaatttagcacatagtatactcacttgatgcctcttttattcctccagtcctgacaaccataaatgtctctaggctttgccaaatgtctcctggaaaggcaaagtcatttctagcttagaaccaatgttctaaaaaaatttgattacccccaggttgccatgttgtaaggaagcccaagctagtcatacagaaaactacatggacagaagagtgtttgaccaatcccagctgatcaagtgggatgataagtggtcatttttagatattatgtaacacagctcaatctctggccacaataactaagatgctcaataaggaaattaaactcttttctacctataaatatcttatcacactggaattcacttaaaatctagaatagcattatttagattaagtctggatgtagattgcagaattgtagatgaggctactttactacagtttctctgttttcacttttgggtacagtttttcttgattcagagacttacaaatttaagacgagttatctgctcatccatattctcaatatgaaaagttaagcagagacagaaatactacaacagataaacattcttaaaaaaggagagaagaagaaaggtatatagcacagatcagtccatagtacttctgtgacccttcctctgcaagccataagtcgtggctcacgttgcaggtgaataattttcttagccagcttcctgccagacacacaaatctctcagaattatgttctctctaccatgaggtaagagttaagatatgtcctcatgatttaaaaatatatttatctacctgaggggtctacattcctctgccttagatgattcttaacaaagggtttaaaaaccatgcacccttgatcttgacctgaaccctacttttactggtaatgtcctggattcaataatggctctgagtctattttgaaaactttttaccagctggaagtctgaaaataagaatcttatttattttccaacacagtactcctgtgttaaaaatattttttctaaattttggttaaaaacagtcccatcgtcaactcatctcttatttcctgttttatcataggccagtaaatgaagctatttggtaacttccacattttgtcctgaaatcttagcctagttaataaggtcatgctgtatattttctatctttcacattggcacaagcaacagtgatcccagtatttggtcaatatataatacagtttccatttctccagctccagtacaaatttcctcactgatcttacagacatcattaaaattttctgtttttgcaacctctttccaaaatagtctcaatggcacaaaactgttttatttatggtagcatctcacttctaggtactaatttctgtttcaattgtctctatctgtaacaaacaactgacttagagacttaacaaataaaaacctattattatttctcatgaatctgcatattgtatgcatggttctgctgctccacattttgttgactggagttactgatcaactgaccccttcagtattatgataatcatttttacttctggtctgggatctatttgttctaatatgaatatagatcatcacatttttatgcctttttttgaacagtatatctgtctttcttgcaacttatctatgtctttatatttacctgcatttcttgtagattgaataaagctgggccttgatttttttatccagatgaataatctatacctcggttggatttttgtctagttcattgacattttatggaattattttgatcattgaatttatgtttaccatttgctttttgtaatttggcctattgttttttgttgtaattttcttgctttcatttctgttttattttggttaaatatttttattatttcattgatatagccatccctttttaaatttttttttacttgttgctctttggaatgccttttgcataatccatttaaatttgcactactacacatataagaattttacaccagtatggttcaatttatcacatttgctatattattgtcatatttgttatgtttattatttataaatccaccattcagcattataacatttgtcttaaacagttgcatgtgttttaaaaaataaaaattttgtatattctagtgtatgtgcctacatatttttcattttcaaagacttcatgtctttctgtaagtttccacttggtgctatttccctttatgctgaagaaattctttaagattttattagcttaatatttattttattaaaattattatatatatgtttacgagatactttaaaactacacatttggctaacattttaatttatttctgttgggaagcactggcctcggttatgtctatgtaaacgtgaatgtgtattaaatttcctgagggtcatgtgaaaattcaatttctgattctataggaccgggatggcctgaaaatctagatatcttttgattttattctacattttaaaattactgtgattttttgttaaatcataactgtatacatcatggggtacaatgtgatgttttgatatacgtatacaaagttcaatgattaaattgagctaattaatatatctattacttcatttatcattttttatggggagaaatttgaaagttactcttattttgaaatatacacatgtagtaagtgtttaaagcaaattttataagggtgaattgtgatgcttataaataacataactaagtgtaataaatatgacaatagtacagcaaatgaagtaaatgggactatactggtatattatttttatatcagtgtgtcatagtacaaatgaactctaaatggagtatgttaatggtaatctaaagtactttattattcactgtagttacactgctatgtaatagatttcaaatcttatgcctctttttgaagctttgtacccttttatcaacaattcctaattccctcctgcgcccctcctccagtctctggtaagcattattttgctctctgctactatgagtttaacgtttttagatttcatatgtaagtgagattatttggtacttttctttcagtgtctggattattttatttaacataatgttctccctataggttaatcaatgttgtcacaaaagttctttttcaataatatttcatttatgcatatatatatatgacattttatttatccattcttccattgacagacacttaggttgattccatctcctgactattgtgaataatgctgcaatgatgtgggcatgcaaatatcccttcaacatacagatttcacatcctttgcatacatacccagaaatggaattatttgatcatatgctagttatattttttagttttttgaggaatctccgtaccatttttcatgatggttttactaatttacattctcagaatgtgtaagttccctttttcctgcatcctcaacaaaacttattatttttcaccttttgataataataagagccatgctaagaggagtaaagtgatatttcgttgtggtttttataatatttgtatttccctcatgcttagtgatactgagcatttttaaatgtatctgtttgccatttttatgtctgcttttgagaaacgtctgttcagatcctttgcctatttttcaaccaggttgtgtgttttttgttatagagttgtttttgttccttatatattttggatattaattccttatcatatgtacggtttgaaaataatgttttcctttctgtgggttgtcctcattttgtttgctttgccatgcagaagctttttaccttgatttcatcccatttgtctaattttgcctttgttgcctgtgcttttggagtcatatacaaaatatccttgcccaatccaattttgtggagattttcccctatattttcttctagtaattttactatagtgaaaatattctgaggatgaagtctctctagtaataattatattcttgacatcgtgctgatatgttgcattgtctctggattctgttttcttcctttaagcaatgatgttatttattacagaatgatgttatcacatctgaactcaaatgccataccccacctcaatgtatttggaagcagccacaaccactcagctcctcatactttcagtggttgcttccactggggaaaattgagattccctatgtgtgtgtcattcaggcattaacaaaggatttgtgcaatttgtattttggtacccttccttatgtggtgtcctttcttgaattccccagccccttcacttttctgccattctgggagcctcaaattgtcctgtgactcttctacacttaaaattgcagctttctcctattgttttcactgcccatacatatcagactgaaggtagccctcaggtgaaaagcaatagaaatacacattttactcagcagagcttctttctttcaaagcttgactcctctttaatttctgtctgcttctggtaactctttagtgccttaaaacagttgttttcatgatctgtttagagttcacaattgtcatctgaagaatggtttgtctatatgctattccaccattgccagaagcctccaggattactgtttgcctttttgtgtgtgtgctctcctaagtccacaatatcttagatttctgaacactctgatctttgacaaaatacaattttcatagtgcaatgttttctaaatcatttatttccatttaactctgtgcttctcacttgaatcaacctcccactgtgatagttttccaaaaccttgccattgtatcctgctatagtctgaatgcttgtaacactccacagccccgaatttttatgttgaaatctgatttccaatgtgaaagttttggagatggagtctttgggggcatgatgacattctgagagggaaaacctctcgaataatttctgaggtgtataagaaattcgagtccttataaaagagactacagtccttatagaagagatccttcatcccttctgccatgtcaggttacagtgagaagataaccacatatgaggaagtgagctggtaccagacaccaaaactgtttgtgccttgatgcttgactttgcagcctccagaaccatgacaaatatgtttgttgtttataagccacttagtctatggaatttaagatatggactctgaaatatttgctaagaggtttaattgtcctagagggtttggctcaagaacagctgtagaatggctagggatgtagctggtagatgtagatgtgtttagaatttaacaattagggttaaacagctagggatgtagttggtagatttgttatagcactgcaaacaaactcacccttttgttattaacaacctttcttatattatttattgaatatacttttaccttattgcttcattaaaacctgtttcattattattgcatcatattccttttgtccctcttaagcaacagtttttttctatatcaataaaacttcagactcaagaggtgggattacattcccctggttattcattgacacaaagaacctattaatttctctttatttcctcaattctggactactccaactttttaattctatgcaactcctcttaggctacagagcaccaatagagaaaaatcacacaagtttgaagactgatgtcaagaaatgtgtgaactggacttcaatagtgcctaaatttttataatggaagactcttccagggaaaagagacagaacctcagtagaatcaacattggtacagtgataaatttattagctcaagtagcaaatcatgagagtagaagtgcattcggctcaggtacattagggactataactttgccatatctgtttgtctttttatagctttccttattattattatgattctatccttctatgaacttttttcttccaacttgaggacttccttttgccagtaattgtaaattcatgtttcatatggtcaatgtcaaataaagtctgagcaacattttcccaaattcttcattcaagattccaagaataatttttgatgtggttgagggtagatattaactctagtcaaactagcaactcctaaagaaaaatgtggttaggaaaatcattttcaagtgaaatagacactatcaccagcatacaggaaaatgtatattcatttaaatgtgaaaagttttatactctctgatatggtttggctatgtgttcccacccaaaactcttgttgaattctcaaagttggggaggaacctggtggaaggtgtttgtattatgggggcagatgccccataaatggctttcgtcacccctttgtgataagtgagctctcattttgagttcatgggagatctggtcatttaaaagtgtatggcaccttcgcccctgccccactctctctatcctcttgccatgcaatgtgaagttgtgcttgcttccccttcaccttctgctgtgattctaagttttctgaggcctctgcagccatccctcctgtacagcctgcggaactatgagtcaattaaacctctttttttttttttataaactacccagtctcaggtaattctttatagcattttgagaatagattaatatactttccttgaattataaattgttatttttctagtcagtcacagaatataaccatacctccaaattccagagaacatggatttcatcaaataactccctcaaatttctaccagtaaaacctctagtcttacctatatctccatccatactttgtatttggttactttattaccaaagaacgacagattcatcactgttgatcttgacaaagtccaatttattaatttttccatttctggatcctgttttttgtttcaaatctaagaattctttgaatagctctaagtcccaaatattttctcttatgttttattctaaaagatttatgattatatgtttcacatttaaatctatgaccatttatatttaagatgacatttaatgttatcaccagatttgtagattaccatcataccacattccactgccctctctgttaattatcttctctacctcctgaagttgtagtttctacttctggtctaacatcttcctatgcacacattaggattactaagtgtgattggatcctagcaggcaagagatgatgcaattgaactcagaaatgtgtggggaatttaataagggactacttacaaagtgcggcagagcatgtgaaaaccaccagaaatagaatgaggtcttttctgccacccaggagctgagtggaggtagctgagtggatggtgctagaacctaaggcagaggagctgtgtggagaccactgccttagggaagataacctgatcagtggaggggcatagccagcttgaggcaaaacacagagggaaatgaggtgataaatgtatttgcatctgtctcttcctttcctcttatttcatattggggctcccatttgccaaactcaaaagaaagcatggaaaatacaggtcatgtagtgtagcttcttggacactgagtagatctgaaagggttaatggaagatagccatagtctcttaagccccataacattttgataaacaaatcttgcttttgtctcacgttccccctatttagcctcgtttctccttaccacttttctaccaaatattttcaagaaggaatctagttttactattgccactttttcatttcatctgtacagtcccaaatatatcatcatcaatgactaaactccactgaaaactcttcttgtgaaggttaccaaggccactttagtaatagttctctggaccattttcacaccaaatcacattggactgtccaatcctatttaggactttcttactacttcttcctaattggaactctcccatcttttgtgttcatctttggcttctcattgtgtgttcctttcccgatccagcctttatattttagtatttcttagtaaccaatcctatgaaaaaacttgaccattccatatatacttctttttgactggtgatttataaaacgatagtccttctagaactttctcctatgcttcagatgcacatactaggattatttaaaggaaaccttgattttaataatttacaatctgacagattcagtatgcttgaagctctcctgatctccctcttcattaaatgtgcttcttccactcctgtttccctaaagcaacaatccatttatccgacctaggaaactgaacatcattttctttttttcttactttacacatctgaacaccacaacattctaacctattttgtctgtaacctaaatatctcctgaaattatccaattacctaactcaagccctgtttccatacctctacaatagaccacagcttgatttctgcaagcagttaattttttctttccagtgtgccataagtagattttaggtgccttgtcacaaaaagaaaagtaaccacatgagatgatagatgtgttaatctgcttcgctatagtaaccattttactatctatatgtatcccataaatcatgttgtaaatctcaaatacacaaaagaaaattaattcaaaagaagaaaaaaatcaaattctactttataatttagaataatctccccaaatttatgtttaattttccccagattaatgacttcgcattgcccctaatattccttgggtgacagttctggtttgaattctgttgaaaactccagcttcatgttctcagagtaattttagctaaactgaatgtctttgaggtctttgaattcccacaggttcttttgcctctgctccctattttatttaaatttattccaggaacatgtataatacgaggatatgcatggcagtttagcacttatcaatatatacttctttcaatttaaagggaaaagaccatttttcacatgctgggaaataggtagttgacacatttgaatagatttgaacaacctgaaaagcatatatagtgaaaaagtttaaaagttgaggacagaatgctgaataatatcacagtttaagggtgagtattgtgctggaaatgaagaaaggtacccatttagaaaacaatagcgttgttattactttccaatttttcaaagctttcagaccattatgaattcaatgcaaacaacccttctctgtgatttttaacttaattataattttgtctcattgttagagtgtcaggagtacattttctccttttgacaatgcaaataaaaatgattagtataaaacgtacggtatagttaaacatttctctaagtttaccagacctgtcatcctattgttgcacataataggtaactcagctgggatgggccgtacattaacttgttgataaaaccatataatatgtttatacttatggtcaattacagtactttttcacttgatatgctaactttacagaaaatatagtcaaatataattacccacccaaatggagcagtcaataggttataaaggaagaaggaataataggtctggtccattaacatgaaataaaattaaaatagtagaattaaatacatgtttggccaagatattaaagagctttgaatctaaaataaaaataagagaaaggaataaaagaagcaaaaaaatattttgttttaaatggtagatagaaatattcacatctttcactcaggttccctatatgcttgctgccaaaataaccttagcatgttagcacttacaacgaactaaaggtaaggatttaatcaccaggaagaagaacacaatactgctaataaaaaccaatatttgctccatatttactgtttaattgctagacagaacaaatgaaagacaaaattaacttcaactatttaacgaatcgtttattttttttctattggattaataacttattatggactcagtattttacagttcattcaatttatttgaccactcctccaaaataatactcatattgtcattttcattaaagaaatttaactgacttttggttaatattctaaattgatctggacttgactttaatacatttccagaacattagagatggttgtttgggtagcccagccaaaatattttatactccaagaatctttagtatagctgtagattgagtagactggagcatttaattacagcatctgtagatccccattgtagcttgacacaagaatgactgaatatggcctgtgaaggctgaaaaactaattgctccattatctgcactccagtctttttcacttcacaagcacttaaaaatatatacttaaatctgctttctaattacaagttcccataacagagtgtccctatccagaaaacagcattattactctggctttcaacacacttaagcatttttattttgctgagttttgttcttctttgtttactttcttttgtaaacatgtttaatggctaattaccatttcagctttttatattaattactacacatttagagacatgtgtctttaaatctctagcagataagacatttgctttgctcaaacattattttcattttacttgtctatacgtagctttagcagaatgacattcttattaagtacttactttcttgagaatcaagcaataatttatgacaaagccttatcttttttgcattagctactgaaaacttttatattttagaacaaaagagtaacaacttatttctcagcatcaatatatgacagaaatataaggacaattgttttaacagtgatatatgcaacattattttcccccagaactccttcatttaatgaaattcaatatgtgcaggtttcattttatgaattataaagtcatcaacaatttagtttgatgccagtaaattcacatttaaaaatctgaattgtgcatcatactttatttttaaattgacaaattaaaaatgtatatatgtagcattcaatgtgatgttttgatacatgtatacattatggaatggctaaatcaagttaatgaacacatgtattacctcacacacattttgaggtggtgagaacacaaaatctaatctgtaagtaatttttaagtatataatacattgttttaaactatagtcatcatgttgtacagggcatcttgaattaaataaattctcctaactgaaattttgtatccttttaccaatacctcctcttggatgaacctggaggacatcatgttaagccaggcacaaagagacaaataccgcatgatcccacttatgtgtggaatctaaaaaaagataaagtcatagaatcagagagttgaatcatacctttctgtaggtactagcattaacttcatatagattacagtatcactgatatattaataggcaatattaatattaataggcaatttgagtattgtggtcttttctacccactaagaaagcagccctattcctgaaatgcactttgcttctttaaatacttcattggtaagtaagacacttcctcaattttgtcaggaacaacatttacatggtaggcagttatcttctctttacttccattatatttcatggacattagttttagaatttaaaactgctgattgggtaagggttgccttattggttagcactgattataatatattttaaggaaatagttataactatgtgaaaaaatagcatttttcacatacccaaccccatttagttctgggggaaagatgagtaagtgtgcttaatcccaggtgtgtgtgtttttatgtgtgtgtgcatttatgtatgtgcttaataattacttttcttatgtagaaagaaaatttatactttgaggcagtatttaatctcatttactttacactcaaaacataaaatcccctacttaatacattttgtatatcaagacaaatttatacaaaattcatttttggaagtgctgggcatagagggcttttaataaagagtgcctcagaaagccatcattggccatgacaatagacacgttaatgacaacagtgcttattaggaatgacttcctcatatctttttgttttaattaaaatagaaaattgtggtatccgaacatggaaaatatgtatgcagtctggatcctgctttgctacatgaaaagcatgaggttttgttcaggtatattataataattatatcagggaaagtgaaaactcatttttacatattaaaatttttgttcatttctgaagaaaaattaagtccacagtaacagaaaaccaaataataccctttccttcaaaaagaaatacgtatttgaaatttatttgctaagttcagtttctaagactagaatttgaaagggagccagattaaatcaaagccaaccacttacgccagtggatgaacacttcatggaaaaagaattgtattaagggatttattttccacatttatttgttttttaaaaaatgaagaaaaaagattctacagatatcaaaaaatatacagcattaataacattttgtatgaaagctatgctatttttggaggatctgtaattttagtactagaaactaacatgcataaaaacactgcattattcagctctgcagaagtaattacaccaagatttttctaattattttctattgttcccataaatggactatataatcacaattcccttttcggacaaatacctttttccagtatgtgctttaaaaagttataactggtaataaaacgtaacttctataaatggcaaaatgtttgaactagggtaaattctcagaaaaacactcaaattctcagaaaaacactcaaggtgccatatcttacaatttcatgtatttgctaaacagtcactgtacatattctttacattttcaaacaaattcataaatgcataaactcataaagttatgtattattattatgctacacattttactcaaaatgaaacagttatgaatctaacctagtacaatggggtaagagtcatctacttcttatataaaaaagatagacatcattttatcaaaatatatgttcatgcaaataagcatctaatagacaaaacttggactatatcaacagaaagccacaattagctcaaaaaataggttataggttatagtttgatcattttctacaccaggggccagcaaatgttttctatagaggaccagatagtaaataatttaggatttgcaagcaaagagaacatatactctgtacttgcgtctgaagcagccatccaccatacataaatgaatgagtatagtcgtgtttttgagaggcacaaaacaggtaaaggcctggatattctcccacaggacatattttgctaacctgtatctattgaattccaaacaagtaaagttatcaaattagtgaatcaactaaaaatttaccaacttaatcttgtgattttaatgtgtcattctggagttacattgtttatgtgtactatttttctttctttgggaaaaagactgtgaaatcactaacaggctcagagcgaatttaatcagaaaacaaagagtttctaagttttacaaatagaaattatttgagctttttgcatagaaactgaactcatagatggattatatatacactttttcaaaaattgtatttattcataacaataaaaaattcaattctagtgaggtattcaaggaaagtctttcctattagcattcaaaggttaattcttaacaatgctggttgctgtaaagaacaaagtaccttaaccttagtggtgtagcacaataacaactcataaattaatttgtttatctctcagtataataggggtattcctggtctgtgaacatcttttcatataagaattagggacctatactcttccatcttctggcttttctctagtttttcaggcaactccaagaagaatgtagaagaaatgaaaaagttaaaaactgtgagatatttttatgaaccacattgcaagataaaaactactattgattttctgttggtcagaattcattcacgtggtctcatctacatacaagataattaagcctgtgcctagtagcaaaagaaaaagataaacatgtagccatcttctgatataccagacatgtttccagctgaaagatgtataagaatataaactgaattagaatgtatttatgtctaggatagggtgtctacagtataaatttatgtgatgtgatttccagaaaaatattatacattattaggtatgtgcattttaaaataatttaaccttgtttttgcttttttgttttatgtatgtacagttccattgaacgtgttaatgtaccatataaagctaaggcactaccattaactgaagaatccttttcactataattcatagattaaaatatttagtatttagtatatgaaggttaaaatatttatgattacctaacatttctattcatgctttgcaaattctgttttgttttaatggaaaatattttggtttggttttggttttaggttttcttttgttactgttttttatttgtttattgtataaatggggtctcactttgtcactcaggctgggctgcagtggcacaataataattcacagaagcctcaaccttatggggtcaaccaatcctcctgcttcagcctcctgagtagctaggaccacaagcatgccaccacaactggctcatttttcctttctatttcttagagacagggatttgctatgttggccacgctggtctagaacttctggcttcaagcaatccttttgcctcaacctctcaatgtgcaggggctacaggtgtgagccactatgtccagcctaatgtaaaatattttgaatcagaaattatttgcaattgtttatttgtaaattaaacttttattttagagtagttttagatttacagaacagttgcaaggatagtacagagaggtcctgtatactccataacaagtttcccctgtattaatatcctatgctactatggtacatttgtcacaacaaatgaaccaatattgatgttattaactaatgtctgtactttatttgtatttccttagttttaagctgatgtctttttttctgttccaatatctcttccaagataccatattacttttagaagtaatatttccttaggcttctcttggctttgaaagtttctcagacttttcttgcttttgatgaccttaacagatttgagaaattctagtcaagtattttttagaatgtctgtcaattgggatttgtctgataattttttgatgactagactcagaaaatgtacttttgaaaggaagatgagagacaaaaagtgccattctcatcatttcatatcaaaagtttaggttattaacacggctgtgtatgttgatgttaaccttggtcctgtagctcaggtagcaattgtcagacttctccactgtaaagctgctcttccctccatgaccccctttttacatgccatactctttgaaagccagtcactatctgctgtccaaatttaagggatggggagttttgttccacttcattaagttcaaagtacctacataaattatttgggattattgtacaaaaagatgcatctattacttctcatttattcattcaaccatacatttccattagtatggactcttacatatttatattttgggtaccagccaatattcctttattttggtgctcaaatcattctagctttgatcattgggagctccttccattggctcgctttgacttaatctcagacttttgtgtttaagtacttccacattttctggcattacaatattattcatgctatatttcatgctttagtcctaaaatagctagatctctaaggagatttgattttttaaattgaagaatgtatgaaaatccaaaatctgggcagtagaaaaacagctattttttaaatgaagtctaccagcctgggcaacacagtgaaaccctgtctctacaaaaatacaaaaactaccctgatatgctggcatgcacctgtagtcctatctactcaggggactaaggggaggatcacttaagcccaggaggcagaggctgcagtgagctacgatagcaccactgcaccccaaccttgttgacagagtgagatcctctctcaaaaaataaaaaatgaagtctaatatttttaccgagattacttaggccattccctctgtatctttaaagatgtatgattaaataagtatgaattgatatcccacctgcccaagcatgataaaatagtgtctattatataaatattacatatttgttagaacattgttggaaattataattaaacaattattattaatttttggcagacattgtggtatttaaataacatttctcatttaaattacattcaactaaatgagctagatatattcttattgtcatttaacagtgagaaagttataacttaatgtgtttaaatggatgtaaaaatatttgaagtgaggcaaacaatcttacatttttcataagtaattataagatacctttttaaggtaaataggtataacattaaaaaaaatctaaattaattttatttagttgaacagtttcaaatttcttagcttagaaagagatactaaagttcaaggaagtactcaatgaattagtatctatatactagttgcaataatatattaacatatttataaggcaaagcaaggatttgtttagtttatggagaaaaaatacaattcctgaactgaagttgaagaaataccatcaaagttgaacactgaaaaattaaacagatgattagcttagaaagaagaagagaaaacttgacaatttcataagaaattaaataatacagaagaatatttcaaatataacatgctaggctggtaatatattccttccttacttttttattgtatcttttggtttcattggtgacctttcaaatagaaaaataagaaactcaactattttagtgtgtatgtaaacaaaactaatttcactctagtttctgcctaaggaataattggttggtcactttagaagctgactttaagaaaatgaaggactaataatgttgttggaagactgaaatgagttcagacaagagacagaagtgctttttaaagttaattatgtttgcttttccttatcccttggtgttcattacctttaaatggaggcacacactggcagaagtaattaccaggttggtcaatgcaggtggctccatttttgcagggatgtgaagcacactcatctatatcaatttcacattgcgtacctttggaaaataggaaaaaaaaatgttaagtgttaacaagacaggcatgtatcaagtcgtaattcttaaatttgcacaagcctttaatccacttaggatgacatctgaaaccaaatttattagataagaatgccacatatattactatcagaacccatttatttcaccttgctacaaactgtagtaacttctcttagaattactaaaaggacactaatctcttctgagtttgtaggcatgcaaagtctctttagatgtgaactaatttatcttttgctagagagtctagagatggtgcagatatttcaggttactgaaatgcagatcaaatgttaggtgaaaggaaataaaaaaggaacgaaaagaaaatattggtgaatcaataacatcctgatgtatgtccctgagggctgaatgttatttgttcatttgtttgttttggagagggaatctcgctccgtctcccaggctgtagtgcagtggtgcgatcttggatcactgcaacctctgcctcccgggttcaagaaattatccagtctcagcctcctgagtagctggaattacaggcacacaccaccatgccaggctaatctttgtattttcagtagagacagggcttcaccatattggtcaggctgttctcgaaatcctgacttcaggagatccacccactttggcctcccaaagcgcaggaattacagacatgggccactgagcctggccctaaatgttctttataaggcacagttattgagtactatttactaataaagccatgagtaatgggtagatgcatttcaatctactcatgatctttgtagatataatattatggtgccagggtgatgaattactttttttctagtaattttacaacgtaagcctatatggaaagaaaacaaataaatgtccattaactatatagtcttagcattttctttaaactgttgtccaattcatattttcattcatcctccacctagaacttgttttgctaaagctgacctttcttattataccacttagattgcttaatttcccaacagttgaaaatcatagcctcaactgacactgaattgatttttatcacttatgacagctaattttcttaccaatttataacaataatagaaaattgacattgacacaatgcaaattattagcaaattatttgaatggaaacattccttctttttttaaaaaaattctgtaaaacagtaacatgaatttagaaagaagaaaacctacatcaaattaatctaataggaatcaacgtactggactaaatagaaaatatcactattatcactgacaaaatgaaatatttagtgaatacctgacactagaacatcagggtaagctgagaaaaaaagtgaatattaaaaagaattatgtgagtgaatgaaaactttttaaaccttaaatatattagtttttttaatgagataatttaattttgtggaaattgagaaccctactgtcaaagcaaaagtttaaccagaaaaaaagttaaacaatcaggaaagattttattgaaggctattgcaatcaaggagagaagccaaaaatcagtctgagtttgactccattgtaacaatggttgagagtttttaagagctggggtaagagagctcataggtcatatgcatttgctatttagccttaacaaaaagaaaattagatttgtttttcaatcttcaagttaggaggtagtattacaacttggatcaaggtgcataccaaagttagtctcctaccctcctacagagactgggagattacatatgctatcttccttacacttcaaagggatggctcccaggtccttgagaaagatagtcttgggttcctaaatgaacaagaggcttttaaagatatttataccccaaagaggcaaagaaagaatttataattattgggttctgaagtaaattctctaagaaaatgaaggggaggaacttctgtggttagatcatttagatcctgtaaagaggtaacaagagaagcacctcaggaagaaacctgtttaagtttagtcacactgagggaaacctgtttgtcttgtgacaaatacactttgtggagattcctacagtcctcaagttcccaaagactggaaggaggaaagaaataatgaaatattaatttataatattaacatgatactcttctaaatttctggtgaagttggagaaacatgggtcacattcctgcacacaggggaatcaatcaccctgtccctctctaggttactattcttaaatatgtctctgtgtcttctgatcccagcttccccttatcaacctgaatgtcacactgccatgagcttgtatttctaaaagacaaatgtgatgaaatagctaacaatttcagccttcaatttctttccacccctcatccgtatttcccaaactaatctattagagcaatcctaactaatgaggataaagaatttatgatcttagacatcaggagggtttgacaagacacctacaaggaagactttttttttttttcaaatttgacactttaaattcatgcaaatcttggattttgcatcatattttatcctcattaatatataacacattctataacacaatacgtatacacccatagggaaacttgacagtccaagatgattctacaatcactgttgtgactttcatgaagctttaaattcatcccctaaagtacagtgctttagcaggagaaatacaaatttagaggatgatgtaaaaaactcacagcatactttacaggaacatcatggtctgtacctagccttccttcttggtcttctctctcttatccttccctgtttcttgttcaccctcttacccaagtaaccacaatgaatttttaaatgcctgtgattttgcctgggaatacctggtttccttttaaaacctggatcatctcaggtatcctctgcctattctttctgggtacaggttagcacaacacttttctagtgtttacaccttcttctgcagtcagttgcatatataaatacatatatatatatgtgtatatacatgtgtatatatatgtgtatatatatatatatatatacacacacatacatatatatgtaatttctttaaaatgtatgcttatgaaaatattttctagtatccatggctcttagaatagctactgtctgatattagtgctcaaaaaccatttgttaaatgaatgaaaaattaacagactaaatgcagaaaaatgccaatgatactgtatctgtaaaggacaggtaatcattttcaatcctgtttaggacaaatcattaacaaaataataaaattccaaatgatgtaataaatatcataaagattgccagaaacagattttgcgactgactcttcaatttcagagtgtgttccacatgatttggcaacaataggccacatttaaggtgtacatgtatataattttagagcttttattgccaaaatgtagattgaatttaaatgagatttcaatttgattcagtgagctgtagtaaaatttccacttatttgacaaataaattaataagcataagtagtttgaacacattcaataaaatagcattcatgtatccttttcaaaagtttctgggcagacaaattaaacaatcaagcattctacatctcattattttaaaatagactttaatttttaaatagttttaggttcacagcaatattaagcagagggtacaaagatttcccatatactcactccacacatgcgtaatctctcccattatcgacatcccccaccagactggagacatttgtgacaactgatgaacgtacattgactatcagacacttcattttaaaataagtttcatgtgttaatttctaaataatcatattttttcttcctcatgtatttctaggtctatgtttcaattccacctaacacacacacatacacacacacacatatacatttaaattagttttccttttaattgtttaactgaattttaatctgttacttaatgatatttacttccatcatattcctcaattgcttgcaccatctgggctaaatcacactgtgatcgttttctcctcataggaaccatcatgtaggaatcatccattgaccaaaaagcaatccaaataattagagttctgtttcatgcatagtatctcaaacattctatgctttctttactctgggttttctgtttcttcttactctttatttttttgtggtctgtcctaaatcctgaatttgcttcctgttttctcctgtccattggatgtcacctttatttttgtttattcattctttcatttgaaattatatttttctacctattcatgtaattgaaaccatcaactgatttacagaaacctcaaccgtatcatgccctctacatgacagactcccaaatcaaaatttctccagtcccaggaactcctggcttcaatgcctaattaaatattagttgacaacaccacttggacatattctaggcatctcaaattcaacatgggcaaacaaaactctctaagcagctctaccttccttattaactgtgataaataacaaaacccaagagttattctttattgttcctcaccctccctgaattattagtaaatctttgcaactttatgtctaaaaatgtaccaaacctgtctatttatctccatctctattaccaatatctagtctaagtatccccatccccaatgagaacaagagttgctttaactgtttttctgctttcactcttactctaatgcagtgcacaacacatccagagtaatttttttaagtgtaatataattaggaaatacaaatccagtaagaaagttaatggcagtactccaaactccttaccttatatgataaggccctgaaaacctttgagtttagaacacatagtaatcctttcttgctcacttattttccagccacactgaacttctttagattattttaccaaacccatttttacctgagggtcttgctctaacaacttctatcactggaaagtcttctctggaggataactcattcttatccagtttttggtgtaaatggaaaccgcataaagaggattatctttactatccagtaactcctctcacatcaccgtcttttactttgctttataaaacttattacacacatagacatgcatgtatatgggtatgagtttgtgtatttcttatttttgtttggttttcctcccacttgaaaattagcacacaatagcaagtaccttcttttccatccttagctgttggaaaatagttgacaaaatagttcacagcgcaaagttgggccacattaaatattttaaatgaattcatgtattcttggaagtcagagtccattattagtatatgaaaattacatagaaatgcaactgtttatataaaacaaagaaaaaatagaattataagaacttaatttacatattttacaattttctgaaattatatgtaaatgtctttcaatcttcaatatttatgaatatcattattaaatctggttattattaatgtagaggtggaagctattgcttatcctactgaacttgtttgatcaccatcaaattcctttttacatatattttggtttgtggaatgtattataaactacatttattctaaacaaaagtcttactttaacataaaaatctcactgtatagcacgttatatgagatttcttcttcagtagaaaagaaaaaggcactaagtactattactgtgggagaactagagcatagagtatggtcagaaaaatgggggtaaatgtcccataatttcaaatcaagtcagagcagtagctctttcacttacaacccaggtcagaataatggccaaaaggtgtctgatccaaggagtttgggagaaagtcaatactttcaccaatgatgtaattaaatgaggtagaaatctaaagttaaaggaaatgtcttttctcttccatgcttagttttcattcagagtaactttgccttaaaactcttgaccttctgttattcaaatttttttcttcccaaaaatggcacaaagagttatctaaatggtgacaaatagccattggctcaaagttgttagtttacagtacagctaaactttcaaagttggcagaagagtaaatcactgtctcttgccttcctcactggtactgatagaagccaatagtctaagtactctgctctgcagactggacatactcatttggattttacactaagctatatcctcctagactttattattaatgtaatactttgttggatggaagaattttacactaagctatacactaatactttacactaggctatatactaatgctctgccatatactaatactgctatacagtaacatactttgctacatactaatatactatatatagtatattatatattgcatattataagtatatagtatatataacatatataatatatataatatatagtatatatagtatactatatatcatatactatatattatatatgtatgatatatatatgatatatatgatatatatatcatatatagtatactatatatcatatagtatactattcttctctttatttttttgtggattgtcctaagtcctgaatttgctatatatcatatagtatatgatatatataccatatactatgtgatatatagtatacgatatatcatatatactatataccatataccatatatcatatatactatatactgtatatgatatgatatatagtatatgatatatagtatatataatatataatatagtataatatatgtactatatactaatatactctgctatatactaatatactctgctatatactatatatatactataaaagttatatactatatagctatatagtaatagctatatactaataccagtactttgttggatggaagaatatgatttatattatggttcaaactcaggcagagaaaaagaatgctatttcttggttcaaacactcacagacccaataggtctaagtgtggtctgtgtttctgtaataccagaagtggacttgccctctattccctcctcaggtagaatctagaaacgttatagatctctggagataaattggaaaaattgtatatgcaaaccttggactgaaagctgggaagtgagtacctaagatcttagttaaaggagctgaatagtcaggatggccctggaaggtgagtctcacagaaaggctgatccttaattttaatgttcacctctagagctcactgcaaacacagacactaggcatggaagtggcaggctgacttgagatctgattctttgtgtgagtaagccaccaggaaacccctaggcctctttctttgtgactaagaatctaggcgtgctgagccttcaggtgtctaataacatgatggagaacatgagtttatagagcaggtgtcaattaataggcatgtattaaaatttggggtgacataataaaatcatcacaggacctgtcttataaattgaaaattttctcacaactgtgatacagtttgttgactagaaatacttacttcccagatgataatctgctaatggctttaggccaactaaatttttttcagtgttgaaaaacaaatcaaaggatttacttaaaagtgatttgtctgggaaaaaaacaattttttttttttttttgagatggagtatcgctctgtctcccaggctggagtgcagtggcgcgatctctgctcattgcaagctccacctcccgggttcacgccattctcctgcctcagcctccagggtagctgggactacaggtgcccaccaccacgcctggctatttttttttttaatttctagtagagacggggtttcacagcattagccaggatggtctcaattcctgacctgtgatctgcccgcctcggcctcccaaagtgctgggattacaggcgtgagccaccacacctggccagaaagcaacatcttttaaatgggaatacacaagatcagatttatagtaattcttcttcacactattgccacacatgcctaggaaacttttataactggcagttggccttgtaaattaatacgtttgacagtgcacagaagaatgtgtcacatgtatttgttttcaatccccacacttactaccttatggttttcctatggtccttgctattagaacctatccaataaatgtaaatttcattggctgtctacattatttacagatatctacaactgaatggccctcctgcaaaataagcatattgactgccttcagtttttgttcaaacatcttggtttaattagttcaatgacaaccacaaaaataaagaggctagggacatcattgcttgttgatgggcatggcattttcaaagccacagcatctgagcctggccaagccttttcattctggatcccacagagattcctcatatcagtaaatggttaataaaataatctcaatttattaaacattaccacttgccactgtccaaacatgtatattgttactagaattgataagatgaagccagtgaaattacataaatttcttaaagctgtgagtcatgtaaaaattatctttgattgtacctttagcaattttgaacctatttccaggtcatgtacaattggtaataacaagattactcttggcaattatacacttgcagatttcctaatattctcaggtgaaataacaatatggaaacccattttcctataatgctcagtctcataaatgaatacttttttgtataatgaagcaggagcttattaggcatgtcatcagagttgaaagaaaaagtacaacagacctgtttcatgatacagtagactttatatcacagagtgcttcagaaagaagatattagatttatagaaataatcttgtctcagtttttagtcaaaattacaacatattcaaaagactgaatacaaattgattcaaacttgaattcattagggaagctatctaaattggttagattttatgctttcaaatgagttcctttcttagtagacatttgctaatcatgcactaatctcactgcagtgaaagtaattaattcacaaatagttacatattgcattgtgaagatactaatgatatactgtgcatgcaataattgggaaatgggctataaaatatctgcttaacaatatcaaatgggactggtcatttaaatgtgatatgtaacatttagcatatagaattattattcctgaaacgacagaggagagaaaggtcatggtcttttactaattctacttctaatcagcttaggaaaatggccttgttaggaggaaaatggcaatatactttcaagaattaagatatctgctattcttaataatctgtgtctgttggatcaaactaaagaaaagaagagaactagagagtgagaaaaagttaattatatccccaaagggacaaagagacatgtatgtggagaattcaattggaaatttccatttccaaactaactcaaagtcctgcagcaggtcatttttaaaatcaggcttaaaatacatatgtctacacccaagaacaggatattctttctgaatagctggacataattaaatgattattcttccttagtccctaaaaattggagtctaacacaaacagtaaaggataaaaaaaaataatgaaatctaagatgccacagattgctcaattcatcacaaaattgacaaacacaccattaattattggctctctggttttagatatgatgtgaagaaatacaataagtgtgctttagaatgtataaaatattgtcaaagccagaaatcaatgggtgtatcagttgggggtccagagaggagacaggaattacattagtaatttgaacaggaaaaattcttatacgtaattattaactagaaaacataattaactactaggaggagtaaagagacacctaaaaaatagaagattttgggctttcctaatatttgcaagtaatgtctcccattgcataaagttgtccactcatggacaggataacgcaaaagtaccatggcagtgagaagaccctcctaccaaactcaccatgtttttaaaaaatattttgtttcctgtttttaataattttaatatcttctgttatttacatgttatataatgagcatagagtcaactaataatttaattacagtttcagtaagggatatgcttattaaagaggcagatattaattctatcacatgctagcaggttaatagtgtgaaggtagggttaatatcctcaggtcacactgctacttcctggacattaattcctattcatataaaaatcactgtattgcaaagtctaatgacaatttttgacgttatcttctatgccctcattgcatttctccttctcttagaaactcttcctcttatactaaagattttattgcctgagagatttttcaaacctatttctgtcatcttggctaatgccaacatgcatttagagcatccatgaaatcagtgcatttctcattttctcaacattctactttccaacggagtcgaatgttaaggaaatccatttcacatcagtcacaccctcccatggctaatccaaggatattgccctcactgttctctcaaataatgaatacaaacattctgctgacatattattattcagttaatcaagtgtgacctccatcacctatccttgttgcccattctcaatttctcccattacacttttactttgaccttcaggcctttgtactattttttcttctattccatgaggccactcttgtgcaaatattttcactcctttgaatttttttagtgatatcaggaaagcagagagtagtcatagcttctcacctgtgtgtctatgtaccaacatgtgagttccaggtgggactagatattaatccccttagccctagcccaggacatagaaactggccaataccagtttctaggtatcataggccagctacctctggcttcaagaaggcttgtaagtatgtaacagatgtcagaaaatgttaccaatttttacttgtgctctgatgttaaaaaaaattgttggcaagcaattctttgaattaatgcaataattgtttgcttatgttcaactctactcataagccatgctctgcagtatctgttaaattctcatgctatttataaacctttcttagataccttagtatacttttaaatttctctgcactcctctaatatctaatcttgctaaaatacatcatcctttcaagagatgatttaaatttttacctcacagagacaatagaaggcagaagagaagcactccatcaaatttaggactcgtaatcttcatgtttacacacattttctcctacatttttggtactctctttttctttccgaaaataaatgtgatattactcctacacatgtggttgttactcaagcttgaagttttgggggattcagtatctccttcctcatctcttgcatcttcaaacttctgcttttactgtcttctttgatcggcatttaaaactattctagccttttctaccttaaaagaaaacagaaaactttcatcttacatcatcctcattctttctctcttccttcctttgatgccaacttcctttaaagatttaacttatactcattttctccatttccttaagtcaactcaatttcagtcacagaacaagtgacttctgcctttccctctacagaaattgctttttgccattgttacaggacatcattaaaggtaaatccaaactgcgatcttttggtccccatcttacataatctcgagatgacattgtttattgttgatgtctcttaagtgcactcctctcagctacacttctcactgttttttatcctttactttgtgtgtctctcgatgtagcttctgtggtttttctactcgtatcttaattattgacatgcctcagctttggtcatgggctctctttctcctctcaatttgtatacatacctgagtaaactcatacattatactggttttaatttttattttttagatgattgactccaagtttacatccttagctcagatttttcttctgtgcttcaaaatctctccttcaactgaaatatctgaacagctattgaaaggttaatttgggaagcccataaaatagtcagatttatattttccaatataaatcattatctttctcccaaacctttgatttctaatcctgtttttcagtaaataacaccaagtctatatagatgctcctgtcagaaaactgatgtttcttttcagaacctcactttcactaattaaactcaagtgatacacacgtcctgtaattttatctccatttacttcagtaaaaatatgaggttaaaacaattcctaaatactgtataataaatccactcttccttcaccactgcaactatctaatcctgattgtcattaaatctcccttccattacaaaaacagcgttctaagtggctttcctgctttgggtcttatctacgtgctaattcattcttcatccagcagcaaaacttctctctcttgaaacacaaatatgaacatgacatttggcagtgtaaaaccctcacatatgtctcaaatcctcttaaggtaaaagcccaaatatctcagcaagttttacaaggttctggagagtcttcacccttgttaggcctctaccttatgtcttgtcactttctttgcatccacacttagcagtcactcacatgcactcactgttggactctactcataacaaccttctctcaatctcctacaatatttttctcattcttacatctagagttttgtaattttaatttttttttgtttgtgggtacactgtaggttatatcatggctagggattttaatgctgttttcttggtgataaagaggtcactagcatcctggccaattcctgttactaactatatcccattctagatgagacttattttgagaaatcttctttttctatgggggcaaatctggattaggtccccctcctttgtgtcttcaatacttcctgttatgtatttgcatcgcatgataccactcatgtctatgtttaagtttactggtctgtatctcccactcaactgtaaacagaacagttttccctactattgaccatttaatactctatgcccggcactattcataatccaataaatatttactaaaagcatagtataataataaactcaggataaaatggatgataatattaaattgcattttacattatttagaaatcacctatacatacatttgtcacttttttatttcacagtttacggttaatatgacatttactatcttaaagacctctcttccttaagaaatggtcattcttttatcattgctggacatgttgttttagtttttaattataaatttgtctttactaaagccaaacaaaaggaatgtatttaaaatggattatggctaaatggatgaagtagttatcactaacttaaaaaattgcagaaaaatgtagaatttagaaaaaaaacaaaaacttattttaaaaatacaaataatttaaatccactctagagagcaagaaagttgttagtatataaactacccattagggtttttaactttcagcctatttgatatcagaaaatttgtttggaatatgcacttaaagtaaaaatacattggcatatatctaaacaatcagaatgggactattccatattataaatggaattctggaaaaaataatggtagtgttgaaatagtttttagatttctgtgaatgcccatctaataacaggcagatcaactagataataaaatttaaaacccatgaatggcatgcacaacaaaatttagtgacatggtatccccatgaatacatactcacatataccaacaacagcaactctaaaattattcacaagaaccaagaacaatgtgtcacatacatctgttcaactgacaaccaagggaaataatatggcatcgtatgggcctgaagacaagataattcttaaatagatgtgaagtattccctagaaagcatagtaaatcaacttgagaacagcagcatgattgaatgtgtcctctccaaaattcatgtattgtaaacttaatccccagtgcaacagtgttcggaagtgtaacattttgagagatgtttaggttatgaggtcttcactctactacatagattaatgccattataaaagtgcttgatgaggaattgcatccctttttgctctttcatcttctgaacctactagtgtcttgatattgactttccagcctccagactataagataataaatttctcttctttataaattacccagtcttaagtattctgttacagtacaaaatggactaagacaaatagtaagctccgaaggattttgtctgcttgtacaatgtgggattaaaacagataaacaaaaatatcttcagaacagtgcatccctataaactcacaatattgagctgcctcagttgtcttcccaaacagggctacatattggggagaaattgtaagaaatttaatagaaattgagtaggacagggaaaatagacattaaagacagagaagactagacaatagtaggagaaggaatcagagacctaagatatcttagcatgcaagcagatatacaccagaacaataaacaaacaaacaaacaaaaacaagagaagagacagattgctgtgaattgaagaaagctaccctgaattatgtctctttctaaacatccataaagactaatagtttgtgaaaataagcaaaagaaattatcaaaatcaactccaatacaaaattatttaaaagaaatggaacaatattcttaaagtgaatgaaagtttctaaaataataaaagcaaataatgaaaacattgtcaaagtgagatccaatctgcaatgtattactatttcaaaatgagctaaaacattttgagaaaataacctaagctatgaagatacaaaataccaattagaatactcagtaatgaggtcatcaaattcaaaaaagaatcacaaagtgaaaactttcagaaatgaatattataccaaaaagaacatgacaaaggatacatacaataattacgtaagataattatttgaaaaaaatcaagtaaaaaggaaattaagaaagagataaaaatgatttgagagaaataggcaaatattgaaactatgcaaagaagattcaatatttgaattaaaagactccctggaaaagaagcaaaagaaagaaaatgaacaaacattatataattaatgttttttatgaacaaacattatacgacattatataattaaacattattataattaaagaaaactttcctgaaaaagaaaaaggtttcaaactacatggaaagattaaagaaaatatagacaacactcagatatattctaataaaataactgcatttcaatgaaaaactaataccctttgggcatgtagcagataaaaaacagcaattgatttacaatgaaaagaaaattagattaacatcagacttttcaacagcaacatattatgccagaaaaaatgatatatttaaatacttaagaatatttaaactgtgagaaaaatagaaaatgtgagtcaaagattttacagagtaaaactgactttcaagtataaagatcacagacctatgatcatgaacacccaagaatgcaagaattatttccattagccctctctgaagtatatcctagataaataagctttaaacaaccaaaataagcagcagagatcaatatgagaataggtagtgtgcactgtacatctatctacttacagaacccaaactagataaaggaaagtgtattgtatataatgcctacaggctcagaatatagatatataataaaaattagaggaaaatgagggcaatatatgaacaaaatttaaaatgttacattgattatatttttatatatactttttaatattttttatatatgaaaaatgagatattctgattttgttgtcccttattttattgagactagacttttattatggaagaaaggatatacaaatattatgcagaagatgttaagtgtaagattatataatgctgaatttgaatttggtagctctggaatgaagtaatgaatacattgatctgtgccatatacttgaaagtatattttaaaaatgcgcacaactaaacactgccacctagaaatgaacacttgaattataaaagcaagaaagtgattctctgaaaatgaggagattggttagttttgcagaaagggaggtggtacgttgccactgggcacatggaagatgtttaggggtgaagttcgacttcttcccctaggtggtagttataagagtgcattaccttgttcatcttataataacttattaagatagtatttattttgtgtggttttatgtattttcacagtaaaatatgaaaataaaacggaattgttttctaactctagaaataaacaaaaatgaaaaacaggtaattccctttgagactacaatatgccgactctatggtaaatactggtcctgaactctgtaattattcctttcttcagctccacaggttcagccaacatagaaatctcggggtcatagcaggtacagcactgttttctcacctgcactgcatctcccaaattattgtcctgaatgaattccgtgcagccctgcccttcatggcataatcttgcctgtttctactcaaggtctcggtgagaccttgtagagaccatgtggcaaaacattattaaatatgaacgtctctgagtggctactgccgagggagtgcttaataattttacaaaagcaatattgttaaatccattttcaagttacgtttcatctaggaacttacacttcccttctagaagcagagtgtatgatattattccctctatagcagtgagaaagtgagtgcgaaatagcagcaaagcagtaatatcaatgtcaaacacagagcatcagatcatagcagagaaatgaacagccaagaggaggctgctttgtggggccaagtaacattttgaagaaagttttaaatgagaagtatctaggaacataattgactgctgagacaggtaaagacaggcctctgtttaaagagagaaatatgaccaactaaactgacatgtgcttcaccaaagatgatgggtgggacctcactgcatgcaaaaacagaagaaacgttcacataagattactccaaaaactagggcacattgtctaagagtttcggtaatttttaacagagaaacaaatgaaatggtattaaaagtcacatgatgtaatacaagtagtcattgtgtataatactgaaaatcactacttaataaaatgtatataattttcatatcatgttgtgagttctcacccactctacttgttatcttcagtatatttgtaggaggatttttaagttgagaacatgagttcttagtcactatcttgaacatttttgaagctcttagactgtgtttgtatcccaccaagagtttgggtacatttcttgaaaaccaagggtgtaataatctaaccacttctacaattcaatgagtttatcatttcacaaaacactgcctacatgcatttacacatattaatggttttaatattgccaacagcttaacacaaaatttcttcacattttgaaagtattaaatattttctaaaggatggaactactatataaacataaattcatttaacttatatataactaacttttaaacaattcataacaatatagttgctaatttatgtgtttttctatatagttttagaattactaaaagctttttaaaggaagagccagaaacgttaataatctgaggaagttcgggttaaagttttagatgaacccaaaatgttatacaattccatgttacagtgaatttcttaaatagtattgtatcagtcttttagttcagaaagctcttatgattccacctacacagaatactagttcctgcatctatggtaaatattcatataaatgcatagtaaggtaatatttgagtttctcacagcctaatatttctaaggagaattatagcaactcttggagaattgttaacatgtcaattctaacctctagtgagttgaaaagtttcatttgaaatgaaaattcatttgataggtctaaaatgcataaatatctgattatttcctggcaggcaactacagtaaaatctcacacctcaatttttccagatcttggaagtacattcatcaatgtctactgcagtttttatctgacagagaagaaaagcaagcattaaaacagtaaatcaagttggatttgaaaaaaacaggaagttactttacagtccaaatgacaactacataatttaatgataagaggtttgtaaaaccacattttatttttgctggacagttttaaaggtaaagatgatagatcatacatgctacttatacaaattaagttctccaaagaaaaaatgtctaaaaatttgaaataaattcagaaatacattgtatcactcttttattgtggcattttaagaatcttgtttttaggggacttaaaactaggaaaaaatattgaggtcatccaagtttgtattatatttctgttatcttttgaaatatcaaattataaaatatatcatacatattgacaatgacatggcaaaataatcagagacaaaattacatatgtccattaaattggtaaataatgttacaaacctttatagggtatgaggcatcccattgtttgatatatattctctcttggtactttaaaacaagtttgtgaatagctatcatcatcacagttttagaaatggaaatcctgggatatagagctaaacttatttgttcaggtttacacatctagaaagcaacaaaattatgactattttagttttgtctaaatccaaaatttatagaaattatcctcagagtgcattgataagcaatatatatgcataaatatatacacataaatatatacacacacacacacacacacacatacatatatatacattctctctcctcctctcatggtaatctaagaggcatgctgagtacttctactatcagggatctgggaggcagaaagagaagtataaagagaggcaggcagttgattaaatatgaatagcatgtattcattgataatgactatcagaaattagtttcctcacccaggtatcacctcccagatattcagactgctctttgaagctcagctcaaaccaggcagaaaactgaactgagaattaggaaatcagaaaacaggggccttagaaggaataacagtagtatagtacacactaaactaaagtcaacaatggggcaaaaagtcaacgattagtggggatatgggttacctgtagtcacgtctacacacacacagcatcaggtgtggaagcagtatagtctcatacacaactctggagtgcctgatgtactgctacgagacaggatctattagccctaaggttgagtgtgaacaaacctatgggtaatctataattatcacagtcatctatgtgtggttgtggcctctgcagaatgtcattttcacatgaggtacatgtttttactcaaagtatgcatttacaagatagctgcttgaatgaacgtcttagtccatcaccattaaagagagacaaacagtaaataaaatatttaaatcaatgttattggttgcattaacactatgattcaataaggtaagcccactaggcactgaagaaaacgctctaggtttataatgaaattgcatggtattaagagaaaatttaatagcagctaatataaacgcaaataaatgcattaagttagatatataaaacgaacattttctgaaacgctcaaacagaattacaacttcttaactttcagttttttctcaaattcattaaactcaaaattattttttaggttgttttatggaagaggcttgttgaacatagtcaaaagccttccttttgatgagattgtattcatttctagattaatgtcagatagataacagaatttcttataaacacattttaccaaaagtcaaaaaatcatggcaattaatttcatttatttgatcttaaaagtaagatgtctatcaaagttaaaaatgtgtcaacatatatttataagtgaacaacttctaaataattaaaaattactttgagataattttaatggttttagaaaaaataaatatgcttcttcctcagatgctttcagttgttgtattcataattaaacaagcaatgcttaatattcacagatgaaaagctgtcagaaaattatgccatcagaattcctgtaaacaaggtacttttgttaatttctaactgattgggaaagtagcattattgaaccataattgatttcctcttttctattttgtgcagcccagtggttgtcttgtgtggtgtgttattgtaagatgattgcttaatttgtggaatctaaacagcctattgtattctagtagtctcacatatttatatgccagcatgcactttatgtttgcagtcaggtttagaattttatgtcaactattatttcattatttatggtaaacaaatttcaaatttgagacattaagtatgatcagaaatattacagtagaaattaaataatgatttatttgttaaactatttttcttaatctatgccctgcagttcaattgtcaattgaggaagttttagaacacaatagcaaaataggaactgcagtaacaaagcaagattgccaagaagaaaaatgctttttaaattattcctttaaaaaaaagtaaaggtcaaaggagtgtgaccagtatctgatatttaaattaacctaagccactgaaggtattcatatgtatgtgaatgaagttccaaatgtagactgggtaaaaactccaaagcaataatcatgttggctacaataatgcatgcaaatcaaggtaattggtatagataataaataattgaggaatcaaatttaggtacattttccacggccagtaaaaactaagcataaagaacattaaaatagtttggttatttgtccctgcccaaatctcatgttgaattgtaatcctcaatgttggaggtggggcctggtgggaggcgttttgatcatgcaggcagatccctcatgacttggtgctgtccttgaaatagtgagtactcatgagatctggttgttttaatgtgtggaacctcccctcccactccctcttgttcctgcttttgccatgtgacatgcaagctcctgcttcacccctgccatgagcaaaagcttcatgcgtcctccccagaagccaagcagatgccggtaccatgttttctgttcagcctgcagaactgtaagacaattaattctcttctctttataaattgctcagtctcatgtatttctttatagcaatgcaagaatagcctattacaaacattaattgatttgattactaaagctgacagagtattgtgcatgaaattgatctcgatatcaagaagtctggtttcttataaaaagtgaattttatttaatagaaacattgagagatgcagtgttcaatatggtaatcagtagacacatggttgaacacttgaaatgttgatgcaagaggaactgaatttttaatttaaattaactttaatttaaatttaaaaactaattcatttgagatatttaaaaacttttaaatatggttgacaacttgatacatataaatatctattttcaaccttcagtttcatgaaatgtaattacagatcaattccaatgaaaagttatccaaattaagatgccctgtaaatataaaatacatgtcagatttcaaagactaagttagaaaaaaagcataattatttaaatactgttttaatagtgataacatattatatattgttaaacatattattcatattaactttacttatttttaatatagctctttaacaaattagaattgcatatgtggctcgcgtaatgtttttattggatagccttgagaaaaaatcaaaatctgcattgactttacatgtattactaagaatatgttttaggacaatatactctaatttacatatattttctctatcttcatacacatctgcttcccacttaccccacctcccttattgtttcccaaaaatcagaaattctgatgatgtaacctcccttattgtttctcaacaaccagaaaatttgatggggcttgaaagacagaagtgggataataacagagagaaaaatatcttagatttttcttttgtgtggtataatggtgcatttttattactatcattaattaacccagaatggcaaagaggaaaaggatttttgaattggaaccagtgaagagtcaaagaagaggaggaatgcaaaaattttcaggtggagaactctctgtctgtaaactctgttcccaatgaccactacaagatccatgttccctccaagagagctgagaaaacatcactacattcatcattcagaacagggtgagggaaggagccctcgacagaacacgcccagagttacaagttgtcctcagagtagtattattgccattaggaaaaattggccaactgtgagtacagtgtgaatgatctggaaagataaagagaaaggtagtaacaataacataattgttttcctggccatgtaggagtttggctgaagttgtccttaatgtgacttttttaagccaatgcttatttccatcaattttggtttcctactcaattctatttttatcagataagattaactcctatacatttactgaaattatacaacttttacatcttctctttcatggctaaagaatgaatctaggacttatctactgatattagatatcatcatttggcattgtctcaatatactgtggctcactatgggcagctcaaacactatattgcctctgcatcagaggcaattttgaattgatttgtttgggtttgttagtctcgaggaatctcaagatatgatttttaccaaaatgagtgtggtttctttccagctgtttgttaatttaaaaaaaaagaaatgaaaatgaaaactattagctaagttcctaaccttttaataaattggctagaaacacaatgtgctatttcaaaacaatgatattttctaatatttcataagcactaaattttgcatctttttacatgtactgatgccttagtccctcttatgttatttgaatttgatgaacaacctggtatctttatctatgtttaaaaatacatctcttcaggggagagcaaaagacaaacaaaaataattcccattacagtctcagcaggtagaaatgctcttactcaaaccacagacatttcttaaagcaggcctcacagctgtaatcttcaaatacttttattctaatagcaaggcataatgtggtaatttcaaatttgctttatcatgactgttttaaatggtgaatacatattttttctaagcaacagtatattattgaaatgaaaataatatatgtgatcattatgtgtcagatactgaaatgaccattttctatatctcagtagccccttttaacattccttctagtaaatcactatgatttctacttccaaggtgacaaaagcaagcttagtggggacccatagctaacctaaggcaacaaaacagggacatgttggagcctagagtcttccaagcctctgtttccaaactcatgcccttacttgttctgttagtctaattcttgtaatggccattatttgatattttattgtaaatttacaacaaatactttgctctattatataaaatactatcatttggaactgaaacttctcaatattatttaaagaaatcattcaacaaacagattttattttatcctacactatgttcactaaaaaactgagaaatataaattcattgatatgaatttcacttaaagagaattttgacagcacaaactttcacattgttttctttttgattggcaatatgaatttagtgcccaaagtactggttatttaaaaaaatgagattcattgatttttaatctacatttttctattcatcttgagattactaaacatgggtcacaattttaagaacatctaggaaaataagacttcttgtaacaagaactgctgaaaaccctttacttcaatttgacattttgtgctcttctaaatgtatcctaatgcatggtcatgctacaaaatgactatcattagggctgtcacaggccatggctgtgggaataccatgactgatgctaagctatcagcactgtcggtgcaaggtgtattctcagtaatttctcaaactgtccatggaaccaatttctactgatctctaagtcataaaactttacaattaccctgagttcattaataatgtattacagttctcattctcaatcacaatttcatcagatccatgtctcacaggaaggttgacaagtaagccacaaaattatccatataaatgtcaagatttattttcctaacataaatgatctaacctagtcaagcatagttaataataaaatcattctttctgagattaccattcacctgattgccatacccattttggccttatatctcaacctctctaatggtggaggttatggatatagtccacataaataaaccaattatttatgagtcatgttcatttctatattaaaaatacaaaaccatgaatacttatattattgcttattactcctctgtaataggcacaaaactaaattggtcaatttattccatgacaatgaggtaagtactaaaagggaaaaatatgttaaaacagtaattttagttacagatatctcaggttgctgttttagcaaaaatcataacatactctacttcaaatacagaatctcagaatatgtccaaatgggaaattaagtattaaggcactggcaaaattattgcattgaaaatgaacagaaacttgcttctacattgcatttttcctacactctgtgcataaaagtttattttgataatgaaggatatatgtaataaacagtttctgagttcttgaagctattccccccattgttacattactatcagcctgttttgatatattatattaatcatatcataattttaaaatatatgattttttcactgatatatgaaatcttaagtaacatattaaataactaattacagaaacatttattaatctaagtaaatgcatgcaatggactgtaatttatttgctttgaggcattttatagaagtaaacagatagataaaagaatgcagatggggtttcagaagcggcatattgataggcgaaatactatactatctttcaagactacaagtggagaatgttaatatattctgccaaattttatatactgtccatcttaaaaaaatcacattgtttagagtagtttccctcctgagaaaaaaacaaagttggtgacaccacttgacagctccactgaagcaggaaacataattgcattcatttattcattttctcagtattagactcacgaacctttaaaagggtggggtggggagtccttcaatagaagtccttcagtagaaccaagaaatcagtattctatgatttactacttcataaaggtaaataagtcagtgaattaatcaaaaatttaaacagtgtatttttctctcaattggctatacaacctagaatttatatctcctaaaggtaaattgataatataaaaatctataggtagcatccaacattatgactctttacatgactgtagaagttgtgatacatttagaattattgttagcaaaagtctatgtaatacagcatatttgttttgtttcctagataaattgatttatattcaatgatttgtctgtagcagataaaataaaatacataactgatacctcgaatattattttgttttgataactgttactttttcaaccctgttttcctaatcattatctttatttcctcctattaagaatactttaatcttactcattttctgtctgaacactgaaattcatcaatgagagtaaacattgaaccaaaaaaatattccttttattgagactggtctctaagtatgctttctattagagttttaattaaaatcactttcataatatacttttttatatttgtataatatatgatactatatttgattttcctagtattaatctgaaggtgataattttataatttgccaaatttttatattactctaagccataggttgacatgtatatttctcagatataaatgttcatatgtaccagaaatatttttaaaagacatattagaatatatatattttttaaataaaatatgctgaaaaatattttcatttctgaaacttcatttatctttggcaagagtcagtcagtatctcatgattaattcagggctgaacccaaacgacgttcaaattagcatgtcagcagaagaaataataacactatttgatactggtcttttcccttagaatcactcaaaaggttctctaagacagcacacagagtcctggttaacttctgaaaacattctttttcactgtaaagccagactattgttaatgacaattgccattaatttactatgaacttacatataagaataaagattctgacactgcattttccccaaatacgatgaacagtagaaaatcagtagaaaatattagagaaaagctatacttagaatccatgtaatctttagattgttaaatatctgtttcactcaaattgccaatttaaatgtgggctttcttctgaaacagtaaatgctactccaagaaagtaaaaccagtagtgaaattttattcattttactttttaaaataaaaataatatctgccctagagcttattttgtcaaaacatcttcttcactgtcgtgtatcctatggtatgcccttcctattctaagtgtcagagacaaggaaccaaatcaaattcctcatacccctggaaatgtatcaggtttttacttccctacaatcatctacaatttaaatgcaaatttaattttgtcagcatttcatgacattgaacgtagataaatgtctcactatctcagtgagtgttatgaaagtttaaaaatattcttgaaataaagttagtgttttagttggaaaaaactatagcatacagcatgctgaaacagaagaggatgtgcaagaagtgtgtagtagcatgggcatcattgtggaggaataagaaagagggtgtgttgctgggacagtgaaacacctcatcctgctgtctaaatctcaggctatattcctaagggagagcatctgggggttctccactgattgaattgttagaattctgagaatactggaatcaaatcttagaaaaaaactgatttttagtctgggaatctaggtcattagatgtctcaactggtgaacagaagaaaattataaataagaaattatgagtgatgagtgaagccagaagtcatgacaaaggtgaagagtaaaactaagaagtactggaaagttaatgaggcaccagacatctcaaacctttaatattaatcttttagtgaggctcagccagagctttcttgcttttatgacaacattcaatcagagagtaatcatatctcacagcatttgtgattgatctgaagtaaggatctctatttctcagtgttctttctcacttaattttctgtttggttttccctatgatttcatatttgaacctcctttcagtggaaagaacatctgtagtcccatgaattttctaatctgaaagggctacagaaatgaaccatcactgtgcttcaagccagccagaacaagatttatcacttgctttgtgtgtgatcttgaataggtggcttaaaatgaaataatgcaattcccagtttctgaaagtataaaaattaaataggataactgaaatatgcccagaaaaattcaaggtaacagcatagcttaatctccctcccttgatctaaattgtttgatgacttttttaaaaaaaatcttccagaacacaactcagatatcttaactcaaagttcaaggctttccatagtgtctcatccatctgcctttccaggtccacttttctctattccctttacgtagctttttgtttagtcaaatgggaccatttagtttatttttcttttgctatgtctgcctttgctcttgcttctttctccaactctatacttgcatagttatcctttccttcaaggaccagctcaaatattactgcacttctatatttctctcccttcccttcccaaaattaatctctcccttctctacgtctataaaaacatttttttgtcttctggagtacctggcttaatgtatcctcaccttctcctctttttttttttttttaaatccttctctattgtctcatttcctctatagttttaaatatgatagtttgaaattaatagatgatggcaaaaagaagactacagtacatggtgaaaccccgtatctactaaaaatacaaaaattagctgggcatagtggcacatgcctataattccacctatttgagaggctgaggcaggagaattgctggaacccatgaggctgtggttgtattgagccgagattgtgccattgcactccagcctaagcgtcagagtgagactccatctcaaaaaaactaaataaaaaaaaaagaagactacagcttacatttgtatcttagccaaagcagcttctttcttctaagctatgctactgctgcatatgtttggtcaaaattttaggctttcatggtttcttttttcctttttggggggatgtgtatagcatagatcacatatggaaacaaacgcaaaacagaaaatacaaatgggaatgaaaagggaatggaagcagagatattatttccaaaagcttaaaaggagaaataaggattgaattgttttaaactgaagaaaacatcatttatatagaaagagcaattagattatgcgatactggtaaaacgagtcagtggaattagttcacagaattatgaataaaaggtctgtctgcattatgtcttccttaaatctattgtttgttaaatttccaattatgtacatgagcataaacacacataaatacagatatatatgtgtgtggtggtgtgtgtgtatataaacatttgtaaatatgtatatgtgggttttttttttttaacggagtcttgctctgtcgccaggctggagtgcagtggcacgaactcggctcactgcacctccacctcccaggttcaagtgattctcctgcctcagccccctgagtagctgggactacaggtgcgtcccacaacacccagctaatttttgtatttttagtagatatggggtttcaccatgttggccagaacagtctcaatctcttgacctcataatccacctgccttggcctcccaaagtgctgggattacaggcatgagccaccgtacccagccatatgtgttattttttaacgcggtaacataatatccaggttaggatgtttaaggatggatatgtgaaatgtgttttccatcctctcacacactagatcccatatttcactttaacaggtatcatatttctcccttttcattattgcagatcatcctgaaagcttcatcacctttggtttggtttattttccattattccaccaaaatgactattttgtttaggccattggtgccctcttattgccaaatccgatgggtatttgaatatcttttcttagttttcctgtgtgcagcattcaaaattgtcaacaattccttacttcttgaattagttccacacattggctttatgatactacacagctgtgcatcttacctaactggctccttcttctcattcttttcactcttcctctttcacccacctcatattaattggaagactcagctgagtggtatcagatgtcaacactcatagcagttgagtgaatgagtggtgtagtcctgaagtggagagatctgagccatgggccagaatacacactaaacccctcatgtctattaagtgagtactaggcaccaaaaggaatatgtatatttgcttgaataataaatgacctctcataggcttccatttgtgattttctgatcacattcttcatattctatcattccatgcacatgtctaagctcaatgatatggtttgactctgtgtccccacacaaatctcactttgaattgtcatccccataatccacatgtgttaagggttggaccaggtggaggtaactgaataattaggacagttttccccatgccgttctcgtgattatgggggagtcttgtgagatctgatggttttataagagtcaggcatcttccctgtttgcactcactccatactcctgtcctgtgaagaaggcgtctgcttctcctttgtcctctgctattttagtgagtttcctgaggtctcctactaatctggagctgtgagtcaattaaacttctttcctttgtaaattacccagtctcaagtatttcttcacagcagtgtgagaatggactaatacagtaaatcggtaccacagagagtggggtactgctataaagatacccagaaatgtggaagcaactttggaactgggcaataggaagaggttggaacagtttggaggggtcaaaagaagacaggaagatgtgggaaagtttagaacttcctagaaacttgttgaatggttttgaccaaaatgctgatagtgatatgcacaagttcatccgtaagtggtctcagatggagatgaggaacttgctggaaaatagatcaaaggtcactcatgctatgctttagcaaagttcctgatggcattttgcccctgccctagagacatgtagaagtttaaacttgagagagatgatctaggttatctggcagaagaaatttctaagcagcaaagcattcaagaggaagcggggcatgaaagttcagaaattttgcagcctgaccatgaggtagaaaagaaaaacccattttctggggagaaattcaagcctgctatagaaatttgcataagtaataaggagcccaatgataatcaccaagacaatggggtaacgtctccagggtgtgtcagagaccttcatggcagcccctcccatcacaggtctggagggctaggaggaaaaaatggtttcatgggccaggcccagagtcccccttctttatgcagcctcctgacatggtgccctgagtcccagctgcttcagctccagctatggcaaaaaagggccaaggtacatctcgtgacattgcttcagagggtgcaggccacaggctttggcagtttccacatgctgtcgagcctgtgggtgcacagaagtcaagaactgaggtttgggaacctctacctagatatcaggggatgaatggaaatgcctagatgtccaggcagaagtttgctgtagggccagggtcctcagggagaacctctgttagggcagtgcagaagggaaatgtgggattggaacccccacacagagtccccactgtggcactgcctagtggacttgtgacaacagggcaattatcctccagaccccagaatggtagatccacctatgactagcaccttacacttgaaaaagctgcaaacactcaacatcagcctatgaaagcatccaggagagggtgctgtgcctgcaaagccacagaagtggagctgcccaaggctgtgggagcccacctcttgcatcagcatgacctagatgtaagacaaggggtcaaaggagatagttttggaacttaaaggtttaatgactgccctattagattttgaacttgcttgaggcctggagcccctttgttttggccaatttctcccatttggaatgggtgtatttacccgatgctggtatccccattgtatctaggaagtaactaacttgcttttgatattacatgttcataagtggaagggactttgcttgtctcaaataagactttggactttgacttttgagttaatgctgcaatgagctaagactttcagaggccaggcatagtggctcatgcctgtaattccagcacttctttgggaggccaaggcgggagaatcacttgaggttaggagattgagatcagcccagccaacatgacaaaaccccatctctactaaacaaatgcaaaaattagccgggtatggtggcatgcacctgtaatcccagctactgggtaggttgagtgaggggaattgcttgaatctgggatgcagaggttgcagtaaagctgagatcacaccactgcattctagcctgggcaagaaagcaaaaaaaaaaaaaaaaattatatatatatataaataaatacacacacacacacacacacacacaaacacacacacacactttgggggacagttggaagggcataaggccataattctgttttgaaatatgaggacatgatatttggaagtggtcaggggcagaatgatatgctttgtctctgtgtcaccacccaagatctcatcttgaattgtaatacccataatccccaggtgtcaagggcaggaccaggtgaaagtaattggatcatgggagtggcttaccccttgcaattgtcatgataatgagtgagtctcatgagatatgatggttttataagcatatggcatttccccttcttacacttctttctgccaccttgtgaagaaggtgccttgcttcccattcaccttccaccataattgtatgtttccttaggcctcacctgccatgcagaactgtgagtcaattaaaacttttttctttataaattacccagtcttgggtacatctttacaacagtgtgaaaatggactaatacactcaccaaatacagtaaggtctttgtggattagaaatatactggatttgactttatattctctacattgcaaagcagagtaccttgcatatagtatgtttttatttaatatttcctaaatgaatggaaacagaagagaagttaaaggataagtcatgggagcggctgatgcagtctctaccagtgtgtcataaatcccaaaatatttgaaagaaattatagtacagggatccacaacacaaagctgctgtcccaaagatccatttattctatttacttgtcaaagtaatagacaaagtaatagacaaagtaattgacaaagtaattgtcaaagcaattactttgacatccctacactgtcattttctggtctataaattaggggtagtaatactaacctgtcataaggtctgagaatgcaatgctctaatagggcctagaacacagtaaatattcaataacatttatttgttattaataaaaccttcatgaagttaatatttcatgtataatattctgtacctttttcttcctttaaaattaattgtacatgattaaacatgcattttttagagtataagaaataaacactaattgttaaattatatttgttcatattctggattaggagaaatttaattctcagtttgtattataaattttaaaaactgccaggcacggtggcttaagcctgtaatcctagcactttgggaggccgaggtgggtggatcacctgagatcaggagtttgagaccagcctggccaacatggtgaaaccccatctcccctaaaaaaaaaaaaaaaaaaaaaaaaacagattagctggacatggtggtaggcacctgtaatcccagctactcaggagactgaggcaggagaatcatttgaatttgcggggcagaggttacagtgagcttagatcactccattgcactccagactgggtgagagagcgagactacatctcaagaaataaataaataaataaataaataaataaataactgcttaataataaaaagaagttagataattcatacatgtattttgttacgattaaaaataatctgacaacaaatgagctgaatatagtaattatgaaatcaattttatggtttgttaaaatgctaaggttaatcttcacgtagtttgagtttttattgtatttatctgcttcataattttgattagtgtaaggggaatggctgtggcttctgtctggagtaggccaaggctgacatccagtacagcacgacacagcgggtttggagcagaggcgcacaaccccatgcactacataattacatttatgtagccattcggttgtaacctgtttgtgtgagctcatacctggctttgagccactgttgtctgtgaaaaatataactgcactgctgactctgtaggagagagaaagaataagtccacatcccacctgcctacggtccctcgagtgtttttcagctacccgccacccatctactgacttccctcggaccccagcttgggttgaaatctgaaaattaggttaatataacttttaatattgaaaatagtatttattatagcttttaatttatatttttgtgaattatttgacccaatctgtgtaagaagatgtacattagaatataaaaatacaattaccagaaaaataaaagataatttttggttctttcatgaaacatagaaactcaagaacgaaaatgaataaagctatattcaatccagtcagtcttgaattcatgtaaaatttttagtacttaacaaagttgcaaagattcatactattaaaacagaaaagttgtagaagtggtctaacaatgaaattctcagaaagttagaattgtcttgctttatttctcaggcattcctaacattatgatttctgtgacaaaaagtaataactactcatatatttaccagcgcctgaaaatcaaatgtgttataacatgaattatcatagaagtatatgactatgcaattgcaaatgcaaaaagtcatgcaacacactattttaataatataacaatcatcttactgccaatgttttcatttcactaatttcattgaatcttatcttctgataactgtttagctctttaattagatatcaaataattacacttttgaaatgcagccaggcatagttttttagttgccgtgatagcatatagtcatctttatcctgcacattttgtgttttatatccaagcacgtatctaattatctttctgactgaattgactacttacagcgcaggaagatctaacacaggtcatttgcaattgtgcagtcacaagtcacaaaaagaatgaaaaagagtgaagaaagcctaaggttcttttgagaaaccatcaagtgaaccaatatacacattgtgggagtcaaagaaggagaataaaaagagaaaaaggcagaaagcttatctaaagaaataataaccaacaacttcccaaagttttggaagcaaatgacattcagatttacaaaccccctaatacattgatgcattatcatcaaattatcagaagtcaataccaaagataattttaaaattaataagagaaaagtgacatcacatacaagcaaccctcataaaactatcagttggtttctcagcagaaacctttcaggcaagaatggagtaaaaggacatactcaaagtgctgaaagcaaataaaacacctaccatgaatattatccccagtaaacctgttcttcataaatgaaggaggaataaaacactttcccagaaaaaccctgagagaggtcatcaatagcaggcctgccttacaagaaatgctaaaaggaattctgaaagaatactaaacagcaaaatgaaagtataaaacttaatgagtaaatgtaaatacatagaaaaaacaagaatactgtaataccataatgatagtagataattctaatataaaagttaaaagacaaaagtactaagcataaccacaaaaatatgttaatgtatacacaatataaaataggtaaactgtgaaatcaataagataaagtacatgcatggaggtaaaagtgtagaaattttatactgtttgaatttaagttgccatcagcttaaaatagactgctgtaagacaagcatgcctcatggtaaccatgaagaatatatccctaaatatacacaaataaaatatatcagagtatgtcactaaaaaacaaatataattccacaagaagatggcaagggaaggaaatagggacaaaatacctataaaatagatagaatataagtttttaaaattttaattaaaagtcctcacttacaataattactttgaatataaatgaattaaacttcacaattgaaatacatagagtgcctgaatagatttttaaaaataaagatctaactttatgctgtctataagaaacccaccttagctttaaggactaacacaggctaaaagtcaagagatggagaaagatatcccatgcaaactgcaaaccatagagagcaggttagctatacttgcatgagacaaaatatatttaagtaaaaaggtgttacaaaaatatgttgataagttttatttagttagttcagaatgtatacatgtttgaaaacatcatattgaacataataagtaataactttcacaggaaacaaagaagattatataatgataactggtcaattcatcaggaagataaaacaattacaaatatataggcacccaacatcagagcacctaaatatatacataaagcaaacatgacttatatgaagggagaaacagacagaaaaaaatcacagcaggagattttaatactccacttcaataatgaatgggatatcttaacgaaaaaaaaaaaaaaaaaaagcaaaccgaggactaaaacaatactatagaccaacgggacctaacagacacatatgaaagattccatacaatagcagcaggataaacattgtttttaaacatgcacagaataatctttggaacagatcacaattgaggccacaatacaagtcttagtaaatttaagaagattgaagtcttaccaagtattatttccaaccacaaagaaatgaaactgagaataacagaagacaaactgaaaaattaaaaagaaaaggtaagtaaatgatacaatcttgaacctacaatggtcaaaaaagaaatcaaaatagaaattagaaactatctcaaaatagatttttttcttaaaaaaattaaaccaacagaaaaacttaaggcatgcagcaaaagcaatattgagggaagtttatagttataaaagcctacactataaaagaagaaagatcttaaacaattaactctatacctcaagaagctggaaaaggaataacaaattaagcacaaaattagcagaaggaaagaaataagatttgaagataaatagcctagagaaacaagaaaaaatgtcaacaaagtaaagagttggttttctgaaaagataaaattgacaaagctctaggtacatgaactaagaagagagactactcaaaataaaaaaaataggagatattacaactgatgctacagaaataaaaataattaaatgagactactattggcaattcctcaccaaaagattggataacctaaaagaaatgtataaattcctagaaacatacaacctactaagacttatcgtgaaaaaagagatagcctgattaggccaataacgaagaaaaagattcaatcagtaatcaaaaatttcttaaaaagccaaacctgcagaagtaaacagtaaaagggtggtaccagaggccgtagtattgggggactgggagatattagtcaaaggacacaaaatttcagttagacaagaataataatttcaagacatctattatacatcatggtgactgcagttaatatccatatattgtatgattgaaagttgctaagataatttaaatgttgaaagttgctaagagagtttaaaagttgtcaccagaaaaaaaaaaaagttaagtacatgaggtaatgtgtatcttcaataatgtgatttagccattctaccattatatataaatacattaaagcatcatgttgggcacaatgaatatacacaaattttacttatcaataaagtatatctttatctttctaatgaagaagagcccagtaccagatagcttcactggtgaactctaccagacaaagaataattaacattaattcttttcgttaacagaatgaaggataaacatcacatgatcatttcattagatgcaggaaaagcatttgactaaattcagcatgctctcatggtaaaatttctcaaaaactatgcatagacggaatttaagtcaacatgataaagactatatatgaaaagctcatggctaacataatattcaagggcaaaaaacggaaaacttttcctctatgatcagaaacagggtgagaatcgcactctcacaacttccattcaacatagtactaaatgttctagccagaacaattagacaagaaaataaaataaatgccatccaaatcagaaaggaagaattaaacgtttatctgtttggagatgacagggtctcatatgtagaaaaccctaatgatcccccaaaaatctgtgagaaatgataaacaaatttggtaaaatttcagtatacataatcaacaaatgaaaatcatggcttttaaaaatttagttttttaaatggtaagtataaattacatatatacttaaaatcagttgtgtttttatatataaacaacaaactaataatgaaattaaagacataatttataataacattaaaataataaaattcttaggaataaacttaaccatggaggttaaagacttgtacactaaaactaaaaaatatgatgaaagaaattttaaaagacataaatacatggaaagacatgctgatttcatggtttagaagaattaatattgtaaaaatgtccacaatcacaaagtgatctacagattcagtgaaatccctgtcaaaatcccactgtcactttttacagaaatagaaaaaaaaattgtgaaatttgtatgataccacaaaagaaccctcatagatgaaacaatgttgaaaaagaataagctggagacatcatactttcagaattcagatattacaaagctatgacaattaaagtaatttttggtagtgttgtgttagcataaaaatagacatatagagtaatcaaacagaatagacagcctggaaataaactcatgcatatttggtcaattgtactttaacaactatgccaagaatatacaatgaggagtgaaatgttttcttcaacaaatgctattgagaaactggatatttacatgcaaaataatgaaattggacccttatcttacaccctacaccaaaatcaactcaaattgggtgaaaaacttcagtgtaagttcttgaaactttaaaactcttagaaaaaaattatgaggaaaagctcttgacattggccctatcaacatttcttggatatgatgccaaaagaacagccaaaacaatagcaaatataaagaattatgactacatcaaagtaaaaatcttctacatagaaaaggaaatgatcaacagcatgaaaagacaatggaatgggaaaaatatttgcaaagcccatatctgataaagggttaatatacaaaatatataaggtactcctacaattcaaaaacaaaatcccaaataatctgatttataaattggcaaagaatctgaataaacacttctccaaagaagaaatactgatggccaacaggtatatgaaaaaatgctcaacctcacgaatcatcagggaaatggaaatcaaaaccactatgagtaattaatcgacagctgttaggatggctatgatcaaaaaacacaagataacaagtattggtgaggatgtagtgaaattggaatcttcatatactgttggtaggtatgtaaaattgtgtagtcactatggaaaacagtatgcaaaattcctctcaaaatggtaaaaacagtactaccacatgattcagaaatctcacttctgagtatccatccaaaataattgaaatcaggactcgatgaaatagctgtgctctcatgttcatttcagtattatttacaataagcaagatagggaaaccacctaaatgtctattgatgataaaatgatggtggatggtgaaaccaagtgtggtacatatgtacgattattcagtcttgaagaagaaggaagtcttgctacatgcaacaacatggataaacctgaaggacattatgctaagcaaaaataagtcagccacaaaagactcatgttgtatgattctactaataggaagtacctaaaataaaataaaaaaaaaaacaaagtacaatagtgattatcagatactgggtagaagggaaaatgggagttgttcattgggtaaaaatttccgttatacaaggtgaatgatttctagaaatctgctgtactacattgtgctcatacttaacaaattttccctgtaaaatattatgttgtttctgtgtgatgttaactaacacaagcacgtatttttgcttttgtttttaatttccacttttaaataggatcgtcatatctcaaaatgtcctaccaatatgtagggacagttatctcggaggtaacactcttttgtaaaatgcagataaaaggaaatgaaaaaagattctaaggaagaggcgcaatataagaatgcttttcttttccattgcagtagtcaggatatataactggatagaattgcctctgtttagagaaataaaaagaatatattggaatcagtaaatgcattttctttgagtaaaagggttagcgcacagatatttgtaactttggagatgtcactcctatagcctcggggttttagaagcaaattctgtgcttgagatgaatccagctgagatcctgtttctcttaatatgagaaagaatgacttataaaagaagatttaaagtacttgtgtaagctttgaactagtcaagctgaaacttaactcccatttcgtctagtaaagctcttagtgccagaatgttttctggttgtagaggataaatgacaatatgtaccagcagtaaattggcttatcttttggaccagaagagatactataaatggaagctaaatgccagttttgacaagttatgaatacaactcccaagaagccaaatacatttttaggattctgaacagctttttcttatgtagtaattagactctggtagaacagcaactaaatggtgtttacaacattacaaataaattttaatttcatccatatcatttcaccccttaggctgaagagtgatgaaacattatttatacttctattcagttctttctttttaagtggaggaagagctaaaggcaaaattcctataaacaaaaggaagctaaaattgaaatctgtaaggaaattataaagtttaaaaaaataataacaattttttcatatatgcaaagaatagcagagtacatatttatttctttgtatttgcagaaacaccatcaagctaagccatttgcaatgtaaatgtttaatctaaatattgtatagaccaaacaagaaatgaagattatgtatttcaaataaaatacaacaccagtaaagaatatatatctatatatatacataaacacacacacacctatctgtagttaaatgtgagagaaaagtatgtgttcaccaaattcaaacaccttaaataatctatatttataaattatatgtggcataggtcttagtgctttatgaatatacaataaatgctttgaatagatcaaatgcctacgaaaataataaagagagtgtcatcttaaaaggtgttctagtggcaatggatattttgccatctacatttatgaataaaataaaaatgtcatcaagattacatattgagattcattctttgataaacagcagggagtaagaaaatcatattctctaatatctggcacatatttgtattgctgtttcaaatagagagaagaataattaaaaagaaagaggtagtacattaagataaactttgctaaagaaatactaagtacctaaaaaagtagatgaatggcacagtattggggttaaacaacatggggatgaacactgcaaaataaagaattttgactcaaaacagtagattcagctaatataactgatggaatttccagggtaatgggaaatactcatattaaatgtgagattataagtattttgaaatatgtttaagtatgtgggatgggcatgaaatagagtatactttctactacattaattgaaatgtgtttttattacaaaacataaaaatattgtacaccaacatatctccggactgctgcaaatcagagggtttggtaattctcaataacttattttatcaaaggcaaaagacaagagatgatataggtttcaagaacaaaactggaacaaattgatcaacacttcatggcaaagatgaaaagactgacaaagtaagatgtagtgacaatgacatgtgattatccaattatctgttggaattctcatttacataaaaactagattgaatattcttgataagccttctcccagttgatatagagaagatactttagatttaattgttaccaattaagaactatttacaatgaaccagagatgaagggcacctaagaaaaaagtaaccctatgaccttttgtgcggacagttcacgattaccagatatgatgcaaataatattataacagcattctgaaaaataggcattaaaaatgttaggatttcttggtacaacatcatagatcacttcaagctaatggtcaggtttttgtccttaataaataaaagaataaaggtacaagctttttgttaagtctgaaaaagaatacctgacaattttaatcagaagtttttttaatgaagaacaaaaaaagagtcataaggcattctaagatgaatgcacattttaaaatgacattcaaagaataaaaaagaaagtcaaggaatctgtgccacatattgctataattgagtatcacatcaaataatatgatttcaatgataacaaagatgtttggaaaaattgctaaaggtaacaaaaaaaggaacaaaattatgttgctgtctaaacagaaaagaaaatattctatagtacaaggcttgagagactttgttatattttgttttgttttgttttaatataaaaggaacctgttgtcaaatgacttgcccaaggtcatatggttgttcagaaacagaattggaaaagtctattgctgacttcgtttgttttaccaaatcaaaactgcctctataaaagctccaaaaaaaaaaatagaatagagacccaaggtatatcataggaatcttaagatacatgaaagctgacaagaggaagtattaattggtcttgtttttaatcactcaaggaatgtgattagaaaggtagaataaaaagatgaaattaatatgacaatagatattcactccaatattcaaagatgaaatgagatacctttgggaagtactgaattattcctctctcaaaatattcacacttgagtaataaatattagtcagaaatgcaggagttgggattcaagaatcattgggatggtaagaataaataaaattttgtatctgagaagtcaataattaaaattacatgtcaaaaggaatgattctggggaagtggcaagcatttatttacctgagaacttaatagcttaatttcctaagaatttgagaaccgttcaagtaagccttagtttgaaggctgaggaacgaggcaatataatattgaaaacatttgaagtttttaaattagttaatgagccactacaaattacaaaccactgtgtgcctgataatatagttggtaccttgtaagtgaatgcaaagcaaatagatgaaagagcaaattaacttttagaaaaagtatttaaaaataaagtggtccttcttcattactcagcttttcattctaaatttatcaacaggccatatgacgtattatttgttttcattttcattactccacttaaaaacatgaattttgtttacatacaatattaagaaagaaacagccaaatctaaagcagtaaactacctcagataataaatagcatttattcattgtgttctgtttgacctttatgtacttacttcttggtttgtgagttgatgagagatctctaaattacactgtcctggaccaaattgcagagtaccttgtctgctttctgacttggagtcacagttcatcttgaccttgctattggtataagtatcagattgggtaatgaccttatttttttgctatattgcagtccctagttatccacttggcatttatggtcagcttttcatttacagcctggtgctgacattccccagacaatactgtatgttaccctattagcattagtgctcgctatccaaaatcatgcactaacataaatcctccaggtctcccagacacattgtgctgtgaaattcttatgaacttgaaacaatttaccagataatcaactgttttatctaggagtataccacatcattattcacatacctgctattttcccactgacatgaaacatgttttctttcaaaagtcaaaagaaaaattaattatattttattgtgtttataagagcaaattactttgtgaggcatagaaaaaactatctttgaaacatagcagtacaattagacttaagcaaatagcacttgtaagatttttgaagatatttgatttctattctatacctttaatgactttgagaaaatatgtgtagcttgcatttcaaccatttaaaagcaaaatgacttacattaatattaatttatatctcctgaagcatatcactcatttttaacacagcattatgcattgtcatatttattcgatgctaattttttaagtgacaatattctaaaagcaattagcaattttattgtagtacaaaaaatagacaaacccagtattcatttcatttttttaaagtcaaagaggctgaagaatatcatggctctttctactttttttatgtagctataaacaataggcaaatatttatacagaaatttaatttcctttaattaaatatacttcaatgtcctaatttatgtataaaatataatgataaataaaagtattttttaaactttaaatttttggggaaagtttaacaggaatgaatttcagttcaggcttgataatttcacacagagaaataaaaattaagttaaaatgctgaattttaaaactctgctggcatatcatgacagcttttcagggaaaacatctattttcctttaataagattatgaaaattaaagctcattattgtgttacaaagatatagtttaacaaatgctattaatttcattggtcttaattgttttattaggatataattatttaaaggtgacaacattcataaattagttttctttaaatttgttcaattgcagatgtgacatgacatgactgtacaaaagtgtgtggtttaaacactggtcacctaacttattaaggatctattttgtttttcttgttttaacatatggcagtagttctcagagtgtggtctttgaggttggcagtatcaccatcacctggaaacttattagaaaagcaaaatctctggcctctcatcctagctgactgaatcagtaactggggagagggtcaagcattgttatgtcttaacaagtccaatggataattcagatacacattaaaggtcaagaatcattaacctatgagttttcagctgtggtgtcatattagaatgatcagaggtgttaaaataaatacatgcataagtcttatgctataacaattgaaataaattatctggtgagaagacacagtacttattaaagaaccatatttctaatgtatagccagggctaagaaccactgattttacctaacatccaatagagcttttttattcctttttcctttctctggacctaagagtgttctttcactgaccttttcattcaaaaattactatctgatcaccagactctaatagtcaatgccaagtcttcccatttttgcctaacatcctgatgggacccatgctgttgacttattttgtattgtaagtgacatatcaatttaaataaactactatatccatacacaaataacattgtattagtgatttttaacaaatacaaaggtgacccacaaagttcactgcttctttaggctactcatcttatcccattagatcttttttccagtaagtatttagatgatgttatgcagtaaaaacgcattataagtccactgaatttcctgctcacttaataacctagcttgttcctactatgctactatgctatagcattaatagtcacccccagaatcaaaattattacctaacaatgagattatgaaaatgtaatgctaacatagaaatgcagtcaggtggtaattcttcaggcctaacaaactcccagtcatgctagggatttactggtcattaaaaatgtttgaatgtccagaaattttaagtatcagtttcttttatcttgttgttcatgactctaagttcagtgtttctcaaactgttgtgatacctaagaattaacaacaaggttgcattatagaacattataaatacagtactttatttgtgaagtagataattttcaaaggagtttatgttaataagatgcttaagtattaaacattggaagtgattacactatcatcacttccaatgtttttctaaagcaaaaatagttaacgattcttttctgaatgttacttatgaattcatgctttgtgggagaaacagattattttacaaaatgtcttataatgtgtccttcaatgtttagaatgttgtttctttactatatttaataaaatatcaattactgacacattttaatttacatctttcacataccatttctaaataacttcattgcaaacctcatagtatcaagcccacaatttgagtaaatgctaacatattttttgttgcttcaagtctctcttactcatcctaaatgcagatgttgaaaagtttttaaaatgtaagaatttttctcatcatggaaaaaattggaagtaactgttttactcaatatcttcaggtttacctacaagtttcttaaatgcccagttccagttcacttcttatcaactcacttcatgtttcttttctttctttctctcctaaaatgcatatcacgacctcatcttgtgtaatattgtgacctctcttcaaagtttgtatcgaatacaaaatcttataaaaattatgcgtttatttatcagcatgaaaccctaatcatgtagcctatcaaggttatattttctttatattttcctttaagaatttcagaatgatacacttttatcattgtaaatatgtggattcaaataatatattttctgaaaacacaaatatttagctttcaatgccacatttaatgaaatcacatactaattttgtggaagactgagatgttctaaaaagaataagaaatcatgaaaatatttctgcaggcaaacaaaattcagtctttccactagtctttccacacatgtgtgatatacatgtttttccatggttaaaaaaacatgcacactacacatgttgatataaaatgtttccttttaactattgttttgaaaaaaacttttgaataatcacatacaggatatatatgagtatgcaggtttgtatgaattttatgaaagacaataattactaaacatgcaaaaatcaaacaattttaataaccatgtatatgctagaaatcagctttgcctctactgaaacaatttcttcagtcttctactgactacattcttataatgttgcatttcagtaacttcaaaattatattgaggaataagtaagtgaaaattgtaattatataaaacaatctataatcataatgtagtggttatatcattatatacacacacgtacacacataaactatttttctgaaaaaccttgttttcctttcctaaaggaaacataaacatgcgttatggttttcatttaatttttatttaagtatttcttcgaccacgcattttacagaaaatttaaatgactatacatttttacatttctgtttatttgttggaaatagtcacatttgcatacattttattatttttgaatcttgacctaatcctgtctgtgaaaccactgcggtgcactatataaagggcaagagagatggggtgagatttgaatccctattccgtgaatgatgtctgtacttctgaatttcctaaatctgaagagattcagagaaaaagtcatgagtatgtgattcctctttgaggagacaacatgaacctgtaactggaggttaatttacatgctattgctagagcaggaaaattatatctttggagagattaattgaagagcataaatctttactcatatgtaaggaaaaagcagtttcctctagtagctaagaaagcaaaaaagatgaaaaagttgattcatagatgaccatggagaaagatagtgaagttaggaataccaacaaaggtgttagcaggctagttcttacagaccatacagcagcataataccattatgatctgaaaaatcatgaaaatggggctacttactcagtaaattctggaattgacctttcattggagaaaaattagacacaaagaaactcttacgcagtatggatagatgagaatattaaaagacttcaaaaaatcttgggcttgaaggtagtacgatctctagacgtatacttttggtttatttcctttcttttaacataacttcctttcaatagacacaatacatatattataaaaatttcttcctatgacccttattttttctttacttgtaactgaggctattttaatttcatgtaatgtgacattaccactgaggttgttttacttcctttttcacgtagtgcccttaaaagaagaaaacagatgtcttaaatacataattatatttgcctctcaaaataactttgttctgttgttatcactattttacacattagaaaactgatgttcaacaatgttacatcagcctacaaaaggcatacctacgtgagcattaaagctaatatttgaaaccgacactcttgtttatctgttatgttttcctgatgcatcgatcctagtataatcatgaagcgtccttatataactctggtaacacatttcttttgaaattggctttttaaaatattaatatagccacttcagacattttatgttcaccgtttttaaggtatatctttctccttctatttactttcagtctttcaaatagacctacataggtctttacatgtaaaatgcatttttgtagatactatatatattctaacaatgtaaatatatatgttgctatgaactgtgaagggtttgaaatgttacacatcatgcacaaatatttatagatagatggccactacatggctgggtttgagaaaaagaacttaatattatttatcctcacagcaaaatgaacaactgtggtaacatttcagtgctgctcctcacccccgctcctcccagccagcatcaacatagagtgatgtggtgagagtcacatgtagaaatatcttaaggaaacaccagctttcactcaataggtaagggatacaggagaaaaaaaaatgttttcagtgcttataaatggcagagactattcactttccccgattcctttaagggagtctttttggagaaacaatgggaagaatccttaattttaccttcgtcataaaaatacatttccttgggagtcagataaggcctttgtcttcagcttcaaatcttcaagagtctgggttgcatttttttttttttttaatgtaaacacctgggaagaaaactctccagctttcctcgaggactatttgcccacctttgatattaatgttattgttatataacacctacaatataattgattggctcttgggaacataaaagaaacttgtattatctttttaaatctgaacaattggctcccttggggaaacaaatggctgcgatctaacttttatggtgtaagaaaatgttcttgagaaaagtgagagctatactctaactttatagtatattataatgtattataatatattagattccatagctccagaggctgtggttttacagaacaactacaaaactaaaatccaggaaagatttattttcccacagtacagtgggtgtttttttttgtttgtttggttttgttttgttttcaatattctgacaatttctgccttttaatcaggctgtctcatttgttaatgtctaatgcaattatccacatggttggtttaagtctgccactttattttttatatactacttggttgccctagatattatgatttacatccttgattttttatagttcaattatagttaatgcaatatttcatgagaatatatatgaaaacattaaaatcttgctcattctttgttataattcttaaatgtatcacacatacaatcattataaatcctgtaagatgatgttatattcttgttttatacaatcatgtttttaaagaaattgagataaaataagaacaagggaaaatagtattttgcatttactagataattagcatttacaatgctagtctttctttactgaatatatgtatgactgttgacctggcacaattttcctttagctcgaagaacttctttttgactttcttgtaatgcaggtccgtttagagataaatgcctttagcttagtttaaaatatctctatcacttcttggttacggaaagatatttattctgtatagaatttgaggttgactttaaaaaaattacgcactttattttttttgagacaggagctcactccactcgctcaggctggagtgcagtggcttgatcttggctcactgaagccttgacctcttgggttcaggtgagtttcccatctcagcctccttagcagctgggactaaaggcatgtgccaccacaccagctaattttttatatttttagtggatatgggtattgccatgttgcccaggctgggatgcactttaaatgtgtgttcattttcttctgtctttcagggtttctggtgaaaaagacaactcttaattggatttttattaccatgtttgtaatatggcaattgtcttttgcagctttcaagaggcaattgactcttaataatttatgtttctcagcatgattcctttgtgtatagtctacttcatgtttgactaacttctgtctgcaaatttgtttcattaaatttgggaaagtccagtttatgatatgttcatatataattttttctgccctatgctttctccactctgttactaaaattatatatatgttggacatttgaataacatctaacaattgcctgagatcagtgttttttttcttttcaatatttattctttctgttcttcaccttgggtgaactctgttggtatacttgaaagttcactttctttctactctgccatgtgcattaagctcttaagtccacccagtgattttttttcaaatttcagaaattgtattttttttagctctagaacgtctttctccttatctcgctgagatttcctattactctgctgagaattttttatattaaaaacctattttgtctattttgtaaaacatacatgtaagataatctatacaaactatttttatttttttctttgatgatagttataatagccacttttagaatttttttctgttagttctaaacacatggttattttagggtcgaaactcttgattttcctttctcttgaacctatgctatgtgttcttggatttttgcatgttagtaattttggcattatattatagctattataaaagttaaattttagagattctaaatttcatcatttttctctaagtgttgtttctcttgttatagtagaattttttgtttgtttgttttggtaggattgaactgcaaacctttttttacttgggcggtagctcctatattatttcatacatttgtcattacaagagttgtcttgagtcttttctgcacgtgtgcttaaggtattagttgggcatgtgagaaggtaaagttttgagagccccccctttggctctttcccttttaaacatttccccattctttttaacaaatcctggtttccttacttcacttttacaactccttacataaaaaaaaaaaaaacacctttttttcatgtgtgtccctgtcacaactgtgagcactgcttgtactgtccttagacgtagtccaaagcccacagtgacagtaatttactctgcctacctacccttctacaggtaagcaaaaactctgctatagaacctgcctacttctattcaccctctcgtaccttcagatagttgcttattgtattatatacgtgttttataattttcttcagggatttgttcactcaattcctactgtgaaaactggaatcaaaaatgttattccctttttgtttaatgaaatagccaaaataagactagcctttcttctcatctgaagtgctcaagcaacttggtttataagatataaaacatctcaaactatgttcttggcatttttcctaatttttaagaattcacagcatctctattacacaaaacttcctgaaaccctttatatcatgttttgtgaagaagagcctcacatgaaaattgtcctagaaaaccagtttttctactatcttttacttcttacagtaattgcaaaattctgttctcttttcattccgtttacattgttcattcattaatcatttaatgacccgtaactatgttccagtagttgttaaattccaaaacaaaagaactaaccaggaagatccgaaccctgaattgtgttctttgaaagtagttttgaaaacaaatgtgtaagcaaataaattataaaacacttttaaaatggttattacacaagtaccaaaaaagctaggaaagtgaaggaaatttttacctctgttttaaggtggaaggtaaaactttatagagggcaaggacatttgaattcgttcttgaaaaatgacaagatgttttccaaataacatctgtggcatagagctttccagacagaaataagagtaaatagagataatcatttttccacgtatcatccctatttctctctgtggcttttttttaagccaaagatgcaaacattcatcatattaaagtacatattttaaaaatgtgtatctttttttcaaaataaatgtttttctatgtgtttgacatataaggtacatggaatggatgtagcattgtgtcaagatgcatgatgctaaactgataaaacttgtcctccatcgtcaacagtgcagtataaaaaatcattgaagattaaatcaattaatgccatgataaaatttatatattagaaagatagtaataactccggttatagcatagagaacaaatttggaaagagaaaattgtaacaaagcagaccatctaatgcttctgaagagtgattataaggatctgaactgcctcaatgataacaggtattgaaacttcagatcacattaggaaaatatggcagatggaattgacttggcagctaataggaaatatgtgcatagaaaatattaacgaaataagactccaatattttatttttagtaattacattaaaaaaaagaagacattttcaagatggaggaatgagttttatttagccattgttgagtttggcgtatatattataaattatgacttcttatatcatttaggaagaatatgtagacaacagaataacctgctttttattttttgtttgtttgttttggtaatttaccattattatttctcccttgtctctctctttccttaattctttaagtgtttcttaacccctgtttgttttggtttgttccaaccctagccctaacccccaaatttattgagaaaacttcctagcaatatagacaaaatatatatttattaatacaatgtatgtttattaattcattttcttttcttggatcaccaattattttgtcacaaaattctacataattggcacatcttacaaacctttattttggactgcctgccaaaatggcacccacatgggctgggtgaggtgactcaggcctgtaatccctccctattgggacgccaaggcaggcagatcacctgaggtcaggagttcgagaccagcctgaccaacatgatgaagccccatctctactaaaagtacaaaaatagccaggagtggtggcacatgcttgtaatcccagctactcaggaggctgaagcaagagaatcatttgaacccaggaggtggaggttacagtgattcaagattgcaccactgcactccagtctgggtgacaaagcaggactctatttccccccaccaaaaagttacccatgttaactttggttccatatactattccatagccacaattttcatctaatttcattatgttcatctcccagaaaaccttactcactttcaacttggagcttatttgctccagtatcaatgtgagatcttttaacctccgcttgagatatgagataactaagactctgcattttaacaacttgccaaacgcaggcccagagcagtttttctgatgaccatattaacttgctttccatcatagcatgctttctctgcagtcaaaaattgtgttattcttggcattttattatatattttctttgatactggatactaataatcatgaacattcccgagtatgcaaaatgacaacctaatcacaaaaaatcaaatataatcttttaaatcatttttatgatagattttcaaagctgcttaagaagaaaaatatcacctgatttgctgtatatatgacctacctttatactttctcaaatctcatggctaaaaaaagaaagtacaatagatagacctttcatctaattttcaacttgcgaccatggcctaagcttgtaataaacatcaaattctattaaaaactatgagaatgttaaaaataaaaacaaagaaaaacaaaatcaaattcctctgctctctctgctattttaaaaattctgaataggaaaaagatctacatagtgaaataaatgtgattcaataaatagcttacattacattgtgaattcctgtatgcttacatcaagttaatgcccagtaattcaattaaatgaacacaatttagaaggagagatttccttaataatgtagcagtgcagtttctgggtaaaatataaaacagtatttatggtcatttactcaaacctctactaacttcagtggatattactttatgaattttacagtatgacacaaaagcaagctcaatgaagcagctatttctctaccagttgaagataataaaatactttactaagtagtcatttgtattacagttgcccttcataaaatactggtgctgtatatttttactatttgcttccactcttatggtatgcaaatataatcattataccattttactgaagtgttcagcatgtttctacaccttctaaattggtgaaaatgaattgcgatagcatgcagtattaatataaaatgccaggaaaattgcccacataatataactctcacattataagatttaaaaatgtcagtttagctcttgcaaacctccttttagttgtgcacgtaagcagaaacatgaggcactaagtgttatatatcttttgaaaatggcccatctctctagggatcagaatagtaatactgcttgcaaaataatatttgcagaatcaaagagaagaatactaatctcagtgaaacctaaatgtattgctttactgctattgaaatttaggaaaaagacaagactctctctgtgaagaatacaatgagaaattgacaatctatatgatgagtaggtctatacatttccctttcaattttatagagtgtattgagatctaaaaaaaaaattgtataggtttattcctgagaaaatacagagttcagtcacataataatgcttttgaccaattttgaggcaaaatttaaaacgaggtagtatggatccttaagacaacctataaaattataagccatggtgcttcaaatggcagtatcttctagctgtattcaatacagaattttaatttttgaacaagaatatatttacttggaatgattgcttaacttctttcttcatgccatgttcttctttacttcttattcgaattcttatattgttgaatgaaagaaacaaacgtggcatcttttagctgtgtagggaattattgggaagacaaagcaatttactggttttgtttcactttttcctatgactaattttttcctgtaagtagctggaagtgagtagcacccacactacatgattgttaagacagaataagttaaacaaagagaaagacaggagaaaaactaaaatcagtcttttctaaagccagattcctctttgtaggtgtgattacagaggcactgtcaaatggcagctctgcaaagtactcttgcttattaaacgatggcactaagaaatcagcatgaaaatctttggtctcctacatagaactgaccttatttgtaatatctccatccaccaaatagggataacaaaacgtatgagaaacaaatataagaattactaatgaatatatttaatacaaataaaacattcagaaacctagaaatatccaacaaatgatagtttcactggtatcaaaaaagttactcactgtatttattctctccattacataaaaaatgttaaagtattctaaatacatgaataaaaatacaaagaaatgccaaatatatgtaactcttatgaaataaaacaaactatatttctttgccttacatttttatagaatatcatatttttttcttattaaaactcataagtagatttgaaaaaaaaaaaagcagcagcagcagcagcagaatctttagttccagaaggacttgaactgaaatcctggcattcttattctagacatttgggtaatctttccaaactaattttttttttttaaatttctccatctctaaagtgatatttcagggtggttactgagaaaatacagtagtattttctgtcctgtctgggatttagtaagtatctccagaagtggaaaaaatctattctatttttctccatagatattaatattaataaagaagataatactgtctttcttggataccattctttctttgtggtatgctatttctctgctttgaagttatttatccctctttgatgacagttctctacactccggagtcacttcttcaagtgatttcatccactattacaggttaacaaccaactgcatgttgattgctcccaaattcagatctctagattctgaatactcctatgtactttatattttaccacaattatacgccctctatttcacttacactattcatcaacttttctcataatgctagtcattcccctagtgattcccattaccctataaacttttctttggcaccactaaagttcatgttatcttttacccttgcatgttttcagtcaataggtagagctgattttacttaataaataatcctcaagctgttcctgtttctcggcctactacatcaacttgaattttcagtacctattacctgaaattctttatttggctgtatttttgcatctttgcctgcaaacttccacaaatacatactttgcacagttatcaggctgatcaaaatatcatgaaatgtggctgaaaagctcttattttttaaattatgaaatgaatttctatcaaatataaaaacaaaaaattttatacaaagtatcataatatacctttcctatgaccattgaagttttcaatgacctaatgtatatgtgcctatccatgttcatctttatcactcactgttttgcagttattttagcaatagcaaactgcattcttttctgtatgcttttgctcatgtccccacttcctgaaattatcttttaatcttgctttacttaatttctactatattctgtgtctcggatcagactagctaacagacctatcacatgctttgaaaaaaatgcctgacactatgttaaagggagaaaatttaaaaaatttatatattacatcttatcttttcattaggtacattcatagctaagccatgccttaagataatactaataccaattagaaatagtctattgaggatttttatatatctgaacccatgttcaggattttataggtatagccattaaactcaaaacagactgtggcagacatatcactattatccaccggaggccatccttaatatgcctctctgataaaagacatagattagatttcctcagagggtaaaattaagatgtacagagtttaggttacttgtaggacatcatataactaagtggtggatctaggagttcaccccacatgtttctgacttccaacattatacttcataacactgtggtgtaacttctctcaatgaaataactatgtctgtctgtctgtctgtctatctaatctatctatctatctatctatctatctatctatctatctatctatctgtttctgtcctcatgagtatttaaatgctggcttgacatctaaaacaaattagatagtagacaacactaaacagtaacattttggaaaacatacctggagtaatttaccctctccctacattcaaatttaaatattcatgaaaacacagaaaaacttatgagttgtttaaagtagaatggaaactaagcttagtggtctataatatgccaaacattcataagctcagtatgactctattaccaaccatagcaccctcctcttttacccacctacaataaacaaaagaagtcaacattcttcacgtctaattaacacattttccccatagtactctggaaagtgaggcatggatgcatgattcatggagggtgaattattttagtcatttaaggtgctttgtggctagaaggatggaaaaaggggatacaagtgctataagtggatcacttaaagagataatctatctctgtgggaagcctgtacagaatgagacactctctagcccaagggcaataactggcttctggagcaagatgctggctattgaacgtgacaaggaactgcttatggctcctcctgaccaaggctgtttctgtacctgagtccttcaggagataggaaagaaaactagccaggaaggtaaatgaagctgcttttaaataacaattctatgaaaacaaaacaaaacaacaacaaaaaaacaaaaacagagatggttgcatttacttccaagacaatatattttatatctacattaagcagaatagggtttgtgacttaagttgttatacaaaaatgacagttacatttacttttgaaaatctgtgtttgtgattatgaaacttgagtctatcaaaaaggagaatatttcctgccaccctatcagttactcccttcctcagtggtttaggggcttctgtgggcatttcaagcccttatcaatgtccaatattcctttcttcccaggtgcatggaacagtggcacttttcttttgtcttgaagttgtagccattaaactgcactggccagtcaaatgtgagtaggtgatatgaatcactttcaggaaacatttaattgccagactgcaactctcctgtgttctcttctccagcccaaaggctgccttaagcttttgaggtcacaggtttttaccatatcattacttagcctaacccaagtgaaccaaatgaacgaaccaaatgaaccaaatgaatgaatgaaaactgctttctttctagctggaactctttccaacatgatcccaaattagacaaagcaccttctaaagctatttatgtaccatcatttccataattaaaacaggtataggacaaacatgggtagatggtagaatttgctgtcatagacataaagggaaccagagaaaaggcattgaaagacattgtgatcagtaaatgctaagtgttgtgccttttcactctctaattacataaagggagtaatttacagactgcttcacattacccaaaatatctgtcccgcagtcaattgaacataaattttcaagaataagtccctcctcacatgaaccacagcaggaaataaaaagcagtaagaggaattagactagctgatttgaggaccaaaataccatccatttaatattagagagttcaacaacaaaaacataatatactttatgtttatatgaagaactgcatgtttaggttattcaagaaataggaaaagcagacaacaaaaaagaatgggcaactgaaagaatttccaaggaagaatctgacataaaaaagaattaaatatgttattaatgccctaggcactgatagatgtcctagagatagagctatgactagcaataccagatttgtttttattacatgaaaaatattttgaggaggctgtggaatgtggtgaattattacatctagaggcagaaggaggcaaaacaatgacataaaaaggaaggcaaaacttgaaccagatacttacagacaataactacaagagataaataaaactgatagtacgaggaagaatggggaaggattgtggttgttggtgatttagagtcagaaggctgggaaggtctctctagaagaagaaagttaactgagattcaaatgatatgaataatccagtgttttgaggttttggtctctgaggtgagatcacgttggcagcatttgaggtgtagaaagtattctagtgaaactgaagtgttctgagcctgagaagaattgtatgaaatgatgtaggagatgtgggctgggcctttttgtgacagatgctggtagtcacatgatgagggcctagttaggcttcatttagaaaatgcatccgaattatgaactactatccaaatacatttaaaatattctggtgtattttgtaaagttaaatacttctcttgttaattatgtctgtttagataggtcttgttaatgagacaagaaacacctgtgtttggcttgccatgaagaattatactggctgttttgacctctggaggaaggctgagccctttggcatcacatgtgtttgcagctcgtcaagctggctggatatcccacctctccatgccctatagctctgtctcggaacctgtgattgctgtgaattgtgtcatctgcacacagttcactaaccagttatgtatagactggttatgctacatttagtagtttgtgttttattctgacagttggaaagccacaagagagttttaagttggggagtaacaaataaatctataatttaatgggactaccatgcctgctttgtgacaaatggatcactagaaggcagaaattgtagtggggtgaccagtttgaaggatgttgaaatgactgcaaataaacaagtttcacaggttctttaaggaaaaaaaaaaaaagaaatagctgacaattctatgcccaatcaagttgtcattgagataaagttaacagaatgtttgttaatatataaaatgtttaaattaaatgttaaatatattaaataaaatctattgtaaaaataaagctctatgttaaagcaaaaggaataatggaaatggaatgaggggagaaaacataccaaataaatcaagtaaaatatcaatagttaagtttttctcttttcaattattatttctagaagaactagtttatgtattacttttatacacttaaagcttctagttaagaaattgctgctctaagacttgagcctctgccagtgaatgctactgtagcacataaggcttaggaagtgggcagcatgcttgggaataccattatcttagagacatttgcaaaagttcaaaactaaacatgtgtaagttacttccagtaaaagtcatcatcttataccaaggcacaaggagctaccacgtctaaaccttaacacaaagagaaacagcaatagaactggtgactgcagggtttcagaaaccaacaaaaccaatcatattatgattcaaatataggtaaacttgagtcattatcagatgttcaagcactgatggtcatcattcacccagatatacattctactcaatctagtattcccaagcacttttagggtcctccactggggtttgccacactctggtaaaaagaatcccatttttaaaatttcttagcctttttatcttttttttttttttgcctaaatcagttgttctcaaccctgaattcacataatattgaatcattctttgatattaaaaacaaacaaaaatagctaggcatggtggtatacacctgtggttccagctacttgggaggctgaggtgggagaatcacttgagcctggaaggtagtggctgagctgtaattgtgacactgcattccagcctgggtgacagaacaagaccctggctcaaaaagcaaacaaagcctgtaattctagcactttgggaggccgaggtgggcggatcacgaggtcaggagatcgagaccatcctggctaagaccgtgaaacctaccccccctccccgtctctactaaaaatacaaaaaattagccgccgggcggggtggcgggcgcctgtagtcccagctactcaggaggctgaggcaggagaatggcgcaaaaccggcaggcagagcttgcagtgagccgagatcgcgccgctgcactccagcctgggtgacagagcgagactccgtctcaaaaaaaaaaaaaaacaaaaacaaatttaaaaaaaaccccaaccaaccaaactaaaaacacaacactcacagaaaacaagcaaggaaacaaacaaatgaaaatctacctcttccccatatgaagatgggtttaaatcagaaaacatactttaaaacaacacctttttttaaaatagttttcttcagaaaacaagcttcctctgcggccttcttaaggctcttctcttacacatcacatatgtcagagacaaggactgacatggctcattatcaatgcttccagacattactctttttctttaaataagcaaaaaaaaaaaaaaaaaaaaaaaatctttggttcctttaagatatatattgtctttccataccagtgtgtcacacactttaatgcaaaccatgtggagtttgtattaaaatgcagtgcagactatgattcagtaagattggaatagacaagattctgcacttctaaaacctcagagggactccagtgctgctggtccatggaatacacctaaaaagcacaagccaatatcatcctctctttctgtgaatcacctcttcgccctcccattcttttgctcaattttagcctctcgttcacagacttttcttccccatctccttttatcaatcccaatgatataaacatctatatagatgaaataatctcaacctgaacatttttatattaataatctaacattcaatgatgtttccctctacttcaccttaacacttgtaccttatcaacaagaaacaagactacatttatatgtctattttaaatatctggttttcatcttccgttctgctgcaccatcctatgtcccatattcttacagttctcctgatattgtacattcattgccatcatttcctgaattcattatgtccctgagcattttgactctactactttctcagaagggcccttcttgtcattcttggtggggagcagaggcacatgagaatcctattctttctggtatctgcatgagcagtcagcccactaaccactgagcaattcgtttcatgtgaatcttgtcagtggccaagacacttgtgcacattgatcttgactgacccaaaagagtatacaccaagtaagggaacagtcttctctgtttagagatggggatgaaacttatacagttgaaaaaggagacaaaggaagagaacaaatggggaacatttgagtctctattttcattaagatggaattaggcatcagattatctaagtttccagccttatttcatcaaatcctaattctggtactaggctaattattactaaattttcatgtggtgtgctttgctaatcacttcttgtgttttcatgagtgtcttattggaaatttgtgaaaaaacatgtcaatcctatcaggacatgattttaaggtagaagctaaaaaataattcagaatattttggggggagtgagtgattagagaacatgtataatggagaatgatcagctctggagcatgtttactttagcagtgaatggcctaatctacaattacttgcatgtttcttagaacattttcttctctctgtattctactactctacagtgatacgtgtataataaattgccatagtgatttggaattttaaagcaattcaggttaggctatagtatctcaaagcccctaggtaaaatttaaagcagaacacaatttacttaggttattttcattttctgcttagtctcacctttacttatttcttattattagtcttcctgtttgtttcatatagctaatttatttttgtttgcaacctgaaaaaaaagaacactaaaactaaatttggaaaaaaagtcataaaatttcttatatcatgccttatgcctaatatatttaaaatgacttaagagaaaatagccacctatgtcttttagataatttgtaaaataaactttcatatgaggtgtaatggaagaggtctcatattgaatcttgaattgggacagatattaaaatatcagaatcccaaaaaattgttttaacaagtaaaacattaaataaagtacagaataacatatgcacagaaatgaatatactaaaaaagcaggtttttcaaatgtagtccagaataacttggctttcacaatatcacaaaaaggggatttgccacaccagaagaaaccattcatacatatcaccccacttgttttttcctaataataatgtttataattcagacaggtcttcaaagacagggacctaattgggcttatgcactggattggtagacataataaggtgaaagttatgaagagcgtgtcaatgagaaaatttgatagtcttgaaacgtaacatattaatttgcagtcttatctcagcaaaacaagtaactatcttattttttgaaattcgtactgtttatcataggaaaaaaaagtgtggtcccattaatgtttaacataggaaattatgttagtttcagttttcacacaccactgaactgtcttttgatgccatagtttgaaattataaaatgtggaataattaaacatttattgaagttataaaaagtgagaaaaaatataatttttgagtcaagttttcacaaactaaaactattttctgttttactcttaaatctgagtaaatcatctaaaatcttaaaatatcaattttagaaataaaatgaaaataataccttgtttgaaaatttaacaatgattatgtgagaaataatgcaacaacacgttgagttcagtgcctggcatagatatacatctatccatttattcagtaatatttgaacatagatattatgagcatatattaatatgaagacacaattagtcgtgatttctaaaaaaataaatacagataaaaatgatttttatgagtacttgcagctatgctatgtctatttaacttaaatataaagctcatataaataaagggaaacttgagcaactgtaattttaaattccaaagagacttcttgactaattgctacgtaaacatcctttcttcgactggggaaaaagtgaatgtacaaacattaaaaaaatttgttcaccctaatgttgtatcctaatacaaagcttgagctattatttttctaaagagatagttaaaaataaattacaaaagaggaagaatgaaagcataatgtattctgtaatacagttatgttttattttgtgttaaatttattttttgctgcttttaatataccttattagaaaatagaggaagtcacctcacattgccataaatgagaaaaagttgtaattaaatataattaattgaattaagttgcgtatatggacagaatatataaggacacttccccttccaccaggaaagcaaagaaataaaaggtcctttgaacagagcttgaccttctaagacagtttgtgataggaattcactgctcaaacctatgaaataattgcaattgaggaaggaaacaatacaagagcagaaggttgacaaaccagagtggctaatatatgtttattacttaatgttatgtcttttcaaaagtgaaagcagctttggtgaaaaacttccaattggtggctatttcttggctttcttaatctttcaccagctgacttataacacccacccacccacacacacacacacacacacacacacactagtttagtctcccaaagagaaaagtttatcatatttcgccaagaatttccctaaattctgaaatggtgaaaacagtcactttatcagaaggatgttcataatgttaaattaacatttaaagcaagccaggcctgtaatcccagcactttgggaggccaaggcaagcagatcccttgagctcaggagttcaagatcagcctgggcatcatggtgaaatctctacgaaacagacaaaaattggcagggctggtggcatgcacctgtggtcccagctacttgggaagctgaggtaggcggatcccttgagcctaggagtccaggctgcaatcagcctagattgtaccactgtactccagcctcagttacaaagtgagacactgtctcaaaaataaaaatataaaggaataaataaatgtaaaaaaaaacattgaaagcaaaagggactttgtagacctcctacacatggatacaaataagaatttatcattgagcttgatgttcgctttgtcacattgagaaaatttaaatattatttccagatgaataaatttgttgcattaaatgtcaatggtacactgaagcgagaatgtgatttgaactcaagagtctttagaaatttgtatcaaaagataatgtacatgcttaatttttatatgtaattcacaaattataaaatataatttgtcagaataaaaaatggagttttgtacttacatttgaggttttataattttattacaacttaaacatctccatgtctaatgaacaatatatgcattacttctcctgactacatcaatctgcattaaatcatagtgacagttgcattaaatcatagtgactgttacattaacagctaaatgcagatagttctcttcatttaggaacatgcttgttaatcagaattacacaaatcttgtacatctccagaaactaacactgacctagaacttaattgttcatctaaatgctctgtgaagtgtttgaataggtgtaatttatttacttagaaattaccaacacagatgctgtcccccattacacacctcttttgtattcaactatgatttaatggtttcttgtacaaaactagtccaagccaattaaaaagcaaataaatagtcacagtggagggtaaattgccttttctgccttcttgaagcatgtgtgcaccactaagataagatgttgtcaatctgttaaaatctccgtgaatccatccttcttcactgctagtagcaggaaagctttaacactttgaacaactaggaagggtcatttgtctaagttgtggcaaagcctaaggggcagaaaggccatagtatttcctgcaacacattaatctagactttaaaataatggaaaatattccaaaagtgtcactgttaaacacactgttgttggcttaattcaacttcctttttcccttcatttattcaagataaaataatgctgtacattttatttacaaacatgaagcaaagccaatgtcattaggattgttcagtgtagacaattcatctatagagtctcaatgaaaccagttgctaagcccccatctcaagtaacttaatgctgtcacttcctcatcaattcctttgtcccccgctgcccatttgcagttgtttagaattttgtttctgttgcctagaacaataatgagtattatgatgaagttatcaatgacagaaatttttaagcacattaattatgcagttctatttcaatgttaccaatgttcttttgataatatatgtctattatttctattttgaattgcatttattatagactaaagctgttgtaataaagaatccgaccaaaatttttgatgtttgatggcttacagcttctacatctcactcctccttgctctcctactccctcacatctataaaaagtggataagaaagtctgtgtgcttcctactttggcacaggtcagaagctcaaaccatgtaaaccccttcccctcctggccccacctcctaacaataaggatccaaagacaatctcccttcccttgcttttaggccaatttaggaggcctgccttcctctcttcagaaaagccccattatgtgagtaacaaaactttttgtgcgctcttggggtatgtgtggctttatcagtctctacatctgaaccaaactgtgggtaggaatctagcctgcatcttctggttgtatacaatggttttataatttacgtatgcatatgaagtacctggtaagattataaagcatagattcctaaaccttctgcaagtttgtgaattggacactctagtgagacaccaacaagtcagggttttgtttctttttgttgtttgttttttacagatttgtggcatcaacattttaccttttatacccatttcttggataaacttattaactctttcatttaaagtcttgctttaccttgtgcattattctcccactcttctttaaggcttaaatctttgtatcttcaatgacaataagactttagcacacgaatgtgctcaatgttacttctatctcagaactaatcaagtaaaacttgagaaatatcagcaacaataataaatagaaatgtcatcatggtttcttatgtcaatgctaactctaaatttgacaaatttctggtttctagcttgatttagagatggatcctaaataggctgcttgaattttccatcacgtctaattctttgttgcatgtagtttttaagtgccagttaataggcaagcacctgcctgaccacatcagcaacaccagaggcagaaggcattattaaaacacagatttttgggcccactccacagataagttggtgtagggcccacaaaaacgatttttaaagaagcaccccttcaggattcttatgcagtcagctaagtataggaatactagttagtaatgaatgtgttctggagcctcaaaatattttagagcaggaagctgccacttattgtgccaagttttctctccaactcttgcagcccagcatgtcaactgatgaaaaagtgctggcgttccaaaaagcctgggggatggtgctcagaaagcccctgctaggagctagattggattatctcaactcatacctctcagctaacaggtgacaccctgctgaaagctgttgacctgaggctcttttggattgtggtaagagtgtgaattgtgatccatcactctggagaaccctgatcagaggctattagcaatgcacctggtcttggcaattgatagaaaaaggaacactgtgccaggggaagcttgcgacaatgaaaactgtttcaaaattcttctttatatcagcaatcctaactctagaatcatcaaaatataactaggttttattgtgtgtgaaaatgtgataattccaatcaacacagttgtactacttaaatccttcagttagaagaaaaatactaaaaaaatactaaataaacgaacagatttttatgaattttatactgtaatttcccttacacctagtagggaagaatatttgaatttctagaaataatgtatgtatttatctacatataaaaataaaattaagactttacataacacccacctttaatcaacgtaacattttctgacatttatgcattttcagaaaagaaacaactagcctgcaaagcaattgttaaattttaaatgtaggcctccaaaatacaataaacaaactacagaaaacagaagcctatcaacacagtaaacatttgcaatggttttaatataaccataattataaactgaagaacagaaatatattaatggaaaaacaatttactgtagctgtgttattgtcctgaaacaggaagcctatgtatctaataataaggtggaattgcatcatgtgtaaatatataaaatgagactttttcaggcaggcattgaacacatgtttactcagacttttaatgaggtgtctgagagaatagcagtggtcccttcagtatccatttcttcattttcttaggcatatcatctcccaaatgaagagccagggtgatgggctaagacctcatatattaaatatgtacagaaaaaaatgtgtgtgcaactttcctctcactgtttgtgcagaactttctctattttatcttcctataaattgcttgtacaatactttattttatcttcctataagcaaaaacacagacagacatctagttttaatcaatcaaataataataataacttacatgatgaaagatcccaaaatggaagcaattgtctttctgaatgactttttggtaagtaaatctggtcttccagtaagaacttcccatggtcaaactattaagagatgaataaatatttatcttacccaaatcattacatttttgggtctaatttttacagcagcttaacctttaccatatccgatcaaggtagaaaaagaaaaatattcaaagttatatttacagagaaatctaaaataaatattaacagaaaggagaagtgagagattgagaagcaaaaccaaggatacccattgtcactacacctattcaatatagtattgaaaatcctagctagaacaatcaggcaagtgaagttaataaaaggcatcacaataagaaaagaacttgaactatctttcttcaatgacaatacgattttatacctagataacactaaaagactctgccaaaaagctcctagaactgatagacaacttcagtaaagtttcacagtacaaaatcagtgtacaaaaatcagtagcatttccatacacaaataaagtttaagctgagtcaaatcaagaatgcaattctatttacattagctaaaaagaataaaataagcaggaatacagctaaccaaggaagagaaagagctcttcaaggagaactacaaaatactcctgagagattacacaaataaatggagaaacatcccatggtcatggatcaaaagaatcaatattactaagatggctgaactgcccaaagcaatgtacagattcagcattatttctaccatactaacaacttgatttttcacagaatcagaagaaactattctgaaattcatatggaacaatagaagagcctgaatggcccaagcaatcctaagcaaaaagaacaatgctggaaatttcacattacccaacctcagactatgctacaaggctgcagtaaaaaaaaccagcatggaactggtacaatagacacatagaccaatggaacagaataaagagatcagattaagtcatacagctacaaccatttcatctttgacaaattttacaaaaataatcaatgaggagaagactccatattcaataaatggtgggtgctgagataactggctatccatatgcagaagagtgaagttggaccccctatctatcaccatatacaaatatcaattaaagatggattaaataaagacttaaatgtaagacctcaaactataaatatcctagaaagaaacctaggaaatatccttttcaatattggtcttggcaaagtatttatggctaaatccttaaacgcaactgcaacaacaacaaaaattgacaagtgaaacctaattaaactaaggaggtcctacacaacaagagacattctcaatagaataaatagacaacctacagaatggggaaaatatttgcaaactatgcatttaatgaaggtccagaatctataagaaatttgaagaaaacaaaaggcaaaaatcaaataaccccattaaaaaatggtcaaaggacatgaacagacacttctcaaaacaagacagactagtagccaacaaacataaaaaaaatgctcataatcactaatcatcagagaaacgaatatcaaaaccacaatgagataccatctcacaccagtcggaatagctataatcagaaagtgataaaataacaggttacctctgaggctgcagaggaaataaaacacttatacatagttggtggtaatgtaaataagtcactggaggggcagtttgaagattcctcaaagaactaagaattgaactaacatttgacccaacagtcccaatactggatatacactcaacggaaaataaatcattctgccaaaaagacacatgcacctgtatgttctttgtagtgttattcacaatattaaagccatgaaattaacccagggtatatcaacagtgtactggcaaaagaaaatgtggtacatatacatcatagaatcttatatagccataaaaagaaaaaaaatcatttcatttgcagcaacatggatgtagctggaggccattatactaagtgaagtaatgaagaaacagaaaaccaaataccacatgttctcacttacaagtaggagttaaacattaagtatacatagagataaaaataggaaaaaatagacactggagcctagtagaggagggaaagagaggagggcaagggctgaaaaactaccgcttgagtactatgctcagtaccttgctgacagattcattcaaactccaaaccttagcattatgcaatatacttatgtaataaatctgcacatgtactctctgattctaaaataaaagttttaaataagttacgttcatgaaataaaattaggaataaatattagcttgcccttcccatacatatttgaaatatttaataacaatgggaaaatagtttttgaagttgtaagacaattgactgcaattaagaaaatcacaacagggaatacgatgcagtcatagaaaagatcatgtcctttgtagggacttggatggcactggaggccattatccttagcaaagtaacacaggaacagaaaaccaaatactgcatattgtcacttataagtgggagctaaataatgagaacagatggacttatagaagggatcaacacacagggggcctatcagagggtagagggtaggaggagtgagaggatcaggaaaatgactatttggtactaagcttaatacctaggtgataaaatagtctgtacaacaaacccctatgacacaagcttacctgtggaacaaacggcacatgtaccctggaactaaagttaaaaaaaaaaaaagaaaaagtacatccccataaagactaaaaaaaaataattaataagttgtttttaaaaatagttttaaaatatgctaaaaaaactgtttattgtaagtggtaaaaatgcaattaactaactcaataagaaagaaaaaatacattgacagaaataaactatttgggacataaatgatgaaagacaaatttatttcttaagtttttataaattatatatacatataaactttataaaaaatatatatttggagtacaacatgttttggcatatacatacccagtaaatgattaatactgtcaagctaattaacatattaatcacctctcttagttacctttgtgtgtgtgtgtgatgagaagttagttttattggagaacaaagtagtcatttcccttgagcttagataagtcaataaaactataaagtaagtaagggggaaagccagaaacaacagaatatacattcttcttattgccacatggcacatactctaaaattaaccacataatcagatataaaacaatcatcagcaaatgcagaagaactgaaatcataccaaagacaatctcagatcacagcacaataaaaaatgaaagtcaagattataaaaaaatcactcaaaactgtgcaattacatgaaaattaaacaatatgctcctgaatgagttttgagtaaataatgaaattaaggcagaaatcacgaagttctttgaaactaatgagaacaaagatacaacacgtcagaatctctgttacatagctacaaggtagtgagggaaatttatagcactaagtgctgacatcaaaatgttagatctcaaagtaactacctaacatcacaactgaaagaattagagaagcaagagcaaaccaaccccaaagctagcaaaatacaagaaataaccaaaatcagaactgaactgaaggaaatggagtcataaaacaacattcaaaagatcaacaaatccaggagttggttttttgaaaaaattaatatgataggctgctggtagactaataaagaagaaaagagaaggtccaaataaacacacttaaaaatgacaaaggagttgttaccactgaccccacagaaataaaaataactgtcagaaactaccatgaacacctctatgcacacaaactggaaaacttagaagagagggataaattcctggacacacacactaccccaagactgaagtaggaaggagttgattccctgaacagaccaataacaagctctgaaattgaatcaataataaatgccctgtcaaccaaaaaaattccagtgccagatggatttacagccaaattctaccatatgtataaggaagagctgattcctactgaaactgttcaaaatattgaggaggagggattccttcctaactcattctatgaggccagcatcattctgataccaaaacctggcagaggcacaacaacaaagaacactttaggacaatatccttgatgaacattgatgcaaaacccctcaacaaaatacttgcaaatcaaatccagcagcatatgaaaaagataatccatcataatcaagtaggcttcatctctgggatgcaaagttggttcaacatatgtaaatcaatgaatgtgattaatcatatacacaaaaataaaagcaaaccccatgtgattatctcaatagatgcataaaaggctttcaataaaattcaaaatctcttcatgttaaaaactctcaacaaactaggtattgaaggaacatacctcaaaataatgaataatctatgacaaacccacagccagcatcatactaaatggacaaaagctgtaagcattccccatgaaaaccagcacaagacaaggatgccatctcttaccgcttctattaacaacatagtattggaagtcctagctaggttaatcagacaagagaaataaataaagcgtattcaaatagaaagaatgaaattcaaactatcattgttagcagtcaacataattctatatctagataaccccatagtctcagcccaaaagttccatcagctaataaacaacctcagtgaagatttaggataaaaaaaccaacgtacgaaaatcactagcattcttacacaccaagaacagccaagctgagaggcaaatcatgaatgcaatctcattcacaattgcaacaaaaagaataaaggacctaggagtatagctaatcagggaagtgaaagatgtctataatgagaattgcaaaacactgcttaaagaaatcagagatgaaacaaatgggaaaacatttcattcttattggtaggaagaatcaatatcattaaaatggccatcctgcttcaagcaatttacagattcaatgctatttgtataaaactaccaatgacattcttcacagaactagaagaaaagtagtttacaactcatttgaaacaacaaaaaaaagtgcccacataaccaaggcaatcttaggcaaaaacaaaaacaaaaaaagcaaacaacaacaacaaaaaacaccaaacaagcaaacaacaacaaaaaaacaaagttagaggtatcatgttacccagtttcaaactatactacagggcaacagtaaataaaacattatggtactagtacagaaacagatacatagtccaatggaaaagactagggagctcatcagaaataaggctgaacacctacaaccacctgatgttctacaaagctgacaagcagtgtgaaaaggactccctattcaataattttgctgggataactagctagctatatgcaaaagattgaaactggactccttccttacaccacatacaaaaatcaacacacgatggattaaacacttaaatgtaaaacctaaaactaaaagccctggaagacaacataggcaataacattctggacacagaaacaggcaaacctttcaagatgaagacccaaaagcaattgcaacaaaagcaaaaaagagacaaatgggatctaattaaacataagagcttttgcacagcaaaagaaactatcaacagggtaaacagacaacctacagaatgggagaaaatatttgcaaactgcaactgacaaaggtctaatatctagcatctataaggaacttaaacaaatttacaagaaaaaaaaacccactaaaatggttggaaaagtttgaatacacttttcaaaagaaggcatacatgcagccaacaggcatataaaaaaatcttaatataactgaccattagagaaatgcaaatcaaaaccacaatgagataccatcatattacaccagttaggatggctattatgaaaaagtcaaaaaacaacaggtgttggcaaaaattgtggagaaaaggaaatacttatacaatgttggtggaagtgtaaattagtttaatcattgtggaaagcagtgtggtgatttctcaaacagctagaaacagaattatcatttgacccagcaatttcaaaggaacataaatcatactaccataaagacacatgcatgcaaatattaattgcagctctattcataatagcaaggacatagaatcaacctacatgcctattaatgacagattggataaagaaaatgtggtaaatatataccataaaataccagatagccttaaaaaaataatgagatcatgtcctttgcagggacatggatacagctggaggccatcatccttagcaaactagcgcaggaacagaaaaccaaataccacatgttctcacttataaggggaagccaaatgatgagaactcttggccgcaaagaggaagacggaaacaacagacactacagcctccttgagggcggggtgtgggatggggagaggatcagaaaaagtaactattgggtactaggctcagtacctgggtgacaatctgtaaaacaaacctctatgacatgagtttacctatataacaaacctgtatgtgtgcccctgaatctaaaataaaaagagagggaaagatcaatttatcattaaaactgagatacattttaggaatggcaaattacattgtggggccagagtaccccatacatatcataatattttgggtcagggattatataagaataatggacaagatcttgggatactcttgcaactgtccagacctagaaaaaatgggaagttgttgagaaaatctgtgatcatatgagtgagtgataggagatttgtaagtttggaaactgatatatatatattttttcagattagagatgatttaggttggaactcttgcagtggctatagaggttgaatggtgagtgatgacacacttcagtaatttagactcataatgtctattgatgtcttattttggaaaattgatttgattcctagggaaataatagagaaaatctatttcaactatgggtgagatgctttaggttattttgtttgcaacggttggaagagtaaaataaatcacatcacctttttaattcttagaatatttagtcagttacattccctatgttatcctcaaccaaaaagttaacttttccaaagacaaattcattttatgaagttgtgttactttttattgaaaaaaaattaatgtcactgaaattttttttcattctacctcttatttaatatgcaaaaacttgttagtaattgagatagaagacctgtagtttaaatgttgtattattcctgatggatgattatgaatataggacttgactatatttcaagtttatagtttataaagaatgtagtttcagtggatttaaaatagatataaatatagattaaaaaattatttatagatggtttagcatgaaagttttctgctaaacacttacaagtctgttaaatatcacttcagttaacagtgaaatagtgaatctcattcatttttttttaaatctaaaatcagattccatctgtccaatttggtattttggcactaactgttatttgtgatttcgtttgatatggttcatctggaattttagtagtgaccattcattgtgatttgatttgattatacatagctctctgtgatgcttactggaacgcagctttataaatgcaaattgtcctgtatgtctcagttactctaaaattggatttaactatttggaaattgtgggccaagagaagcttcatgaacttcttttaaaaattctgtaaaacatggtatatagcaaatctatttttgaatcttttacatgtaaatttaatggaaacattaactttcatggcagaaataaatatgtatatatgattctaaatgattcattcatcaatatcagaattaaataataaagacaaataaaaaaattcctgtcaatgtggccttctccttgaattataagtcaaatgtattccatacagtacattgaagaatttgtacctatgttaacacaaaagtttgatccatagcatattcttcatgaataaaagaagtaagccatagagggatatgtgtaaattggatacatataaaagtattaggcaatataaattaatagtaaaatatgatcaaatttgaataaactttcttgaaaataacaaattttcaagcaggaataagtaagttatattttataatttccaaggtcattatagtacaaatcatattacgatcacttttttatagttagaattatttctaataggactatctgagctacttcgagaaaactagcaaggtctaccctgaaaacacttcagatatgtgatatttcaacatgtaataatatttataatacatatgtcagatcttaggtgatagactatttactaacataacaattaaaaacaaattacaaactgaatttctaacataaataatgaagattaaatatcctatgcactcacacatatattatcaaaacagtatgttactagacaaaaaaatatcacaaaattataatttttcttcctttttcgagacaggatctcatactatcaaccaggctggagtgcagtggcatggtctcagcttactgcaacctctgcctctggtgctcaggagatcctcccacctcagtctcttaagtgggaccacatgtgcacaccaccacacctggctaatttttgtattttttgtagagatgaggttttgtcatgttggccagcctggtgtcaaagtcctgggctgaagcaatctgcccacctcggccttccaaagtgctgggattacaggtgtgagccactgcacccagccaatttatttcttttttaattcaaaaacttttatattgagtactaaatgtatgcaacacattgtgcagatattcgagatacacagatgaacacaatcaaatgtcttctgacctctaaccttatagaagagtccagataagaaagtaaacatccagcaaataatcaccccaatgtataagtaaataaaactgacaaaaataaaaaaggatagctatatggttccaggaaaccccaatagagaaattcactctagtttctctgaggaagtaaagatttagttatgaaacagcattataaagcaattagcaggatcagagaagaagcagtgcggaaagaccattccaatcagaaacagccaaatgttaaaaggccctcaggagtttggcatcgtgaagaaatgagaccatttgaggtcaggttgagaggtaagactgtacccagactgtgggccatgataaagactgaccacttgatattaaggcaatagaaaagcactggagacttttaagccagagatggaatggagaatcagggagaagatcagatttgtagactggaaaattttgacttcagtatacaaaaagaagtatctgaggaaaagagaggtctggggaaagcaggaagccactaaattagctcatgtgagtgataatggctgctggatataaggagatggaaagaaaggcagagaagtaggtagaatcaataaatatttaagaggttaaaatatataggattagtactggaatgggtggcatttgtgtattgaaagagaggaaggaatacaagagatatttaagaggaacaagtttacaaaactaaaccatatgtttggttataaatatgttgaatctcaattatatttatgatatttacttggaaaacataagtaaacatttacatactaaggtatgggcttcagtgagataaaattttgtgtttattacatattggtgataatatcacaccttgggcagaaaagagactgctagagattataatgcctaaataaaaaaagaacaaaaaattaagaaatctttaaatgtaatgttttgtacaaaaagatgaaccactgaaaaagactgagaaggacgtttttaaaatatcacctgaggccaaggacagtaccgatatcaatgaaagatttcaatgaaagagactttttcaatgagaggatttgagtcctattgaggaaaaaattaattacttaaattagggaaaatagttaatatcattagtaatcacagaaatgcaaattgaactattaagatataactgcaaattagcaacagttaaatgataatatagaatgtaactataaaatgagtatcacaatcttcacatgtctgcttcttactttttttggaagcccagtattactttaaaatgtatcatgtaatctactaccagcgatatttggaacacagtagtaaaaataagaattattaaaatatattaagagtgtatatttggttccacgctgaaatggaaaaatgcatttattcctattatttctgctaataatggctaacaatcctggacattatttgtaaaacaaacagaaaactgaaagttggagggaagaagcaagactagctagtaatcctaggatccgagaaataacatattggtgagcacactgggttttctttatactttatatatcccagatcataagtgcttagaaaaataccttgaactaccaacaagagttcagataaaaatagcacccccaaatgcctgctttaaccaaacaaaagcaatgttgcaagacagaaaacgttaaaataactgacctgctctagccaaacatcatgaaaaattacattcatgaggccaacaagcatatgaaaaatattcaacatcactaatcgttagagaagtgcaaatcaaaaccacaatgagataccatttcacaccagtcagaatagctattggaaagtccaaagataacagactctgccgaagttgtggagaaaagtgaatgcttatgcactgctagtgggaatgtaaactagttcagccattgtggaaagcattctggagatttctcaaagaacttaaaacagaattaccatttaacccagaaatcccatcactgatatacccaaatgaaatataaattattttaccataaagactcatgcacacatatgttcatcgcagcactattcacaatagtaaaggcaaggaatcaacctagatgcccatcaatggtagactagataaagaaaatgtggtacacatacaccatggaatactatgcagccataaaaaaagaatgagatcacatcctttgaaacaacatggatggaactgaaggccgttatcctaagcaaactaatacaggaacagaaaaccaaataccatctgttattgcttgtaagtggaatctaaacagtgagtacctatagacacaaagaagggaacaacagacaccaggagcctatttgagggtgaagggaaggaagagggtaacaatcaaaaacctactcatggggtagtatgcttattacctgggtgaaaaaataatctgtataccaaacctccacagcatgcaattcatttctataacagacctgcccacgtagccctgaacctaaaataaacatttaaacaaatacagacccgctcccaccctcatcttcaaatgttgagtgggaaactagacttctacccatgcccattggaaatgatgcactcctcccgttcttagccagagaggtgtcagcagaggcccagtgaaaagcccaatatcccactttcactgctagtaggaatgtaaactagtttggccattgtggaaagcattctggaggtttctcaaataacttaaaacagaagtgacgaggtatgtcaaaagatgccatttggggaatctggaccttgacccctacctggagctactgactcaggactcacttcccccaccagcagtgtcagaggatgccagctaaaaagatgattttttaaaatatccagaatctcataatactatatctaaaatgtccaggatagaaaacttatgttttccaagtaaatatcaccacgaaggcaattaataaatgacaataccaaaatgtgacagattttgtaatgatctgaaaagaattttcaagctgtcattataaaaatccttcaacgagcaattataaaggtgtttgaaaaaataaaaaattagaaagtctcagcaaagaaatataagatattaagaagaatgaaatgcaattttagaaataaaaacataagtaaaatgtatttttctattttcaagttcacaggagaatggaaaaggcagaggaaagaattggtgaacttgaaaatacaaaaataaaatttgttaaaatgaataatagaaaataaactgaaaaaaaaatcatgaactgaacttcagggacctgtgggactataacaacagtttataagatgtaactttgtgtcatcagagtcccagaggaaaggagaaacttgagggggaagtttaaaaagtatttaaagaaataatggcagaaaatgtaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaattgacaagaagaaaacaaacaaccccatcaaaaagtgggcaaaggatatgaacagacacatctcaaaagaagacatttatgcagccaaaagacacgtgaaaaaacgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatagacccaaaggactataaatcatgctgctataaagacacatgcacacgtatgtttattgcggcactattcacgatagcaaagacttggaaccaacccaaatgtccaacaatgatagactggattaagaaaatgtggcacatatacaccatggaatactatgcagccacaaaaaatgatgagttcatgtcatttgtagggacatggatgaagctggaaatcatcattctcagtaaactatcacaaggacaaaaaaccaaacaccgcatgttctcactcataggtgggaattgaacaacgagaacacatggacacaggaaggggaacatcacattctggggactgttgtggggtggcgggagcggggagggatagcattaggagatatacctaatgctaaatgacgagttaatgggtgcagcacaccagcgtggcacatgtatacatatgtaactaacctgcacattgtgcacatgtacccaaaaacttaaagtataataataaaaaaaaaacaaaatttctaaatctggcaaaagatattaacaactacagattcatgaatctgagtgtaccctaagtggataattctaaataaatccaaacacacatctattcaaactgaagtcagtgagtcagtctgtctgtctgtctgtctgtctatctatctatctatctatctatctatctatctatctagaaaggaatgaatacaaacatgttaactatatgagtaaaacaatttaattgacagcatatttctcatcagaagttcgggggcaagagtgaagtggcacaaaattttcaagggttgaaacattttctttaccccaaattctatggtcagcaatcctatctttcagaaatgaagacatttgtaggtgaagaaaaacactgagaatttgttataagcagatctactctaaaaaaatttttgaggaagtttggtaaacagaaagaaatgataaaagaatgaaccttggaaccccaagaagaaagacagtacaatatgcagagcaaacatgtgtaactccagtacactatcattaactacagtcctcatgttgtacatgattagatctttcaacttgttcattgtacatatttgctactaccatctaagatgatgggtaagttaatttgttcactatagtaattattttatagtatatacgtattttataatgtatcgtacccctcaaatatacacaagaacagttttcaaaacaatctaatatattttatttctctttagtttgaagcaaaagcttaaaattatctaatgggaatcccagtgtacaaaaaggaaatggttaagacaattacattataatcaggggaaatcaagagacttaaaaagaagttacagtttcaacacttcactcaaactggtaaaatacatcagtagatctttgttgtgatgaagtagttctgtacttgactcaggtggtggttacaggaaacatgataaatggaatagaaatacaaaacacacacacacacacacacacacacacacacacacacacagagttccaatactaatttcttgatttcataatagtactatagcagatgtaactactgggaaaagctggttaagggccacatagaatcactctgtaatatctttgcaacttcctgttactctatagttattccaaatttaaaaaaaaaaaactaataaaggacattagttatagggagctcagacatagctgaaggtcctacaaagtggaggccaaggagacatactgaatatttcagaatgttgccaagctttatggtatttttcctgacttctcatctaaaactatggaggctagaagatagtggagtattttaagtgtcaaaacactttaaaaatgaagcatattgattctgagttctgaaactgcccaaaatatcttttatgaatgaagcaaattaagacattttcagataaaagaaactagcagaatcaatgtaactacttttgaaatatatgtgacaccttcttccaacatttaacatacacctgtccagaaattccatttctacatatttatccaggaggggaaaaatgtatgtttatgaaaaagactcatatataaatgctcatgataaacttgctaataacagaccaaaacagtactagtgtccacacacccgagaatgaatcatatgctgatatactcatgcaatggaatactatgtgggagtaaaactttatgacttattaggacataaaacaacatggatattccttaaaagcattatacagactgaaagatttttttttttgtaccacaggatatagtatattactgaatttatgtaaaattctataccaaacaaatctaatttgtggtggaaaagagcttcaaaacagtggtcatcaatgggatataaagggcattaaaatgtaaagaggccagaaaaaacctcctgtgatatctgtaagtatatagatttattataaccaataatattcaagttgaaaaaataaaattattcgatttagataacaaaaatattattttgggaaattaaaacacactgttgggatttgtatataaaacatttagcacaatggaattaaaacaagataaaatgatgaaaatgacaaattgagatgtaatttaaggattctatcattttctcaatttacggttttgttatcctccaagacatagcttctcttcacattgtctcacttgtcatctccattagatatatttcctctgtgctgcaactgcatcctatggattcatctaccacagtatttcctttttgcatatgtctctgttactcctctagaccagagaacgtggctcatttatctttattcttattgctatcatctggcacagaatctgcctacagcaagtagtcattaaaggatcagcaaagcaattcacaactaccaacaattaagtagaaaattcttttcttccttttttttcctattattgtacaacagtgagttcctcagtattgggttaaatgaagttcacaaatgaaaatgtccatattgcccagttaatacaaattattgaaatgggttgacacaaataacttctgaataagtaggaagttgtgtcttatctaaggaaaatcacactcctctcaatgcctgctaaacttttgtcatggaggaatataacctgagcacttcagagcttcagattttcaagagaagagacatatttcagcttttttataatatcagctcaaacttcacatcttggctaaatatctgtgtcacatatattacaattctattctagattctgatctgagatacaccactttgtgatctatgctacgtaatttcttagtctcaagtaaagagtacggaaaaagaaactatgttagaaggtattcttattgtgaattcagtaagctcacctgagcaatatttctttagactttttattcaacttagaaacttgaaggatatggttatattacctttgaatggaaaaatttaaagagagaaaacgaatttggttaaaccagtgatcagttgtaaatatctaacatctgggttcttgatccaaataatttcacagcattcgcaggaaatatttgtgcttaaaaacttaatacaaattgcaaagcaaacttttacaaaaaactcttacttttttctctgtctccatgatcataattcattgatttaaaattgaacagtatatgttccatattagaataaatttttttaaaaagggattaattcactgtgtctactcataatcacagaagaacagagttattttacccattagtttacttactttttttttttttgagatggagtctctgtcacccaggctggatggagtgcagtggtgccattttagctcactgcaacctccgcctcccaggttcaagcgattctcctgcctcagcctcccaagtaaagtagttgggattataggcatgccccatctcatttggcttgttttttgtatttttagtagagacggggtttcaccatgttggccaggctagtctcaaactcctgacctcatgtgatccacccatcttggcctcccaaagtgctgagattacaggcatgagccacagagcccatttactcaccttttgaaacacacacacaccattcttcaccttaataactacctccttttattttttattacacagaaaacaaaaataatatcccattggaaaattgttcacagattttattcacttaatatctagtccactactactaatttatttgatattaatatttaaaaaacacaaaatcgaagaatattatgaattttttcaacatatattgttactattttttctttatgccactgttttatgataataattatatataggtattttccctcacattttatgtaaagttactagtggagttatacattaaaactttacagatagttaagtttattgaagccctgtatctttaggtatttgtgtctaaaagacatatagatggttacaatgaaagatgcattattgtattttagtccaggtctgtcagactatgtaagaggaaaaaaaaaaaggatgtggaggaaagaaatgcctaattaatataagtgacaattcagggattggatgatgcttaaagagagatttcataatcaatacataatggcaatgtcatcaaacagctagaaattaaaatctgacaaatttgacaactcccaggaatctttgcaccactggtatttattcagtaatacacagtttgatcctaagatattcatcattgcttcctcgttcttgccaaaattttcaaatttatataataggagtttttctctgcaggaaaaaagacctctgattttataatgcatttcagaagaatattagtgatttataatcaacagaattggaatatatccattccatataggaatatattactgaactctaatatgactaggtttaaaaaacgtttttacattttggatactctattccattaagtataatttaatttatatttactctttatatatgtttatatcctagaattatactttaaattcaacttttctatgaattcagaatttatttcaggtatcaataggaggaaagttttgactacttttttggtcagtttccttatttttaagagtatatttaaagtaaatatagcactattttgttgagttaagcatataacataaagtaacacttgaaaaaaatactttctgatatttatttaaaagataatgatctctaagcaacgtttagcttatttgtaagaaaacatttttcccccaaggccaaagttcaaaatcacctcattaggaaagaaaataactgacataaacaatcgcaaaaacaaaaataataatgatccattgaatactaattctcttacacttagaaagaattcctaatagttcttagggcatttcaaaaggaaaaatgagaaagaagtgagaacaggatgtgaataaatcatggaaatattctcatcatggtttcctgttcttcctcaaaattaaaagaaatcaatattaatttttctatgcaccagggatgatggtaaattctttaaacacattttcttcaagtaatccttgctttcttcaagtgatggttgctacgtaattacaattgaaatctctttaattattatcctagtgttttctttttgcatgtatttggttattttgttagaaaactattggtttcttttacaaaaacaaatttgcttcaggcagacctgtcaaattttacattttcttccttttttcttattcagacaatcaagagatttgtctcaagggtaagtctaaaggaaacaggttctgaaaatacttattctttttaccatttgaagagttccatttatcagtttaatttttattaattccctaatatgaatgattcaaaaacgttgtcaaagtaagtatatgggtgtcttttttctgtgatctacaatggtgacatcatttaatgctacattatttcatgtgactcattgtcattgtgtcctgtaagctttggaatagtgcattctactttttgttgctttgtatatatttgtactttttgtatggatttcttctttgctctaaaaattacctaacagtatgttttttggtttttaaactgcatttatatttttggtaaaaattgattattaatttctacttttattagatatgactaaagatggtgacatgagcatatctaattattttaatctataaataatttactctgtagccaagcacatgacaaatatttgtaaatactctccaaacaccaaatatatgttctccatttgagggatacatgattaaatatgcacacacatgtcatctctgtataaatattaacataaataaaataaataatggaacatattttttatatttatcatttcaccagaatatttagtttataagagggatattagaattttcgatgaaaatgttgcttatcaagttagctttgcattgctaaaacttcagtatttcttccaggcagttatttgcaagatacaagttcactattattatatatttcccttacatttttcttatgattacataatgtctcatgtcatatatttaggccctttaattctaaatctaatcatatcttgatattaatgttgtcactccttcttggcccattattttaaacttttcttatactttaataaatttgtcccttctaaatagaacatagataggttttgcttctaaacaaaatacatgattacctgttatattagtctgttctcatgctgctctgaagaaatacccaagactgggtaatttataaagaaaaatagtttaattgacccacagttccgcatgactggggatgcctcaggaatcttacaagcatggtggaaggggaaacaaaaacggccttccttacaaggtggcaggacagagaagtgttagaaggggaaatggtatatgcttggaaaactatcagatctcctgagaactcactcactatcatgaggacatcatggggaaaactacccctatgagccaatcacttcccaccaggttcctcccatgacacatggggattacgggaaccacaattcaagatgagattcgggtgagcgcataggcaaaccatgtcattccacccccagcccatcccaaatctcatgttctcacatttcaaaacaaaaacatgcattctcaacagtcctcaaaggcttaactgattccagcatgaactctaaagtccaagtccaaagtctcatctgagacaaggcaagacccttctgcctatgagcctgtaaaatcaaatgcaagttagttaattccttggtacaatgggggtacaggcattgtgtaaacacacctattccaaatgggagaaactagccaaaacaaaggggctacaggccccatgcaattctgaaatccaatagaacagacattaaaccttaaagttccaaaatgatctcctttgactccatgtctcacatccagggcatactgatgcaagagataggttcccatggccttgggcagctctacttctgtggcttttcagggtaccgtgcccctcctggctgctttcatgagttggcatttagtgtctgcagtttttctgggtacatggtgtaagcctttagtgtatctactgttctgggggctggaggacagcggacctcttctgacagctccagtaggcagtgctctagtatgcactctgggtggggactctgaacccacatttcccttctgcactgttctagcagaggttctccatgaggtctccacccctgcagcaaacttcagcctggacatccaggcatttccatacaccctctgaaacctaggcagagtttcccaaacctcgcttgacttctgtgtacccacagactcaaagccacatggaagccaccaaagcttggggctttcaccctctgaagtaatggcccaagctgtaccttggccccttttagccatggttggagatgaagctgctgggatgcaaggaaccatgtcctgaggctgcacggagtggggagccctgggcccagcccaggaaacatttttcccacttaggcctccaggcatgtaatgggaagggctgctgtaaaggtctcttacgtgccctggagacattttccccattatcctggtgattaacattctgttctgttttacatatgcaaatttctgtagtaggcttgaatttctcctcagaaaatgggtttttcttttcaattgcatcatcaggctgcaaattttctaaatttttatgctctgcttcctcttgagcactttgccacttagaaatttcttccaccagatatcctaaatcatgtcttcccaagttcaaagttccacagatctctagggcaggggcaaaatgtcaccaaaatgatttgctaaggcatagcaagagttacctttgctccagctcctaagaactcatctccatctgagaccacctcagactggacttcattgtccaaatcactattagcattttggtcaaaaccattcaacatgtctctaggaagttccaaacttttccacaagtttctgtcttcttctgagccctccaaactgttccaaactctacctgttacaaagctgcttcctaagaactcaactccatctgagaccacctctggctggacttcattgtccaaatcactactagcattttggtcaaaaccattcaacatgtctctaggaagttccaaacttttccacatgtttctgtcttcttctgagccctccaaactattccaaactctacctgttacaaagctgcttccacatttttgggtatttctatagcattgccccattacctcagtacctatttattgcactagtttgttctcacactgctatgaagaaatacctgaaagactgggtaatttataaagaaaagaggtttaattgactcacagttacacatggctggggaggctcaggaaacttacaatcatggaagaagcaaaagcaaaatgtccttcttcccaaagcagcaggagagagaagtgccagcaggggaaatgccagatgtttacaaaaccatcagatctcaggagaactcactatcatgagaacagcatgggggaaccgccaccatgatccaatcacttcacactgggtccttcccatgacacatggggattatgggaactacaattcaagataagatttgggtgggagcacagccaagccatatcacctgtcattatggggggaaatagtgtgaacacttttatctggtattatttctttttatattattttatatttactctttgttttactttttttccccttttttctttttcttatttcaggaagatttatcaaggtgtagattttctggttaatttaggagttttaatactcttttcaattttatataaaagcacatatttctgatcctttatatgaagatgacttattttctaccaagatatctatgcccaattacatccacactaataagatggatattttaaaataaatcactcccctacatgtaggttatgtggttttgttatattaaccccagaataccagtatatttattttctattatgtctttccttattcaagatttcttttccttcacttacattactcattttcaaatagtctgtcattacaggagaatctatttctcatcatgtttcctttgttcttcatctgccatatattgatttgtagactttttcttattttttatcatttttaatatcactctctagagcattttgttctaataggttagtaactaataggttactagtggattatttttcctcatattctttacataaattttaaaaaattttgatttttatctcccaaatttattgtttaataatgtttaatacttattgattattaccaattctatctatttgctcccttgggtattttggtgttcctctttgtttagctaaatgctaaattaatttattttcactttttcttatttaataaatcatatgatcagggctctgaactttttcctaagtgaaactttggcagtattcacatctaatcttcaaaatgtttcttgagtttacaatatttgatagaatctgttgctgattcattatggaaaaacatagaatattatgtattttttagtatgacatttttgacaatgattacataaaataagtttatgacctatttactcaatttgatactaaaaaaaatatggaaaacatttgtagaacatcaaaatcacatgcagacattctgaaaaatgctccaagcatcagaaaaagtaatgactgtgtaattgtatcgaaaactctgaggcagagattaacatgcaggaggttattagagagggcttttagggtcttcatctgtagaagatagggaaggagagataattgggcagagggacaatttcagttctggtataatccgaagaaagtttttaactcaacctgtaggaagctttgaagctagaatggctatttaagattgtcaagatttggggaactaagtgactcattggattcaggctgcctcagaaaataaatgtgatactgctctgactaggtgattcttgaagaaaattgcatgcagaaagctgtctaacagcattccttctagtaactagaagaataagtataagccctcagtccatcacaaatagtaatagtttgattagatagtaatgttctatagcatgtttcattctaacgtgctattttgttttaaatatacaaacacatatatatgcatttaattgtactttgtttacattttcagagattagctatgtattttcagtcaacatataatacattatatttttcttatttaaaatatttggacatagtctcttaataattagattataggaagtctaatttttcaggaaaatatttccagtgttaaatttgttatttaacttatattactggttcagatatttagaattttcctcccactattttattgatattctataattttgttttgatttaatttttaacctaaatgacatttgtaaaatatgtttttattaaagagatcaatgttagtgaaaattacttaataattaaattatataagatacttgtattactaatagcaaattacttgcaaaaggccacgaaccagcataatatttcctaatgttgttcttcatagttgcacccattgcctcatgtcaccatcattgtcatagatctctccaaggtctaggacaaagaaaatgattgtgttgctaagaaataaaattgggtttgcattctgttagataattatgctggcctatgttcttctaggcaggaactgtttcatttctctccatactttacacacctagtgttatgagaggaattttgtccaccaccctaaagatcccagtgttgaagctctaacccctagtacctcaaaatgtgactttatttggaaataggactttaaagaggtgattacattaaagtgagaccacaacagttggccctaatccaattggtctttataagaagaggaactttctacaaatacagaccagggcacatgcacagaagggcaatcaggtaaagagccagaaagagggtgaccatctgcaatccaagcagagacttaagaaaaaaataaacctgccatctttgatctcagactgccagcctccagaactgtgaaaaataaatctttgctatttaagccattagtttgtggtattttgttatagcaaccctagcaaactaaggcagctagtatagtaaagagcatacttaggtcattttgagtactttacttccactttaatagttcagccatgaaataaaatatataaatatatgaatcatagataaaacaatgtaaaataaaaaatgataattttaatattattcattaaaatataaataaatattttcatggctttagattttatgtaacatacaccctgatgctgctctagcaattaattaacaatatgacttcatattgttaattaatttcatgccaataatacacaagagcacagacggcgacacttgtattagaccaaaaaaaaaaaaaagtcaaaaactgcaacttgcctcccgtgttcatgtccttgtgtaatctctaccttgaatattgacaggacctgttactggcttttaactaatgagaatatgctacataagattgtaacatccatctcgcgagattaagctcttctctgctggcattgaaaatgcaagctaccatattataagccaccatatgggaaggccatgcagcaggagctgagggtggccatgttcagttgacagcattcaggagctttcacctcaaaggatctcacagttccagtcaatatttttatgcaaggaagagcctaagcaaaggactcaattgatctgtaccggacttcttacccacagaaattcagagatcataaatgtgtgtgtgtgtgtgtgtgtgtgtgtgtgtgtgtgtgtgtgtgtgtgtgttaaccactaaatgcgtggtaatatttttgtgcagcaatagataaatattatgcctatcttcaaacattatatgacatgttttgctaaatattttagctgggtacttatttttcaccatatctacacgaaggctaattttcttctctattctagagaaaattttcttataaacgttatgctcagtgctgccatgttctttatcaatagtatcattatgatttctaatcagccttctgtattctcttgttaactgcatactgacaagtgacaagggtgatcatcagtgatattttggtataaaatctaataaacagattgaaaagcatctctctggatttctttaagcagaatatagtcatgtaaaaattctttagactgttaatgtaatcacatctttaggcatgatttgttgcactctctggctttaaaatatcattgttaagtagataagactattatggccttctcttcacaagtgacatttatattattaatagatacattattatcatctgatatcattcaaagtgcctccatttattttgcaattagctaataattgtctaacgatagttctattaatactaactacatgttatgccactcagctggtgtccatcatagattgcctttggattcacctattcatttgtaggtcttaaatccttcacaatattttaagctctcggaaaagagggctcaagtcttttgaacctcacagtgccaactcctaccacatataagtagatattttacttacatgatcatgtgattcgataattcattaccttcaagaatcttgaagcatttaaggaaatagaaaattcacgtaggtacaggtgaaaggaagaataaactgccttaaaatggacaaaagtagaaaaaatttcaaaagaaaggagcaaagaaaaggtggaaggaagaaaagaaaggagtgagaaatgaaaaaaggatgatatactgaaaaatagaaaatgtaagacaatgtattttaatagttttatacaatgaaatgcttggtgtattaaaattaatgctaaagtagattaactgtgaagaaactgctttactggataattactatgacagatccgatataaagtaattttataattatatgtttaataattttaaagatcacactctgttatttgataattattaatatatctcttctaaactgtaatggttatatgagcaaagaggaagtgagaagagcaggagaacttttaatacttaggataatctttgagtagtcccttcactaagtacatttaattacctccattaagcatacctactgcttgattactagagcagattattttttccaactgaaatattaaaaaaatggacatgagtctcagattttcagtcaggatatgtaattatactgataggaagggtaaaggtgatttattttcatatttaaattagacaagccactcaaccaaaattaatagttaataaggaattcaaccaggtcacattatcaaaaagtacaatattagttttttatattatttaaaaacaggaaaaattaaaatgccataagttaattgacaaatgggtttagaaaggaaaataagctcatataatacatcttgaaatgtggacaatggaacacaggcatgctacatttcccaagtatttaagttattacacataagcaaatgcactcaggaattttacatcattttgaatcttcagaattacagaagggtagcatgcctttgtagagaagggtggtttttatttcaggtaacattctatcagcattaccactgacaggttagtattgcctgcactttatctagattaagccttaacataactctttcatcaaagctactacactgacatgtaggtgactgattctaatggaattagatgaaaagaagacaaagaaagggctgtcgtgcccacaccaagagctttgccacccaacatgtaccattatttcctttaaagctttcaaatttgactttgaacaggtttcaccaaatacaacactgaagcaattgctattactgatcatgccagagggattagtagaattttctcctgaattatttctttccaaagggggagtttgtagattaaatgagtcttggaaacgtttgctgaaatgtatagattcattttatgactagctttctagtcactgtcttgtgggttattaaccctataaaatgaatattttgattaactgtcctcatttttaaaacatttgacatgaattgttcttggaaattttagtgacagcactcaatatgatttcctcagttatttattcaacagaaagttgtctattatgtaaaaagcattgcagtgtagataaaaattaagcaagtcaaagcattgactaagtaattacattgtgtttggagacatgttagcagtttgactctgctaaagctttggctgaatatgtccaaaggcaggaaatgccactagaaagtttccagattataaagatccttgcataacatgccaaggcatttaataaacagtgagaatacctttatatatttttaacagaagagtaacaaggaagatctgtatttcagaaaatcagccaagcttcagtctgtagattttaattgctttaacttttaacttcttttcaaagagaattaacacaagctaagttggtgacagcagcaatggtgaagggaggaaggagagataatagaaatagtcaagaaatataattaatgagacctagtgcctaattagatttgattgcataagaggaggagaaagtaaaaatagtaataagactgcttcagagactcccttggaattatagtgtattccagcaacaattaaatcctaaaaagacccagagtacttttcattcaattcctatgctgtccaatttctgggactgacagctgtcaaaattttggctcctttaaccatatcccgtattcttgtagtcttagatctttggcccagatatatgactataaattatatatcctctcatattgttcctgttcccatattttctggacttcctctttccaagtccaacttccttcagttccctttcctcctaaaatttcccactgtgctctctcagaactatattcctcagttaacaaatttgaccatataatcattgctgaatatttcaattaaattttggctgttcctgagaacaaattatcttactgctaccctctcaatttaagggaaatttcctccacattcctcagtcattaggactgtgacatgaggatggcattccacatactctactcataattatccagaccatttccctctgatattatccaaaatacccttgctctttggtacttaaacttagtcacacacacctttttattcctttctacatcatctaccaacatcttcatcagtctttccctggcctcccattctttgcttctgcttctcagtttctcatcaaagataatggaaaaatctacttggattatccctctgacaaattggcatcccagtcccttaacttaaactctagtgacattttcatctattctattttagccactcaattctaaaacaaaaaataatgaccttattcttctctagaactgctcaacctctacaaactcctacatctgttatttgactcagttctcaattttcttagcaagttactcttttaagtgttttgacttcattgactccttaaaatatctccattagagtgtcgatttcttagtttttctttaatagcacctattctattgaaatattttctattatgggtttaaatgatcttgggaaatgttaactcaactaataggcctctgtgattacgtaatctacaccactattaaaataattataacaacttggatcatacaatgtcttgatgtaaacgatacattaggtcatgttatggaaatgtttactagccattgaatattttaatcttatttagaatctctaatcaaatctatagagtttaattatttcccagatttttctatttctatacttacctaccactgacattattcttatctctgaattttaacctaagttatttgacaaggtagttaattattgcctactcagtcatagaaatcaaaattcaaacataaaaagatatttgttgtaagttttactgttcttgagatcagagaagctattacaattaatagcataaaaattactagaaaagtagaatttttagataaaagaaaaatttagttctctaaactagtctgggttagaaaaatgcatgaaaattatatagtcatgtaatttcttaaaatattatatctattttgagcaaaatatctgaaagttttctttaagaattcctttttgtttctattataaattatttaggaaaaggttatatttttatgacaggttttttccccccatattataactttaacatgttttctttgatataaaaatataaatcaagtaccattatatttatatgtcattaaggtactgttcttgagcctatatcatgtatagcgtattgtgcattattttttctggcaaccataatctagaaatgggctatagaatgaaattcattaatgctatgttatactagaaggcacagaacataaagtaaataaatcttttgtaatatcataccaaccttataaattgctttaagggaataacaatctataggggtggtagatgattttctaatcagatattacacaatatacatcaaatattctcattctgtagtatttaaaataagcagttgtctacaacatacaatcaccagtcacaataaactattcatgcttttgtagacccccaatttgataactgcataaaacaaccaaatattttagaagaagaaatattataaggaatgtatatccaagcttctgtggttcgaccaggagctattgcctgaactacacctccttagttggactgaacaattatggaatgtgtcaaaataggcctaataatttatctcaaaaattaattaataatcaatgataaagctaaagagttttaaaattaatgcccagtaacattcttttacaatgtgaaacaaatgtaattcttatgtcatagtcatattcttagatgccatgtcttggctcactagtgttttaggccctttgcaaagaaatatgtttgtgttgataacagaaagtcaacatttgtagataatttcctttttaaaattagttgactaaacttgtcttagtttagttcaaatatgctttatttggtggcagagaaaaaggacagggtttaaaaacaaggaaattattcataacctgggtatctctaaatgaaagtattgtaatttcaaagacatatgtttcaaaattttattccagttaaaataaaactgtattatggtaagtcctatttaaaattgtaattttatttcagcacaaaagatatacacccatagataatgcaacactttctgcctttatgaatttgcactgcggaatcatttctaatagaaacaattccaaactattccaaaaatgcaagttctatgaagcattctgagtcccaaccaagcatgcaaccaacaaacttttagcattgcactgagagggtttttttaaatattgctatttttttgtttgtatttttaatagtgagaacatgccacaatattcctggaaaaattctgagcttcccttcttatcttgctcttttgggatctgtcttttatgttggaaatctgtctaaaacaacacataatttttgcccctctattcaagtttaagtataacagattaagaagccaattggaagaactctacatctgggcacaatgcattaattattgagatccattatagatagcttgtatagccaatattcttattacatgtgaacttctactggccaactctgtagaccccttctggttctatcatccagtgacctggcagtgggcattctaaacgttaatgtagaaagagtgctctaggtatgtcatactacctaatacttccgttttatctcctttgtgtttgcatttaataggccaatgacattttggcttaatttttgtatctattgtcttttatatgggtcagggagggacatcttttagactgtacaaagtcaggaggcccacagaatttaaatgtttttttgagcacacgttcaaaatagctcttcgttttcagttaccagtaacctctatcaattaccaagcttttcctgagttttcccagataagtcaaattacttcccattaatatctacttccgtaggttcttaattctgacctctctcagcactgctaagtcacttaacaactctccatctactctatactcactcatattaagttttggtattgtagatatcctggttttgtcaaagacagaattgtgtttcttttccttactttgtagctttgaaagaaaaaatggtgtaaatgtcattactccactatcatgaaatttgaaacaattagaaataacagttggagagagagaagagagggatgtaagtgtcattactgcataattttgaaatgaacaattagaaatgagagtaacgaagagtcaaagttttaacttcaaggtgattgatgggacatgggaaatgagttacaatgggacgtctagaatatttcccaccactgttaatatttctgccacaatttgattttttgtgccaaaatttttctcatatttgttgctctatatgtttttaaaaatcagtacagcgttttttttgtttgttttcttttgttttttaacctcagcatttatgaaagctaactatggtctactggatgtaaaatttggagagctgggtttgagttccaaggttgttattctctggtcatgtaactttcagtttttaacttttcctttctttatctcagttccagattactggtataggaaatgtattagagagacatttttaaatgtcctctctaaaatagtgactgttttgaatactttgcatattgtttttaattcttcatgaaacctttaatgtaactgctatattctattggttttgaccaaattatctgagacataacttacccaaggccataaagctatacaattatagatgaatatactgataaccttcaaattttcaaagttgggggcacttatcttttgtttgactacttggcattgttggcaaccaccccattgaattttatggccctaattcttggccatttcttctccacactttttgtagatgtctctgatgtttatccttatatttcaatattttccaagctctttactcagcctttcgttcatcccacgttaaagatggcatttgaataaattttttattttcccttaaaaattatatttccttaaaaattctagccaagaattctctgatatgcacaagatttgtatatgtaaattccatatacctgtggatatcacgagaaattcaaaccaaatgtctctataattatatttattatattttcccccaaaactacctatcctgttcctggttcccaatttactatttactgacatctgaggcctcaatttttggtctcattcatctatttatattcttatatctccctaccttctatctcttctcatctacactctttttctacatctacactgatttttctaagccacaaagttttcatggtataacctacttaaaatctatgtcttgacacaaattttggtgtatattttatactctttagattatcatgtaagtcttttcattttatcttcagtaagcaataaggagttggctactgcttaactttctggtcacttcctatgattcccccagtatacttgttaatctgtctaaagatattgttttactgtctaaatgtttcctgatccatttttctgccagcatgtaagtttctttctatgtgatattgctattattcatcttttaaaattcagctcaaatgtcatccatttcaggaagatttcccttaaatctcctctctactttccatggctcttttttgatattcccataggataatgtacaagcctctctcagagcatgagcctgaatttattgcaaaattatgcatttttgccttgcccatttcctccaattttatttatagaatcttcaatgctatgtttatagattcacttatagtctcagaataattcttatcatataataaacatacagtaagaaaatttcaaagaaagaaaaacaaaaggaaagataaagcatttgattcattgtctttctattaccaaattctaaattgtttccccttcacaatgctgccttacttatctcaaagagatgttctgacactgacaaaatttatgtgaaagcattttacaaatacagaactatattcatttacaaacaactaataagaatatgtattgtgaagcaatatgtagtaacagaaaaacttgaaatacttggaagtaaaagaatagagatcaaatctcagtatcctttatttatgcctgagtatacttgccaacaaaattaggtcaaacattctaaaatccagatggtttctgtataaattgaaatatttttagtttccccgcctcctcacatggtccataacctcaagtaatctatgtgaaaatttggttaaatagcaaagcattctacaaatataaggtcttacttatggttaactattaaacatctgaaacaggcaaaccattgcaaggaatacacagttacagaaaaaagtagtgtgttttaatggaaagagcatggactttggagtctggcaaactaaattctacttcagccagttaccaagtgtatttgactacaacacttggtctttaatctcagtttctccatgtataaatggagataacaccagttctgtccatttctcaggattctatgagacaagtgacataatccatgggtcagcttttgaaagcaatgattctgaatgcagataaaataaaatattgttattttcttgagcttgaaatacaagaaataattagaatgcgtgagatagagaggaaaatcctcggtaacactacctgacaatgagcagttctaagtttttattttattttgggaaggtaattctcaattcacatcagtcatcagctttaggcctgtgactgtaagtctacattttgatattttaatattagacacatatagtacattacatacaacaaaaagaatataatgttataaatttccatttttcaattaactaattctgattaccactttatggctattttattttattttatttttttggctactttaaaactattacataaatatatttccatgtcctgatagtttttcttatattattaagaaaaacagtcctgataatcctgataatttttcttatattattctcattggtgtttaggtgctctgtgccctaaaactaaaaattaaaatgagacatttctttttgaggacaagccaggacttgaaaatgttttgttttgtgacaatctccatcatccttggcctatccagtgaaaatcacacgtgacttctcttgtcactgcaacaaggcctcctgttctgtttgtgtgtgtgtgtgtgtgtgtgtgtctgtgtgttcccaaccaaacacatatttttcatgctcttgtttttttccaaaatacattcatgttatcagaaatctaatcccttcagtactaaattgccaaaatttaggggtcaggagtctgtgtcactgcagaaataatttgtggttctaaagttctcatagccatgtcccaaatctgattttcaaaatctctttatgcacctcttgagttctccattattttagagctttttcaaatgtttatttactttttaggtaactttaactacttttattctctcctatgtattttaaaattcattttcataacagatacaaaactttagttttgaaaacacagttcgtaaggtttaagaaaatttccatccaacataacatgttgtaactataaaagagagttaaaatagagctgaattaccattttttcaaagattaaagactctagaatgaaattaaacactgcattaaaattgtccatatgtttcttacatgaaatatgttaaaatttaattttcttgttttacaattctaaaattggaaatgtctttgtcactcttaaagaaggacattctgggccagtgtactagatcaatggtgaggggacgagcgggtgggtaaagaagtgagtgtaaaaggcatgtctttattgacaaagaaggattgccaatatagttattctacttcaggtatgtagagcaaggataaagcatatgggccaaagctcatccgattcctgcttttatattatccatgaattaaaaattatttttacatttttttaactattgaagaaaaattgaaaagtagaataatatttctgacacatgaaagctatataaagttcaaatgacatggtccacaaattttcattgaaacccagccaggctcatttgtttatgcattgtccatgacagttttcacactataatggcaaatttgaatagttgtggtagataccagatggctccaaagcttaaggtatcaattagctggcactctgcacaagtttgcctggttcttatcagatgcatccctgagactaaaacaagtgttttctccatttccccatattattataatacagacagcagcccctcctgactctagcttaatcatacatgagcagataactgaggaaaaatgaatattacaatattaactgaaataattgtgagttgtttttaaaaaagattctcaggggaaaaagtatacatttatacatttgtaaactgcatatttgcaagactacaatcatttaaatatgttaactttgttttatggcttggagtatgatatatttcggcaaatgttcacatgcacttggaaatcatgcgtatgttatataaattaatttaggtcaagttatttaaatgtgttgttccggccttctgtatttttaatgattttcaggtctattgatctattgattgctaagagaagactgcttaattctacgattatacttttactgcatttgttatttttttcctttcagtttcattactgtacactttccttttcttactatatgctttccattttctctgcttctttttttatcacctctcttgacttctgatttatgaaatattgttttatcattacacatttatgtgaatgtagacagatctagatctatctatctttattatcttgaaacatatatactatttacactgttttagaaaatctgtattagatctctagggctgtcataacaaaacattacaaactgggtggctaagcaacagaaatcaattgcctcatagttccagagaccaaggtgccagcgatgttggttacttcggagtgctgtgaaaaagagtcggtttcacggttctcctagcttctggtgatttgctggcaatattcatcactcattgaattctcgatgtacaaccccagtctctgccttcatcttcataatgtgttctgtcttgtgtgcttgtatctgtgttccccttcttataaggacaccactcatttcaattaggggccaccataatgatctcattttaacttaattagtgctatgaagattgtgcttccaaataaggccaaattcttaggcaatggggtttaggaattgaacatataactttaggggtacacggttaaacctataacagtagctatcctagtatacacaaaacaaaatgcttggcaaataaattctaacattaattggtactttttttttctaacacagttcatgcaagtatgtcaaaataccataactccattaagctaactcttgacaaatgatgtttttgtaaatgtttatctatattttaaatctcacaggggttattttttatcccttagctttgcatatatttaagttttctttgttttttttttttaatttatttgcacatcttcaagctttcatctcaaattatctcctgtttgctcaaacaatatactttaaattttattttagagtgtgtctacttgtaataaattcagaaaatatatcatatggttatccttgaaagatatttttcttaaaacagaatcctatttttcagaaatcttctgtgacatattcaaaatattttatcatcttatgaattccatttcttcatatgaaaaattagttgcatttcttacttttattcattaacagttcactttttctctttttaccctttggcttcttgtgagattttatttccaagacctaccaaaagaaaatcctcagctacattatacttaatggtgaaagactgaagttctccccagaaagattaggaacagaccacaacattgtactgaatattttttccagggatattagggaaaaaaaagtaagacaacttatttggaaagggacattaaaactatctctatggcatatgacacaattttccatatagaaaattctaaggaatagacacacacacattcacacacaaacttagaaccaagagtgggtttagcaggttcacaggatgaataatcaatacatgaaaatcaataatatttctgtacacatgcaataaacaatccctaaatgaaatcaagtcccattagcaacatcttcaaaaataataaaggctaatatttataatggtaaaataaatataatcaaaagtaatataagagctatatactgtaaactacaaacttcactgaaaaaagttaaagaagatctaaacaaatggaatgatgtcccgtgttcatgaattggaaaattcattattaaggtggcaaaaattcccaaattattctatagtctcaaagtaagccctactgaaatccaagctgattttttttagacattaacaagctgatttgaaaatgtttgcagctatgacagagtcacaaaatcgtccaaataatcttgaaatagatgatcaaatttggaagacttgcactttgtatttttaaaacttaccacaagaaacactaataaagacaatctttactaacataaatgtagttataaaagatccatgatggaattgtgaatccagttatatttcctcacatttatggtcaagtaatttttaacaaggatgctaagatgattcaataagcatagaatatccttttggtattattttgtttatccacatacaaaatactaaagttggacccttatctcacattatacaaaacaaattactacaaatggaccaaatagttaaatataagagctaaacctataaaacttttagaagcaaatctatgaatacaccttcatgaccttggattaagcaatagttttttacatataacaaaatcataagtgacaaaaaatattaacatattttatgtttcaaaggacaccatcagaaaagtgtaaagacaacccatagaatggtagaaaatatttccaaattatatcttataaggaaccactaattcagtatatagaatgaactcataagataacaataaaaaggcaactgtctcaattaaaagtggacaaggaatttgaagatacagttcttccaaagaaatacataatataaacagtcaataagttcaaaaatatatgatcactatcattagctgttagagaaaatgcaaaacaaaaccataacgaaataccccttcacacccactaggatgacaacaattaaaaaaagatgtaacaactgttggtaaaatgtggagaaatggaaccttgcatataccattggtgggaaggtaaaatggtaatgcactttggaacacactttggcagtccttcacaatgtttaacatagaggtatcatacagcatagcaattttatcctaagaaaaatgacaacatatacccacacaaaaatatgtacatgtatgatgatagcccaaatgtatcaactgatgaatgaataaacaaatgtggtagatgcatacaagggaatatatccaacagttattttaaaagatgaatggattgtggatataggctacaacattaattaaccttgaaagtattatgttctggaattaaatagtggcaaggattgcacaactttgtgagttttctataaatgggtatattgtacacttttaaaaagtgaatttttatggtatgtgaattatgtctaaaaatacttttaaattaaagatcactttctctttggttttctgcaattttgctatgaaatgcccaggggactatataggtacatggatacacagatatatagatggattaaaagatagaaggataggaataaagatagataatttcaatcttgctcctgccttatagaacttctggaaactgacttgagagtacctgtttggggcaactattgattattatatctccgaatattgcttctgtgacattctttatcactgtgtcttttgggattccaagtgcctgtattttataccttcttcttttatgctctaacttgatctattttatatattttccaactgttcagttgcttgaggttcatttggtataattatcaattcccataccttcctttttagctgtgtttttttggtgttatgtttctatattttgtttgtgatttgtttattgctttgtttcgattttagaattttcacttgatatttttacagcttgtcaatcttaccatttcttcttgaacagagagaacagttattttaaagtctacctcaaatgcttgcagcccttggggactgctgtattctctatttttttctactagtttttgttcaaattgtcctttttccttaaatctatggttatttctcaatctgttagtgacatgacattttttaagttgctgatggaaagcatgtgaggcagggaatgaaattatcttttcttatataaaaagtaaatatttttacatttggcaggcctggaagttcagtagcagtccagtaccaccaaaatctaattgcaaaaaataagatggcttgaaatggtcctgtagttcatgagtcttagtcgatttagggctgccataacagaataccataagctggtggcttacaaataatagaaatttatttctatttcattctggaaattgagacttccaagatcaaggcaccagcagactcaaggtgtggtataggcctccttcctatctcttcactgtctcttccctgtaacatcaaatgacagaagaggcaagctatctctcttgggtctgttttgtaaggacactaatcctattcatgagggctacactctcatgacctaatattgccttaaaggctccacccaccctccaataccatcatcttgggggttaggatttcaacacagaaatgtagagggtacacaaacattcaggtcatagtaccatgtaaggatatatttatgttcaagtcattcttccttttaaattgtggccactttgaggttttcaacttctttcaagacgggattttactaggcaaactttttaaaattttgtaccagatagaaaatatcccctctcttcctcaattttttaaagctattgagtttttaatctcacaagcaactttttcaaaattggccaaagagatcatggctgatatctctggatatccatcttcttacattgctttggtgaaaattacaaccattttacctttaccatgttttaagacatatcaaaacaattgttcagcatttttaattgttctaagcaggaaaagtgatctatgagaaatcattccctattcctgaacatttactttatgtactaatgtacttgtattgttatgtgactgagtccaagaagaaaggtttttgggataattcatatatatgttttcaattattttccataatgaatctgttttcatgtagagaaaaatgtattctattatttttaactagttgattatctttcatgaaattagattggaaaaggccaagagctgagttggtgcactatattagtaccacagggaatacccaatgtccacataaatcacacctaagctgtacataattgtgcaagataacacaagcaaatatgataatttgtggcattgataaatagtttgcataaatatttaattgctatatctaaaatgtttaaaaataaaaatacaaatatatgtattacgttctatttttaaatgtttacattttaattagagatatcagaaaacacagtataacctctaatttccttggatattccattttccagataaagccaaaataaatcagccaatacaacacatgctttttcaattatggtactttttacaagagttaaaacaattatttaaatgtaaaaaattaaacataagactgtgtggaaacttttaaaggcaaaatttttttttgggtgagagcaagtctatatatactgacttctacctaactacagtatccaaacttatgctaaataaattattttacattctataatgatcctcaaattttgagtgcacttacactcttctttctaatatatgtaagtcttttaaggatgttttactaaattgttacactaaacagttggaacaacttcctttggtactatacacattgagaagagattcaatgaaacacactaagctctagcactgaaaacaaaaattttaatgtgtattgccttgaattgtatgcaataaaacagaagagaataagcacagattattgtagtgcaatcttctaaaaatgggaaacttactttcacctgcaagaactatttttgtgataaggtaatgatggtgctataaaataattatagggacactttcctgagtgagtcaatttagagaacagctaaataagtcaattaccaaagaaccccatggtgaagatgttggatttttacaggttttagaacacacatacacacatacaaatacagatgcacacacgcgcgcgtgcacgcacacacacacacacacagagagaggagagaaagaaagaacccattgaatgatagaaaagaacatccctgaaatgaaaggtacatggagttttttgtcatatagaaaaaagaggttgattttaaaatgaactgacatttttgaggcgaatatattatactataaaccattttcttgaccacaaaaagacgtactaaagtgggaatgaaaatgaaagcatggccaaatgatctagctctgttgacatcctatgagtctaagtggtgatctaaatttcaaagaatttattacaatttctggaaataggccagttttctgccaacttaaaaggtcagaaaataactactaaacttattggtacaaggtttccaaaatgtctaagccaaaaatggtttcaatagcataaatactaaaagtagcttatttcatcttatttaaatattattaaaatacttgaaacctgaggaagcacagttacattttaatacatcagccaaatactatggcattaagaattgaattactactaaggatcaaggaaatagaaatcaatgacatctaagatgaaaaattaacaacaaaaatcatcataaattttctcacttatttttaaagttatttagaaatctttgaatatccaataacaaaaatgagaaatttgtaagacacaataagattctccaaatgataacagttttcaccacatttttctcaataattttatattttaagtggcaactctctcccttgacttatgaaaccgtcaactactttctctcctccaggcaactccaacagacaatgaataatttactcataattctaattaaaaactgaatagaagctgcacagcctgtgtaagttataaggcagtgtactaattatctgttacttgaattttaaatagttataggcagctttaggaaagcatgtatagaattagcaatccaaaccaaaccagtttcctgaaaacactgttgagatattactgatttcctaattattgggtcttacatgccttctaattacccttacaatttatatcctttctttttccatgaaaatacataaactatagtcatctactatgaacaggtaacacattaaataatccccatgatatccatgcaagacaatgattcttgtattaattgctgatcttcttcagaggctaaacctttacttaacttttcaatgcttacatttcaacttttatgtcacaaagtccagtatgctattcatacttatgaagttaaacagaaacaaagaatttcaaatgtaagacccaaaatgccagatgcatatttgtgtatatgtggtaaaacccaacactgaagtatatttctttagttgtgcgaggtcgtttctggtgctaaaatggaactggtgatgacaacagttcacaccaagaaaaaacaatcaaaactctgccacccaccctaccaagcaaacactgctcacaggatcatttgacctcatttttatatgcattgttcattctacaggaaagataaagctggcaaattccaccagaggaaggtaaactattttttaaaatgtttcttgacactgtaattctatacatgactgaaagtatttttaaggactgagaagaaagttattcaatataatttttgttgtattttatttaattaaaaacagttgttttaacttacttttaattttaccaagtattatataccatgaatattatgagttaacagaattttattaatttagaaagtagccaatagtgccatgttaggaaaatatatgatcatggaaatttcccagaactccaaatgtttagtttaactttggcataaattttagaggaagaacaaatagtaaactgaatttaagcagggtctccctcttatagagaactgcaatactcattgaattattccttaatatcacaattaagttgataatttatttttatgaaagtttgtacttttgattaaaataatcataggataaatcagtctatgatttcatagaaggtaaactgagttacagaaaatctttgtctagccttagccttttaagtatattagtaccttggaaatcctacttgaaagtcagctgatatggaaaatatgcccatgcaaacatcatctaaatttctttctcaagtgaaattttgacaaaggggcatacatacaccaataagaatgctgacaaatagcatatgcaggttcccaaagcctatgatattggccattctgcttcctgaagagggaaagataaattcaaagaatatatttacctatttatgtttaatttattgaatatagatgctgttactgtttttcttaaatgtaaaacatgtaccaaatttatattaaaaattcattattttatatttctaatatggcaatcagctattcaagtagaaaacaggaaggaggatacagctgaacagttcataaggacataaaacagatttgtattttgttaacagtttccaattttggtccttgcaaacttgtttaggaaaaatgagagaacactttgataacatggtcttgagaggtctatattaatatcacgtcaaataatacttattgagagtatttttatgttgatcttagataagagaatagtatcttgagctctgtaattaaaacatagaagacatagtatgcttgacatgtattatcagaacatgaaggaacccagtgtggtcaagggatcaaatttgtgttgcactggtttggaaagcaatatgagccctaaagcctggaaatttaaaaaaaaaaaaacttagagccttatataagaaacatgaattttaattgaaattctctactttagaatgtacagctttatcaagaagataataaagaagagattaattagcttgtctggattctggcagcagattccatcatgttggcctaagagttgcaatggataaccttatcccatcttaaattacggtggtgctgtgatagccttacatttgttatgctataaaaaatattaaacttcagtggtttttcatgtctgtagttcttttggaacatgcttcccgaaaatgatgatggtttatagatcacgttctgtagaactgtaaaatatttagcaggagtgaatgagacagaacttcttgctacttcactgtaaatctactaacctctctaaaatatgaatcagaagaataaaatataaatcaaaatagaacgggggactcaccaagtattacaaaaaataatatgtattatcaaacaccaataaattttccctgacatctaatgttggtcttacatttattaaaaaatgtaacctttgaagtacaactttacatgaaaacctattttaaggaatcataaagagaaggcaatgatgggattatataacaatttttcatttccatatgagaatataaattattaagcttatcatttttctttttattttagtaacaaagacattactgaatgttgccaacagatttaacattggcaaatcatctgacatacagcttaatctcctatgatacaatatatgaatatatagatgtaattctgttgtatgaacaaaattgttatagcacattctggaattgattaccttgaaactaaagtaatagattagagttacttgaaatttagttgcatagtaaggctaaatcttaaataaatatgctacaattacattgacagaataaaagatttttactaaaatttcatacatagccttaagtgtatgcttgagtaatcacaacgtatatatagcttttttcttaaagataacataaggactctgacttcataaagattgaataaaatgagaaataggacacaccaacccacatgatacaaaataataaaagctacaagaaaaaaatgctataacagggacacagtttgggaaatttttaaagcaaacttcacccacaaacccaacagatggtaaatctacatctgtttacacagcttataatgaccactttcttatgtagaaaaaaggctgtgaaagagaacataattttatataaagcacactccacattacatttatatggctgtaaatatggcctagaactttccattgctcatcattgtccacaaatatttctcactcttttccattaaactaagcacaagatacatcagttgatagcactgatttctaaatacaaatttcaaaaatatttgtaatttctctgtccacctttgaaaaaggaaattgccattagactttaacattctacaaattccaaaactctttatgaccagaatagagtccccaacatttgcttaagccaatcactgatgatttatgataatttaaagtcaattgatatgtcaacagtagttggaaaaagtttgtgaataataccaagaacaaaatgtcttaaaagattttagaagataattcgatcttctaaagtttcatctgacaatgaattttaaaaccagaaaaaaatagctgacattcatgttagcaagcattttttattccacattctctatgcttgactgatccataaattgttgcaaatcatctaagtgaagcactaaatataaaaagatgagcactggaaattttcataagaaattacatttgtatgtattataatatgataatacatatcacatttaactcatattgcaactaaatattaacagaaattttggcagctgttaaaaagttcaaatattcactcatgtaaaaatatgacatctatttttttcttaaactaagattattttttgttcatggatacagatacaaataacctctctctaaagtcactccttatatagtatcattcatttcacaaaagccagcctgaacatgtcacacactgaaattcaaaaggttttaatgaaaaagtctcttttattttttgaaacagtaccattgggatatctgaaaagggtaatacagttagagagactgtgaaaatggttctatcacaaacaaaaatagtaggtcaagaaaaggaaaggatgttttaaggtaagataatatcattcattgaatttggatctactgagtttgaagcattgatagaatgttcaactggaaacagttttcagacatttggaatataatagtaaggcaagcacaggagatgtgcttaagctatagtaaaaacttttagatactataccagtcatagttaaagttacaaactatgcaggatatccaaggtaaataatgaagacagagaagcacaagaaaagattatttgagcaaagcatatcatttgagtggtatgagaaagaagagataaggaaaccttactggaataagtggtgctctcaaaaaaattaaaatgaagaaaaataaagaacaagaaaagagtgttgtttgtggtcataagtgaccagacaggaaattattcataaagcatttctcactggttttataaatgagtaacaaatatgaataaacaggtataagatcctgaagtgtaagtttatatatgaaggtgaagattttaacaagtggacttgagatcatggatcatgatgaaataatatcaataatggtgaatgacactgagtcaaaagttttgtgtgataaaatattctaatttaataaaatcaacaaacaactgactcaatgaatatacaagaaccataacctttgtagaacttactaatttacacacaaggcataggtatgcttagttagttgtgcttgttaccaaaatgccaatgagatgtttattttcccccaaatctttactgcattatcattaacaaataaaaattgcatatatttcatatatgctttgatgttttgatatatgtaatacattgtggaataattgccacaatcaagataattaacattcttcacctcacataattaagtgtgtgtttgtatgtgtgtgtgtgagagagagcacttatgatctattttcttaggacattttaaatccacaatacagaattgttaactatattctcattgctgtacattagattttcagaaattattcctcttacataactaaaactttttatcccttgaccaagatcttgccatttcctgatcctctcagcttctgggaactaaaattctactcttcatcagttgtccttgttatgcatagctaaatgtatacttaaaaccaacattgtaaagcaatgtagaagtcaggaaggagctctggtccctgtatgttgacttcccagacgaaaattagaaattgacacagaaatagcaagataatttagtgaatagtaaagattcacaacacaaaacttaggttataattttacttttatataatgacattttatttaaaaaaaactataacaatagtaaactatattgaaataataactttctatatacttttcacttaaatcaaaggccttacttgtctatatcaacttccattcttcatccacataaaatcctgggatttaagtttctccaccacttaaagtctatgtgaaaagtgaggaagtattttcaacaatccaaatttcagttccttgtctataaattagagatagtaatgtctatgcaaagattttaagaattaaatgattatataattttgcaattatttttttaaaatttgaaagcttacctaaatggtgggtaacatcatttgaaattatttgcattaagttgcagtaaaatacatgctaattataaataactagaacatgttaattttaagaaaattaaaatccttcataattgtgaaataatggaatttttaggtatatgtttttcatatgtcagttcatatcattatcatatacctttgtattctggtttttaacttagcactatgataatttaagtgttttccaaatcattacttattttaaaaagtgtcttaatgcctgtataaacataacattaatttgtgagtgtttcaattaactaagggaatttgtaatttttaacttagcattttgagtactttcagaattttttataaacaagactatattcaaaaatctttgctggcaactaatttgtctgccaagatttcattagaaaaaaatgtcaagaagtaatttagccaggttaaaaagcaatcacatttcaaagactttgatgtaaattatcaaattggccactagaaataatttgcgattattcatccatttgcaatttgaggaatagttcatggcatataccctccgaaataaaatgggcattatgttaatatctttctaatgtgttagaataaatattctattttattattatattaatttgccaattaagtgtttgtcatagcagttgagtcttttactatatttcaggattgtttgtagtttgtaaacacgtttagctatacgattatgctatatatattcttttgtatctgtctttttttagcaagtttgttctctttccaattcagtatctgtgtatgtgcatataggtacatataccctcacatatacatacataattattttaagtctgaattgcattcagagatggctttaaccagtttctctaaatggacaaatgaacaatttttttttcatgttggcaaattttatacataatctacatagatcactgtctttttttgttaatgatataattatttggagtcatttccatgaagagtaattagtgagtttaaaacatgtacctatgttacttgatgttactcattgtaaaaatgccttccagagacgttttagcaatgtatagcaccagcaacaatgcatcatgtatgagaatgattttttttctccacagatcattcccagaattagatttcagtttgttagtccctttcacttttgtggggcactaaggagttaaaataaaattgacaaataggtttagcttgcagaaacagacaaatgggtaggtgggagtgaatgttccaagaaatggggtcaactgcaaacagcttactggcaccccccgagtatcctgccacaggccctgagctcaccagctcacatgcacccaagcatcttgtctgtaagcattcagactaagcagcatgaccttataaaatttccctctagctcctgcctctttgcagacagcagagagccttctttttactatcttgcctgttgctcccttgcaacgtactgttcccttttctctaataaatctgtctttctaaacttgttactgtcttgggtaaattcctttactacccaggcgccagcctctgacagttgaccatgacaactttgtctaattttgactgaagtaaagagaatggggggtggagacaagatggacgaataggaacagcttcagacgaagaaggccattacataatggtaaagggatcaattcaacaagaagagctaactatcctaaatatatatgcacccaatacaggagcacccagattcataaagcaagtcctgagtgacctacaaagagacttagactcccacacattaatagtgggagactttaacaccccactgtcaacattagacagatcaaagagacagaaagttaacaaggatatccaggaattgaactcagctctgcaccaagcagacataatagacatctacagaactctccacccgaaatcaacagaatatacattcttctcagcaccacaccacacctattccaaaattgaccgtatagttggaagtaaagcactcctcagcaaatgtaaaagaacagaaattataacaaactgtctctcagaccacagtgcaatcaaactagaactcaggattaacaaactcactcaaaaccgctcaactacatggaaactgaacaacctgctcctgaatgactactgggtacataacaaaatgaaggcagaaataaagatgtcctttgaaaccaatgagaacaaagacacaacataccagaatctctgggacacattcaaagcaatgtgtagagggaaatttatagcactaaatgcccgcaagagaaagcaggaaagatctaaaattgacaccctaacatcacaactaaaagaactagagaagcaagagcaaacaccttcaaaagctagcagaaggcaagaaataactaagatcatagcagaactgaaggaaatagagacacaaaaaaaaacccttaaaaaaatcaatgaatccaggagctggttttttgaaaagatcaacaaaattgatagacctctagcaagactaataaagaagagagaagaatcaaatagatgtaataaaaaatgataaaggggataccaccaccaatcccacagaaatacaaactaccatcagagaatactataaacacctctgcgcaaataaactagaaaatctagaagaaatggataaattcctcgacacatacatcctctcaagactaaaccaggaagaagttgaatctctgaatagactgataacaggctctgaaattgaggcaataacagcttagcaaccaaaaaaagtccaggaccagatggattcacagccgaattctaccagaggtacaaggaggagctgttaccattccttctgaaactattccaatcattagaaaaagagggaatcctccctaactcattttatgaggccagtatcatcctgataccaaagcctggcagagacacaacataaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaaagacaaaaaccgtatgattatctcaatagatgcataaaaggcctttgacaaaattcaacaaccttcatgctaaaaaatctcaataaactacgtattgatgggacgtatctcaaaataataagagctatctacgacaaacccacagccaatatcatactgaatgggcaaaaactggaagcattccctttgaaaacgggcacaagacagggctgccctctctcaccactcctattcaacatactgttggaagttctggccagggaagtcaggcaggagaaggaaataaagggtattcaattaggaaaagagaaagtcaaattgtccctgtttgcagatgacatgattgtatatctagaaaaccccatggtctcagcccaaagtctccttaagctgataaacaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaacgaaataaaagaagatacaaacaagtggaagaacattctatgctcatgggtaggaagaatcaatatcgtgaaaatggccatactgaccaaggtaatttatagatacaatgccatccccatcaagctaccaatgactttcttcacagaattggaaaaaactgctttaaagttcatatggaaccaaaaaagagcctgcattgccaagtcaatcctaagccaaaagaacaaagctggaggcatcaccctacctgacttcaaactatactacaaggctacagtaaccaaaacagcatggtactggtaccaaaacagagatatagaccaatggaacagaacagagccctcataaataatgctgcatatctacaaccatgtgatctttgacaaacctgagaaaaacaagcaatggggaaaggattccctatttaataaatggtgccgggaaaactggctagccatatgtagaaagctgaaactggatcccttccttacacctcatacaaaaattaattcaagatgtattagagacttaaatgttagacctgaaaccataaaaaccctagaagaaaacctaggcagtaccattcaggacataggcatcggcaaggacttcatgtccaaaacaccaaaagcaatggcaacaaaagccaaaattgacaaatgggatctaattaaactaaggagcttctgcacagcaaaagaaactaccatcagagtgaacaggcaacctacagagtgggagaaaatttttgcaatctactcatctgacaaagggctaatatccagaatctacaatggactcaaacaaatttacaagaaaaaaacaaacaaccctatcaaaaaatgggtgaaggatatgaacagacacttttcaaaagaagacatttatgcagccaaaagacacatgaaaaaatgctcaccatcactggccatcagggaaatgcaaatcaaaaccataatgagatatcatctcacaccagttagaatggcaatcattaaaaagtcaggaaacaacaggtgctggagaggatatggagaaataggaacactttcacactgttggtgggactgtaaactagttcaaccgttgtggaaatcagtgtggcgattccttagggatctagaactagaaataccatttgacccagccatcccattactgggtatatacccaaaggaatataaatcatgctgctataaagacacatgcacacgtatgtttattgcggcactattcacaatagcaaagacttggaaccaacccaaatgtccaacaaggatagactggattaagaaaatgtgtcacatatacaccatggaatactatgcagccataaaaaatgatgagttcatgtcctttgtagggacatggatgaagctggaaaccatcattctcagcaaactatagcaaggacaaaaaaacaaacaccacatgttctcactcataggtgggaattgaacaatgagaacacatggacacaggaaggggaacatcacacaccggggcctgttttgggtaggggtaggggggagggatagcattaggagatatacctaatgttaaatgacgagttaatgggtgcagcacaccaacatggcatatgtatacatatgtaactaacctgtaggttgtgcacatgtaccctaaaactaaagtataataaaaatatatataataataaaataaaaaaacaaatccaactttaaataaagggggtgttaaatgttaaaagaaaaaagagaatgaaacttatttttaaaatttgaacacaataggctattaatgaaactttatttaaatctttatatttttccaggccaattttaaagcttttaaaagttttgtttttttaattctgtgcccatttttagtaaatatagtatatttttcttaatggttcttaaggttttacatcataataatgcaaacatttctccaaatacttgatgtttagtatttccacgtcactgcatttagtgcattttcatgattttttaaatttccttgacatgttttgtatttccttgacatatataatattattaaaacacacactcaatcataatttaaatgctaatcctcacaaatctattagtctcaattttgtttaattggttttttttgtagtagatatataattttttatagtgaattacatcagtcttttctgtttacttcttttatactttgtaaggaattggataagtctcaaacaagacagttactcatcattctgggttttttgttttgttttgttttttgagacaaggtctcactctatcacccaggctggagtgcagaggcacaatcttgactcaccgcatccttgacctctctggctcaagtgatcctcccaccccagcctcttaagtagctgggaatacagtcacacaccaccacgcctggctgattttttgtatttttttgtagagacaggatttcctcatgttgcccatgctggtctcaaactcctgagctcaagcaatcttcctgctgtggccttgaaaactgctgggattacaagcaagtggcactgtgcccagcctctattctgttcttctttcatctgcatttatgtttaaaatttcaacttttaaaatttaatttttaaatgttgagaaataaaggacagtattttttcgtatagttattacctgaacatttattaaatgattatttagcataatgccatatgttctcattcttaatgtgtttgtaatctctcaattggttgcattttccatctgtcaaaaggtctcacttaaacattttaagctttgctgagtaccttttaaaaagtgtaaaaagggtgatacaccacaaatttcaccagaatttttaaagtatatattcctatttataattccaaatacaatttcggagttattttgagtttctaaaggatcttctttaaattttatatggaattttgatgatgtgataaaagtgaaaatacatatcttatagtactaaaaagtttatttggaaatacagtatgttctccactcatatccttcttccttaattactttatcaaattttgtgtttgtgttaccagttatgatatatttcttgtttaatattttttcttctaattttatatgcttttaaactattataagtgtactgattttattatactttctacccagttagtattttatattttctatttttgattctcttgaaacaaatgtgtcatatagatggagacactgaagaaaaaaataggaagattaggattagggaaaggttagggaaaaaaagtgtagttggtattttcttccataatcaatgagtgaaataaaattttctcaagcaatgactgcattgttacctcatcctcctccccaaacaaacattttaagctgaaatacagtgtgtctatactgcacttcaagaaatactttagctggattaatatctcaatggaatcggaattccatggaacataattatatcatttgactaaagtaaattcatagtcttttgttgcactgacttgtccttagtttagggttagttataaatactttcagaatatgttatgaatgactttaaataaattgataaagtaaagtcgcataaaacatcgtgatgtgttttaatctgtttgtgctgctttaacagaataccacagactaggtaatttataaggagcagaaatgtataggctcttagttctggaggctgggaactccaagatcaagcggccagcatttgattagagccttcttgctatgccataacatggcagaagtcatcacatggcagaaaggcaaacagtaggagagagagcaacaggagtcaaacttacaaccatgataatgataacagcattaatctattcatgagagccaggacctcatgactagccatcttttaaaagtcccttctcccaatactataaaaatggcaattaaatttcaacaagagttttggagaaaacaaacattcaaaccatagcatgattcaaacaaataaacagcaacaaaccgagaacaaatatataaatcctgattttaaatttaaaaatcaacaaaaggctaatgcataaaaataatcattgtaattccaaataaatacagattcaaatataaaataataacattaataataacatatttttaaaactgaatttaaaaataattaagaaaaataacacctaatgctgtaagggttttgttattcagtctctggaaaaaagtctaaaaaccttctggaaagcaatttggcttcacaaatataaaacctcaaataaatttatatattttgacttatcaataaaatctaccccatttctaggaaatgtattattaaaatatgataaaacgtttggataaagatgtgaagacactaatgtctggcacaacactatggaatgtttattttggatagatgcatagctacaataaaatattttgttctagtatgtaataaaaataaatttgaagtgggaaattttcatacatattgtatgtaaaaaagaaagaaaaaaaaaactatatgtgtgattgatctgaattgctcataatttcaaatgttatatattgatataacatttcatttttatcatgaagaaagatgcacatagatccactaaaatattaacagtctctagattttcagattctagatatttataaatcattttgatatacttattacatatcttatgaagactagagagtagagtacaccaactttgtgacatcatgtcccacccaaactagaactttttcaatacaagtgttgaccgaatttatgcaagtagaattcacattcagaacactcagactcacatattcagaaatatctatggcagccattgccaccagctctgaaatcttagtttcagagcagcatccagttttagagagctgagctgaaagacatttagaaaacatctattgcatcacatttgttctacagatttgaaaatatggatcactggagtttaatcaatttattctaaacacaaaatattgtaaccaatggtagaattacgatcataaataaagcagcataatttttcttggctgtttccagcgtgtaacctaccttactttaatttcaaagaagccatgaagactatgacatgagtgctaggctctgttatatttctaagctatgtgttcgttctttttgttttttcttaggagaatggcactgtattttgggcacagttcatcaaggaaaaacagttgtcttaagcaatggattttagtgacggctagttgattgttacctggctactatttatagtatgttcttggttttattatgtgattttatttaaaagttacatagaaaataagaatttaaagtagaagtcccagttttactatgtccatgatatacactcagaacattgatattctctttagaaatgaatatttaatctccacatccacttttgtcagaagtaagttatttaattgccaagcactttacaaattacttctcttcacgtattagttccctacaattcccgaactataaacacaggtataatactaacttgctttctgatattgcagataagaaattaagtagataatctgtcttagatattatctattagctaacattttcactgattattggggatatattagataacttaactttgttcctgaaattatttgagagaactttacctcaacaaaaattgaagatgggaatgagaatttaatgttctttaagaaaatattttgtgctcctgccaatttgtgagagttaaaatataggaaagatcacgtttcatacgaaaaatcacaattcactacttcctcttgatatgggatatatggacaaaaattactctttaggcatgtagaggtctagtgcaatggtaatgaaataagtgggatgatagagtgtgtctgagtctattggttttaaactactcctgggttactggtaactacatatttgtcactaagcctatttaatacagttccttaccttggggattgaactatacaacacatgagtgagaaatacagactgaaatgacaacaaagatgaaatgatggagataaaagtactttggaaatgagatgatagaattcactaagaattatggatcatttcaaattcataaacataaatatctactttaaaacattacaattcatggaaagcacttatgtcacttaaaagattgggcttcagaacggtgtcgcctcttaggttaaggtggcaagtgtaaaaagtcaccatagcatcacagtacttgaagacatttaaatggaagtattagttgataccatgagacttttaattttgacatactattgtctttgatgatattggatatatttcttccataaataaacaggttttgtttaaatggaaaatatgctgaggcaagtagaaccccttttttatatttcctcaatgagaaactgtcttagcagccaaagtaacagcgttcactattattgcctcaagggttgggcagattccaataggctgggaacacaggcactatttggggttgtatactcaagtttagacagaagcagtctggtcacatgaaacttaatcttttaaagtgttatttaaacacattctttatagtttaaattgtaccaaatttattctaggcacacacaacatttattcaatattcaatttacaaatagaacttatgtgatttcttagtatagttttttggttttatattttgagtaaattttaagaccttcaaacaagagaaaaagccatcagaaatagattactcagggtagggaggacatcaaagaatagaggttaatttaacaatttctagatttcttcttacagttttttaatgtcaagtattaaaatagcacgcattttttcaacatattctagcctcaactgattttagaaagtcaaactcatgtcaacatgtcattttatagacatagaatgggaaagaaaataatagtacagccagagtggcaggtatttcctgcaagaatatgaataattccaactttttcatgcagttttcacttctatttgagaatcagggcttattctgttattattttgtgtttgctatgtattttatatagtgttgtcagttaagcaagttaaataaatgcaactggtcaaactgtgaagactcagtaataagcatcaaaaataatttagtttccaagaaaaagcaaactcttctttgtcaactgagagacatgtctattgagaaagcgtttcattcaaacttgagaaaaagtttggtaattatggctaccatttactctgaaaacttattggaattggtatattcatataaaaatattgctaattttatttttcccaaattaatttttgcctttgagattcacttgaaattaaagtaacttgaaactaaactatgttctttttccttctaatttcactgtccctatatataacaatggcttttcttaagacattagagtagcattccttcgtaactgatgacttttacattaaactttcatgtaaaattatattcaaatttgctttcaagtctctttttaaaataactgtttttactattcaaaaaataaatcatagtgaaaggttaataaagtatatatactcatatcaatcttattagaaacacaatggaagttatatcaaatattttacaagtttctcaattcacattaacctagctctagaagtttcttctgttctcaattcaactggaagataattgtcttgactaggaaaaaatgctaataatgagactgtcaatatataaactataaaagttaatggaaataaaaaataatcttaaatgcataaaatactaatgaatacaatgttcacaatattagcattaaaagtggtcttattttcttaaaaacaggtttgtgttgtaaacaaaatacaaggaaatcttctattaaaaatatatgcttgagattcatggtagcttaaatttatccagggaaaatattttacaatatgtctcagtggtagtcagaataatcacctccaaagatatttatatcttaatcctcagaacttgtgaatgcgcatgaatgcacacagcaaaggagaattaaggttgcagatggaattaatgttctaatcagctgactttaaaatacagatattattctgaattatctggcaggtcccaatgtaatcacacgggtctttaaaagtggaagaggaaagcagggaagaagttagagtgatgcagtgtgaaaacttgatcctttattgcatgcaaaaaaaaaaaaaaaaaaagatgaaggaagagggccaggagccaagaaatggggacagcttctagaagatggaagaggcaagaaaacaaattgtttcttaggggcttcagagggaatgcagccttgccagtatcatgactagcccagtgagacccattttaatcttctgaggtacagaactataaaataaggaatttgtgtagttttaagccataaaattgtgtaatttgtaaaggtaaccatataaaattaatatagcttctatgaatacctctatcttaattatatagttacagttttaattttttttataatgcatatcccttgaaaagttgtaagcaatatagcatgtgcttaagaggcaaaaaggtaatgtgaaaattttttaaagtataatttattatatatttatgatagtaatttgcaataatgtattatatgtattataaatcagtgttaatgtaccagtctatataaatatctatatgattaaactattccttattcaatatcaacttgcccactgtaaatcacactagtatgctgttgattattttgcaaagtttcgttcatgatgttttcaggtggataattcatgcttacgtgtcatatcctcctgtactctataaaagaaataagagcagccacagcacatgtatcactctatggaacatattaataaagttctcaagatcaatgctgctgagtgcttttttgcaggagcagtttaatgttagtataaaatattgccccattaaagcacagaagacaataaaataaagcaaaatcagcataaataaaatttattaattatgtctcagtgattggaccttttcttttacgttaaagaaggtttacaatgacagcagcgtatactagaaatgatggagtccctatttatccctggtaatgcaccttcttagatcacagttggttagttgtcatcacttaatgtttataaagagctctaaaattgaaattactccctaagtgtcgagtagcctcatcattcctgaacaatcctaatgaagaaaagcatatgtgaccattttgcaagcctcttcagaggaaagtgaatatttaccattgaataaaacaaaacaggaaaacaaacagataaacataagagcaaaagaacaaagtcaaaacaagttgcagaccaatgtagaaagaaacaaaagtctgtgcttcttccgttcaggttcctcgggccagagacagcatgtaggtcatgctgtggttgatcacaagggccacagatgatattccctagtgtttgcaagaacttcctttaaagtactattaataatatagagaaaaatgagaaataagtttagcatgatcattagtatgcagtgtatgtgagtgatgcaaccatcatatacaagcattataactttcgtgggcctattttcttatgctctatctctctgtgtataaaacataaaatatataaatatgtttatattttatgtaaatttatatttatgtttaatttatatatttatatgttatataaagtattttcatgtataaatatatttcctataaaatatttatatattatattttatatgaaatatatgtaatattacctaggctatgttcactattttacattcatcgttattcattgttatactcattttttctttggtttctaagatacattaaaatttgaaaatataatgggcctataaaattttcatgacccctaagtgccgtacctactgtgtctgacgaataagttgtctctggtctttataaccatttgctatctaaaagtgtataccttcagatgtccccaattttatatttgtgataaattcatgttgataagaatatgggcatgctgattacctaaaattcaaaatatgaataggcccagtataaattgtttatgtatatgcattcaagcactagtgtgtttgttagagctttcaaatctgtttccctcttttaatccaaagtgttccaaaacatatttgaatataatgtgtattttctaaaaatattccataatctgcatgtatcacatcttaacccaacaagtaaacactggaaatgactactaatcagggcaagacatgcatgataacatgtaggtgtgggttattactaatacaaaaattctaggaactttcctatgtactctgtaggatgcgaatgagggactgtaaaagtggagaatgacaatctgtatgctaattctgaaacatttgcattgagaagaatggcctgggaaaattgagctaaatctattcccgccttagcaaaattcttcatgaatgtgaaatgctataggttagttaggtaaactagaagcttctacaatcttgtctacattccaagataatgcagtatgctaaatatttttctctagactgaaaatatttctttaaaatgatctgtaattttagcttcctacaaagtcagccttactttctctgaattagaatgattatgtgaggatctgttaaatttatatgtttagttttgacaaaataacacctacctgctaaagaaaattgtaaaaagcgataagaatagtgaatatgttaaatatcatttgacctaatgaatattggttttgttgtggcaaaagaacaaaaaatggaatgggtattttagaccacagtaacagccactcctacaacagataaattactattatttgattttcagcctttgattgtcttttttcccaaagaactcagaaaaatatgctcatatatcacctgtgtaaaataggaacaaattatgttctttcaactgtgaatgccaatcacacacagacatttgcaaatttacatgagatgaaaagcaatttcacggcaatcagctaaaccacaataaaaattacgcatgcatcacagcattgggagagagagaaaactgtgacttgccaaaagaaaatcagcttgtacattactctggccaaccagtgccaataccctgaacaaggagctatctctaggcaaatgacactgtagattgatatgctaacttacccttcaatacagcatgtatgtatctggggatgcagagctacaaagaaaggttctgaccctgtgaaaacaggtgatcaccatgctgccttgtgccatttacaactgctaactagaaataatttggtctattttcagtggttaacttaagggtaatgcattgtattcatttgtacttttttttttttcaaattttaaagacttccaaaatatctattgcttttgaaatctactcagtggccattcagctgtttaaattgaaatggccaatgtaaggaaagaaaaagattaaatatattcaactggccatgataaatacaatccaggtcctttggtgttagaagctcagtatgattaaactgtttttaatgattaggcttttgatttttacacataaagaattcttaatcatgattttttatcataaaaaacaaaaacactcaattagaaaaaatatggatagcatttcccaggatagggcacgttaacaactatttctttccctatagctttttctactctgtgtgtgtgtgtgtgtgtgtgtgtgtgtgtgtgtataatgtgtggtattctcttaaaatttgcctttctatacaagttcacataaaaaattttatgcaccaaattttatatctttttcaagaaaaattgtaacttcagcaaaacaaagattaaaaaatgttaataaaggactataattttttacaaaaaaggctaagttcatactgtactaaacatatctttatcagaagatgtaaacatactgaatttgatgcaaatgtgaattttagaaacccgagctcttactatttttagagtccttaataaatatctaacagtctactatggtttgaatgtagtttgtccccactaaaactaatgttgaaattaattgccattatattggtgttaagagatagggcctttatgagatgactaggtcattaaaatctcaagagagactgggttagctcttgcaataatgaatttgttctcataagagtgatttttggcttattgatccataatatttatatatatttggggtacataaaatattttctcacatgcttaggaagtgtaatgatcaagtgaaggtacttaggatgtccatcaccttatgtatcatttctgtgggttgggaacatgttaactccactcttcaagctattttaatatataaaatgcattgttaactatagtcaccccactatgctattgaatattagataaaaatcctttcatttgcaacaacatggatagaactggaggtcattaagtgaagttagtgaggtgcagaaagacaaacatttacgttctcactcatctgtgggagctaaggaattgatctcatgggggtaggaagtagaataaatccttaacaggttaatttcattattacaacaattcaatgaggtagttatatttttattctattttgcagatgagaaagctaaagtagataaattttaagtaaatgctcaggttcacagtgctagtaattaacctattcagcatctgtacctagaaagtctactgccagagtccacatttatcaccagtttactgtaatgcctcttcctttgtaaccctgaaaattacttatgagaaaacttggctagttttcacccatatacctatataagggacagacatcgatgcgccttttcaaaaaggtgaagtgggagtacagggccagagaaagataaatggaatcatggagtataagtgatgatgccatttttttttctactggaagtttgaagtaatcttggaaataagaacaagttctgtatataagctaggtgagagcttccccaaattcccatccattcatttattgttcaacaaatatttattgagtgcctacatcaggcactgtttcagaaatttagagcttcgtaaggaacaaaaatctctgcctctatctagtatatttactagttgggaagagagttaagtaaacaatataatacaaaagagataataacagtaaagaaaacaataacaattgccaccctgaggtaaaatttgggggatgctcagagcctgagtacaaaggtgtcaaccaaaccacccgaggaccaatgggatcagtgtctcaggacaccagtaagtggatccaattgaaatgcctgcaataataacatcgttttaacttcttggtaaaccaaggttttcaattaaaggttggtttggggaaaaaattgcctttccttatgaataattcaaatggatttcctttgaatttaccaaaattcttcatctgatgagataggattttttctcttttcgcccataaactttgctttatagattgcttagggctactgcctaaataaaaataaattcctgttgcagtatggttttaatatgttgaaatgtattctttaagttgaagatctctgtagttcatttgtcaatgcaacttttctgttcaataggagtttttaaaaaagaaaacaatcaaacaaacaagaaagaagtttacttccttttgctagtgtattccattactacagtttgatatttcaagtggctcatgaattagaaaaacggtctataaaatcaacttataactatctacctgaaagaaacaacagaatattcatagtcacattctttttatgttaaatttaagttttaaaaattaaaatactaatgtattatttataatatgtataaaatgtgatataataaattccagcaactaacttatacttttttgcctagccattccaccccttgtgttttcctccatttatgctggaagcaggcttcatgttcctttgcacaacagcaaagttgtgtcaggacctccagcagaaatcacgttcatttaaacaagtttctcactttgtgttaaggcctttgtccattgaagggcctgtatcccaagtgtgaggagggagaattccttgagaacagcgaagcaagcagaaggggtcctcccgaccctagagaaaagatccagacccagggaattgaggagaacaagtgacccgggtccaatctcctcaaaatagtttcggttgttgttacagtttaaaataccagggagaatctcatgtttgccagttgtttttttttttttagacctggattaccagtagaacactatattaaacctagttggtttatattctcaaagaagagaataggaatatagtctatgggtttctattttttcctactcatttaattttattacaaaggctgtatgttagttgatatgagggatagtgaaacaatttttaaaacttctaattgtaatcattcacatttcaatgtgatattgtgttaagtatgactttatgttagctataagtttgacctggacctttttgtcttatattaaggatttgtgctcctgctctaaaataattggaatggattttaaaatttcttgactttcatatacttttagaaattactacatatccttttgcttatttgacctattggcatgatgtattagtagagttgtttttacaattccatcatcaacttgtaagttattcttctggatatagcgtatcaatatatttcatataagaatgatgcatgtctattcataaaacatcagcctggatttttcattcttaatgctgtggttttacttttgtagttgcttgtgaatctctcttgataaggttaaatactgttttaacttaaaaacaatcaagttaacatacaatttcattgtcatattgcatacttccttttcccttctttaaaaagaactcacagtgatgttatagccatgtctgctgaatgtgttaaatggaaagtagattgagaaattttgaggtagttgaacatcagaacattattcttactagatgcattgaacagagagctaagtatattgctatcttctctagcacttggctgagagcaaccaagcaatttttcattttacttgtgagcacaccatgaacacaccacctccatgtatcactaaaccatgcaaaagcctctgttattcatgcccaagctggcatagagataaatttgaaagaatattagtgaaaaatgctgcttcataccaaacagtattctgtctctgtgtttaaaatgactttaaaaaaataaatcatgcaacaggaatgtctccaaacacagacttctggaataaaaattgccaatctcagagacctagctccaaggaatatcaaccagccagtcatccacctagcatgaaatggaaaggacattatttcaaccttcagtggataatgaatgccttgacacaacctgttttgaaagataattggatatgtaatttgctaaacatactatctacaaggcaataaaacaagttatcccatttatattttttgctatttttctttgtcagtttgccataattttgttcacccataaagctattatttcccaaacgagtgctactagatctagagatggtttctaagcaagtgaaattatctgaaatgtgactaactgaacttcactctttaataggattcacttaaggaatacattatacttttcatgtactcaagctcaaataacctttaccattcccatggttttttatatgttcttccagttaccacatattatttatagtatcatattaagaaaatataaattttcttacacatgcaattgaatatgccccgtccccctttgggattgtttgattcacttatttactcaacaaatcttcatcaaactcttaattttcactcattcaatcacctgcatagggcaatcattcaatcaacattcttgagcacttatcttgtaccaagcattattaagcccttgggactacagcagtgaagaaaacatacaaattcactgcttttatgagacttaaattctggtgtagagagacagaaaacacacacataaatgtatttgatgtgctgagaagtactataaagaaaactaaagcagtaagagcacagcgaatgaaggacttttagtgatggtggtattattgtcgtttgaatagactcattacaaattatctctctgtcaatgttacattggaggaagcacccaaaggaaacaagggagtaataattgcgaacgttttccattaagagggagtggtagggaatttataggtgtgctggaggatagcagaggccagcagcctcaccaaactggagtcaacaagagtggctgcaatggggtgccagcagtgagttagtcaaagaaagataacatcatcaggctctgtagaacactttttggaaggactttgaatttaattccatgtaaattgcattttaaacaaggcttttccaaaggtcattctgtagctttgtggagagtaacaacagtagatgcagttgtaggcactgttagaggtacatgagaggcagaatacaggacggtattgaagaaaatagactctcctttcatggagtttactctctgatgtgggggcatataataacgacgctaaaataaatatgtagaaaggatatacaggttagtgataaataccaggatggacataaaacggattggtgtgattagacaaaaggtggaagctattacttctttttgcttgattaaggatctaataaagacttatactcaatctgagaccagagtaactaaaaagagacagccatggaaagcccattaaaaaagggagttctggaaagaggaatagcatgtgaaatatcacttatgtgagagcagaaaggtggtcagtggttttgaagaggaagttcaatattatgcgaactggagaggtggaggcaagatcatgttgggccttatcagccacattgatgacattagatatatagtcatatgtcacttaacaagggggtatgttctgagaagtgcatcctttagtgatttcatcactgtgcaaacattatagagtgtacttccacaaactgagatggtagagtctgtaggttactgtactgaaaactatagttaagtgtttgtatatctaaacatacctaaacagaaaacatacagtaaaaattcagtatagaagattaaaaactgctatacctgtataaaggacttaacataaatggagcttgcaagactggaagttgctctgggtaagtcactgagtgagtggtgagtaaatgtgaaggcccaggacattattggttttataaacactacatttaggctacattaattttttttctttcttctataataaattcatcttagctaacagcaacatttttactttataaacttttatatatgttttacaatttttggactcttttgtaatgtcagcttaaaacacaagcacattgtacagctctccaaaaatatttaatttatttatataggcttttttctatttgtagtaattataactttttagtacgttttgttgataactaagacagaaacacacacattagcttagacctacacacaataaggatcatcaatatcactgtcttctaccgccacatcttgtcccactggaaggtgtgcaggggcagtaacatgtatggagttatcatctccttgatagcaaggctgccttctggaataccctcgaaagatctgcctgaggttgttttatggtgaactttttgttataaataactagaaagaatatactctaaagtaacaataaaatgtatagtatactaaatacataagccagtctcacagtagtttattatcattgggaagtattgtgtactttgcagaatggtatgtgttacaattttgtaagattggcagtgcagcagggatttttttttacacctgcatcaccacaaacacacaaataatgcattttcctaggacattaagattgatacaatttcactatgcaatacatgggaccaccactgtatatgtggcatatcattgactacagaaagaagtgagaagcccctggaaactttaatgttaagagagcaacataatctgacttatgtatttcgattgactactctttgaaaaatgtattttcatggaagtgagtagcaagaatgacattttggaaagctattaatccaaaagggggatttggttgttcagattaggtggtaaccttgaagatgaaaataaatgaacaaaattgggatatcttttggcagcagagacattaggactattttatggatttgattggggggtgctgaggcaagagacatcagagatgtctcctaagtatttggcttgagagaatgtgtgaatagggaaacatgttatgatgtagaatggcctagcgtagcacatgagcatggtgttaaggaagcattatttctccttggggtatggcaaattagagatacaaattagacatccagtagtcccgtcaagtaaacaattaggttgcttttctaatctgatttagtttaaaggagcatctgagatctaccccaatgagatgctttcatgttactgctgttaaaacaattttatcagaatcctcagtttttataaattatccttttagcatataatataaatatttgtgtaaccatggacttggatgatgcttgttttacttgagtgggcttccactgcaaagtcaaaacctttagccaaaacttcaaaacaggaggtgagtcaaattggccattctccaatgacctgtcagaagtttaagaaattctttgagaagaatgcaaagttttcctactcaattgttatgacatatttttgaggcttctaatatttcattcatatttaaccgacagcagcgaagtactcagtgtatttaaaaataaaacccaaactgaccgaggtctcagactttaaagcagcgtataatttatttagaaaccagacagtgccatgaaaccactagatgctatagagtgtctatcatagcaaatattatataagtgatatgtacatgagatgaaagatgtagataacattattctgttcaagaaagttaaattgacttaaaaatactgaatcatctgagttccatcttggagagatagtaggattttctaagaaaggagaaacaggagtggtaagctgaatagcagaaacaagagcataagcaaaacaaggaaatgaaaataaatagatatttgcattacacctagtcatcatttgaaaggcaccaaggatgcatggaggagagtgactggagatgaggttgaaacaggaaacgtcctagattgcgaaaacatgttggagcattctacagagtttacattgaggatagtataaatcatggatgagtataaacagattatattggggttttagagagaatactctgttatcttattttgaatatgatgaagtaaaggacaagatttcaagaagtgaatgaaatggctcaagacgataacagtgagatttaaaaagacaggaaagaattgtgagaaagatcaaaactagagttattacaacttcctaagtgaatgttttgagtgaaggaaagttaagtgtcaaagataattctgaagctctcagcctgtgtgactgagtgaattgtggtgttcctcaaatgaagatggaaattctatttgatgagggagtagtgataaggcaagaaaagttctgttttgaaaatccaggtggagatgactagtaactagatagaaatgcaatctgttgggcaggagatcaatatttaagccagagaattaagagtcattagcatattcaagaaagtggtaattgctggactccatgaagtccctatgaataggttaaattgagaaaagatctttcagcataaaactctgaggggtgggggctttccaaggagaggcagcagaagccagagtaaattaaaagaaagggacttgtcagagagacaaaagagaaaagaagagatgctaaactaagaggaaggtgatttttaaaaagaaagctaagaattgacacgaagtacagttattgtatataaatgtgtatataccatgacccatatttcttcattattgaacactttttactttcatttgagtattgtcatccctctgttctttaaattgctctaacatctttcatatttctcgaaattctaaatattaaaaaattgcttagccacaaaattttctcaagcttcctgttcatatctgcatttaagaaaaaattaaatagtaataaaatcaaataaactgaacaaatagaagaaaaattagggaatagaaacagaagaaaaactgtaattcattttgcctgaaaatgagaataaaaatgtattctaaagactgtttttcatgttttatgtaaaaatgacagtttttaaagttttctaggggctgtctcttttaagatattagaacatagtgatactttattttgaatagatgtattatggatgatacataaaaattagttataactatctattgacgatatattgtttactacaatagaataagaccacacctgagcctaaagaaagttctcagtttactataggtaaaatcttgctatgaaaggtgcacataaagattagaggctttctgtggtggaggggaaacactgctggctgcagaaaaaaatatctgacataacatttaaatttaaaagcacaaattattgacttagtatgttaacataaatgaataaatgtcttctaaatgctttgtcttttactaaattccagcattttattactaaaaggacacatatacaataagtagtaaatatgcctgatatattttaataatgtaactaatttcctttataaattagttatagttttaatactcttctttatgtgctctaagtggctccattggctaggttaatcattagaggatgactaaattgaaaaatctttctacaaataacgtggtgaataatgtcatcttccaccatcttatgctaatgtataactaattattatccattgctgccatttctgaattttacataatttgttcatttagtgtgagctatctaaaatatatatggatttcaaatatgtattttatgccatggataaagtttatctctcttattctgttttgtcctataactatttcaaagcaataacacctatatggtccagaacagatgtcattgcttgtggtctggaggtcatgaacattgctaagccacacaaaaaaatgattttgtgtgtgtgtgtgtgtggttgtgcacagtatctcatgcctgtaattccagcactttgagaagccgaggcaggtacatcatttgaggccaggagtttgaggccagcctgggcaacatggcgagaccccatttctacataaatacaaaaataagctgggcgtggtgacgcacacctgtagtcccagctactcagggggctgaggcatgagaatagcttaaacccaggaggcagaggttacagtgaaccaagattgcaccagtgcactccagcctgggtgacagagcgagactccatctaaaaaaaaaaaatgtattttacaaccatggcttacatgctgagacatatataatctctgatgaataatgtatcatgctaattttatttaaaatattaaaactcatattacaccactatcaaagtaataaaaaataaaggaaatcgggtattctgtatattgacacaatatattttgctatttattctgatggctgatatttaataatagaatgggtacaaaataacttggaaaattatacataatattacatatatataaattcagaaatgtcttgtctagctgtttgtgaaagctgtgaagcatatcttccatttccctgagtagtctgttggtggcctggacaagttcaccctcatcacagcttgacccctagcggctagaggacaaaccctttggcctggttccagttccccagaactctagcacacagtttgggatgtatgaagatgacatctgcggcctgatctccagcaggggaggagtccacactgtcaaaacatagagaaaggtatggtgatgaggaagctgggtacccctcccttctttagacctgactgaaaagcttattgcctgacagctgtggtttctgctgcaggaaatctcaccatcgagatgcctagaatagctttgtgatctgggcacaaatggttttgggtcagactaacttgtagggccagttgccagagtggatgccagagggagactcaccaataagagggtgtatgagttggctcttcctctgagccagctctgtggtgcaggagaggcacctccaaccctttctggagggtcgtccatgaggcctgagagcttccactagacacctgctaaggttggtacttgcacctgcctcagagagcctggctgccagctcaccagacccagtgccgcacagctttgccctctcaagccaccttagtggcagagcacaggatggaaaccctgagagtccaggcactgcccatcaccagaaatatcccagtactactcctgatcaacaaaggctatgtaaaaattccactgccaccaccacaattacctcttgcctggaagtatcatctactggctaggaggtcaaactgcatggcccatcacaactgctgaaaccagtttataccatttaactggcttttagccaaaattgtcacctacttgctggtagggtgagctgcacaacccaacataattcttgcttacagcagtgtgcagtgctagggaactagatatgcaacccaagccctgtacctcaccatctctgtaggagacagtgagcctgaccacatacacagcatattgctaccacaacccacaaaaaaactagcacttaagaaaacctacactactatactacactcaggctatctataaccaaggaatttatacagagccttggccccataaacgcaaagcaaaggactctacctgacatgtgcaacagtcacactctcaaggaggaagaaaaaagtcatgtaaatgaaagttaatttaaaaataataaatgacagcatctacatatgaaaagaaaccagtccaagaactccagtacaacaaaataacggatattatgacacatgttatggaccatcctggcttcctagcaatggatcataaccaaaatcaaaacattgaaatgaccaaattcaaacaaagaatttaagatatgcattgtaagtaatctcagtgagattcaagagaaggttaaaaaccaactcaaagaaagtggaataacaattcatgagataaaagacaaaatagatatattttttaaataactggaaataaaaaaaaactgaagaaaatttaaaacacagctgaaagctttaacagtagagtagaaaaaagcagaagaatttcagagcttgaataccagtctttcaaatcaatatggtcagaaaaaaacagtaacaaaaaggatttcagaaagcaaacaaaggctttgaaaaatatgggttatgtaaagcgaccaaatctacggcttataggcattaatgagagagaactagtaaaactatgaaaaacataattgagaaaataattgaggaaaatttccccaatcttgctagagatgtagacattcaaatacaataaatttagagaatacctggaatatattatacagaatgtacattaccaaggcatacagtcataagattatacaaagtcaacatgaaagaactaatcttaaaggaagctagagagaagtatcaaatcatctgaatgaagaaaatgccatcagactacagcagacttcctagaggaagccagagattgaggccctatttttagcctccttaaaaaaaaaaaaagccaagaattttatatcctgccaaattaagcatcataaacgaagaaaaaataaagtctttcccagtgaggaaacactaagggaatttcttccagattggacctataagaaatgctcaaaagagttctaaacatggaaataaaaggacaatactctccatcataaaagcatatataagaaagctcacacattacacaaagcaattacacaattgagactccaaggttactagctaacaaaactataacaggaataaaatgaaacctcacatatcaatattaacattccagttaaatacccttgaacttaaatattaataattctacttaaatattaaccatgtacataaatagcctaaacattctacattccagaataatatattctggaagaacatatttatatattctggaagaacgtatttatatattctggaagaacgtatttatatattctggaagaacgtatttatatattctggaagaatgtatttatatattctttatatattctagaagaatatatttatatattctagaagaatatatttatatattctagaagaatatatttatatattctagaagaatatatttatatattctagaagaatatatttatatattctagaagaatatatttatatattctagaagaatatatttatatattctttatatattctagaagaatatatatatatatctatctccaactgtcggctgcctatgagagaacctatagggggtctaatggctagacacatatatactcaaagtaaaggggtagtaaaagatatagcacacaaatggaaaacaaaagtctgaatgactagccattcttatattaaacagacttcaaagaaacaacagttaaaaacattaacaaagaatggcattatataatgataaaggtttcaatacaacaagaatatttaactattctaaatatatacatgcatccaataccagagcacccaggtttataaaacaatttctacttaacctaagaaaagagattaatagcaatacaatattaattgggaacttcaacacctcactgacaacactaaacagctaatcgaagtacaaagtaaacaaaccctgacttaaactatactctaaactatgtggtcctaatagacatttacagaacattccactgaacaaccagagggaatacatttttctcatctacacatggaacatttgaccatatgcttggtcataaagcatctctataaattcaaaaaatcaaaatcacatgaagtattttctcagattagagcagaataaaagtaaaaatcattaccaagaagaactctcaaaaccacataagtacatataaacaaaacaatttgctcctgaatgactttcaggtaaacaataaaattaaggaagaaatccaaaagttttgaaacaaagaaaaatggaaacacaacataccaaaacctctgtgatatagcaaaagctgtgataacactaaagctaattgtgttaagtccctacatcaaaaagagaagaatctcaatttaaaatcctaatgtcacatctcaaggaactagaaaagcaagaggaaacaaagtcaaagctcgcagaagaaaagaaataacagatatcagaagagaattaaatgattctgagacttaaaaatgatacaaaagatcaacaaaatgaaaagttgtttattggaaaggataaacaaaatcaatagactgctagatagtttaaccaaaaaaagacagaagactcagataagcacaatcataaatgataaaggtgacatcacatctgatacatgccacagaaatagaaaagatcaccaaagattagtgtgaacatcagctgtatgtgcacaaactagaaaacttaaaggatgtaaataattcctggaaacatacaacctccgaaaattgaaccaagcagaaatgtaaatcctgaacagaccaataatgagtaataaaattgaatcaattaaaaaaaaaattataaaaataagcccaggaccaacagattcagagctgatttttaccagatgcacaaacaagagctgctaccaatcttactgcaactattccaaaaatttgggaagggattcctccctaactcattctctgaaacaagtatcactgtaatactaaaatcatgcaatgacaacaccaaaaataactacagaccattatctctgacgaacatggatgtaaaaatcctcaacaaaatgcaagtaaactgaatctgacatcaaaaagatgattcatcatagtcaagtgggttttattccagggatataagggcaattcaacatttgcaaatcaatgaatgtgatccaccacatacaccaaattaaaaacgaaaaccatttgattgtcttaatagattcagaaaaagtatttgataaaatccaacatttcttcaagatgaaaaccctcaacaaactagcaattgaaggaaaatacatcaaaataataagagccatatgtgacaaacccacaggtaacaatctgctcaatggggaaaagttgaaagcattccccctaagaactggaccaagaaaaggatgttccctctcaaaaatactattcaacatagtagttgaattcgtagctagagcaatcaggcaaggaaaataaataaaaggcatccaaattagagaacaggaagtcaaattatctctattcactgatggcatggttttataactagaaccccctaataactccaaagtagtactagagttgatacataaaggcagtaaagtttcaagattcaaaatcaatgtacaaaagtcagtagcatttccatacactaatgacattcgagctgagaaccatataaaaaactcaatcctgtttaaaatagccacatgcacaaacaaaaaatacctaggaatacacttaaagaattaagtggaagatctctacaagaagaactaaaagacactgatgaaaaaaaaaaattgtagatgacacaacaaattaaaagacatctcatgttcatggattggaagaattgatattgttaaaagtaccatagtgcccaaagcagtctacagattgaatgcaattcctatcaagtagcaatgtcattcttcacaggattagagaaagcaattgtaaaattcatatgaaaccacacaagagcctaaatagcaaaaacaatcctaaactaaaagaacaaagccggagacatcacattacctgacgataacacatactacaagggtatacgaaccaaaagatcaagtactgatataaaaataaacacatagatcagtagaaaagtgtagacaacctaaaagtaaagccacatacctacagcaaactgatctttgacaaagtcaacaaaaataaacaatagggaaaggactccccatttaaaaaatggtgatggaaaaattggctagtctacgtataacaatgaaactggactatcactaacagtatatacaaattaactcaagatgtattaaagatctgaatgtaaggcctgaaactatagaagtcctagaagaaaacctaggaaaaccacattggcctaagcaaagactttatgactactaccctaaaagcaaatgcaacataaacaaaaatagataactgggaattaaactgaaaagcttctacctaacaaaagaaataattaataaagtatatagaccacctgcagaatgggagaaagtatttgcaaattatgtcaaaccaacaatcccattaaaaagtggacaaaggaaatgaaaagacatgtctcaaaagaagacatacaagtacctatcaaacatatgaaaaatgctcaacatcacgaatcatcagagaaatgcaaattaaaccaaattgagaaatcttataccagtcagaatgggtattattaaaatgtgcataaacaacagattttgacaaggatgtggagagaagaagggaacacttataaacagttgagggaaagtaaattaatataacttctatggaaaatagtgtggggatgtatcaaagaactaaaactacaactaccatttgatccagcaatattacttcaggtcatctacacaaaggaaaagaaatcattatctcaaaaagatacctgcacttgtctgtttattgcagagctgttcaccagagcaaagtcacggaatcaagctatgtgtccatcaatggttgattggataaagaaaatgttatatatctaaaccatgaatactattcagccataaaaggaatgaagtcatttcctttgctgcaacatggatagagctggaggccattatcctaaatgaataacttacaaacagaaaaatcagtaccacaccttctcacttatgagtgggagctaaacaatgggaacataaagatggaaataatagacaccagtgatgcccaaagtggatatggttggaggggattgatgcttaaaaaattacctactgggtaatgtccaatattggatgatgaatatactaaaagcccaaacctcacccttatgcaatacattcaagtcacaaacctactcacgtgcatcctgaataaaataatattgtaagatatattactcataattcctcaaaaataggacttaaacataaaacataagcccaacaggttgaaaatacttgcaaatacaataataatctacaactaatttgatgttattccagtgccttactgaatggcatcagggcttctgaaagtaagccctatttttgtttcctgaagcactttaaggtaagattgtcttttaatatgcaaaataataaaaataattttgatagttttcacaaaatggttgtgaggaataaatcaggtagtaaaatgtaatagcagcaaagcccagtgtgtggggaagtttttttttttaatttttacttcctatgtatatttattactggactctcagtaaactgaactaatcatagtacttgaaaaaactccaagctttctgctatattaaaagaaaaaatatgtgagaatgaaacaattatttgctccacaaatcaggatttattaataccatttttatcccccacttaatgatcccccacttaatatagagtaatataaacacaacaaggaatgtttattttcatatccttgagccctcagcttgattttctggcccaatttaatgttttatgcatttgttaatctgaaaatattatttaatatgtattatgtgtcaggcactgttataggcactggaaagagtttctaagatgatggaacatacatgtttgtggggatgacatagaacccaaaacatataacatatactttcaggtggaggaagtgcaatgcgttacaagaaagcctgctaagctttctgagggttactggagggagcattgtacatactatggtcagggatcaccaatctaaggagctaacaatttcagagacctaagtaatgttgaaggaagtagccatgtggagatatgggagaagtgcattacagacaaagggaacaacacatataaaagccccaggtgggaaataggttgactttaagagagtaagaaagtctgtattgcatccagcacaatgaacagagaggaacagttaggagaagagaaataagagcagtgggaagtaatgaaaacatgtagagcattttaactttgtacagagactgtagttgagagttgacaaaatattaaattaatagtgaaatggatcaaattaatgacagctgagaagaaaaggaaaacagtgatatatgttaccaaacatgaaatgtccaaaacatgaagacataaacacaggcataggattgaattctaaaattttaaagtgctttagaattgacaaattacatgcgaatgcgtaatatgctaagtctcatgagtttcacaggcataatgtttcagtcttgactcttgtgaaacagtgtttgttggagttgattacatgggaactttcccattggaatcctatttgtctctttttccttagggggtttaaataatgacagaatagaggaaagtctgaatcatggcagaattatcttcccacttacatatgaaggcataatatctggtaaaattgattttggccaatgatgacgtttaataatttcatttaagataaaaaggataattttcaaacaattaaaacaaagactgcagttactatgctcactggaaaatagcctcatattattaaatcaattggcatgatctcagttgtggaaagcttggaaggggacagcagcgttgtaagtacatggcaaagaaaataaataatagtgtattatagaggaaaaccacatgaaaggaatcatgaataaaaagataatgggggtaaatttaaatgtaactgacaattgcaaaaatagaaaatcacttgtagcatgaagaacgtagataattttataatatatttaatgagattttaaatttctcagtgttaagttttagacaaagttttaaaataaatattttataattcttgattataatggcctcttgactagcaagtccctgcatgcagcctttcctgatgttttaatttacctataaagtcgtacaaacacacacacacacacacacacacacgaagcaaacgaacatggttactgaaaagtgagagataaatatactagtcagtgtctaactggaaaaacacaaactattcctaggtaattttaagaggaaatgtaaaatggggaagtgtttacacgagtattagcgatattaaatcctgaattaaccaaatataaaaacttcaagaaaacctattactcttacagatgggagaataggagaagtattggagttacaggaaccttgaagttcagagaagtaccacaaattgaatattcatatctcctaggaaagggcttgtgttggtgctgctgatacctttaagcatctctattattttcatattctaacaggaagtcacttggtaaaagaatctgaaaaatgtagtttgtagaatcccaaccaaaactgctatcacagagaaaaatatagaagactagctttctatctgagacataacatgcaaaccatctattggcatactgttagaaaaaattttgatggaacaggactgttaagagactgtaggtcttactttataaataaaaacaagacaaaagctttatatatatattctctgactcttctctaactctgaggtataagatatagtcatccaaagtactgactttctaactctgattttcaaccaaatattcttgcatctatccatacccatttagagagagaaatttccagaaatcagaggagcagacaggtagagtatgacttgtccttgtgaattgtgttctggtaaacagagtagagagaaaggaatatctgtaggaggggcagaaaaaaaagcccctatagctatccaaacttaggattattatttttgtgtgtgtactccaaggtacacacaccaaaactagaatgagaggactattaattcactctgtcttccatatgagaataggctcgaatatcactcagaggaaacccaaagtaggttaaaatttcatccatatatgaagtcttttgggtgaggtaaaggcataatagatcttagcatctaaattatggacaaataagtacaaaattgaacaccactgtgattatggaaaacaccattgtgtttactgtgaagcaaggaaaacaaaacatagacatagagattcagaaaattatttatgccagaaaaaaaaaatttaaaagtcaccaaatagtgtgaaacaaatacataagaaaggctggaaataaagttttgtaataatgccattaaaatggatggagatgggaattttatcaagtatgtggacaatttgagtactatacaagaatacaaacaaaatgatgagagataaactgacaattggaaaagaaagaatatggtggtctaacataagaatgaaaggtattttccaggaagaaattaagaattgaaacagaggaagtaatcagataaaattttttctttaagaagaaaatagaagatatctgggatctatacagctgaatctaatattttaattacagctaaagaaagcttgatactttttggcccactgttttcttaatatattcaatgaactttctcatatgttagccactagttatgtgttactatttaaacataaattttaattgatctaaattaaatacaatttaaaaataaatttgtcagtctgagtagtcacatttcaagggcttaatagccagagttgccagtggctactgaattatataatacagatatagaacacattgattactacagaaagacctactagacagtgctgttctaagaaattatttttagaaaataaggagagatgctcttgaaaatttatgtataagaagagttatcttaagaggacatgttaaaaaattcattaatattgtactactcaaataagttatattcataaaaattataaagcatttaaacctataatttagaaaataaatttatcacactagacaacattcttatgataatatgtaaaaatatattaataattaattgagatgctttcaattttggacaagtaaatggggcttatattttatgtaattttaatatataaaatcgatcgatgttcgttacatttaagtggcaggattattcaactgtttttctttatttttttttcctttgatgtagaggaattatttatagtgaggcatgttattttatagtcagaaacacttcttttaaacaaaattagcatatatttgcatgtgatgctgataaactgaacaaaatatgtgacattacttaaaatagaattttgagatggagagggtgctgctcatggaaaagtggttctgacagaatcgatgaactgtcatccgtgtgcgcacctgcggcaactctgctggaggcttttagctgaatcccagcggtgaccttcaaagttgtttttaggtatttgcattaaaattttgagaaaaacgttcctttgtttttacaatacagacatgccttgttttattattctttgcttaattgtgccttgcagatgctgagtttttgaacaaatggaatgtttgtggaaaccctgcactgagcatgtattggcttttccaacagcatatgctcacttcatgtctctgtgtgacggctgggcaattctcacaatatttcaaacttttcattattattttatctgttatgatgctctgtgttcagcgatctcttatgttactaatggaattgtctcaaattgccacaaactacaaccacataagtcagataacttaattgctaaatgttgtgtatgtcattactgttccaccaaccacccattcatctgtttctctgcctctcctcaggcctattctatgagacacaacaatagtaaaattaggttaagtaataatcctacatggcctttaagtgttcaagtgaaaggaagagtagtgcacctctcaggttaaatcaaaagctagaaataattaagcatggtgaggaagggatactgaaagctggccgggcgtggtggctcacgcctgtaaccccagcactttgggaggccgaggcaggcagatgacgaggtcaggagacagagaccatcctggctaacatggtgaaatcccgtccgtactaaaatataaaaaattagctgggcatggtggcgggtgcctgtagtcccagctactcgggagtctgaggcaggagaatggtgtggacccgggaggtggagcttgcagtgagccgagattgcgccactgcactccagcctgggcgacagagcaagactccgtctcaaaaaaaaaaaaaaaaaaaaaaaaaaaaaagcaagcaagctgatataggctgaaaaagttaggcctcttgtaccaagcagccaagttgtgaatttaaagaaaaatttggtgaaagaaattaaaagtgttacttcagtgatacaaggaatgataagatagtgaaacacccttattactgatatggagaaagtttttaacagtctgtataaaatattaaaacagtcacaacattcccttattaaaaagcctaacccagggcaaggccctaagtgtcttcaattcagggaaggcgggagagaggtgaggaagctacagaagaaaagttcgaaggtagcagaagttggatcttaaggtttaaggaaagaacccatccccattaatagaaaagtgcaaggtgaagttgcaagtgctgagtagaagttgtgacaagctatccaggaaaactacctgagatcactgctgagggtaactacactaaacaacaaatgttcaacgtagacaaaaaagccttatattggaaaaagacatcatctaagattttcacagctatggaggagacatcatagactaaattcaaagcttcaaatcacaggctgactcttgttagaggccaatgcagctgatgactaaattgaagccaatttgaagccaattcagaataccgttctgaaaaccctgggggccttgaagaaatatgttatttctactctgcttgtgcactataaatggaacaagtcctggatgatggcacgtctggttacaggatggtttactcaatattttaagcccactgttgagaactgctggtgagaaaaaaagactcctttcaaaatattactgttaatatacaaagtacctgcttacccaagagatctgatgaagaggtgaaaggagattaatattgttttcatccctgctaacataacattcattctgcagtccatagaaaaaggagtaattataactttcaatattattaagaaatacattttataaggctatagataccatagatagtgattccacttatggatcttggcatattgaaacattctggaaaggattcaccattctagatgccattaagaatgtgtggttcatgggaggaggtcaaattatcaatattaacaggagtttaaaagaggttaatttcaatcattatgaatcattttaaggtgttcaggcttcggtggaagaaggaaatacaaatacggtagaaataacaagagaactagaattagaagaagggcctaaagatgcgattgaactgctgcaatctcatgataaaacttgtatagataaggagttctttatgaaggagcaaataaaatggtttcttaagatggaatgtacttcttgtgaaggtgctgtgaacattgttgaaataacaacaaattatttaaaatcttacaaaaacttagttcatgaaaccatggcaggcttaaagggaattgccttaaattttgaaagaagctccactgtgggtaaaacgctgtcaaacagcaacacatgccacagagaaatcttgtgtaaaaggaactgtgcaccgatgtggtaaatttcattgttgtgttatgttaagatttggcacagtctctttagcattcagcaaccaccatcctgatagccagcagccatcaacattgagacaagaccctccacaagctaaaagactatgacttgctgaaggttcagatgattgttagcatattttaacaatgaagaatttttcagttaagctatacatactgtttttgtagatataatattactgtggacttaacagaatatagtatactttaaacataactttatatgcactagagaacaaaaatattttattgcagtggtctagaaccaaacctgtaatttcaatgtaagtcttcacagtgttcttttgtcagcatggtacacaaagatgtacttacatataaagtgttctaatttttcatataaattgtaaataaatgtggcaaatgttcacagttcttaaattaaggacaaaagcaaatattatataattaagttcatcttttgttcatgtttatatatttatattttatatatgcatagtaatttctttttgaggtttgtcttaaatgagtaaaaagtgtttacatgagtgaagtgtgggttctgtacacgtctatatgactaatgttcaaattgtatgaatacccatacatatataagttatttatagtgtgaatatatgcattgtatcatgaaatatgaataagtttataatccatgctataaaatgatacaaattgtattactactttatagcattaatgtacacaaatatatttaatttaccaaaaatataaggtaaaagtaaataatatttttgtgaattttgaaacattgtggtgtgagaagcactagtttgctattgtggttaaggcacatttttatattagaatatattgagtttaaaaatagtacagaatgtttaacatattagcagtaatttctaggaaaaacctttatgaagtttagtataaatagaatataaaaaataattttaaaatgatgtgatcagtcatcaaaagcatctgatatataaacaataaaaacacaatcttaaactgttataatttacttggcttgcaaatattttataatataatatgtatacatatattatacatcaaaatttatttttgatgatatgcttttagtaacttattcctatgacaaatttggcaagtaaaaatcaaaattattatctaattccattaacatgcaaaacatatcacaaaattagtgaaaacctaatttgaataagcccacatttaaatgagaattgctaggtcatactaatcaattaatcaacctctcaatctagaatgtattgaacaaatgagcctcagcaatactgcttaatacttatggtccattaagcaagaccaggtgaatgaggcaatcaaaatattttaatagtgtatccgatcaggagatagtagaatactaaatgatctggtggttatttttaacaatatgttgtgctcttgagaagtaaatgaatcttggaggattgtcagctggaatccaaactcaatgtatcattttaaacagtcacttaatttcttgattgttttaacctgaataaatttaagactgtagcaattttagacaattatccaaatctaatgtctatggtcatttcattccatgaagatgaagtattatgtatagcaatgcttttttcaaagaaaaatgaattatacattagaaattatatgatcacttataataaggtattaaacaatgagaaatttactgtaaagatggcctagcattctaaaaaatgccaataaatatttgtcaaacactcttctagttgctcatttttagggatgatcaaaacagacctgaaaccagatgatgagacgggctggagcaaaggaagggagctcctttaattagggtaatcacagaaggcatttttgaggaagtaatagttctgttgacatataggaaataagcaggaatgcaatgaaaagagccatatgaaaagccttttagtctgaaagaataagaaatgcaaacgatctttatgagcatggagctagggatgtcaaagtgtaaaaataaaccagaagctggaaagataggccaaatacagaaaatatagagttttctgggatgtggtcagaagtttagatgtcatgctaaggacactgacatgccagtaggttaaaaatattatctgatttaaatatacactaaaaatattctgacttgctgtgtggagattgaagagtagaagcaagagtagaagcactgagaccaactatgaaaggttttacattgtctccattgagagatcttggtaacctttactgaggatgtcacagctgaattagataatagtggataagttcagtttatatttttaaatagaataaactagatctgggggctatgtgtgtggtagttgagtaagagaaaggaattaaacaagtatcttaatattttcctttagtaattaggtaaattgaaaatactaagagaagataaatgaacattagatagtatgggggatagttataaagcagaaagtgttttatttctgacttttgtatttaattcatctcttaaacataccctgatagggatacataagaccaacttctaaataagtcaattacaggaaaaaaaatttagttattggcatgcagatggtatgaagcatatttgatgctaacattttttctttacctccctggttttgtgatacctcactgaggtaagaatgtgttttttgaatgtatgattttggttttggatatgtgagtttcttcagcaaaacaaaaacaaaacatgagtagagatgacaatgtaccagttgtaagctgaggctttattagacatcaaatattttcactcattgggattttgccatttgtcatgagaagagcatactctgggtacctgttgatcctgaaatgaaaaacacatgaatcagacttcaacctagtcccaggcctaagtctttactctagccactcaagatttgtgagaaagacaaatcgttacagttctaaatcaccaaacttcagatgtctcaccagaaatactgttaaatatgtgtcatataaacaatgaattctaaataaaatcatctagcctagaatggagaaaaaaattaaagaggaataaggagtagggcaatctatcttttgtggtcgggtagagaagagaaaagggtagaaaaatcttgcaaaataccaaggatccaaaatgaaaacaaagcaagtgaacagtgatagaaatcaagataacttttttttccaaaaagtaaaataagacaacttcagaatgctaatgagaggtggagaaaaatgaagacagagaagttatttctttattatgatctcagcaagccttaatttacatagaagatatatcttccaaattttgcatgatttgaagcacataaaatattttagggggctcataatcttcaagtaggtttatatggcatttaaatcaagaaacagtaaagctgtaatcatttctggagatgtttagacatataagcacacatacatatatttggatggtaggcatttgccaatacaggaaacatggttcatgctgccagatttgacaaagattaaaacaatggttccaaataaaccggaatgttgattttcagtagaggaaaaatagagaaaattggtgattggtaaaaccatacagaatagttcacaacctaaattatcttggtgattaaaatatagtagagtgtttgccaagtctgcttgtaaagatgctggagtattagcagctgaaaagaaaagataacattttcttctactgagtttagagaaactttttttcagactaagaaatgtagctttcaagtattaagaaatataccatgagatttacaatatttttttccttcatttgtgaagcactagacaaatctttgtttacatctgtttctgaattccagtgaaatgaaatagcacagaagtcaaaaacaataattgtattagtctgctctcatgctgctgataaagacatgcaagactgggtaatttataaagaaaaataggtttaatggactcacagttccatatggttggggaattctcacaatcatggtgggaggcaaaaggtacatcttacatggcggcaggcaagagagaatgagaaccaagagaaagaggaaatcccttaaaaaaccatcagatctcatgaggcttattcactaccatgagaacagtatggggaaaactgcccccatgattcaattatcttgcactgggtccctcccacaacacatgggaattatgggagctacaattcaagatgagatttgagggggaggcataaaggcaaaccatatcaataattgtatctttcttcctctcatctataagcctccatattgatgtgatataatcctatagccttgggaaaacctctctgcaaaactatttttttaaactttttataggctcagatttttgcatttttatccttattgtttacatcaaaaagactacttgcgatttttaatgactgtgattttatttttaaaagtatcaccaaatccagaaaaagaaatattggaaaaaaaaattcactcttcattaggtacatttttaccatgtacctaccatgcactagacactctgctaggtagtgagggtaacactgtgatgataaatgataatatggcttgaacccagtgggtggtaattgaaacatgagggcatgtttttctcatgatagtgaataagcctcatgagatttgatagtttataaagaaaaattccttgcacatgctctcctgcctgtcaccatgtaagatgtccctttgctcttccttcgtcttccaccatgattgtgaggtctccccagcatgcggaactgtgagtccattaagcctcttttctttataaattactcagtcttgagtatgtctttattagcaggatgagaatgaactaatatagtaaattggcaccagtagagtggggtgctgctgtaaagatacccaaaaatatggaagtgactttggaactgggtaacatgcagaggttggaacagtttggagggttcagaggaagacagaaagatgtgggaagagttggaacttctcagagacttgtggaatggttttgaccaaaatgctgacagtgatatggacaataaagtacaggttgaggtgctttgagatggagatgaggaacctgttggaaactggaataaaggtgactcttgctatattttagcaaagacactggtgacgttttaaccctaccctagagatttgtagaactttgaacttgagagagatgatttagggtatctggcagaagaaacttctaagcagcaaagtgttcaagaagtgacttgggtactgtaaaatcattcaattttatgtattcacaaagatatggtttggaattggaacttatatttaaaaggcaagtagagcataaaagttcataaactttgcagcccaatgatgcaatggaaaagaataacccattttctgaggagaaactcaagttggttgcagaaatttgcctaagtaatgaggagccaaatgttaatcaccaagacaatggggaaaatgccttcagggcatgtcagaggtcttcatagcagcccctcccatcacatgcccagaggcctaggaggaaaaaatggttttgtgttccaggcctagggccatgctgctttgcgcagtcttgggacttgatgccctatgtcccaggtgtggctaaaagggggcaacatagagctcaggccattgcttcagagggtgcaagctgcaagccttagaggcttacacatggttttgggcctgcaggtgcataaaagtcaagaattgagatttgcatagatttcaaaggatgtatggaaacacctggatatctgggcagaagtttgctgcaggggcagggccctcatggagaacctctgctaggtcagtgtggaagggaaatgtggagttggagcccccacacagagtgcccactggggcactgcctagtggagatgtgagaaaagggccactgtcctctagacccaagaatggtagatccactgacagcttgcaccatgcacctagaaaagacaagacacaaaatgccagcccatgaaagcagcttggaggggggctgtaccctgcaaagccacagaggcagagctgcctgaggccatcggaacccacctcttgcatcagggtgacctagatggaagaaatggagtcaaaggagatcattacgaagctttaagttttggctgccctgctggatttcagacttgcatgagacctgtagcccttccttttggccaatttctcccatttgaaatgggtatatttacctaatgcctgtacccccattatacctaggaagtaactaacttgcttttgatttttcagcattataggtggaagggacttgccttgtctcagatgagactttggacttggacttttgggttaaggctaaaatgaattaagactttggggaactgttagaagacatgattgattttgaaacttgagtgcatgagattttgcaggggccagaggcagactgatatggtttggctatgtcctgacccaaatctcaccttgaaatgtaataatccccatgtgtcttgggaggtacagagtgggaggcaattgaatcatgggggtgggattttccgctgtccttgtgatagtgaataagtctcatgagaactgatggttttataaaggggagtcccctgcacatgctctcttgcctgccatcatgtaagacatcccttcgcttttccttcatcttctgccatgattgtgaggcctcccagcatgtggaactgtgagtccattaaacctctttcctttataaattactcagtctcagtatgtctttattagtagcatgagaccagattaatacaaaagaacacagaatttggcctcatttaaccaaagtaaaacagaatcaaacggaaatataaccatgaaagttttacaaggatgcatatatagtgctaaggaatatgatatgcataattggcctactttgtgaagtcacaggatctttgctcaggaatcaacaatgattgagttacagagaaaaatctgaattagatacatgggatagcagagaaaagtggatttgtcaggaacgagaagatatcacagtaagaagaaacatggtggcaccagcttaaagaactaaaaacggtcagtttgtctggataacaaaacataacagaaaacacgtgaaataaggatgaagaagaagtaagagtcagggtacacagcaactcacaacagaacagctaaacggaagtgattaagagtacagacctaaggacgacatcaacaatgatggtaagaattccaaaattcagtccctctacaaaagcaatgataaatttaacaaaacctgtcagaatcaactgttttaaagctctggacctctaatcaaaacctcacaataaataggggaatgtatgatgatgaaagaaactgccgaccagcctgaccaacatggcaaaatcccatctctactaaacacaaaaaattagctgggcgtggtggtaggcgtctgtaatcccaactactcaggaggcttaagcaggagaatcacttgaacccaggtggcggagtttgcagtgagccgagatcatgccattgcactccagcctgggcaacagaatgagactccatctccaataacaacaacaagaacaagaacaacaacaacagaaactgccaaatattaacaagagaacatatgacattttaacttaccttctatcatcttccagtctctaacttagtgctatttgtggagataagtggtctatattcctagtgtgtctagcttgtgccagaggaggcaaaaatgactgttttcaaagacatatgatgtgtgttgatatgtttggtgggttgctgagggattggatctgaagtttgcctttattgagaatattgcctagaagtattctcagtctaagaacagcaccttatatcacatttggcaaaagcatttatagcaaagtacactaccacagtagtctaggacaatggataccatccaggtcaagtagcagacagatgaaaaagcctcggaaagaagagactggggaaggaaattggcaggctgcttttcagggtccctccactgtggtaccagttggtccaccacatataagactgtactcaacctgggcagctttcctgtcttggagtaccagctcacaatggatactaggctctgatctcccttgctgcatatctgtaagtaatacattcacttaaggtaacttgtacacgagtgtcctgtctcactagactcagacaagttggtaaccagtgcacaatgaagttgcttgacaagatgacttgagtaacactacaaaccagacctaacagacatgcacaggatagtccatccaacaacagcaaaataccaacaacaaaatacaaattcttattaagttcacatggaacatcctctatgtattaggccacagcagtctcaaaatattaaaaaaattgaagtcatacaaactatctttagggatcacaatgaaataagtatagataaaaggaacaaaaaagtagagttcataaatatgtgaaaattaaatgacacactcttaaccaatcagtcaaagcagcaatcacaaagtaaattctaaataaaaaaatatgttgagacaaatgaaaaagatatacagtatgccaaaacttacagactgcggtaaaggagtacttggaagaaatttctatcaataagtacctacattataaaagaagaaatatctcaaatcaacaacctaatgttacaccttaaggaatcagaaaaatagcaaactaaacatgaaactgaaaggaagaaaataataaagattagagtggagataaatgaaatcaagaaatgaaatacgatagagagaatcaacaaaactaaaagttggttctttgaattgacaaacctttagctagattgactaaaaaaaacagcaggagagaatactcaaatcactaaaattagaaatgaaattgcagatggggacattactgctattttaacagaaataaaaggataaaaggatttataagaatactaaggaatacttagttctatgccaataatttatataaccaaaacaaactggacaaattcttgaaaaaatacaaactaccaaaaatgagtcaggaagaaatgcaaaatctgtccggacttaccataggtaaagtgattgaattcgtagtcaaaacctccccaaaaagaaaacacaagacgagatggccacactgacaaattctatgaacatttaaagaaagtttttcagataatatcagaaattttcagataatatcaatttttctcaaatagaagatgaaagaatactttctagctcattctgtgaggaaagtgttacccttaataccaaagtcaaacaaaaggaacaaaaattatacaccaatatatcttatggatatagttagaaaacttttcaatatatgtataatatatagaaaaatacagagaattgaaatataataatcaacaaaactaagtctaaaaacttttacaagaaaactaaaaactaattataatgtattgaaaatatttgaatctataatataatatataattataattatatagtatagcaaatataaagcagcatattaaaaatggtaaaaacattgtataccctcaccaagggggatgtatcccagaaatgcaaggagtttcaacatagaaaaccaatccacataggctgggcacggtggctcacgcctgtaatcccagcactttgggaggtcgaggcgggcagatcatgaggtcagaagttagagaccagcctggccaacatggtgaaaccccatctctgctaaaaattcaaaaattggccaggcatggtggtgggcatctgtaatcccagctactcgggaggctgaggcaggagaattgcttgaacctgggaggtggaggttgcagtgagccaagattgtgccattgcactccagcctgggtaactagagcaaaaaactccatcaaaaaagaaaaaaaaaaaaaaggaaaagaaaaccaatccacgtaactttaattgaaagagaccaaaaaactacatgatcaactcaattgatgaagaaaaaaataagatttgcaaaaatccaatgcacttttgtaataaaaacactcaagaaactacgaatacaagggaacttctttaacatgataaagagcatttgtgaaaacccacaaatatattatattcaataacaaaagatggaaagttttacctttaatatcaggaactagacagagaaatctgtttttaccactacactggaagtttaagacagaaaactatgcaagaaaaacaaagatatctctattagaaataaaaattaaatctatttatatttaaagacttcatgatgttatatataggaaattcttaagaatagtaaaaaaatctattagcattaatatgcaaattcaacatggttgtagaatacatatcaacacactaaaatcaattgtgtacgtatataccagccataaacaaatttttaaaaattaaaatctcaattccattgcaagaacatataaaacatttaaatatttagaaataaacttaatcaatgaataaactaaccaagaaggtgtaaggctcttacactctaaactgcagaatattactgaaaaaaaattaaaaaactaaataaatgaaaatacatcctgtgctcataatggactcattaactcaacaaaaagacaagcaaccaatttaaaaatggacaagggacttgaacggacatttctctaaagaaaatagtaaacaaatacataaaaatatacccaatatcaattgtcaatacggaaatccaaatcaaagccacagtgagatccacttcatcctgagtagaacaacaacaaccataaaaacctgagaaaaaacaagtatcattgaggctgtggaaacattatgaccttcatatattgtttatagaagtatgaaatagcgagaccgctgtggaaaagaatgttagttcctaaataagttaaaaatagaattactgtatgacccaagaattttattccttggtataaactcaaaagagttaatagtagttgttcaaatcaatacttttatacaaatttagtagtgctcttcacagtagtcaaaaggtagaaacgcagtcatccaaatatccatcggatgataaatagacaaaatgtggcataacaaacaatggaatattattcagttataaaagcaaaataagtggcctagtgcagtggctcacgcctgtaatcccagcactttgggaggccgaggcctgtggatcacctgagatcgggagtgagagaccagcctgatcaaaatagagaatcccatctctactaaatatacaaaattagctgggtgtggtggtgcatgtctgtaatcccagctactcgggaggctgaggggaaaaacaacaacaacaaccaaaaaaaaaaaaaaacaagaagtactgatacatgttgcaacatgaaagaatttcgaatgtgaatatgacatattttctgaattattccacaatatatgacatgtccagagtatgcaaattcagagatggaaagaagtttaatgattacaaggggctgagaagtaacagttaattgggtatgagttttctttgtgaggtgataaaacagaagacaccagtttatgtctattaggagggctattatttaaaaatacacatataagaacatgaaataattagaattatctgcactgcttgtggaagtataaaacgataaagccactgtagaaaatgatatggcagttcctcagaatattaagacataaaattgatgtatgatcatattgatatatgatcaagcaattctacttctaggtataaataaacgaattgaaagcaggaactcaaacaggtatcttaacactaatgtttataggagcattattaataatagacaaaagcttaaatatctgaaatatccatacattgatgaatgaataaacaaaatgtggtatagccataaaatggaatattattcaatcttaaaaaatgaaattatgatacatgatacagcataaatgaacttagacaacattatgctaattgaaataagccagacaaaaaaaggacagatattgtttgattctacttatataatgtataaattgaaattcatagagacagaaaatagaagagtggttaccagaggctgtgggaagggggaaataggcgactattgtttagtgggtagggagtttcagtttgggatgattaaaaagttctagtaaggaataaggatgatggtcacataacaacgtgaatatatttaatactactgaattatatgttttaaaatgggttaaaatgttaagtttgatgttacatatattttaacacaattttcaaaaatagatgcatccataaaaagtctatagctagcgcagtctatgtggaaacaaggatatccactttctccatttccatgcaacatcgtactggaggtttttaaatggtgaaataagacaaggaaaatacagaaaaagcactcagattgaaaaggaaaaaataaaagtattgactaatgacataattgtctatgtggaatatcctactaaatctattaaaaatactgaaactattacatgtgttccacatggttataatatttcagtaacattaaatatatagtaaatctgacaaaaatatgcaagacctacacatttaaaacttcaaaagactgttgacagaaattaaagaatatctaaataaatagatatattgtggtcatggatcattaataatacttttcctcttttacactattggcttttctctaacaatttgatcctaacagcttttaatcatggtgaaaaccctaccatttgaatcaatactttcagatattaattctccacaaattgatctacagattaagtatagtcccagtgaaaatcctagcaggtattttatagaaataggcaagatggttttataaatcatgtgaaaatgctacgaaaaaaatagtaatacaattggagttctaacactctctgacttcgagacttgttataatgctgtagtaatcacaagagtggtggtattggtaagagagaaagacacacttgttaatgacacagaatacagaatctacaaataatctagttacatggtcaattaattttgacaacagtgtaaaggcgattcagtgggaaagagcattttatcaaatgatgctgggagaatcagattgttgtttcaaaaaaagaaagagccagtcttaatccataccttgcaagatatacaaaaattaagacaaaatggattatagacctaaaagtaaccataaggaaagaagattcttgagagtagacaaaattgagcaaagaaactggtagaagaaaaaccaagacaacacaatttcactgaagccaaataaacagaattgacttttaaaaagaaaagaatgcttcattggataatgctgaaatgttttaaaagattaagattagaaagtgtccagtgtatttagcaagatatggaccatttgaacaactagtgttgcggctagataaacaaaaaagaaaaagaaaaaaaggaagcaggttttagacagtaatttttagaaaacaactttttcgttgagcaagagatttatagggagacagcatagcaaggatgttgtttttgtttgtgttatataacagtagagaactgagcatggaacaaaaaagagcttttggtcctaaagctcttaggaccaaattggtggagaaaagtcaattgtatagaaaataacatgtactattaataaacgaagttacagaaaaaaaaaagtggcagaatccggagccctttcgggaaattagacagaaagaaggttctctaatgtaagagaagacaagagtgcagatgggtgtggttttagattgaaagaagagagagaagttcatggatagtgagtttatactctttctaagactggagctgggtggcaagttgcagaaatcagaggagggtgaagaaaagtgaaaaaacataatgttgaagaaagtgacaatgagtgaaactgagaagtctcaagtgtgatatctggacagtttgctgtgtccattttagatatgagatgttgcatttactgcaagacaattctcctttattgtgaggtaatacagttttgtgtaattgcccagttgaagaagcagaataaagtgcacatgggtcttgccagagatctatgacacatacataaataatccacgggtcttaggggaatgtttctaaaataatcaaccatttaagtaataaggggaaatgaaaagaaaacaatggctgacagactgttagaaagtataggggtcaatgaactatgaaaagtgaatatttatacaataaccacttgagtaataaagggtagaatccatcacagacagcttgcagtttaaacaactgttcttctaataacacaatagaagtaatctaaagataaattaagtgatcaaatccttaacagaaggagtcacatttcttgccattttttactttcatgtgattttctcctagattacactgtgttttgttccataactggacagattttaaaatccaataaagaaaaaaataaaaataattggcgaatagcagagcatccagaatgattggtccaggtttagcaaccatctatgaggtcaatgtgttaatacaattacccatgtataatacaattattcatgcatacaattagttttccccccagaagattatttttatacaatgccatacattttaatacctctttttaactttaatatgagttgctaatcctcgtcccttaaaaatgttttcagagagaaaaatttactgtcttggttaaatgcaattatcaacaatgcaaaatttattttcatgtcttttttttcctagagagtctgtatttgaacaatgggcctatctcacatgtggagggcctcccctcatttttcacatactcctgagttacaacgttgacaattatttttctttgagtcatatcttttttcagagagtaaggcctgaaatttgtctggaatatccctcttttatatgagtagaaattttaaaatttgcagtagtaatatgcatgtcaaagctatcattgttttgggaaaaaaatatttcattgtgttacatggcatgctcttaattgtacaggtgaagtgatgttttacttttactggcagtatttaagaaaaacaaaaagtgaatatatatttcatactaggcttaataactgggtgatacaataatctgtacaacaaacctccatgatactagtttacctatgtaacaaacctgcacttgtaccccaaaattaaaagtatatatatatgtacttttatatatatatatgtgtatatatatatacttttatatatatgtatttatatatatatacttttatatatatacttttatatatatacttttatatatatattttatatatatataaagaaaatatatatatattttcttttcagacatatatatctgaatttctgttgctttttaagcaataatatcctgcatatgattatttttggcttatttctctgtgtattagatcagaaaaaataaaatatataaaaatcacacaattgtgtatgaatatatgcatgtatttatttgaatgaaatccattcattaaaacagttaaattctaaaattgttctatgtcgctcaaattccctctctgtggtgttttattaaaagagaggattggggagagactctttacctaattatgaaataatacattgtgttggcagagaaaatcatcatgatggctcaaagccaataaagtctgtatcacagatttcagtttttttcaccttgaccataaatacacaaatggatgaacagcaaaggataaatgtgctatcaaggtttgagaaagttataggtacaggcaagtttttcttctggagtgttgcttaataattaaatttaataatgaaacattgatagatatcctcttagtgaaaatacatcatctcctttgaaagactccagtcatgggatatatttataattccttaaatccttagttaccgagaaatatgcaactatgcagtcatatgatttaaaaacaaaaggcactctaaatcaggagaaagcaagtagtggtatgaatagttcccaagtcttgtggttgaaaaagatataaaggcttctcctgagattaagctggaaaactcacatagcaattagtgaatccaatctatatgccagtgtaggcaatgccactattgtgtgcaagaccatatctaagtgtttatatttctttttaaaatgttctatatttatctataaaatacactatgtaagtaaaaaagcaggtctgtagaagatatgatacattatattatatacagtttcttcagccttctcttttctgaagttccaagagacatattcctaatcagtccaagttgcatatgtctatgtttatgtctctgtatttgtgcaccattgcatggtggagctaccagaactgtgggtgcagatataatgtccaaaattaaaatataaatccttactacatgactacagagaagaaaaaagtaatatttgatttcccatcaaatcacgcatgtggtactttcggagaacaaatattgcctaaaaccactgtgatctactgtattaatggactcctcaaaagtgactactttcttataattaatctttcaattattttccaaaattcttaaagtccaaatttcttaacatgctctataataataaggataaaatctttttttatgcctcagtctcatgcttaaacgtttgagtagttttagatttgctgaaaagttacaaagattgcaccgagttcccatatacccctcacccagtttctcctcttattaacagcttaagatctggcatttgtcacaattaatgaaaatagtgatttattaactgaagtccatacttgatttagcttctgtttttacctaatgcctgttttcattcccatatagaatacattatactatttccaaattaggtcatattctaaggtactggaagttagaacttcaacatatgaatttgggtggggagtgataatttgacccataataaccctcaaggttctaggcaatcactaatcaacttataaactgcctattctagacttttcatataaatggaatattatagatactgtgactttttcacttagcatgttttcaagatccatcaatattgtcacatgtgtcagtactattagtctgctcctgtgaatttttcatttcagttcattaaagaatttcctttgtatttcttatatctgtatcttattgatattctccatttgatatgaaattgtcatcatgccatcctttatttaatcttagtgtcctttaattctttgagcatgtttttaagagctgctttgaagtcttttttggctaaatttaccatgtaggccccatcaaagacagtttttcttgtttgctttttcactgtgtatgggtcatattttcttgtttctttgcatgtgtcatatatttctgttgcaagtgggatattttcggtaatatgttgtagcacctatgaatacattacccacccctccatctggcagtggttattattgctgccgtttgcttggtcatttgtttgcatagtgatttgactgaattaactctgtgagggatattttccttgcagtgttttccctgatcatattttccccttatttttaatctttgagtctaatatctagaggttgtcccaggaagaatatagctatttattgttgaaacattttgcataagctctccttagccagttggagttttacccttttactgttggatatgtgtgtgtggcttggaggctgcaatcattatttagggagtttatgtcagtctcacattcaacagactgccagcttggaggttccttctcttattgtactttaaagggtgcagccttgttgggcatgtacagtcttccagaaagctgaggataagtgttattttatctttacgtttagcttctctagtagctacctccatgtcagaataattaactgttcagtcactgttttgctagaagttgtgtttaagctccttgtgtctatgaggtttctaccctgtgttgatgggtctgcatgtagcttggagaatgttttcattttcatgccttgacctgctcagattgctcctgagtgagggcaacccagcacatgcacacagccttccagaagccctgagttgactgtgatctccaaagggacatcctgggctgtctctcttcctgattctatcacatttccggctgctctgttgttctgtgtatattatgggtctactagcctcttcttagtcactgcccaccaagatcttcattatttattaatagtgtccttaggcatggaattctatgctttttgtaccaagtaaacccagtcatctcagacaaatctgcagagctctttgtcatacggccagcctctcctgtgggcagaacctcctgccacagcatcagagctgggtggagggaaccattttttctcaaagtggtactccggctctaagagtaagcagtggatggaagtggtgttattatttcctggtctttctggtttgttctttctatcaaggaactcctacattaccagggacctgggccacaggcaatcaaagtctcagatttctttgcttgctatccctgaggaggaacttcttctctaccagtgagggctatgtagatatcattagtttctatatattgtgaagtgatgtagcctttggagctctaattgaagatcaccatcatttctacagcattaaaacacatttccaatttgaatcagattaattgatttgtgattttatttaacatctcctttcttaccaatcactacagttgatactggaaatgccaagatgaataagacacacagaatgcaaagtatttataatccaatgtaacagatagatattaaaaagaaacacaaactatactatttatattgtcagttagcaggcataaatatgtacaaagtgtttgtataatatggagatgcctctgtgagatatgttgatgccaaagagaaacaatctcattaattgaatttccaggatttaaagatactacatagctagtgacgtttgatcttttaaaatttctgcaggaatttactaataaattgggagtagattgggtaaaaatgcctgcaagtaagaatatagaataaagtcacagaggaatttggagcatgatgtgttaaaataactaaaggagttcagtatggctaaagccatattaggggtgggtgaagaatattttaaggttcattaaagttttatctttgcagcattaaattgtcacagaaaccaagatgcattggctagcattgcaagaaaatattcagtatatgagcctaagctagatgttctgccttaaaatattggtggagaattttgtagttgtgctattacagaggatgtcaagatttcattcttcaacatggaaaatagtataactgatttactttgttcaagtttctcttaaatatgcagagaggttgtcatccttaatagtactgtgactgagccacatttaatctactggaagtaaattgaaataaatggaatatgtatgacactatgaagagttggatgtatacatgtgcaatgaaaatatgtggataaactgcataagacacaataaggaaaaaagctataacaaaagtagttggtatgaaggtttggcaatttttattctatagttatttcacatatcatatttctcctttatatagttcataatgccaagaggtacaagctgacagctacagtaggaaattgaagcatgaattaggtgatgtagattgtaattccagctctttatgacaatttttgccactctgaacaagtcgctaatcttcagagtttgagcttcaatattttaagatggcaaaattatgtgattctggtaatttacattctagattatttagcaaaattttccttgatttttgaattatgtgtgcacctcttaagtaacaaagcaaaatatatacattgtagtactttgtaataatcattattatgagtagcattaatttgttagtttggattatatcagcattgcttacatatgattaatgactctttaaagggaaaaaaaatcttgaggatcttaatattaccagaatttctattatgttacttaaaatgtacaaaaattttggcatatatttcttaggcttacatatgtgattctgctaatttacatgttagattatttaggaaaaatttccttgatttttgaattatgtgcacctcttatgtaataaagtaaaatatttatagtaatttgtaataaatattattagtagcattaatttgttagtttggattatatcagcatttcttacatatgattaattactctttaaagggaaaaatatcttgaggatcctaatattaccggaatttccattatgttacttaaaatgtacaaaacttcaggcattaggtcatattctaaggtactggaatacatttcttaggcttacatactcaattacaccataacctaaaattacaaagtaaatataaaacccgtaaaatgggtctggcacggtggctcatgcctgtaatcccagaacttctggaggccaaggcaggtggatcacgaggtcaggagttcaagactagcctgcccaatatggtgaaaccccgtctctagtgaaaatacaaaaaattagccgggcatggtggtgcacgcttgttttcctagccactagggaggccgaggcagaatctcctgaacctgggaggtggaggttgcagtgagccgagattgcaccactgtactccagcttgggcaacagagtgagactctgtctcaaataaaaaaaaaataaataacagtatcattttggcagatgatggtttgtggctaccaaatatatgcttataacacctttatggtactgacttcagtggtacagtttcttttacatttaataggtagaaactttcatgtactatgactataaagcaaagattttactgttttcctcaaagctaattactgtgaaactttcgtcacagcaacttaggaccacttttcatctttgcctgatgcaagctaagcatttgtagattaaatctctctttatcttttctttggccaatacaatgaatgtggtttctgcttatgtgagtgttcaaaaacataaattaaaatgaatatactgaaaatgattaagttgggtataaggtcgtagatgtgctgaagaccaattttgtttatgctctttttctttcacttgaatatattaacacgtttttacatttatattaaatacaaaatgaaaatctaaaatataagcacataatagagaactgggtaaacctgggtaatacatctacattttccaggagtaagcatatgcctttacgcgaataaacgaaagccaaataaatttgtataaaaattagctctgcactttgctcactataactgtttttgcatatacccagatactattcaaacatatacaagtcaggggcctcttataaagtctatcatcatgaacacttaggacactacttgaactacaaagtataaggaatgttttagaaatatcattacattttagaacattctctagagacttgaatagtataggtttgtatcattataactgaatgcagatttccagtagaccttccacactgatctcagatatctaaaaggagagggatttgtgccatttaggcaaaaggggattaaagaagtgacagtaggaaaaactgaaaataaagaaatactccagcctgggtgacagagtaagaccctgtctcaatcaatcaatcaatcaaggattgtggtagtgctataaaccacatttgtataattgcatgggcaaacagttatgcttttggtgtctgttcctcatttacgattctgataaataatggtatgtccatctaaggttattatgagatttaaatgagttcataagcaggatctgctgtttaggacccattgctaacattgaaatactgttatacaaattcttcattttttgaactagtaattatagatggaatgatgtatgggtatgcaagaaattgatatcatacagtgtatttggtaaaagaatgaacatttaactgattacagtgaatcatggcccattttggcaaaagaaaaatggtaaaaattaagacagtaaaaattactgatttgtgtttcaaatgatcacaaaatggtcatgtaaaaccataaagtacagttctctttcaattaccaagatttgttcatagtaatggctttaggtatatgtatatagatggaaacatttttcttttttaccaaagtttgatttcagaactttaaagtctaacaatgtgaatactatattatacaaaaagtagtttgctatacttttattcattttctattaattcctgttatattttttactctcaaatactattatgtaaagataattgccaaacaaggtatataatccttttaaaaatataatatatatataatatatgtaatattcaagataggcacaccaatacatgaatcaataatactagaatcactttttatccattttcaattaatatttcactgtcacttgtcagaagaaataatccaaagcatcatcatgattatattgaaaagttatctcattttgatctctgaagcgctgggtttgaatcctaggtttgatttttagtaattttgtgatcatacccaaattattagacctctttaatcatagtgttctatttctgaaatagaagttaatgccttttctattctttgtgtgtgagagagggagagacagaactaaaaataaagtgtacgaaagcacttttaaaaaataatgatccaccataatgttgttattgctattatgactaacatgataatcataatttatggttacattcttgaactcctctcaaaagaaaattaaaattcagagcaaaacctttccatatattgctggttttaaatcttattcaatggcaaaaggtaggaatagccaaatatttttatgtcctgttccacaaaatttcatttaaaagtattagaaataccaataaataaaacacccaaattttggtaacataactgaagatgaacaaatgctacaatgacaagtcagttacatgattaatataaaattacaatcatattaatatgcttaaaaaagttattggaagaatgataggatgacaaacagctgccatattcttctcattatagttcaaaaaataagagctgagaatatcataggcttactaaaattgagcttggctaaaatattttgtcaggtaatctccattttattgcccttaatctccattacatttctggtttaaaaaatgtgtaaaaattagtctgcagaatgaaaaactcatagacacaggccaaaacaagacatatcctgtcttcacagggtgatgctcattgtctcctaatcatttatttgaaatgagagcgtaaaaataacaattaccacaatttttaaattaataaagcatttctatatattattttgacataaatgaatcaataaattatagacaagaatcacccttcacatgtgaccaataaggtttacaaaaatatcttggtacaaattataatctggatatttttgttaactaaaggctagtttaatatataaaaattatctgaaagtataaactttgctaaatacataatgtaaattttcatatatttattctattcaattggctaatgcccactctaggattttaaaaattcttttaaaatttttgcctttaatatttttttcacctactattaagatgactccagataaacaagcagatataagcagaaatgtaacagaacctcattaaatgaacaaatttgaaaatcttcagaattttgtgggtttagaagctgggtgcaacaagagttgatattaaagaaaatggtttttgaaattaagatatacatatttatttgtgaaaggacaaataatattaaatgcatggctatgtttacctcagttgtataatacaaaatactaataccatacatgtaattctaatgggtaactttctaaacctcaaattactaccctgatgaatgttttactttgtactataagcagaaaaaaaatctgttaagaaactaacattaaacacctgtacagaaaacatatctgattttaaaaatccatgtatttgtagcatatatattttgattttttttttttttgagacagagtctcactctgttgcccaggctggagtacagtggtgccatctcagctcactgcaacctctgcctcctgggttcacaccattctcctgcctcagcctcccaagtagctgggactacaggcgcccaccaccacacccagctaattttttgtatttttagtagagacggggtttcaccatgttagtcaggatggtcttgatctcctgaccttgtgatccacccgtcttggcctcccaaagtgctgggattacagacatgagccaccatgcccggctgatttttttaaatttcaagttttattttaggttcagggggtacacttgcaggtttgttacatgggcatattgcttgatggtgacatttcaggtatgaatgatcctgtcacccaggtactgaacatcgtacctaatggtagttttttcagcacttgcccacctccttccctcccaaccctctctagtagctccctgtctctattgttcccatctttatgtccatgtgtactcaatgtttagcttccatgtataagtgagaacatgtggtatttgattttgtgttttgctgttaattaccttaagacagtggcctccagctacatccatgtcactgcaaaggatgtgattttgttcttttttatggctgcatagtattctgtggtatatatcaccacatttttttatccagtctaccattaatgggtatctaggttgattctatgtatttgttgttgtgaatagtgctgcaatgaacatacaattgcatgtgtctttttagtagaacaatttattttcctttggatatatatccagtaatgggtttggtggtttgaatggtatttctgttcgaagttctttgagaaatctctgaactgctttccatagtggctgaataaagttacattcccatcagcagtgtataagcattcccctttcttggcaacacaattttataacagatttttcctctgaaatatctacttgaaattcctgacagtgttttcctaaaacattttaacataaataaatgcataaatatttttctaattatttcattttaaatacaaatacttactaatttcactttacatggtagaaaatgactggttttgttaaatattttgaaattagacttacataaaaatggaagatcttatatatagttatttttcactgattcagtcttcttcctttcacattgttaaaataatatgttaaaagtaaaatcacgaaatagatatactcataaaacttacttgaatttaagtgaccattttatttatgaaagtcctctttgctagttttctcttttcttgtctgttacatataatgattgagttacagttacacgcatagcaacattttccattgtgcccctgtgttaagtataggcttttattctgtttctattctgcactaaagagtcagtagcaaacaagtttataaacatttcagagctggatgcataatcaaaactcataatccactccaacacccacttttttaaaatcaagacccacctaattttcttttccctctggtctaatttttacaaaaatttcattttgtaattatttataataatttatatctgcaatttctgctttgataaaactggtatgtcaggagcctccatccatgatatattgtatctttgcttatcagttaaaggagtccagaaaataactctccccttcctatgtaccatatttatggtttcacacttgatttttcctacaaagttggagggtatttcttaaagttctatatgtgattatctaaccttgcttggacagagaaagagtaaatcaggtgttagcttgtactttagggattgtcttaggcagaatattgactccttctgcttccctaacacttattaacgagtcaatttagctattcctaatgtgtgcatgcgtgtgtgtatttcagaacaatgtattatatatacaatttatatttgtcaattaaaaaatgagaatattaaaaatagtgaattagagaaaatattgtgcaaattccagcaaaattcctacagataagtttttaaatgaacatttaatttgattacctgtataatgactccattacactattaaaaaatagctttatgtgtaaaatttctatgtattttttaaacagctatattgagatataattcacgaactatacactttaccatttaaagtttgcaattcagtgattttagtatatttagaaatttgtgcaaccatcatcacaaatctaattttagaattttttttttaaccaggaaaagaatctattagcattcagttcccatctccccatctgctctaggtgatcaataatgtattttgtgtctatgcatttgccttttctgtatatttcttataaatggtaatgaccaatatgttgtctttgtgactgtcttgtttttagcataattttttaaggttagtccatttagtggcatgcgtcagtatgtcattcctttgtatcgccatctaatctttcattgtacagatgtaacatatttcatttatccattcctcagttgatagacatttggattatttccatttttaaatttttattaatgctactgtaacatttttggacaacttttctgtagatacatattttcaattttcttcagaacatggaagaattggaattgatgggtcatatgataaatttatatttaacattttgaggacttgccaaaatagtttccaaaattgctggatgattttacattttcactagcaacatattagggttcccatttctctacaacttaatggaaaattattgtctatatttttattatatttgatctagtggttgtaaagtggtagcgttttcaagtttagacttgtatttttttttaaatgactaatgatgtcaagtatatttttgtgtgcttacaggccactgctgtcttctttgaagaggtaactacttaaatgctttgctcatattttaatgtgtttatttctgtattgttattgaattgtaagtgttctttataaattctggctaaaagtaccttaccagatacatgattaacaagtgttttcttacattgtatataacaatatgatttgcaacaaaaaataaactgatttgcaacaaaaaataaacttaattttgtcaggcatattttgatgtgcattcatttattcattcacttgtttttttgtgtgtttatcatatcatttgtacttttgattttacaggtatacctcaaagatattgtgggttctatttcagatcatcacaataaaacaaatgtcacaataaagttagccattaagattttggttttctagtacatatacaagatatggctacactatactgtcaactatcacagcagcagagatcagagttactggtggcctgcccctctcagaatgaaactgtagtcctagaataggagttggggggtgaaggaacttctttgctttggagcttctgagcttttgtgacgctttgttgggtgggaatgagggaggaattaagggaacaatcaagactcaaataccacagactcttgtctctgattaccataaggttctaataggtgtttctcccttttttgtatgccatttaagacaatgtcaaagactttatttttttctttttttataaataactttcagcagttaaatttatgttcctctggtgagaggacatgctgagcaactcttaccaccattttggaaatcttttctagcccaatcaacatagcgagacccccatttctacagaaaaataagaaaaaaaatagccatgtgtggtggcacgggcctgtaatcctagctactctgtaggctgaggcaggagcatcacttgagtccaagagttcgaggctgctgtgagctatgattgtgccactgaactctagcctaggtgactaagaatctgtttcaaagtaatttgtttttaaagtttgtatttttttccattttgctagttgtattccaaataaaatagtttttgaaccaataaagataagttcactctttatcattgtcatagtcctcttctctccatcccttcatctgagctgggcctattgaacgctcactctgataaatggcaatggttagagttgaaatataagagggctgaggcctctccctaaggggcttggagattttccagttaggcttgtttttgtctttttaaggacacatgaacagattatacaactttttttgtgaatagtatttattagaagaggtcattggtacgatatttcttttagtcgtttcacgcaaattattttatcttattttccctaataaagtttaattgctgatacaatttgtccatgaagattggctaggggtaactaaaattcactttacctacaaattaaattagcacataagttattctttaaaacctactagaaatgtctccctaaataatgtatttgttcctattgttctcttattcaaaagaatcatgctgttctaaaataattatacttataccctaatttctaccttaattatccgaactatttatttatttatttatttattatttgagaccaagtctcgctctgtcgcccagactggagtgcagtggcgcgatctctgctgactgcaagctctgcctcccgggttcatgccattctcctgcctcagcctccggagtggctgggactacaggcgcccgccagccctcccgggtaattttttgtatttttttttttttttagtagagacggggtttcaccgtgttagctaggatggtctctatctcctgacctgctgatccgcccgcctcggccttccaaagtgctgggattacaggcttgagccaccgcgcctggcccgaacttatttctaccatggcatctatctttcaccaaagttatactgaaataccatccaaaaatgtgtttatttttatttctatatttatgatctttagacacactaatgtctaattcgaaagatttggcttattgtagttccactattttagcacaaagttaatttaaatatttgaaacaaataggacataaaatggtgaaaattgtactgctgctcacattattaaatgttttaactattagaatattcttttgctgtcattttgaacagtactagaattcaatacaagtttatcagatatttagaatcatcccagcatattacatatggtgttgctaaaatgtggacttaaacctattgcagcagctcagagcatgctcacaaaccaatatgtaaataaagaaaacgtaactagcaaatggaattctctgattctgttcagtttgagaaggaaatatgcaatgggagggatacatcaagtacactgattttctctacagattacctatttttccaaaaatgtaatcagtttttatttatctatgcttcaaaaaatagcactaagatggataattgcaatccaggattcaggcaaattaaaactgtatttcattcataattattaagttacatgtaagtcccatacatgtaattgtataacacaaagatcatacaatagctctgacttcaaaaaaaggctgccacctcagcttattattctcatatcaaggcctttatattgatgttctttctcagttcttgtgcgtttccctgaactaggttttcaggataacaaaatctgttgtttttcttctaaattacatttttactagtgttcagtttaatctaattgcaccttctccttaaaaaaagtaaaaaaaaaaattgaggtactagcaggatgtttagatatttatagcttgttttatttgaaaaatcttggataaacaacaacttttttgttgtttctggtgtttgttttgtgttatcatctcagtgacactgaggcctctttttctggccatggggggaagatctctcaaagagctaaataatatagaatctatttaacaatataatttagtttatttttaatttctgaaaaatctactttggggaatactgcccttgacataactggaacctgccccaccaaccttgttgtctttctattttccttatattcctattatttctccctagtacagtagacaggaagggcaatcaaatgcaaaatagcaatgtgaaagatacacaaaatgatttttctcattcaatcttattttggttgttcctaaatggtactatgtaatagcaataattatcacatggtgtgtttactatgtgtcagtgtgtgtactaagcactatgaatagattattgcactgattcctatactcaccttatgttgtaattactatcattctcagtttgcagttgatgaaactgacatacagagagtataggtgacttttctgcctatattgtgaatatgaaaatgtatagggacaagtacacatacatcaagaagactgaatgcaaataaaagtttgttgaataacacaaggaaaggctgttaatttgtaacattatttaattattcatgtcttatggtatgccagaggacaaaatcaaattaagagaactttatttgggtttagatttcaatttaattttctatccattattacaagtatatccacaaggattcaatgtgcctaacagaagcttggtggtcactgggaaaagagccccccatagtaatatttttttcctgtctttttcctgcctttaatatatcctcccatttgctcatattgccttttctaaatacatctgaaacacggtatgttttactgtagtcttctggtattcagattggaaatacacacacacatgtatgcgtgctcgctcgcactctctttcatacgttcttcaatcaaaaacttttaaaacaacaaagaatggctaagcagataatccatttgcaggccatctttaaaagctattatttcagttcttgctttttcattcactgtgtccttgtgacaaacatattttcaagtacattcctaaagtaacaaacataaggctaaatgaaaagcctagaataaactcagaaatgaagagaataaaaaagatctctatttctggtattgttctctcaatgccaggtctcatggaagaacaatataaggtgataaagtaaaaaataaacaaatagttcatagggtgattttatgttttaaaatatgtatttcaaagcagattcattattgttttaactaaggcctgagtaaactggagacaggggcaaatgaataagctgtatcggtccatgataatcatctttcttatcactctctcttgctcactcgggtccaaccatatagtccctttcaggttcatgaatacaacatatgctcacttgactcaaggattgtttatgtgtctttccttccagatatcaattttctcattatctcacttccttcagatcacttctcaatgtcaatttatttgagaagtttcctctgataactttctatcagataggacccattcctatacctaatcttttaccctgctgtattttctcagtaacatctttttattcctaatatataaatattcattgttttgcctactatttgttgctctagcagagtgaaaccctaacaggcattgttttatcttctgttacacctccaatacagagaacattgcctagtatatgacaagaactcataattatttgaagagagaataaagtaaataggggagaaaacatattctctttcaatgatctcactatgcattctaacctaattaccagacaccttggcaaatttgtaaaccacagaagaaaatagaaggattagaatgcattacatttctttatgtttcctgtctcactttggctagaatcactccaaattatttttgtccatagcctatacacaattatttctttaaaattgggtgttcagtcactaatattgttctatattggaaagaaaataattcaaaatagtatcagaataaaatttgaccaaggttatctttaggctttacaattaaatagtttgtgactctctttattttgcttattttggaaaaaaatgggcctttataaaacctgtataatacattaaagaccatacatttgtgattttagattgcttataatttcccctacaatttactctataaaaaagattatttaaaagaaagaaaagcaaaagatactcagattgttgttggttttttttcctcctcagctggttttggctgctcaattttaacactccccagagagctctcagacatttatgtgatttaatggcctactattattaagtcagaaatattttattttacattgagattgccataaccattgcattaacatttgagtaataggcaataacactgagaatgtatcaatgtatcatttagtgaattaatctgtattcccttcctaggacttgcttattgatgatgcaggataaatgtaatagtaacaataagtcatcaaacattctggcagacctgtcaggaagaggagatgggggtgcatggaagtgagcttgttgagagacagttcaatgcagaagaaatgacatatgtcatattttccccacagtgaaatgatagagtacatggggatagcttagtgatcagcaatgtgtgcaagttttgtttgcctagagcctgtggttgtgtttctggttaccctatgtagcaaaataataatgagttaattgaaatagcaatcaaattctgtaggaaataaatcatctagaataaaagaaaaaatgaaaaaattagaaatcacatttaactgtaaataatatctcctagctgtctatcagtccacaaattagggtgacgtatattcaaggcagaaaaaaaaatagatttgttgtgcatgtacaggaagaaaatattagaacttccatttatatgcatatttatctaaacataagaaaacatggactcattttcattaaagtgtgtaatattcagattgatatgtatgtgttcatggtatgctgtgtacaagttatcctgaagaagaataggaggtcctataataggcaagtttgccaatggctgccagactcctttgtggagctcagactgttaatttcagtatactgtgatgttgagcatatccaattaagttgatttaagaatattttctgggtttagtaaaatgtgtcctataaaactgacaagtgaaaaaaaaaaaacaaaactcaaaccaacatgaacaaactgtggaataaaatgagagtaataagaacaaagtataaaagaaaatagcatcactgatatttttcagagtataactatctaaaccatattatgaagaatagtagtctaatatgatgaacaccaacccccaaaagctcaaaatcacaacaatttaaaatattaatatttacctggtttcattaatgataaatcagaacttacacactgtgttttaagatgtgaatggctgtataaagccgtgaaaataaataagacattccaaaattaagcatcttgacaatgaagagaaccaaaatttttgagaaacatctcaggtcatgcaactcccagtccagtatttcatgcaaggtcaccaaacaaccctaaagagttagaattttattggaaaaattctcacttaaatagcaaaaggcctaaatccacaaacaattacataaatatccttttttttttttgctatggtaaaagtggtttaaacactatcaagaaaagaaaaacagaattagaagtctcttgtctgcgaacacaaaaataatgtataaaaattgttggaaatttacaaagcaagcattaaaacacatttattgtgtgaaacacttttttctttgaatttaaagtacatatgctgcttctgtcataatatagagaaaaccattgaatgaaagatgcagtggagaagataaattataaaagattgcccacaggagaaataatgtacaacttaaaagcacttacttcattaatgataagcaaggtaaacaaggtactgcagcaaaaaaggttaataactggaagcatcactggcaatacgtggtttcaatacttgtgttgttggtgaagagacccgctataccagaagattgtgcagaaatccgtgtaagagaggttcaagcattgggcccggatttaacaaacgtaatggaagaggtcaagtttcagagatattagagaagcaaggctcaaaaaatgtgctggcagatagtatgtggaatatgtggaaaatattgaaattgaagatgatacttagattaaaattttgtcaagtgcaactgaatggatgatgataccatagttgctttcggttaagagcatcaaatcaaacatactaaaactatgctctattatatgcatgatgaagtctggagagtgttctggaaaatccagcaaagtttaaataaatattctttcatagtctatacatttttctatttaagttcatttggctaaaaaaaaataagtctaggttatacctattaagtgtctacccttattagctgaggggaagagacactatcagttggtattctcctatatttatgaggcagctcctgtaaaacaaaccactgatcttttatggatcttcttggggttactagtgagcagagtagattttgttcaccaaaaattctcagaagaaatctaacagtaccttaataaagctgacttccaaggtcaccactaaattaaagctaaaaattaactctgttctatttttatcccaacttacttccaaccatattcagaacctggcctcaaaaaacattctcaaggagataaaatgacattataaaaatattctcataatgaaaaacttcaacaatacagatgaccaaatttgaatataaacccatgtatattatcaaaataagagatagatattttaagtccaagagatatatccttttgcaagttaaagaaccaaaacagtaacatccaaaaaaaaaattaatctaccgtaagttagaatttgcttctctgtggaaagacttaattctacaataatgctagtcctcataccttaatgtaaaatttagtgcaattcaaattataatcccaatgagtttattctttttaaaaggagattggctaatatgattttaagtgatatgaaaaaaatatccggaaaatagataagaaaaatataaataacaacagaaaaaaaaaaaaaaaacaggagagcactggccttaacacatatctaaacaagcaaaaatttgtatgaatagacaaatgtacacttttatagcattgagaatccagatataggtagtgtcaagtggaaataattaggaatatttaataaataaagacaaaatttatcttccaacaaaaaaattaaaaatgaatgcataaacaaatagcatcaattttataaaataaaattaattacaaaatttatgaaaagtaaactacactagaaaatactgatgtttgatcaacgtatgtaaaataaactataaaatagtggtatatttttgagcaatttattacaaactataaaaattttaattatagagaaaaaattattttcaatatttttgaagatgttataagttcctaggatttccaaacaaaaaaaaacaacaaaaatgaaatctatttatttgtgggaaatatataatcaagatagagacactgttgtcaagataacaatataccaactctgattccagggaagatggaataatgacattccactctactatttctcactgaatatagctatagaaagcctgcagctgctgtatgaggactgactcaagcaaacagtagcaggtaaaatgggtagaagacccaaatgccagtgaatttaccattttttcccctcaaatatccatagtctgaacgcaacgcttcagaactggccacagatggagttagagagtgatgggagaactctggttctgactcaaagagtgggaaaggagactcccaatgcctaaagagaataccagattccttccccatcccagcctccctgtgccacatccctttttttgttgtttttgtttttctctctttttctttgtaccagccttaagcaattccgtcatgctggtggtgatagccgatggtgacaaaagcttatagtagtcaaaattatgagggaggggaactttcctttctgtttgctacagtcatttttccagggggtaggggcgactcctattgtttttgttttatattgccttttcttttgcttcttgcatcagatggggatgcagtcatggaagtgaagagcagagtattaaaccccaacttcctggcaagaggtctaagtggaaagggaactggagtgcacaggggagatggcagagggaggagctaagcaaagtgaccccatcacatttttaataaactcctaaatcacccctgtgttgcacagatgtggatctgattttattcagcataccaaagacaaagaaaatatagtaatagaccaccaaccacatcacagattgaccattgatggcaaacacttaggataaatacaaatacaaacagaacaaaggtttgaaaacagaatggacattggagacaaggctcagggaagacattggaatttgtgacctgaaactaaacaaatcaactgcttgctaaaataaaatgcatatatcctcaataggatttaaataagatccagcgtctcatatttattatttaaaatgcctagggtataatctaaaattattcaacatatgaagaaccagaaaaatatcaactgatatgggaaaagccaatcaatagatgcccatgtttaaatgtcgaatttatctgacaaacactttaaagtagctatttttaaatgcccttgtaaataattgagaacactactgaagtcaatggaaaaatacaaagtctcagcaaatagataaaatatataaagaagaattgaatgaaaattttacaattgaaaattgaaataactgaagtgaaagttttcattgggtgggttcaattcagaatgaagatgacagaaaagaaaagtcagtgaacttgacagcagatcaatgaagattatccatctaaatagagaattggtgaaaaaagtgaagagagcctcagacctgttagacaataaaatttctagcatttgagacatccctgtaccaagaaaagagatgaaagaatgcagtactgaaacaaacaaaacaaaaaccttgaagaaattgtggctgaatatgaccccactgtgctaaaacacataaatccatagattcaataaatacagtgaaatctatacattcaaaacaaaacccttcagacacatcagaaggaagctgctgaaagctaaagacaaaaaggataatatagcttgagacatttatactgtagctcttgctgttggactcccacataatatatctaggctctaatctattccaatctgccagaaaggctttgaaataattttcttattcttcttcattaattccagatgaattatcctggtgtttgttttaaaagaatgttgtgttgtagcttctgcctttttgttaaattgaaatatgtgaaaataaaattaaacgcccactgaggtcatcatactctacttatccaaggtgattttcctttaactgttttatgacctagcagaaaaatattaacatactgtaatttttatatatttgaattatttgtaaatgcagtgttctgatgtaatgcataagactgagatattttataagtcatatacatattattgtgaatgacatccatcattgaaattattctaaaaacaatattttaatgaaattactctaaaagcaatttgcattgattcagaaaggtcttcaaaatagaagtcactgtagaccatagctatatttgagctagattcataaaaatacaagcaatagaaagttaaagttaatagagtgctacttcaaaacagtatacatggatataagagtacacattgtaaatggaaacttttttctttttattacgtagtgacttagtcaaactctaatatcctatctttttctgatttttcaggcatttcccccaatacaatataaattctactgtatcagactcaattcttagtaaagcttaatctcattgaaaatattaagaggatttaaaataaatcttaaggtaggaagcttaaaagtgctttatatctataaagtcatatctataaagtcacctaagaacttcaaagtttctaagaaggcttgctaaaagaagtctttaaaacatatgccgagataacatagcatttattttgatacacagatttacttttatctcttagaactttttcaaatcacctgagcagttgagtattgctcttttataactaatcccttcccgcacccacacaccctgatgtatatacagaccagtgcacacatagaaaacaactggcttgtgtattgatttaatgatgagatattttgggggataaaacaggtatggttaaacacatctactaagaccactaatattccgactctatttcattttgaataaagtgaagaagatcctagttaaagtgtaagaacaagtaggaaattcaatttacacaggatggagtggaagaggtaattgtacttgaatggaatagaatgttaattatgaaaagaaaaattactgcattttgaatgataaataactttctaaatttcagtacaataaaaaattgatagacacagaactgcaaatgttagattccaaagttattgtggaaagattaatttggttacacatcttttaaaacaagaccatagtaaaatgtggaattcagtatagattttcatattctaaggagcttcccaatttattactgttcaaaatagtggaaagttatgtagggctgttaataagtggatgtttggtgccttgcggaataatgtttcttctaatatttattttcatatgaaatcaaagacactggtaatttaaaatgatacacaaaaggaaacagcacatttttacagcataaagtaacattttgataaaagtattaatatggctccattttcacttttgaaaaataaacatgaatttacacatttttaaataaaccatgctcataatgttcaaacatatcacttgaattagttcaagcaaaataactgccattgaaatccttatacaaataccagtgatatttttcacagaaagagaaaaaataatcctaaaattttatggaagcacaaaagacccagaatagccaaagccatcctgagcaaaaagaacaaaactggagatatctcattacctgacttcaaattatgctatagagctattgtaaccaaaatagcatggtaccggcataaaaacaaacatagaccaatggaatagaatagagaacacagaattaaatccatacatctataataaactcattttcaacaaagatgccaaaaatatacactggggaaagaacagtatcttcaataagtggtgctaggaaaattggacatccattttcagaagaatgaaactagatccccatctctcaccataatcaaaaagtaaataaaaataaattaataacttaagtcataaagctactaaaataaaacattggggaaacactccaggacattgtctgggcaaagatttattgagtattatcccataagcccaggcaaccaaagcaaaatgtaaaagtgggataatatcaagctaaaagcttctgtacagcaaaggaaacaatcaactaagtgaagaaacaatacacagaatggaaaaaagtatttgcaaactacccatctgacaaggaattaatatccagaatatataaggagctcaaataacaggaaaaaatcaaataatcaaattaaaaattaggcagatgatctgaacagacatttctaaaaacaagacatataaatggccaacaggtgtataaaaaatgttcaacatcatcagagaaatgtaaatcaaaaccacaatgagatattatctcacctcagttaaaattgcttttatccaaaagacaggcaataacaaatgctgatgaggatgtgaggaaagggtaacccacaagcactctcaggaggaatatgaattagtacagccactgtggataacaatctgcaagttcctcaagaaagtaaaaataaatctaccatatgatccagcaatcctgtgctggataaatattaaaaggaaaaaaatcaatatatcagagtgatatctgcattcccgtgctgcttgcagcactaatgacaataaccaagatttggaagcaacctgcatgtccatcaacagatgagtggatagagaaaaggtggcacatatacacactgaagtactattcagtcataaaaaagaatgcggtcctatcattggcaacaacatgaatgaaactagaggtcataatgttaaatgaaataagccaggaacagaaagacaaacttctttttttttttcttttttttttttaattaaagttttagggtacatgtgcacattgtgcaggttagttacatatgtatacatgtgccatgctggtgtgctgcacccactaactcgtcatctagcattaggtatatctcccaatgctatccctcccgcctcccccctccccaccacagtccccagagtgtgatattccccttcctgtgtccatgcgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccatcaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggccgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacatttaagtctctaatccatcttgaattgatttttgtataaggtgtaaggaagggatccagtttcagctttctacatatggctagccagttttcccagcaccatttattaaatagggaatcctttccccattgcttgtttttctcaagtttgtcaaagatcagatagttgtaggtaagcggcgttatttctgagggctctgttctgttccattgatctatatctctgttttggtaccagtaccatgctgttttggttactgtagccttgtagtatagtttgaagtcaggtagtgtgatacctccagctttgttcttttggcttaggactgacttggcgaagacaaacttcacatgttctcacttactgtatgaggtaaaaatgaaaacaattgaattcatggagatagtgagtagaatgatggttactagaggctggaaagggttgcagggaaggagaaaagtaaagatggttaatgagttcaaaaatatagttaaaatgaaaaagatctagtattgatagcatgatcaggtgactgtagtcaacaagaaattattgtacattttataaaaactaaaaaagtggaattggaatgtacctaacacaaagaaatgataaatgttttagacaacagatactccctttactctgttgtgactattgcaaattgtatacctatgtcaaaacattacgtgtaccctgtaaatatatacatctaatatatacccataaaaatttaaataaagttttaaataacttttaggttaaaaatgcgaagatattaacatggatatcattttccagttagtgacagaaaaaaaattgttggaatttaaaagtggggggaaaaatccactgacaatagacaaagcaagggaagaagagttgaattagaggagaaagcagcactttccattcaaagtaatttgatccaaaatttccacaatttccctgtgatataggtaatcttctgagaaaatctgcattgtatattgtgggatacaggattcctgtgaagttttgattattgacgtatttaacatttgtatattctatcgtgcatggtagtttaatctcaaaagagaaaaactgtttccctttaaaagttgatgtagtatatgtcacaagctgtggggaagggggagagctatgtaatccaaccaacaaataatttcaaaggttaggaaaatgtctttcttgcattggttaaaaactaataaaactcctatcagacattatgagagcaagattgtctggttctagtacctacagagaaattttgcggtggaatataaatgaatccaaacaggtatgccactgcaggagatacaatggaatgtatactcagagtttctcaaaacacaaatctaccatatgtttaaggctgaaagttaaagtaaaattttctggtttttgaccatttgaaattaactaaaattggtaaagcatttgtgaaatgacataattgtgaaatctcccataaaagtattttttaaattttggggaaaaagaaaaattgatacaagtaggaaaaccctgcatgtggaaatgcaagctggaggggagtacagaagaaaaaataaataaacttttgttacttctgaatatctgataatttccagatctacgcaagatgattaagaatgattacagaaatttaaatattttcataaagatttaaaatgacaaatcctagatggtagacattactgaggtcttgtgtctcttcctttatacatatacctattgaagtaagttgagactttggtcaatgaaaagtgaaaggaactggtgttggtcatttcaggatagaagcattaaagagtcattgctccacccatgtcctcttcttccctcctggtggtaacaaatgaagttgcaataaactgaaacagctggaaatacagagtgagtcattaggtagggaaaaaaactgcttcagagattcctgcagttttgcagcaaattttctgtaacccagaaccaaatgtcttcggtgttaatcttctaagattttgtctttgtgcaccacagtataacatatcctatcctgagagagacattgaataaatttaaaaaaaatggttgatgtgtttttatacttgaatgcaaatttagatagtaaaattgccacttaagaattacaacattaaatagatgaaatgttgtatttcagatgaaaaatttatctgtttagaaaattatacacaaagccaagattattggtttgttttgtttgtttgtttttcaaaatcttctttggctccataggactgatcagtaaaaatgataaatcttcacatggaatttaagacctaactcgacatatctttcaatttctatctgatactagtgggaatgtactcctaattttcatgtgcttgaaaattcaaccaaaagtacagaataatgaaaaatgactaagacccaggatacatagtgacactccagttctgcctggagtagaaactgtctttggacagctcatgcaatctctctcaatttctcatctgtaaagtgaagtggttggagagtagaatctctttaatttacgcaatatattagtccattttcatactgctataaagaacggcctgagaccgggtaatttgtaaagtaaagaggtttaattgactcacagttcagcatggctgaggaggcctcaggaaacttaaaatcttggtggaaggcgaaggggaagcaagcaagcttcttctcaaggcagccaaaaggagacgtgcctagtgaagggggaagagccccttataaaaccatcacatctcgtgagaactcactcactatcagaacagcatgggggaaactgtctttatgatgcaattacctccacctggtctctcccttgacatgtgggaattataagaattataattcaagatgagatttgtgtggggagacaaagcttaaccatatcactcaatttcaaagacctgcctgcagatgcctgctctactttaccacacaaaggcttttatttctgttgtttcatttctctgacctatctttttcttattattatttcctagaaacatcttattgtttctatggtttatcaatgtttcaagtacccaccacaatgccactttttccataaagcttttcttctctcattaaaattgtctttgtttgaattatattacattatcactgcctcttgtagtgtttattttttaatccatcaattattttcatattttgcctattcaatatattataaatttataaactgtgaaatacacgtttaagattgaaatacacatttaagattacttatatgtcacacaatatccaatatggcccttttatgttgtatgtgctctaaatacacttttaagaacaatgggtaaaaaagcacaaaaaaacacgaggacaaaaataataaaagagaaaactgaaacatggcttgtagagaattattttcctataagaacttattagaaagagatcactacctttattctatcaagatgaattatttgttctttgactctattaatccattttccaaatattacacttctatttactattttcttgtctaaaacctaaaagcttttacttaatctaggtctcagagttactaagtactatcatcattgtttggagcgactttacttgggggaactttgcacttcactgatctttaaagagtggagaataagaacatttcagaatgcattacgaacattttaagagcagagaatgttatctatgtcactcaggttctgttggattatctcacacaatactgattgtcacagtgtggaatcaagaaaaaagtttaatcaatggttattttttaaactgcattttgaaaggacatatataatatgtatatttatacatatatatttacattcacatgaatatatatatacacacacaaacatatatatgtctgatataatttttacatctcatccaaatatatacaaagtgagcagaaaataaggaaaaatccatatctgtctggtgtgcatgtgtttaccactcctctgttgttaagcagcaaatatcaagaaaactcttaagttgcttgtgtttaataaaagactgacatgttccaagcaatagtaaactcaattatggtttgcataatgattaacaaagtgttattctcacacactgatttatttggtattcacttaataatataaaacagataaagcaactatgtatagataaaaaataagaagattgtcatttgtctatgatcaaattgttaaaaattttaaggtcatggcttgagcctaagttttcttattctaaatctatactgctttgtttcttcaatcataagtggtatgtcaaaatttttccacttggaaaattttaactgtattttttctttaatcctttcaatagttaactttatttgctcattaaatagagttgttttaccagcatacaaaaatgtttactgttttctgtctatgaaacagtctatagctgttctgaaagcaccacgatattatttgaagaatttgcttttccaattgaacaaggtctactaacattatatttatggacacgttcctcttaggccagtggatcaaactattcaatcaaatcttccctccttagaatataattcttatcagagatcaaaagagaaaagtacactgatcatgttgagatttatcctgtatcccatccctaaatctctgcacctgatttagttctaaatagctcccaggtgctttttcctagctagccttctgttaattctgagaactcattatatctttccagtaacatacctttgattcaattagccagtgatatttgtgttacttcttactaaagaatcttggtactattggtcataatcaatttaatcataaatatttttctcaatacattacatgtcatacaggactaagcacatacttaatcaaatgtgatgattggaagacaaaagacttaatgtataattgaataagaaatgtattactcaatataatgaatcgtctactgagaataacattcagtgacctgcccagcccagaaacacgttaactcattcacttagaaaatgacattttgttactcgagagctagaatgcatgagatgtaattatcactgggtaactacaagagtgatttttgcattcccataagtctcagggttaaatttctgtacttcatcatatatatgatggaagatataatttctttaatgatataatatgatatgaaatgatatatattatgatatgatacaataagaacaacaataacacatttatgtattagtttttcaaccatgggcaaaacaccagacacccaatttatttaaagtacacattgtgtgtttgagatgcactagttaggttcatttaaagctcatgtaggtatctctatatttaaagaatacctttaaaagattttaaggggacacccatattaagaggataattggtggactctattcagtaactgtccatcatatagatcatcttgcttataatcataaagccattggatccgtcattgatattatatttttccaagtccattgtataactcgggtctgttatgaagtagaaatggttattaatgtaaacaatcaaaacatataaaaaggagataacttagttttggatgacagcgaattgtaaacaatgcaagaagcaggttacagtgacaaacgcctataatcccagccctttgggaggctgaggtaggtgaatcacatgaacccaggagttccagaccagcctgaggaacatggcaaaaccccacctctataaaaaacacaaaaattagctggtcatggtggggtgcacttgtagtcccagctactcagaaggctgaagtgggatgatcacctgagcccaggaggttgaggctgcagtgagctatgatcgtgccaatgtactccagccggggtgacagagcgagaccctttctcaaaaataaacagacaatgtaagaaatcagaagttaaatatggagagtgttgatcatataagtgtaaaatacctgaaatcctcaccaaaattcagtaaagtaatatgataaagtgttattaccctttacataaagaaatagctcttccaaaattccagaaaattaataaaaactaaaaattaaaagtcagttttaaaacaggctgatgaatttgtattataattaatgtttgaggaatcaaaagtaatttattattttcatgaatattggaacaataaaaatatgttttctataagggtagcaagtagctgatttacaaataaggcatagaacttcaacctaaaaagcaaaaacaaggcaaagctgtgtgtgtgtgtgtgtgtgtgtgtgtgtgtgtgtgtaatttaaaattaaataaaaaacaattgtggtagcttgcgcttgtcagttacttgataggcagaggcaggacggtcacttgagcccaggagttcaaaactttaaggtgctataattgcacctggaaatagtcactgaactccagcgtgggcaacacagtaagaccctgtctctcaataaaaaacaaggaagtagaaaaaaacacagaaaagaagtcaagagaataggaaaaaagccagtcatgatggttaatagtggaggaagacagtactgagaaaaaagtagaggagttaggcaaattagacatttaaattttctttctttcttttgaaataatatctctgcagtaaattatttggaatgttctatttaaaaaaattaatcaacctgcatttctggtaaccaatgatatgtctttccagttgttatacctagcaaggcactttttgaaccaatttaaagttatttaccagcgaacaaaggaaagtgttaccaaaaattctaacattcaaatatttatttctcctttgtaggaaaagtgtactaataagtgctaattaacatttcttctgttaaatacccaagttattctttgttttcaaaattgtaactacatttcattgcaaattgttttcattacttttaaacatgcagagaatgagactggatttttaaaaatagccagaattttgatgcacgtaagacattcacttaaaacaccaaaagtttagaaaataagtacacctcagaatagaagtacttctttgtctctccttaaataatcaaaattgtattgcaaatttgggtactttcggccattttattttgagaagactgtttagttgttgttagtgaaatcaaaagaaaaatagaaaataaataaaagtgatttaataaaaaggtatgctttgctggtttcctttaggttactggttgtttatttttctcttgtctcacatataatgaatctctttcactgtttaaaggtatcatattgataacaatgaaagactatttactgaacttattgatgtaattttgctcataattactaaatataaaaaaattaaaatattctcacaacattctaaagtaaaaatatttggaatgatttttacttacattatcatagatatatctgtgtagatatatcttattctatttattttatctaaaataatttattttgatattatttataaacaatattctattgcattagtatacaatgcaatacagattgcattgatttttaccctctagaaaagttcagaaagattttaaaacataagtagcctactccatataaaatttaagtacacatgggcaacaacagaaattggagactattagttgcagggcagagggagagaggcaagggttgaaaaactaattattgggtgctaagcttaatacctgggtaatgagatcttttgtacccaaacttcagtatcatgccctataccctaggtaacaaacctacacacgtaccctcaggatccaaaataaaagttggaaaaagaaatctctaaagaaagtaatttgtttttcctttgttatcgcatagaaccttatctgtagttcttttaccttatttggtcttgaattattatttgtatttatggattgtgtcactattaggggataaggtatttaaagcagggactatggtttgctattctgtgacttttctacaactctgaacgtgattcctaagagaagtgagtagatgtttgctgactggacctggaacatgtgaatatgtctattattatattttcttaatatggtatgcttaatgtagtgagctaaacaaaataacaatgtgtatagagtattgtttaaaataccccacttccaattgtttaaagtgcaaaagaaattatatgtttgaaagttaggtggaataaatgaagattaaatgatatagaactactcagaaaacaggatgactttgtggggaagtgaattttgaccctgcttttgaagaatatatcaaatgtaacttacagagtaaggatatgtgggaagaacataggctgtggatttcagaaaatgctcttattttttagctatgcaaacttaagccatttaacctaggattctattttctaatctgtaaaatgaaggtaacagcactcaccttaacttactgggtgttttgaggtttaaatgaaatacagaatttgataatattttgtagtttctaattttgagtacacatctaaaattttttcatctatttctttaggccatcagagaataaaaaaattaacatttaagaaaaaaatatgtttgccttgtaagtaagaaatacagtattatccttccatatctcattcttgattttactatatccaagttgataatatagagagaatttttatattttattttgcagtgtaccagataatccttcagataattggtataactgttcaatcaacttaagattatgatattctttactattcattctagttattgcaacacctgtagaacctatatttactttcctgtcagtcagctaggggaccatacagactttaaggactggttagagaatgataatattgatagaatagaaattgattctgaaacagtgaaagaggtttgactcttacatataagactataaatctatgaaggcggaactccatatacttttttcaccattattttctttcactttgatgcatggcacctaaaagctactttacaaagatttgttgcatgcatgcatgaatgaatgaatgaatgaatggatgaatgaatgaaatttaaaaataaaattttaaatccacaaaaatgctttatgtaaattgatcgtggtgcataagccttttgatgtgctgcaggattcggtttgccagtattttattgaggatttttgcatcaatgttcatcagggatattggcctgaaattttatttttttgttgtatctctgccaggttttttacaatactgtgttaaaatattaaaaactagttcattagtatcatgagctcaaagcaagaaagaacatataaaaaattttcagtgttaatttctacttaagctactctacaatatctgtttaataaaaaaaactgaaaattttaaattaacatttatagttgttataaatacacatcttaatgtgtgtgcatatatatatatatatatatacatcttgagacatatatatacacaaacattgatatatatatatatatgcacacacacacataccttgacatatatatatatagagagagagagagagagagatcacacatgtaaaaaatttgaattaagccctatttttggttcacaagtcttgcttcttccagaatttttctgtacatgtctctcaagcagacaagtacctcggcttttcagaagcatgtgtgatcctgaagagatttgaaaatacggactcctggtgctttatgcaaggctataaaaaagctccaattttcaattatgattgggtaaaatatttctcagttatataatatttttcttgatattaattctgcaattttcttttcagattttctagactgtaataacgttccactgatatataataattctatagttgggaaaatgactaatcgcatgaaaaagaaagggtactgtgagaccatcacttgacaaaaaaatcgatcatagtctgcctcaacttgagaggcacagtctttataagatatttaattcgtcatagtacattgcctgcaggagtgttacacagaagtccaaccagtgttttccatggggtttcaccctagatctgatgaatcataatttatcggatgaagcacaataacatatgtttatatgttctttttaatacctctcttatattttacttatgtatgtatttttctgtccttaggtttaggggatacgtgtacagatgttaccctcagcagtgtataagcgagaacacaggttcgtaacaattccgattggtaactatcatgcaaccagctaaattccaggtaaacatatgagaatcaaaataccaaaactttaaaattcaaacaaacaaacaaacaaacaagcaaatggaaatctgtttcctgcaaagtatgaaatattttaaatttttctatccaatttcttcaaaaaaccaagatggatctcttcttaaacctatacctcttcaaaaattggccatattgaaattaaccttagaaaatgtgtgtctcactatctctcccctctaaacacacacacacccacacacacacacacaaaagcatataaagaaaacatacttgtgtcttattatgcacaggataattgctaatgtaataggcaattatattcagaaatgatttgcatattcacaatgtaaaaatgctgttatgctgtggatatgcaatgaataattaatcagttacacttgaaacaatacctatgaaacacacactggtgtttagcaataatcatgaaagaatcattgcaaatatgtatgtgaaatagattacaaatctatcattaaaattgattcagcaatttaagatatttgatttccacctaccaaattattaaagagataaactttactaggtaacccatggttttggttgtagatcatatgataaaaaggataaattatagatttgaaaagatcatgaatattatgtatttcaatatcatacttagttttataagtaatataagtaaacaatagttatgatgtttagatataatttacatcctccctttttccctactccataaaatatatttgagaaaacatacaatcaaacattaatgcaaataaagtcattgataaaaatagagatcacaagagcaattccctgaagatagggagaataatagaaatggttatgaaagcattgcaaccaagttagaacagttactgagcttggaaagaaacatttaactttgaactttttagcaactatatcgaaattggaaatgtaagggattgtatcattctcattctctagaaagaagaacatcatcgttttatctggaaagaaaaactgctagaactaaacgcaagaggaattgttttttgtaacataacgtggtatttcaacataagtttttttttaaaaaaaagatgctaagatctcttgatataattttattttacatttctaatatcctactaatggttagctttaatgattgtaaaactttcaaaaatgcagtcaaatcagtaaattttattataattttcttttcaaaatttataattgataccttaatttctcatattacaaatatttaaagaataaaaaaatgaaggcaaatattatctccaatctaagcctaataatagtcattattcagccttgtcatcaccctgatcattttttcttgactctaggctctgtttgtcagtatcagctcttaaaatgacaaccaaatcctgctcaataattcaaatatagtttctagtcaatctttgtccttcatgtctttgaacatattccctatatttcataatcacccacattgtgtgtcccacttcccaaagcataagttcaaacaaacaaagaaacaaacaagcatgtctagattatcttggagtttaggtatatgtgtgtgactcagattctagatatcacagtgagagaactggatttaaaagggagcaacctgtggaggcaattgtataagggggatgtcatctccagacaagtgtcatgtgtaggtatttcctgaaacaagcagtaaagaacttgtgacatccagccctgagtcttataagacttggtagttctgagtttctgctacagcagctgctgtgatatgtgggttagatgtgattcctatctgtaaagctacagaatctgagttatggcactcatggagactgtcttaattcagcctgctataacaaagtaccatatactaggtggcctatacacaacagaaattatttctcacagttctagacactggaaaattgagatgagggtgccaggatggtggggatctggtgagggtcctcttcctcttccaagtttcagactgctcacttctcgtgcatcttcacatggcagaccgagggcaagctagtctctgacctcttcttacaagtacaatgctaatcatgagggtggagtcttcatgacctaattacctcccagagaccctacctccaaatatccttacattgtgggttagagggaaagaaatattcaattcataactttctattcttccccccaaattcatgtcattctcacatgcaaaatatattcaacttaacagccccaaaagttaacttacactagcatcacctctaaagtttaaaatgcaaagtcttacctaaatatcatctaaattagatataggtgcaacttgaaagccaattcatcctgaggcaaaattcctctccagctgtgaatttttgaaaccaaacaaattgtgtgcatccaagctacaatagtaggacaggcataagataaacattctcattccaaaagggagaaataggaaagaaggaaggggtgatgggtctcaagcaagttcaaaacctagcaaggaaactccaggtgatcttaaggctcaaggataattctctttggctagatgctcttccttctgattccactggggtaggtgtcctgccttccagaattattggatcaggagttacatctttattgctttgggtggccctaccctcacagtttggggcagcccctctgctcatggttttgagtgaaggccatttgtactgttgaaagcaacgtgaagtccccaacaccaacacaaaatacatcctaactgttctcgcttaacacactttctcattttttttgtgatatggataggctgagaattttctcaatatttaatttctagttctttttttcttaataatttggtcttcaagtcatttatctcatcacacattttactatgaaaagtcagaaagaagcaagcacttcttcaacattttgctgagaagtttcttcaattaaatattaattttattgattgcaacccctaccttccacaaaacaactagaacataaataaaattcagcaaagttctttgctagtttataacacagatcacttctgctccattgtccaataacatgtttctcgttttcacctgagaccataatggcagccataatgcagtgttctatatatgatttatgtattatttaagaaaacagaaactttctctacctctcttctctttctgagccctcaccagaattgtctttaaaagtctcttcacaagagtcttagcttcttctagcatatacttctttcagcttctatccattatccagttctaaaattgctttcacatttttaggtacttatcataacaacatcccaccgtctcgataccaaaatctgttttaggattctccagagaaacagaatcaatagattatatatatatatatatatatatatgaagatttattataagaaattggctcacaggaagctggaagttgagaaattccacaatctgctgtctgccaattggagacccagaaaagttggtggcataatttgaagttctgagacccagagagtcaatgatggttccagtctgggtatgaaggcatgagaaccagaagcactcatggcaaaagatcgatgtctcagctcacacagtagggaagagggcaaattcaactttcctccaactttttattctattcaagctctcaacaaattggatggtgcccaaccacactggggagggccacatgctttactcagcccaccaattcaaatgctaatctcttccagaaacatccttaaagacatacccagaaataatgtttaaccagctatctgggaatccagtggcccagtcaagtttttaattttttttattattttttatttttttagttggagtcttgctctgtcactcaggctgtagtacagtggtatgatctcggctcactacatcctatgccccctgggttcaagaaattctcctgcctcaatctccctcatagctgggattacaggagtgcactaccacatccagctaattttttgtatttttagtagagactgcatttcaccacgttggccaggctagtcttgaactcctgacgtcaagcgatccacctgcctcagcctcccaaagtgctggaattgcaggcgtgagccactgcacccagcaccagtcaaaacataaaattcaccatcacagagaccatgagctctaccttcagccagttgaaggagaaaatcctgaatttgattttcagcattcttagtcctatgtctacaggaggtaaagttctcagcatacatacagctttcagattgtgtacatgcgcttaaactggtaattcaaattcctgagctcatccttttcttttcccagtctgtctagcaacattaggaaaaatcagccaattactttatatttctaaatttgagacaaatattcaaaagtatcatatactcagtcactgagatctttgcttcttataagtggttggttaggagtacccaatggtgactatttatttatctctattgccagatcattccatgggcaatcagtgctctttgaactgctgaaaatagtgtcattatgagaggagagtgttcccttgactttgacccccttgaccttgaccttgtcccttcatgagcaggaaccgaaggggctcatttcattcagcctgcagtccatggatggctaagagttaacagctcactaaagagtgacttagggccaagattccaggtttgagggtagagtttagccaggagcccagccattctgcatcaatcagaatctaaatctaatcatgttccagagtcaattccaaaaaccccagaaccatttctgaacaaactcatctttaaaaatctcttccttttgaaccattctcagtatcaaaatctgtattagttatggaaacagaactattaggatatacattaatccattcatgtattataattattacatatatataaatgtcattcttaacacagtaatgaatacattaatgttatattgaacaaatttaaaactcattctcacggataagtagaatcagcattcaaaatatcttgacattaaaaagtataacatatctaaaaataactttatgcataaatatattggcatgagcggccttaatctcccacagatgaataagattaagattaggatgatagggcctaccataagcatgtgtgcgatcaagtttaatttataaattagtcacagtgctcttgcattttggggcctttattaagtaatgtaaacgttacttgaacataaacactgcaataaccgtaacagtcaatttaataatcaggatggctaattgaataatatgtgatacactggataaaaaaagattcatgtcataagagggagggagaaagatgatgtgagatttcatcatgctactcctaatggcacataatttaaaatatctgaatggtttatttctggaattttccatttaatattttggacagtagtcaactactttgactatacagttaccacaggtaactgaaaccatggaaagtgaaactacagataagtggggactactggactgttagtctttccaccagcattccacaagtgactccacagccttttaccagtgtaactctgcattaagggaagggaaacaatcatgagatagaaacttaaaaataaatatgcattcattcactctaaggaaagtaacaggcaaggcaagggttacaaagaaaagaacaaactttactctacctagcaagctcacttcaaggacaattataaggtaacactctccggaaaggcaaggccaaagaaatgggctccagacacccccaatccagagcaagtttgaaggggaaaaaaagagaaagacaaattatttccctggtttcttaagcatgattatgttttacaaatgtctgtatttagccagttcttgttttccttgcaatgcagctacaaggtcaccagctatgcaaggccacaagttatgttatgctatacgttacgtgacatatcaccgtatgattaactgcttttgttttgcttctgtaggtctgcttataaaaaccccactctgtctttgttcaaggttcagctttttgtatgcgaatccactgagccagtgcgtacctaaaataaacaatcctcctgttctccatattggtctctcctgtcctcagtttcccgcaacaatcagaccttttaaggactactggacactgtccctgaacccatactaacttcaggagacataaaacatcactggtgtctaccagttagaactggggcttatggaggtcaggtgagcagtggagtttttacacaggttcaaatcacaaggggcccagtgagtccccagacacaccctgtggttacttccccagttctggaatgcacaataggaatatacatactcagcagctgacttgtggagtgaagattgttatggtagaacaggacaagtggaagccactagaactatctctaaccaggaaaactgtaaaccaaaagcaatatagtatttataaaaagattgcagaggttagttctatcatgaagaattgaaaaatgcaggggtggtgatttccatcttatctcaattcaactcctctatttgatctgtgcagaagacagatggatcttggagaatgacagtggattatcaaaatcttaaccaggtggtaatcccaattgcagctgctgtacaagatgtagctttattgcttgagcaaattagcacatctccttgtccctagtatacagctattgatctagcaaactgttttcttcattcttattcataaggaccaccagaagtagtttgttttcagctggcactaccagaagtatactttttctgttttacctcagggttataaaaattcttcaggccattgtcataatttggttcacagggatctttattacctttactttctataagatatcatgctggttcattacactgataacattatgttaattagaccaagtgagcaagaagtagcaactactctggaccaattggtaagacatttacatatcagagggtataaatccaacagaaaatcaggggacttctaactcagtaacatttctaggggtccataggtcctgtcaagatatcatttctgagttgaaggataagttgctgcatctggttcctcctacagccaaaaaaaaaggagagagagagagagagagagagagacaatacctagtggcctctttagattttagagctaaaatattctttatttgggtattcccatttacctagtgatctgaaaagctgctagtttgagtgggacccataataagggagggttttaggggaggtccagattgctgtgcaagctactctgtcccttgggttgtatgatccagtagatccaatggtgctcaaaacggcagtgacaggcattctgtttggagcctttgataggttcctataggtaaatcatagtacaggcccttaggaacaaaatcttgccatccgctgtggctaactatgctccttttgagaaacagctgttggtatgttactggaccttagtcggaactgaattttcacatgggtgataattcaaccatgtgacctgagtttcccataatgaattagatgttattaacccaccaagtcacaacattgtaccttacatagcagcacttcatcatcaaatggaaattttatgtatgtgattgggcttgagaaggccctgaaggcacaagtaagttacataaagtggcccaaatgcccatggttgccacttctgccacactgtcttctctctttgagcctgcatctatggcttcataaggagttccctaggatgacatgaaaaggaaagaagacttaggccaggttgttccctgcgcttggaagaagaaatggccaaaagggcaatcatatatggattcatgggctgtttctgtagccaatggtttgactggatgatctcagacttgaaaaggatataaattggaaatttgggaaagaagtttgtagatagacctggctccaaatatggcaccattccccagggtgatcagccagctagctacctggtggcagattggttacttgaaacattgtcatcacagaaggggcatcattttgtttttaataaaatagaaaattactctggatatgatttgccttctgtgcatgcactgcttctgtcaaaactactatccatgcacttaccaaataccttatcaccatcatggtattccacataacactgcttctaataaaaaaacaaaacaaacaaacaaacaaacaaacaagaaaacctcatttcatggcaaatgaagtgatgcattgggcccatgctcatagatttccctggtcttaccatgtttcccactattctgagatgactggtttgataaaacagtagaagagttttctgaaagctcagttatagtgccagtgaggtgataatatctcacaagagggaacaaggttctttagaaggctgtatatgctctaaatcagtgtccatagatgagttatttctcccattgccagaactcatggtccaggataggaagagtagaaatagaagtagcaccattattcctagtgacccactaaaaaattattgctttttgtttctgaaaccttatgctctgctaacctagagatcttagttacaaagagggaagtgcttccacccagaaaagaaaaaaaaaaagattcctgacacttagttaagactgccactgggtcacttagaactcctcatgcctcaggatcaacaggcaaagaagagttactacactgcctgtagttattgactctgactactagagtagattggtctactgttttacaacagaggtaaggaaggctatatctggaataaagatcattgaaagcctttcttggtattacaatgctctttgatgaaggtcaaaggaaaacagaaaacaactgaatccagtcaagactactaatggctaagtttcttcaagaataaacatctaggtcacccaagatcagctgaggtagttaatgaagccaaaagaaatacagattgggtagtagaagaagcagggatttatcctaggtcacagccagctgtgaccatgtgactagttacagaaaaagataactgtaattgacatgagcatttccttcttattttggtataaatatgtgcatgtttgtataaaatattttttattgtctctcttatttcctggtcatgtaacataagacatataacaaagtattgaagtattgttaattttacatcatgacaacaaactacatgtttatgttcccccaaaattcacatgttgaaatcattgctcctagtgtgacgccattagaaaatgaggccactgggaggtaactattagacataagaaggtggagtcctcacgaatgggattggtgcccttacaaaagggaccccagggctgggtgcagtggctcatgcctgtaattccagcactttgggaggccaaggtgggtagatcacgaggtcaggagatcaagaccttcctggccaacatgatgaaacaccatctctactaaaaatacaaaaattagctgggcatgttggcacaaacctgtagtcccagctactcaggaggctgaggcaaaagaatcgcttgaacccgggagccagaggttgcagtgagctgagatcatgccactgcactccagcctggccacagagtgagattccgtcaaaaaaaaaaaaagttaattaattaaaaaaaaaagcgccccggaaaactttttttcctcttctgctatgtgaggatacaaggagtcagcagtctgcattccgggaaagaacccttacctgaactcaatcatgctggcaccctcattttgaacatctatccttaagaacagtgaaaaataaatttctgctttataagccacccagtctgtggtactttgtcatatgaaaccaaactgacttatccatcatagtaattaagttatgggatatgaagaaaagcaaatgtcactcaatgactttacctcctttttagagcaggtggtgatacattttccactgtacacaagatagatgtatcaagttaggagattcagacctagctattgtcttcatttggagattgagtatgaaagagatgcatatgggtggttaagttaacacgggatggacttacaatgtttatttgtcaattttactgggccacatggtactcagatatttgcttaaacattgtgggtgtttctataacacctggataaggagggattccttctgtctgactaccttttagctgggacaccaggttgttttcttttcttttccttttcttttcttttcttttcttttctttttttctgccttccgtcttaaactgaaagattggctcctgggtctagagcctgttggcctgtggactggaattatagctttggctgtcttggatctcaggcctttggactgggagtgttatggcattggctcttctggtgtagactgcagatctggctgcttgttaacctgcataatcatgtgggtcaattccttataataaatctctttccatatatattctatatatatatttatagaaatttatatatattctatagaaatctatatatatatagaatctatatattctatatatagaatatatattatatatattttatagaaatgtattttatatatatatatctcctattggttctgtttctctggagaaccctaatacagcagctcatatctatatattacattattcaaaaattattttttctaataatgccattcttttgctgcaatctttttggatattgactctactttttatttctgaggatcaatttcaaggttattcagtgtggcataaatgtattcaccccagttactgatagggttttgtttttaatttgaattaaacacaaggcccaagtcagaggagtttactttgtcatgctcactattgtatataatttatcatttgttgctgactcttctagtcaattcataattgtttctattgtgccagatgacatgagattgtacaacagttctgtgaaatatactacatttactaccactcagccattgagttttattcaaatagtatctgagtctcagatgtcatgattaactcttggtcagtcatggctctaagagggtcctatgaggtgttacataatatgatacctgtggcccagcccggtggctcctgcttgtaatcccagcactttgggaggccaaggtgggcagatcacctgaggtcaggagtttgagaacaggctggccaccatggctaaactccatctctactaaaaatacaaaaatattagttggatgtggtggcatcctgtagtcctagctaatcaggaggctgaggtgagaggatcgcttgaacccaggtagtggaggttgacaatgagccaagatcacgccactgcacttcaccctgggcgacagagtgaggctctggctctataaaaaaaaataataataacaaataacaaatatggtacctgtttacctcaagatgtctgtgcttagggctctctcttcctgcaactttctttctccctgactttctcatagttatttcccttattttttctagatctctgcttaaatgtcatttccttagagttctccctttgctatcaatctaaaatagctttctactcaccatatcatcttctcctattgcctcactttattttcctttgtagcaagtgataacattaggcaacataccacactttccctaacttatatttttcagtcttctccagtaaaattttagcttcccaaaagaagacaggctttttctttgttcatctgtgttttcttcttttttttccctagccattcccccaaaatagttgcatgtctgacaagcagtaagtataacaactgataatattctgttgggtgaatatatgaatgactaaatgagtgaataaataaacttttattttaagtactcatcaagcatcctttaaataattctggcatcatgttaaaatcaacataaatccttcccatttttttaaatgtagacttacataaacctttcttatgtgacatcttgattgtttacatcttgctaaagattttgtaaaaagacaacgtgttcattcttttcccaacatgatttcaattctataattttgacattcaccagcccagaaaatacaggagttcctcagattatttaattttcctaggagacaatctctgaataatgaatacctcaggaaaggaggctttcctagagcattttcagtatcacttggaaatagacccaggatagcaaccacttatttttttgtggtatcctcttataaagtcacttaataaagtactggataaaagaagtagatttatattatttctgctcttctcagaggagctttattttagacttaactgacttcccctacctactaaacagcatctctaaaataatgttactaatttccagtttgttagccactcttccaatccacaaacaatgactcattagtcaacagaacatcccttcactcagcccctccctccattctgccatcgacgccacctccagcactgtacaactactgagtgttctcactaggaaatgcgtttattctcaaaaacaaatgtctgtatcagacatgttgggtgaattataactttagtttttatgtagtaagtatattttcaagatataatagctaattagaggcacttggaaattattaatagtgaagttacctatttgagcaccctgacgtttcacatagaatgctagtttcaagctatactaagaaattaatgctgtataatttatatcataaatatctgtagctgtaattttttcttatgaatttaggtttaataaatatttgtaagttacttttacatgatttcatttttttaattcggtctgtgggggatataattttcacatacttgtaatgtaaaattacaatttccagtgctattttatgatattaattcatctgatacatagaaataataacacctggctgggcgcagtggctcacgcctgtaatcccagcactttgggaggccaaggtgggcggatcgcctgaggtcaggagttcgagacaagcctgaccagcaaagtgaaaccccgtctgtactaaaaaaaaaaatatatatatatatatataaatcagctgagtgtggtggtgtgtgcctgtaatcctagctacttgggaagctgagacaggagaatcgcttgaacccaggagatggaggttgcaatgagccaagatcatgccattgcactccagcctgggcaacagagtgagatgccatctcaaaaaaaaaaaaaaaagaaaagaaaagaaataataacacctaactattgaggtaagttttttttgtcatatatatgtatatgtacatatacatcattaataaagtgatacttggaaaatctggaatattatctataccacctctcattaagcaacattattaagttaacaatcacttatattttgttttctattttgagtatattaatttgatattcaactactcttattagaagtagtatttgtaagtaaaactagcaaaattaaagataaatgttaatattcaacagaatatttcagatgtattttcactataattaacactaaaataatttccttttataactcacaatgtatgtagttcttattgtgggataattagtctctgtctagtcactgaaaattactttgaaatacagttttaaacattggaaatagtgtcctgagcttgtgtgttatgttattttcttgtatttcagaaagatcactctcagtataactctgtgaatgcttgcagctgcacacttttgaaagatcacataaatgtacatttgaacgtgtaatcattcttgcatatgtcagtactttacttgaaatctcaactaagaaaggataaagccttgatagtcacatatagcatgagagagaaaaaccatatatttctactaggcctcatatcagaaagagaataggtatggattgaatactaatgacattggggacttcttttgaaagctcataacagatgaaccaggttctgtaagttcttctgaaggaaaactccatttctagataaatatgtctcctagtttttacctatagttttgtatttctaattttatttagtatttgggtaatttaaacatatttaaacagtacatctatgttaaaattttttatccattcatctgttgatgcataataggttgattccatatatttgctattgtgaatagtactgaaatgaatgcttaatatgtggaatcttaaacgattcaagtcatagcaacagagtagagtgactgttacagaggatggaggatttgagtgggggtggggggtgatgattaatgaatacaaaatttcagacaggagggaaaaaaatatatatatagttctatggcacagcatggtgaatataggttaataatagagtattaaatacatttcaaaattactaggagagtacatttcaaatgttctcatcacaaacatattaaatatttaaggtgatggatctgttaactagtttgatttaattactccacattctatttataaatcaaaacattgctttgtacatcatacatttataaaaagtaccgatttacaattcaacaaatttctaacaatatactgaataacaaaatgaactaaaattaaataaaaacataacattggctcttaaaatgtctgaaagtagaaaaaatagtaatagttttaaaagtaaaacaaaaataagttgttaacacgtgagcaaatttttaagtatgttattgtgtgcaatgctgattttcaaattttactacatgattatagaacagaaaactttaacttggaaaatatagccaatttttcataagcactgtaaacattccatactttctggggccgaatgagataatacatttttactgtcaataattgatgtcacagatattaacaaaatagctcactaataatggctttccataaagacatgtgcacattttaactttatattctaggtacaatgcttttgttagtattacttcattgctctataactataatgtttttattaataaatacagtagcatttgtatactgttgattattggtcttatttgtacaattaaatggctcagtctgcagagtttcttaaattgtttcatttctcaaaaagtttcatgtaatttagcatattttctccaaatgccattcattttacaggtaggcaaaattaaatatatatacatccacatgctaaaatttgtcattttagtgactgcttatatgttattagacatgtctatcatcttgcaaaatgcataatttaaaaaatttgatatttgttaatatactacattttcaactacccaaagcaatactaatttttcttttttcccacaaaattaaaacaatatgactcaatattatttgttagttaatatttttcctatcagaactccatagctagtgttctacttgatctttttggcactgaactttaaaaagaacaagtctcattctgtaataattttatttttattttaaaaaatatttcagctcatgatgttaaaccagatacattgatatttattttataattccaaatgataatatcagttgtttatatggattagaaattagttttatatcttacttttgattattatttgttagcatttagtagcaacatttatcaatatggtggcagttcattgtcgtgactatttgttaataacatcttttattttttctattttttttacatttaaaatattctaaattcctttctcatattatagacttgacatttgtaacactaatcccattctttactgattttaatggagattattttactatgccaatagtaaaatagagttactctgttaactctacttttctccaattttattcaagtggctattcatttttacggtggtctcatttcataacctttttttcacagtatctatgcctttttaagaaaacatttgtgtcaagctagctttctcatctctagcagatctcataaagaattatacttttcagtgtcaatattagtttctattttggtttatgttgcaaatttttatgggctgtatttgagctttgtatattaagtgaattaatttgtatgagcagaaatctgaacaatctaaataattgcttacaaaatagtaggttatttttattttaatcttcttgccatttctgtggccactattaaaatcttacgtgatctaaactcgattgactgaatgttatatacgttttccatcaaagcgatgcaccagtactcctggaagagttgaaagattctggagcgattgctttctcacctgccaagaattgaaatggcacatttcctgtgtggctgtgggctccagttagcctctgttctgttgctaggttcatgttgtacactgcgcaatgccctagccacaaactttggggaagctaatggctaccagataacagaaaatctatcttctcaaaaagaagtctggccaaattttgtgctttttattttgctaaaaataacttatgtgaatatcctgcttctgccattttgtttttaataatacattttgcctgtctcagttgccatatgaaaaaagctactactttttttttgcaggtgatttttaaaaagtcagaagctgttaagtataccataagaaaaaatatcattttaaaaactatttttaccatgtatgcttataactattaaaattgaaaagttaatatctattatagtgaatattatctaatgctatataatgagaacccacctatgcttctctgaaaatatcctggcttacagatctatccagcttgaacttaactaacataactccaatcatcattcatttttggtgtataaataaaaaaggaaccacatagctaaatggttttaaatgtataattaatcactatggcctcattatacttgataccttatgccaaggtaaatacaagtatggaagaataaacaggttgttaacagatgaatggatggatgaatccataatacataactttgttgaagcgtatttaaaaatacctaacttattgaaagattgtttgaagcaataagcttagatcatcctataacttataacatctgattaatttgcatgtttacatagtgttcatgtaacaagaggtattctatttgtaatgaaataaaaacactaaaatatctttaaaagcaaacaaatctattttccttctttcttaaacatgtgcatatttattgtaagtgtttgatgttttctggctatgtttttctattaaaggtcttccctgaaaaaaaagaaaaaagaatgacatgtaatggaagctttcaaagtgattgttgatacgtggtatcttttacaaaattgagaaatatatgttaaaatttaaaacatcaaataaaccctttgaggattgtgtttaaatttgtgttattttctgctacattttgtggcctaattatgtgaaattttactctgcaattgtattttgcagctattttactatgaataatttgcatttttttctattttccatggaatttaaattaaagacaatcaacttttcatttatgagagcagggcagtatcacctttacattgtagcaaaaataacaaaagatagagaaatcacttagttttctgagaaatgcaaaaaatgtatctttcctctcttgcatttttggatgctgttttataatgctttttacatttagtcagcatttttgaaaattgtatagattagaaatcttttaagaagtgccctaacagcaagaaaagccatgctatcttctattcataaaaaagatcattttggaaaggtactttccttcagcagcttttggaggctgtttatataatgtagctgcaaaataacattttcagataaattttaaaaactacaaaaatataaattgtatagtgtcaacaaatatgactgtattaaatgatagaaaatgtcctaagtgtacaaatcgagaaatattactgtcatatcacattgaattataaatgcagagctaacctggtatctgttagaaagagaatggaatttgacaactatatcatttaacttataatggtataaaaaatcaggagaaaaagttccccaggtattgtaggaacttacacaacttttatcagtattctggagggtgaccaaattggtagttcactgattattttggccttcacccatcgtgaggttgcctaggttaacaccaaaatttttctgggttagcaaagctactaggtcacaggagggaaattctaaccaatcacttccatactatgccttaaaaaatctaaacacagaaattatgttagaatttgcagccagaaaattaattctcattgaaaatgtgtcattttcatacttagacctgttcattttaatctctattctcatttactctcatttagttatttctcagttgcttgataattaaaataattatacagtatgcatatatcacacttccaaattaagctggccttttatacattatctcaatctctgccaaatgtagacttgtctttctctcacttctttcttgtttacagttaccttgcatttcatggagtgttggaagactcagtttcatcccattcatctttcaaggatcagctcaaatattacattttctaataacacaggcaaaagtcattgactatccatcaagacagattcttgattaaatttttaaaaatacatttctacatgtgttgaattaaaaatcaggacctgtaacccacagaaatatacatatatcttcaaaatttaacatgtgatgtctttaatgttgataaaactatattatccatgtacataagttatagaaatgaataccaaaaattctacccaaagaataacagtaattctttctttgagagtactaaaaatgttctgaataaaaagggaagaaaaacaagctatcaaaataaagtctcagtgatatgccacttagttatgctgtgtaaattcacattaaaattaaaaacccacactttaaaattatctgtggtcttgggctgcttgatatttgatttaaaagcagttaattgaagagtagtaattttaaaagtagtgaatggggttttagttttgtatttgttcatttgtatgggtgctgtattgttgattgatttcttaatgggattcttttaacttcaatgggaatgtgtaagaaaattaaattacgtaaagccgggagcagcttataaaagtcttgggctcagtagtgttatcaccttatattaatatattggatttcccgcaggaagctcaagatcctttcagtatttatcctaatagtaaagtagggcaggtatacagaggggaaatagaatgtctatacaccaataatgggaaaattgaaaaaaaataagatatttcatatttagatgaaacagaatcagaaaccaggtctcctttagctactttggtacagaatgaatggtgctcacacctataattttactaccatttactatggaccactccacagtgtagaaatgggctcagcataaatgctaaacatatcattacaaatacttcatgttatgatgaatatatttggtcatttcccttggggtcacttcccaagatggttattttataacactttaatataaatgcttaacctttaaaaatgtagttcttttggagaaaatcccagatgtgcatacaattagaaccaacatcaaatattttgtgttgccagatcactaattaaattcctgcacataaccttttccttcctgaaatgcaacatttagtaaattattttataattatgcaaacaatgttttgtatagcttttgcattttaatgagtttgggagaaaccaatttagaattaaatcagattctgaaaaaaaacgaaacaaaacgtgttgtactaaagagctgccatctaattataataacacacactactttccatgagtctgtaattcctttgccatttaaaaagtcacaaattttctgcttaatttttgtttttttgcctttttatgggaagatgtttaaatatttaaattcacaaaggactcataagaatcttccaaagtgaagaaaaactgttctgtctcccataaccttttcttttatattacctttcaaaaaagtttctagagctcctatattctatttggttagattagccttcggtacactcaaagtccagggatcaaagtaggcaaaaatataatgcccaactttatttccctgatttcatcaataatttcatcagacattgtatagaacagtattctactaataggactaaatatgcattagttgttaaataaaatgaaaattatgtagcagaataattatcttgaaatattggactttttaaattcgttaaatatctttagccctctttctatttcctgtttttcagaatgtaaggagtataaatggacctgtaggaaatgacaaacttatgtctgagggacaaacatattgacaaacatattatgtctgagggaatcctataaataaagaactggagtgaatagctgaagttctgacaaaaaatatgggaaatatttggtattatagctgtctgagtcttccactgaattctttgtaccatggtgtgctttaaaaaaatataggaatggacaaagaggagtcaaagttattataggactaagaatacgagatagatacaaacaaacacatatgtatatatgtgttcatagatacaagcacacacatgtgtatttggtacagttctttcattttacttaattaaaattgacctcctaccatcaaacatcttttaagtataaaggtgaaagaaagaggtaattagagaatggagaattcaacacacgagagctgcttaaaaagttaccatacatatggcaaaagacactagttggaatttcacaaatgtaggagataaataagggcaataaaatagtacaatgtgagtaaatctaatattggatgtataaaatgataacaatgtctcctgctattttaaagatatatggaataatacatatgcacatatatgtgaaggggattaaatgtggttaaatatttatgacttttaccttgtctggaacgtgtaacaagtaccaatttctattaaaatatggtaagctaattaaaagtattgcaatccctaggttaagcacttaaagagtagtaaaggtaagtgttaatatcaataaaggggaaattggacagacaaaataatcaattgaaaagaatacataaaaaggaaaaatataacatagaatggatgaaacaaataaaaaacaaatagtgttggcatatatttaaaccttaatataaactaactacataaaatgaaagtaggtgaagtctccaaataaaagataaaggcaaaagtagtatcccataaatagatttaaataagaaaatatgtttattttatacaaatatggattaaaataagaaacttttaagtatatgctaaataatatagctcaaaatttaaaaggtaaaattttagaactacttgaaacttattaaaaccaactggcatgaggacctctaactcatttatattgggtttgtgtgtatgtatatacatttatgtttattataaatagatgtaaatgttatatagtcaaatttccaacatttagctacactttaaaaccacatgggagtatggtatatagattgaaacactgagttttttcttgaggactactcccaaatatgtggatatgttatatttgaggtggcatcaaaatactgctttcggaaaaatgtattcagataattcttacccccagcctgatatatataccacagaaaaagacattttgaagtatatgcgtaaggtaaatttcttccaaatatccaagcactattcaaaaattatcacatgctaagccaagcataacagatgagtcataggaatccaacattcctaactccttcctaaattcacacattactaacaaatcatagcagtatttctgccaaactttaggaatttttctcagcacacttcctttcagtcctcttggtaggtgctagaaattctctacaattggaagaacaataagaaataattttacatttctgtatttttcaaaaaaattaagagcaaaaatataccaaaaagcaatgattagtaatcatgttctttattaatgatacattaacactgaaaattagtaccaaaagagtaaaaagtattgccaagtaaatttagaagtcttttctttcaaatgccatatttactcataaatggaaatgaaaatcaagtctgaaatctatttagaaaatagtacaaataagaaactttaatttaatatttttagaatacaggcaaagcaatacccaaagtatttgtagctccaaacttgttattattaaacaacagacagaataaaaaattgactaagggttaacaaaacatcaaaaattaaagaacacaaagaacaaagcattgtaaagtttagtaaagatggagaaaggactctgtcattaaacatataaagtattaaacaaaaatcagagaaaaccttgagaataaatctatgaaaataagttcttgaaaataacaatgatatgcagaaaagtctaactattataagagaaaatacaaaagatgaaaaaaattgattttgattttatgactatatttttttctcatgttttattagtttttgattggaacagctagaattttgcatatcattgaattgttattctatgacaattatacttttaaatgtgaatattataagtaactccagtaatatacattagcaaattcttagcaaatcctaaggaatttttaaaatgtttgcaaccattatgatttatctcactttatttaaaacattttagagtttagagtcagaaatactttccatatctttgtataaagtcagcacaagattgtaaggccataaacaaaacttctaataaacgcatctaaaagaccaaaattgttagtgcatcagtgtgtgcaatttgcaaaatctttaaaaattatgaaagtaaaatgtcagtttattaaacagctgttgtgctaaattattacttccccttctatttctatttaatgtgttttaattagaaatgatatcatcttatttatcatctccttaatatcaagccatcaccatgtttaatgatagtgaaatctaaagtcctttgaaattcaggaagaaaaaaaatgggtgtttactctcaccattaatattgtactttgtcttagaaatttgatcaaatggtattaaacaacaacataatattagttaagtaaataataaaaagaaaataaaaactacctttatttgcagatgtaattctctctagaaataataagaaaagttgtatctttaaattataaagcactacagcaactaagtaagatacacttctcaggaaaacatggttaaagagcctgtaaaaatttcacattgtaagcactcaatctttttttgctgctgcaagaagtgaaaatcaaaatgagatataatctgatatgttaagagtggaggaaagtcaaaaccataatgattaataattggcatagtgaatgtgtaaaccaaatggtcctcctgcacactgttggttgaagtgtaaatgaggacagagaatttggttgtaccaaatcaacaaccactcacatgttttttttgatttagcaattttcttcaagttaggtacatgcagttacataaatacttcgaagccataaaaagtgaggttgtatatttatcttattgatatacactgatggtcaacattcatgtgttattttaaaaaaaggaggttataaacatatgtacatgaaatccactgttaacctttcataagggaggttgttctttccatgacatgaatgggtaggaagttgacaaaaactaaaggaaaatgctccaggaggtcatctctgggaatttagggatgaatactccttgagacagatcagctctgtggagactcatctttggagtctactaaaagagttatgttgcttcaaagatgaggctcattttcatgaagaactaaattctcagtacatcgaaagagtaggatcctgcttctacctacatcagagaacttaagccactagctgagtggtttaagagccagtatgtcagaatatagtgcagagtgatgaaattgagcttgacgtgatcctacaatatgtcttgaaagccctgagcagatacaaaaggttaatggaatttttatgaagagagggatgtacatgcagctccatgagagacagaatatactgggataagtgataccaacaaaaaaacatagtgaatttaaggcacaaccccggtgactaaaaacaaaatattttctgaaggaagactacaatatcatggcgaattttggggaaaaccataaatacaagcaacgggcttatataatatctcctactttctcctcttaggcataaattacaaaagaaaatatatacaaaataaaagcaattacataagatataaaatcaatgttatttgtgcattggtgtttttaaaagatcagaacacaaaataggctacactataaatttgttttctgtaaaactatccatgaggtcttaacagaattggtgattataagggctaggttaattaaatgtctattcaaagtatagagactggaatgtcgaaggaagcaatcaagggtaaaaatcttactaactgggtcagttttgaacacccaacatgaagtagttcaattctaatgtggacgagatagtcttgggcagtgtgatcactccagtgagtgttctagaagtacgaaggcacctagaagtttctctctttgtatataactcctttgtatataaagtaccccctttaggtacttgtagactgctttggggaaaatgaaattataacctgaaggaatatagtacaacagtgaaaataaggcatcaataactggcactgtacagtgggagctaggttccagctgaaatgcaaacgtggttgaaacatactagtacacttctacagaaataaaaattagcagacaaggaaaggaaaggggcctatggaaaagaaattaatcctggaatttaaacagttttgtgttgccaaggtaacttagacctaaaaatagaataaagttgtctggttggcattttggagaacagagtcataaagatttgcaagtcaaatttataatatataagattgtatcagaaaaggagtttgctttaggatagcagcctcatggaaattagatgaaaactaacaagtctatcaataaggcttatctcagtctcatctcaaacaggaaacggctgggcttgatattgtctaagaacttgaatcctattggttaaaggagaacttcctagacttctctggtaatcaagacaatcataagaaaagtaagatgagaagatggttactcaaatcaagaaggacgataaacttgcatggtcttattttgaccatgtaaaaattttagacaatactagtgctgaaagtgtcaaaaggatgagggaagaatattaactaaaaaaaaaaaatcaattttgagttcattactaaaatattatagatataaataacactggaattgcaaaaaggttataacctgaaaaaacacattctttgaaattatttccagagttaaaaatatttggagagtttcagaaaattgattggaatcagttttaaatcctgtaggattcactcaagcatatggccttaccaaatgaatgtatcagcttcttcaagaactccagagattagtggttttctgcagagaagattggactagctgctttcctcatgctgtgtttcatggtagttcacactcagaagtgaattttacatcttaggatccatacaactcctcttcattaacataatttactgggtttagaacagttttcttaaagtggttcacagatcagcagtgtaaggatcaccccagacatgctggacgctagagctaccaactgagaaactcctaacgtggggccaataactggtgttgtaacaagacctccaggtgattctactaacataacgtttgtgatcctctgggctggagatacagagactgacatttaatctggaaatttgaccgtaaggctaatacttccaaaaatgtgatggggatcagggaaataaaaggtgattatacttgatataaaaagccatggttacgttgtttttaaaatgttaacaaatgccttcagaaagcacatgagtttggagacggagggagagaaagcaaatggaggggggaaaagagacagcaaggagaaatcaaatggaaagggagaaagggaaggaggaggatcatatgatggggagagaaaccaggtggaaacggagaaatcagatgggaagaattcaagatgaagggagatacaactaacagaaggaaccagatagaggaagagaagggggctggagagaaagaggggcatctactttaaactgcccccaaaagattccactttttgtgggattaactctgcatccctgggaaagtttaggcagatcagttcctttacttctcactgtgtgaagagtttagaagtaggactgaactgaggaaagccagaggattttttataattcagtggaaagaaaaagacacaatagaaaatacaggccttgcttataatatgggcctgtgaagcttgtgttgggtttaatttgaaaagtgaaagaaacataatagtgtttaaccccacctggagaagtaggccataccaattttatattatattccagtaataagtattatgtatatatgtggtaaaactatatagtttatacacaatatatatttaatgatcatataacgtacaaccaatatagagttgatataaaaataatagatgattcattgatcatgtttgcaaatacacatatgtatttagccatgcaaaaggattatggcaaattacatattctgttagtaatggcattatgcagagttaaattcattctttattttatgtaaaattactgcttaactatatatttactgatatttggaagattgttaaagaaatgatatatatctattttctaagacagacacctatattttaacaatgctagcacatttatgcaattttatttttacttagaatatgtttgaatgtgaagtaatatgaccaactttttagcaagcttaccagaatttttgcgctcaaatttatttttgccttaaaaaagctaatctggatggctatacatttattccaatgatatcaccatttccatttttggaatttatctttaaattgcttccaaaaccttcaacatattactttaaataccaagcagggaaaatatttttcatgttacgatgaaaatccaaataacttttcgaattgggtctgcttaataaaatggaaaatccaactggacaaaacttaaataattttgttttataagtgataatgtaattgtttttctgtatggccactgttctgattttataaggtaatgataataagtttgaaattactataaataattatatcaatgtaagaccaatcataaaaatgtcaggtaattaaatttgaatgcttaatttctgatatttaaccttaaaagctgccttattactacactgaatcttgttctctatgactgtacagagaatatagtatgtttgtgacttcactttttcttaaatgttattaacgtcacggcatcaaactgacctagacaatactgaaaccaaattttattcttaaactagaaaaaattgtcactccatgtgcttatgcagccaaacaaaaggttgaaatgcagtactaagctgtttaggcaaaattatttggagcttatggctgcctgtttttcccttcagacctttgacatataccatcatattcccaatgcttcagcctgaccttattagtcttatttgcatgagcaaggctgtgtagtcagattaaattgcccaaagaagcaatcctattattcaagtgaatgcatttttttttttactttgccaaataagaaatgagacaacaataccaatcaatagacacatttgagatatatttgagatatatcaaataaatatattaacaacattatttactagaaaatttaatttatcaggaaaaaaaaaacttgcctttaaatcctgggacacacttgcggaagaaatatccccttaaatgtgtactagttgttccatttttgcaggacgcagatttgcagtcttcagtatctatctcacagatgttcctttcatatctttgcagaccgctacagttacaattgtgcgaaagggccaggcagaggccatgcactgatatactgtggttccctaagcaatagtcaacattgacaacacacaatctgccaatgtaactaagagaacagctgcatctgaaacacagagaaatgaaaaacccaattagtcatatactttattttgatatatttaagtatttaaatcacacatttatttaaaaacacagaaataaatatttaatgaagatagttgtggggtgcatttaaaaaatattttcataaagtgtccattcttggcaaaattacttttgattactgtgcagaattatgagtgaaaataactttggtgctgaatatatctagtctcaaaaacatattctgccacttaattgctatgttagctgggataacatcatgaactctgcctatgctaatgtgtgtgtctgtgtgtgtattcatatattattaggttggtgcaaaagtaattgtggtttttttcattgaaagtaatggaaaaaaatcacaattacttttgtcacaactatatatatatacatatatataagattattcaaactcagtttgtcactcaatgcaattatttaagatgtagctgtaaggcaatgccaggtattcttatattattctttaaatctataatattttgaattttaaaatatctgtactcttgaatacatgaacataattcatgcattcattattttagttttttagatacatttttaatgaatttgcaaatttcgacgagattttcccatagtaatttcaatttatccaatatatttttctagtagttttttacatagttttcttgtaagtgaagacaattgtgaaatagtctgcaatttatgtaaatgtattttaaatatattttaggtttaatgttgagaactatgttggctatcaacaaaagtggggatatttttctggagttagagagacaaagatttttcactttttccttcctttcaaatacagacgtgcacagaaacacacacacatctgttcaaggcctaatttatttgatcattatacattgaacaacttttcttgggttcctctatatctaggcatagttataagttattaatataaattcttagatcattttaatataataatacattatataatatatccatatgcatttctttgaatattttatatacatacataattgaaaaagaaagcaaaagatgaaaaaaaattaaagtatcatgattttcaagaattctttaccaagcattcaaagggcacttaacattagcatataaatatgtcaatgggctgagaaaagcaatgtcaaatcactttgcttgttattattaataaaaattaacctactgaacctaagtcattacacttataactgtatatgacggtaagcgtttggagccagcaaaaatgttaaaggtgaattagttcaagcctttcttcttgtagttgtaaagaacttagccatttaatgcaatttgtcaaggatcactgagattattaacggtaggaagtgtagtggatgctttgatgtgttcaaatcactggtcttggagagaaaactttggttttaattcttttcaaacatgtattaaataaatatatttgtgcctgttttctcatctgcaaaattctcagctgcacatctatttcacagaagagtattgaatgcattttttactgggcaagtaactgttacctactatatcaaacacccttccaacaaagttacctgaaataaaatcatagaatacagttacttcccttcaatacctttcctcttctccctccacatacagaaaaagaaaaaaaaacctaggtaaattcaaaacaactgccacatggcaaaaaattgttggcctgtgctaggccttgtttaaccgtatctttgtaaattgttaatagtgctctttcacttttaacagtgttctgattggggtggtagattacacggggccctatgtataatgccaagattattacatagttctgtgcctctactatgcaagctttagtcataatgctgtttgttattccatgaaaatgaaaagaaaattgtagaaagttccttcctaaatgaacaggatatcctgtacaagaatacgaaggcatatctttataattcttcctgagctaatctctagtttattaaatctcaataaaggcatcaagaggtagactctaaattatatatgggaagcttacggcattgagaatatttttgaaaattaagagtaatatggaagtactagctcagatactataacaaacaaaaactgtactaattgaaagagagtttgccagttaactattaggatcttgctgaagtctctaatctgaactgtgtggagatagtgacaccttttattaagaggaagatttaataggagaaaatttggggtagaaactaggaatctgcatttggccatagcaaatttgaaatggtaattgacctatttttatatttcattatatttcatgtatttttatattgaccacttgatgtttgttttattgagctttaatgtcctcaagagaatactttttcttgtgtactcgtctttttaaaatttgacgagttgtggttagagcaacaacctacttgttcccaatttttgaatttttcaaattttatttttgacacaacttaggcacattcccttattgtttagcattaccatttctatatcaacctacctacaatacaaacctacctacacatacatatttatatatatatatatttaaattctcaaaaatgattatatcttagtaatatataatgctctgaaattttatctttccatttaatgatatgtctgagataccaatccaaattagcacattttgttttcaaaggttgcaaatattctattatatgaatgtaccataatatttcaccctcagaaggcactgtagttactatgcgttttaatttgttgtgttaatatttatacagaaatggaagtccttgtacaaatatatcagtggattctatagagaggatccataggataaatcccttgcaaaattggccctaatcaaaaggaaatcaagtgtttaattttaatagttcttatcaaagccctctctataaaggttgatgttcagaatgccgggcttcccaaacactggagagttctgcatatcataaaatgttttagtatttgccagtctgattaaaaaatctgtcctattttgctatgatttgtatgtgtttaattcatgaattgcactttttttgcaaagttactggtcatttacctttttgttttcctaataacaacctatttttggtaatttttctacaataaataacatatttttaacactaattttataattagcacaaaagaaaatcagatatcaacacttccttttcctttgcaccacatccttcccctgaccccccccaaaaaacaacttggcagtctattgctttctaatggccattgtttgaaagctcattgggatgttcttaggaaagtgtcgcttctgatgcattggaagtagtccaaaatttctgaaatgccaggcgttttggttttaaatttatttccaagttttaatattctggtttattttaatttatattttcatcaaatactatgtaaatattcctataataatgcaaatatttcttatagaataactatagtgtcttctgagggtcaaatattacagtgcgtttccatttctaactcatcctgccacctatataagatgtttaactatttttgtgttttcatttatctcaatatttccaaataaaatattttacatttattacttaataaaaaagcacatttaaacattattcattgatgtcatcctatggaagagaagtatttacatttcttacactgctccttaccccaaaacacacacacacagacacacagataaacacaccaagcccttatatcattctcccaatataaaattaggttaattttgtaataaattaacattcattttatataattatgtgtttagtgatatcatttgtagctgaaagaggtcatatgcatttacttttacagaacatttttgttttcctggcagtttttaatcactatatttttagttttgtttacttattctaagcatccagtcatcattacttccccatgtccctcaatatgcaaaatacattggatattctctcagcctcagtctttttgtccttagaaatgcctcttctgaatgggtagatccacaggctcacttcatagtgttttctgggatgactcttcaccttcatcctgggaggctttaccgcctgtcttctggtttggatcctcagtttcctaaattcctcatcttttccttacttgacttcctattttaagcgaagtatattatttttaggttagacctcttagaactaaaaatgttcacatattgtagatctgaaaactatttttttctacctttttcttattactttgagggcagtagtcttaagttttggagtttttttcaaaagtttaacatgcatctcttctttgtatttcctctgaattttctccccaccttccaactgactttggtctctggctgtgaagttagagaatttcctaacttacatggttatgcttggctctccacttatattgaaaaataaatcaccaaaaaatatggtttgaaattccatgtattcattgtgagtggttttctagtgactttattgcactgtgatcaaagagacctggctgatttgtttaagaactctctaattctctcagagtctgtattcttttacctacatccactcagtgacagtcaggggaagtggcctgaccacccacatttttagagcagaatagggaaaaataccttgttacctttgttttgggagtagatttttacttaatttctcctctgtagtattgcaccacatccctgggctctgtgtattgctcaagaatggaacaggctgttcgcacagataaaagagagaattcaggagtttaactgtgtgctcataaagctttcaaccaattctttgattttcagctttaccatggtcccaccctcaggaatgactgatgagtacaatgcctgtctttcgagtattcggcttatttagtggcttcccctctgctaccaacttagtttggtggttctagtctttcctgatgctttgcattttaaataatttttgttaggatgttagacactgtaaatattttattgaaagtctagattttgggctgggcgtggtaactcatgcctgtaatcccagcactttgggaggccgaggcgggcagatcacgaggtcaggagatcgagaccatcctggctaacacggtgaaaccccgtctctaccaaagatataagaaattagatcttaggcatcgcgtcatagaggaactacaccttccagaaccctcgcgccctgcgtcgtgctggcacttttaccggccgggccttagagcgcagcctgtagccgggcgccatctttgacgctggcagtcttggttttctgctagtgctgctgctgctgggaggacgacggacggcagcggccaagcgagaagaaagacgtggcagcaagcgggagtcggggatagtgtcatcggttcgggtcccactactttggagcttgtctcaaactccacatacagaaagccaccgaccttattccggtatcctacacccattccccaccctcattacactcccacccctggccctcagcgtgggagtcaagagcaacagggacacttccgtactccttgtaggattggtgaaaccgtaatgacgaacacccctaaactcccataattggtgcggattcctgtggggaaggcctatactgttgacatcttccaggccatctcaaggttctggaccttgagaaggaggctgtggaactagagatagtgatgctttttaggatttggggatattccctgcccaaaaaattcctggaaaattgactagtattaagtgtgaagaaatcttgaagaccagaaattggatcttactgaaaaactgattttttttgtttttcagattatattgttcagctatggaagatggattttttttcatgatcctttgactctcaagttcatctttaaatgaactcttttttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaaattttttctgcttcattattattaattcatggattgagtgttggttcgacctacaggcgtaatagattggaactcagtgaagacacagacgttcctgttgagagcaatcagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattctacatgtaccaaaggtgacagctgcccattccgtcactgtgaagctgcactaggcaatgaaactgtttgcacattatggcaagaagggcgctgttttcgacgggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaagtgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccaagcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgcattttggaataaaaactcttgaggaaattaagtcaaagaaaatgaaggaaaaatctgaggagcaaggtgagggttcttcaggagtttccagtcttttactccaccctgagcctgttccaggtcctgaaaaagaaaatgtcaggactgtggtgaggacagtaactctctccaccaaacaaggagaagaacccttggttagattgggccttactgagacactggggaaacgaaaattttcgacaggcggtgacagtgatcctccattaaagcgcagcctggcacagaggctagggaagaaagttgaagctccagaaactaacactgacgaaacaccaaagaaagctcaagtttccaagtctcttaaggagcgattaggcatgtcagctgatccaaataatgaggacgcaacagataaagttaataaagttggtgagatccatgtgaagacattagaagaaatgcttcttgaaagagccagtcagaaacatggggaatcgcaaactaaactcaagacagaaggaccttcaaaaactgatgattctacttcaggagcaagaagctcctccactatccgtatcaaaaccttctctgaggtcctggctgaagaagaacataggcagcaggaagcagagagacaaaaaagcaaaaaggatacaacttgcatcaagctaaagactgatagtgaaattaaaaaaacagtagttttgccacccattgttgccagcaaaggacaatcagaggagcctgcaggtaaaacaaagtccatgcaggaggtgcacatgaagacggtggaagaaattaaactggagaaggcactgagggtgcagcagagctctgagagcagcaccagctccccgtctcaacatgaggccactccaggggcaaggttgctactgcgaatcaccaaaagaacatggaggaaagaagagaagaaacttcaggaaggaaatgaagttgattttctgagccgtgttagaatggaagctacagaggcttcagttgagaccacaggagttgacatcactaaaattcaagtcaagagatgtgagatcatgagagagacgcgcatgcagaaacagcaggagagggaaaaatcagtcttgacacctcttcagggagatgtagcctcttgcaatacccaagtggcagagaaaccagtgctcactgctgtgccaggaatcacatggcacctgaccaagcagcttcccacaaagtcatcccagaaggtggaggtagaaacctcagggattgcagactcattattgaatgtgaaatggtcagcacagaccttggaaaaaaggggtgaagctaaacccacagtgaacgtgaagcaatctgtggttaaagttgtgtcatcccccaaattggccccaaaacgtaaggcagtggagatgcaccctgctgtcactgccgctgtgaagccactcagctccagcagcgtcctacaggaacccccagccaaaaaggcagctgtggatgctgttgtcctgcttgtctctgaggacaaatcagtcactgtgcctgaaacagaaaatcctagagacagtcttgtgctgcctctaacccagtcctcttcagattcctcacccccggaggtgtctggcccttcctcatcccaaatgagcatgaaaactcgccgactcagctctgcctcaacaggaaagcccccactctctgtggaggatgattttgagaaactaacatgggagatttcaggaggcaaattggaagctgagattgacctggatcctgggaaagatgaagatgaccttccgcttgagctatgagaaatgattgatagctgaaggtggtagtgaggacactttaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcaaacttagtgactccttgaggtgtttgtcagttttggcttttttctcctttgttgtattctttatgtattgtcttgatgtacttaatattacctgagtttgaaatggatgaagacagctgctaccattaaggaccaaattttatgctaccactaaacaaaaatacccactcagtctgtgttagattgtatgtctttttaaaggtatttagagattcaactaagctttaaagagggctgagcagctcaggaagcctgtaatgtgggcataactctttggacctgatcttgatgcttctgctgctctgttggcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatatggttaattttttatttctaattctcccaacaaacccctgttgcccagtatttatgtggtggcctttaaccacctgagggaaaaaatgagcttattcaagctgccaatatttatctatgggctgtagcagtacactgaattgtactgtgccagggatattgagatgctctgggggtatattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccccacctgtcatgttggctcctaaggaactgctgttgtaagcggctcatcaagagttgaacttcacgtagccttgttgggaatatggaaaaggaagaaagccacaggactgcccattcagtcttgttaagattgggatgattctgcacaagcaaaaatgacttgaaatttatgtatcgacacacctctaccaatccatcttcagctgactgaatgttgtatgatagcccttctccaaagcaggggtagaatgttcaggtttcaccacggattttctacttatttcgcttttggaatcagcttacagattccaggtcccttttgtagatattctttattcttttgcttttttaaaaaataaactggtattagtcaatgtttcgtgttccgcattatttgaaccatttgcccttacagaaagagaaatacttgtttgtgttttaaataaaactgatgtaggataaaaaaaaaaagaaagaaagaaattagccaggcgtggtggtgggtgcctgtagtcccagctacttgggaggctgaggcaggagaatggtgtgaacctgggaggcggaggttgcagtgagctgagatcgtgccactgcactccagcctgggcagcagagcaagagtccgtctcaaaaaaaaaaaaaaaaaaaaaaaaaaaaaagaaagtctagattttgtagtcttcctctggaaagccgaattttgttttgccagggagttaagttacttaccattcaacctgatcctttttaagcgtatttttaagtttgggagtatgcgtctagagtaagtttttctttagggctaatttaattatccttttgaagcacgcctcttcaggaggctcgaggaaatattcagggtggtccgcaatgcctccattctggctggctgcaactcaacccccagctcacaaatcccagtagctgtttttgcctggcctcacagagtttcatttcatgcatatgtagcctaatattcaatgaaggactcaggatagctgcctgtatagatttctggagttctttctctctgtgcctcacatttcagctcttttagctcctttaactctgatctctgtctattaaattcagtaagttggatctgccttgtcatggttcctcctctcttactgcagtcttggaagtgcctacatccagaaagccatgttggttctagggcttacctcatttcttttcctgttctgaagactcacacttctgtgctgtgtctgttttctaacgtctgaaaacagctgtctcatgtattttgtccaatttcctagctgtttacagcagagagacagatttggtaccagttattctatcacattgagaagtgatagtccctaaacttgctctaaacatgtttagatttaatgtgaacaactaatgtttccattttcagtttctcttagcagttttcaggagcttcaatccgttaattctcaaatacatccataaatcacttggaatatcttaatgcattgtatgaaagataattcctcctctgtacccatcatcaccactcttcctttaaattgtgggatatgtttttctgagactgtggctttagtgtgtacgagaaaaattcagttgttatcccctcattttggggagtaaaaataataagaatgaggagcattatagtatctaatcttgtccaacaaaaacctaggtaactttggaagttttcttctctctcccccactctcccacttctatgtgtgtataagtgtgtttattgaataaagagccttttatttttatttatttatttatttatttatttgagatgatgtctcactgtcatccaggctggagtgcagtggtgtgatctcagctcactgcagcctccacctcccgggttcaagcgattcttctgcctcagcctccctagcagttgggacagactacaggcacatcccaccacgcccagctaattttttgtatttttattagagacagggtttcacttgttggccaggctggtcttgaactcctgacctcaggtgatccacctgccttggcctcccaaagtgctagaattacaggcgtgagccactgcctcaggctgaataaagagccttttagataatgtcttgcctgacaagtttaaaacaactttcttaccagatatgccataataaaaatctccaagaagttttccttaggctacatctcaatgggccatttaatactatatcaataaactttattacataataagatcttggtgtttatcagaaagggatttgagccagggtgttttaagttggttagtatcttgagtgagaaagatctctgttttcattagccttctcagaaaaaactccccctatttatcaggaatgcaaatgtttcagattgaagtgggtacccagacatagctcaacattgcacaaacaggtgccaaggggaatctgtttccttttctatctaactccaactcctttgaatttttttgacaggtacttagaaaaactgggattgacaaagtgatacagtttgagttatatgttgccatagaaagaggcaagttggcaaatattttggtaaatcatttcaagatagctttgaggaggtcctcaaagcttagtattatacatagagcaagaggattatatgaagtatgaagagaaaatttcttctgattttctaaggaagatattgtttaagatccaagactagaaaaccagttgaataatgtaatagtagtgcttgggcgaatcaaaccttttggtgtgttaagtttaaattctcaggaggatcgggaaatccatggaaccagatggctcctaattgtttacaaggagaaaaaagtcatgcagaggttgagaattgcatggtattaaaacctatagggttaaaaaaattagaaaaaactagtgtggagtttggagtatttcaactggtaatcaaatacagaatgttatgagatagctgatgagatattctttcgtcagatttcctcaaataaataaaggctgttgatggttccatcaagacagttttgcgtgtagggaaataattagcatgtgttttatctccgttaacatatgttcgtaattgcacccatacacttccttagaaggggaaagtttgcaggcctctgaaatgacatttgtacttccatagcagaattcaaaaccaacactatagaaagcatctatagctgccttaaagaaaaaaattggtgaatcagccaagggtgatgggaaacatggggcctgatagacttgtcatatcttgttacaaatgttctcaaaaaagcattattcatgtgcctctgcttcctatgactagatatcagatatcaccaagtctctgtcactgaggagcttatagcttaaaagggggacttttaaataagtaaacacactagtagacattaatcagctcaccaaccccaaaatattggagcattaggaagaactgaattcgaatcttcgctctggtacttaaagtgtgattatgggaatgtgttttaattttaatgaacatcagttcccatctcagttaatagcaaccaagcttcccggtaaaaattctatggttatcctttatgtatctttccccttgcctcttactgccaatttagcagcacgtccaattgatcctactttcaaacagacgtgactacttctctccctttcacagtgacatccaaggccccaacatctattgcctagacaattggcctccagtctacttctacttttgtcttcctccccttgatccctgttcaatttttcttggttgaatagccatattgatcctttcagtatgcattggatcacaatactatcttgctccaaccccttcaggtccctcccattgcactggactatacacactcttggctgggcgtggtggctcatgcctgtcatcccagcactttgagaggccaaggtagacagatcacttgaggtcaggagttcgagaccaggctggccaacatggtgaaacctcatctctactaaaaatacaaaaattagtcaggcaaggtggcatgtgcctgtaatcccagctactcgggaggctgaggcaggagaattgcttgaacccaggaggcagaggttgcagtgagccgagatcatgacactgcactccagcctgggtgatggagtgagactctgtctaaatctatctatctagctatctatctatagatatagatatatctgggattagtggtgaccagcttccaagatgaccctcaatgatcctgcctgcctctgagtacccacactcttgtgaagttccctccctcacacactatgccagggttagtctgtttgactaaccctggttagtcaaaaacaaaaacaaggaaataaaaaaacccaaactcttcagtatgcccttcaaggctccatgtgaccttgtcgtgtctacctcttctgcctcatctgaaccttagctctttccacacccttctcattctgctacagtcatctagtccttactgttctatgagcagctcatttgctaagcacatttcttctccaaggagtggctccatttctcgagtgattcccatttccactggctggtttatcattatcatataagctccatgtctaactcaagtgttaccacttcaaatgggttttcaccatcctagctaaaatagcagccactgtctctcttgctctgttttatatcttcgtggcaatattgccaactgaaattttattattattattttaaaatattatttatttcttactagaaggttagttctgtaatgaccaacttttcctgtcgtgttcactattgttttccaagcacataatcgatacccattaaatatctgtcaaatgaatacgtaatttttaatggggatgatgaataaaatattattttttgaggagggaataaaagaaaataagtatatctataaatactacacttgatcttagccaaaaggccgagaagcgatacgtatatctataaatacttaaaaagtatgaagtactacaatattaatattcttagatatataactaaaagggttggatggtaaacaaagtacttggacatgtttctggtaagtttctctatgagctgggacataagttttacatttaatcctattttctatgttaaaggaggataagtgagttttacccattgaacaaatagacccactactcatatttcacaattagctgctttatgcatatttgaccaacgttgcactttaagcaattacagataacacttagtcctggacttacagatggtttgacttatggatggggaacgcagtagaatattgtgttcccaataatgctgcctatttacaaaagcagagtttccatccttttcattagttaaaagtgaatagtttttactaattaaattaatatttaatatttaatttgtgtcaattaaatatgcacaaattctgcacaaccctcagcccccttttgcagattctgatatgacagttgagtattattatatgagtaatgataactgtcagggccaatgttggaagcaaccatgtgacctactaatacaatatttatcctctgtccctttgattttctgtttagtaggctctccaaattatcactcattatgtatcccaaagcagaaatcagtgtaggtagcattactaaacttagcaaataaaaatatgggatgccaagttaaatgtgaatttcagaaaaatgagtgcttttctggtataagtatgtcctatgcataagtatgtaggggtaccgttttgctaaaaattatttattgtatatttgaaatttatatttagctggatatcatgtattttatctggtaaacatatatataggatatagccagtgacataattcctgatgccatcactggtcctttggctcagaccacagtatttctaatatcagcggagcacagctagattgttcaactgttgcatctgttaaggtggttagaagatggtatttcatggaacaagaatatttactatgccttcctttatctaagtgcctttaatatgtttccttttatttgaataactttgagtgagaaatagacataaaggagagttttcctatgatgcttgactaactctgaatacttcctggcacttgtaagataaacttggtcatgataaattaagtgatcagttattgctcccaaggtttctgtcatctgggtttagggtcagaggtggattttctgtgaagttaggaaaactatagctttagggccgtcactcgcataggtcacttccatggccccatgcctaattttgtattctttttcttaaatacaaaaaaaagagacctcccaaactctataagtgccatgaaaacctgcattctatcccctcatcccccacccatgtctagggataaacagtctagcatgctagctctagataattgctgctttggataatttccagataaaatgcccaaattgacaagacaaatgttttacatgtaaacaagttgcacttacttatctcaggcccccaacaacctgattcatttcagctattggctttttcttttctctatggtcacagttatcacagtatgctctcaggaacatgggggcagagcttcaacgttaaacaggtctttctgttttcctttccactgggagatacctagttcaatgttcctgtaaccagttgtaatatatgccaatctcaaagttaaattctggctctttaggagggagctttcatctgaagacctgggatcttcagattatcactgcgttgtcacttcccctaatttaacagctgcttgttttgctttactccagtcctcaacccccagatgaggtagtagagatcccctactgtttcgtggaacaccagcaacacggacacaaaggcaaactccagctttcctcacacctcttaaagagcatcttgaaccctacaagtctagatggccctggcctattccctgggggatattttttccccataggtagggctggtgagatattatgttggagtcacccggggcctattcttgtacctcttctgtctttctttgggtactttcattcacttggtaatcccatcttttgtcatggctctaaaaaccatccaaatgttgacagctccctagtttatatctgggaaataataggagggtttagagtaaagaagtgacccgatacatgcgtgattaacacatgcttaaaggatcagccccgaattatcccttgactcaaaacttattcaactgtctatctgggtgtcctttaggcatctcagacatactgtgatcacagctgagctcctgatcttgcctccaaatacggtctttctgcagttttccgtatctcgataaatgacaacttaatcttcccagtgtttcaggccaaaaatcatggagtcatttctgactcctctgttattctcacgttagctgttcaaactacctaaataacagtctacctactaaataccctttgtctctaccttcagaatatatccagaatctgatcccttctcagtatcttcacagcaaacacctggcccaggccaccccatctcctacgtggccttgtaattgcctcctaactagtctccctgcttctgttttcagccaactttagtctgtactcaatgtagcagtcaaagcagtcttttcaatacataagtcagagcatgttagttatcctctgctcaaaagcctccaagagcttcccacattaataggaataaaagcccaagtcctataatggcctgcaaggtggtatctgatcagaccctctgcaacgactattgtccttgtctcctaaaattttatccaccacccactcccctccagccttgctgaccttgctgtttttcacagaagccaaacatttccccacttagtgcctttccattggctgttccatctgcctggattgctcttccttcaggtgtgtctatctgtgtgtgtgtgtgtatgtgcatgtgtgtgtgtatacatgcttacatgcttccttacctccttcaagtactttctcaaatgttaccttctcaatgatcaccccatttaaaatcgaaaccccccctccacaattgttaatccttgttttgatttttctccatagcattcattacttctaagataggtttttaaaaattttttattctgtctcttccaattaaatataagctccatgaaatcgggtttttatctgttttcgttcctgctctatcattcctagcactcagaatagtgcctgtcacaagaaatggagggcactcaacatatatccattgaatgcataaaacaggataagaaagtcttaaacatttgcttaatgtgtcttcatcaatccttaaaggttcaaaagcactcaaccctctttctcttctttggacttccccttatggtgtgtgtgtgtgtgtgtgtgtgtgtgtgtgtgtgtgtgtgtgtgtgttttccagctaaaacctaatatccttgagtcacaccattaagagagttgcagctagctcttcagaaatcttgtatctactgaactccaagaacatcatttattcagtacccaaggatgggacatagccaatgatgatgatgggaacattttcaggaactgtgctcactcacatagatttttgttcatggaataagtttctgaaggtctgtttatcagggtaaaacttcagtcctgtatcaactaacaatcccatacagaagggtcactgtttatatttctccaaagcctggtcaaaagtaactttgactaatttgattaaattgattgataaagtaaatcatatcaccaaaacacttctcattccaatgcttgatagttatggaatttgctgagaccacccactgaatacccgttcaaatgaatggaatctcacagagcacacataatcatctctgacttttgtagccatagggatacattaatacctgtgcctcatacttaactgaaaatcaccagttgtctgctgagtagtttactgcatgtcaaatctgaggtccagtgtaatagactgttttaccacttctattcagaattttctaattcatagacattctaattttatttgtctttttctctcaaataccatgatagggtgaaagtttgagcttttgtatcttaatgtttattgaatattaagatacatagagaatactctactatacataaatgcataccattcaatgaattgtccttggatgaacattgctgtaaaactattcaagttaaaaaataatatttccagtatccagaagtcttctgatgtctcctccccatcactactcccttcttcctccccaatgtaactgttacgctcattctaacactggagttcagttgtgtctcttttccaactttctataaatgaaatcatctgtataaatcttgcatctggcttcttttgctccatattatgtttgtgaaattcatctatattattgaatataataactgtggttcattcagtattactgcttcatagtattccactttatgaatttatcacaatatattgtttctagtttttcatttttataaatcatgttgctctgggcattcttggaaatatttttggttaccatgatcccctttctgttgaatatacactttggagtgcaatatctgtgtcataggtatgtacatgttcaactttagtagataatgtaagcagttttcctaaatcattgtcccaatttaactcccaccagcaatataagagacatcctattgctacatatccatgtcagcagttaggattatctctcttctttattttagttattctccttggtaaatagtagtagtatctcattgaggttttaatttgcatttctctgactacaaataagattgaaaatatgcagatatccttttcctgaagtgtccactcaagtatttccttcttttttctattgcattatttatctagttatagttaatttgtaaaagtttaaaaattatttatctggatgcaagtcttttgttagttatgtgtgttgcaaatatcttttctcactctgtggcttgtttttatagtctctaaatggtgtttctgttgaaaagaagtttttaattttaaaacatccaatgtatccatcttttcttatgaacagtcatttttggtcccaatttatcaaatccttacctatcctaaagtcttgaaggtattatctgagttatagtcttagattatcttctaattgatttattattttctctttcacacttttcacagttaaatctacaatcacccagaatggattttcatgtgtggtgggtggtaagggtcatttcttttttaatcgtcaactttttaaaaaaattatttttatactttaagttctgggatatatgtgtagaacatacaggtttgttacataggtatacaagtgccacggtggtttgctgcacccatcaacccatcatctacattaggtatttctcctaatgctatccctcccctagcccctctccccctggcaggccccagtgtgtgatgttcccctccttgtgtcatgtgttctcattgttcaactcccacttatgagtgagaacgtgcagtgtttggctttctgttcctgtattagtttgctaagaatgatggtttccagcttcatccacgtccctgcaaaggacacgaactcatcctttgttgtggctgcatagtattccatgttgtatatgtgccacattttctttatccagtctatcactgatgggcacttgggttggttccaagtctttgctattgtgaacagtgctgcaataaacatacatgtgcatgtgtcttgaattgaaccagcatcatttgttgaaaagactatattctgtgtggatttcaatttgaaaattttatataataaatattgtatctatatttataactatgatttctctttatgtttgtaaggcttagcaattaggatatgctatcaatttatcattttaaggctgattttgtctttttttaaatgtcaaagtatttattttacctcaattgttggaagaactcattggttggagcagctaaacctagatctttgtggagagataatggaaaaaatctgtaataggtgtttgattttctacttaaatctattcactgattactaatttgctcagtttattttctggagtcaatttttagtcatttatatttctccagaaaattatacatttaaaggcatgttttatttttactactataaagctacattcaatattctgttaaatgtgtaaacaattcttgtaaatactgtttttcatttgtagttttggtatgatttttgttttcctattgttacggtctgtatattttataaaatgaatgtctttgattctgttatctattgctgtgaaacaaattactccaacacttagtggcttaaaagaacaaacatttagtatctcatgcaatttctgaggcaaggaaatctaggggcagcttggctggttcaacatctctcacaaagtcacagtcaagcttttcttcctgggctgccattgtctcaaggcttggctggggctggagaatccactgttaagctcactcacttggataccgacagagctcaattccttgctagctcttggctggaggctacattttctcttccttccttccttccttccttccttccttccttccttccttccttcctttctttctttctttctttctttctttctttctttctttctttctttctttctttctttcagacagagtctccctctgttgcccaggctggagggcagtggtgcgatctcggctcaccgcaacctcctcctccggggttcaagcaattctcctgcctcagcctccagagtagctgggatgacaggcgcccgccaccacgcccagctaattttttgtattttcagtagagacgggatttcaccatgttagccaggatggtcttgatttcctgacctcatgatccgcccacctcggcctcccaaagtgctgggattacatgcgtgagccaccgcgcccggctggaggctccatttttttttttaccgtgcagtcctctccatagaactgttcacaatatagcaacttgtttttcactcctttccccttctcactcctcttttccagcaatagatcagagagagagagagcgacaaagacacaaagagacagagagaacaagagagctcaacgtggaaattatactctttcaaagtctaatcttagaaatgacttaccatcacttccacatctgctattgttcaaacagactaaccctggtatagtgcgtgtgggaggagacttcacaagagtgtgggtactcggaggcaggcagggtcattgagggtcatcttggaggctggtcaccactgatcctggttatatacatattttatatatatattatatatattttatatattatatgtattacatatattttgtatatataatttatatgtaatataatatatataaaatatatataatttatatatataatatatgtattttttaagacagagtctcattccatcacccaggctggagtgcaggggcacgatctccactcattgcagcctccgcctcctgggttcaagcgattctccttccttaaccactgaagtagctgggacaacaggcatgtgccaccatgcctggctattttttgaatctttagtagagacggggtttcaccatgttggccaggctggtctcaaactcctgagctcaagggatccacccgccttggcctgcgaaagtgctgggattaccgtcgtgagccactgcgcccaggctggtcatagttttgttgtgaattctatttttttctgatattaatattattttctacttttgatttgtgtatttacatatatatgtttacatgatttttatctttatatttttaaacttttaaaatgtcactatttggctgggtgtggtgtctcaggcctgtaatcccagcactttgagaggccaaggcaggtggatcacttgaggtcaggagttcgagaccaaactggccaacatggcaaaaccccgtctctactaaaaatgcaaaaaaaaaaaaaaaaaaaaaaacaattagccgggcatcgtggcacatgcctgtaatcccagctacttgggaggcggaggcaggagaatctctttaacccaggaagcggaggttgtggtgagccaagatcacatcaccacactccagcctgggcaacagagtgagtctccatctcaaaaaaaataatatatatatatatttttaattaaaacgccactctattttagcaaaacatgggttttgttcattgaatctgaaagtcttcagttttccatagaagaaccgaaaacatttaaatgtactgtcctgatacttggccttacttcttattcctcttattttcaaaaacattgttgaattatatttgtgtctttattaagatgatgtccaaacaggagtttaaaatttcttctgtataatcatggaacattctctgaactagcacattgtagacactcaataagtatttgttgaatcagtgatacagatagatggatggttggttgaaagaggaatgacgccgctttgctaggggaggtgagtgtaggactccctccctcaaagtagtctgttaaacagggaagtggctgcttggttatctgaacaagtattcactccacattttgagctagacataatcattgaaagagagctagaatgccttcctattgacttcctggcctgctgggaatttttgcttccttctcccccagccatccaatttttcaagaaaaattttctgtttgccagcttatttccccaactcccctactcttttgtctttcctaccctctaaagagagtctaggtctcacaggtgatcttttgtagctctgtgatgcctaataatagaacagaaaaggagatggggaagaactgacagaaagactaaagaaaggaattaactagcgagtttaagtggagctgcctaaggatgcaatgcaggaaaaaaaaaacacacacacacacaaaatggatggggactacatgctgaagggactgaagtcaagagggagaatttgggctgcgagtcagccaatgagagattccaaaaggaatagaaagtgctgagaagacaaaagcacatgtagcctgataagggcatggtgaccaggagctcaggtccctcagaaatgagtgtctagttcatgccatcaggtaagctactaagactagcagagctgcagcctgatataggaggaatccagacggataatggaggaaggagatgatgagtatcagttgcagccctgggactggtgcagaagcaggggtggagttcctcctattaacttcccctattgtagatttcactgggaagagatgcctcttggtacagtggaggaactgctccttgaacgtattcaagtggcacatttggctccttgaagtggatccaagtggcacatgggatagatggtggtagaaacagagaagtgcatctcagaaggacatgttgtccttctgccagttatagttctgccagtagatagcctctagggctcagccccttcagggattcttttagctgcagaggtgcaggttaaacaggttgccttaaggtggcccttaacaagtggccttaaacaggtggcctgaaaaaggtggccttagctaaggccaccacccccatcccctcaaaggttggcatgcagtgactgatggagggccatgttcaccctaagtgaggcaactccagcaggcacctacagcttcctgtggagttggctaaggcaatcaggtctgcatcacaacctgacttctccctctgctcaattgttttccccttcttttcacagctgttggtcccaagggataccctagaaatatactaaacgctaaacattgtctcaggtctgctgttggataactcaacccatggcagtgctctgtaagactacggagattttgtgggattaaaactagtagagagtatgaaagcctttttttttttttttttggcagatgcagtattctgagaaatggattaacatgatttaaaatggtggccaagaaatatgattcttcttgtttcattggaaggcctggaagtgtaagaggctaaaatataaaacagactgggaatttgtttcaggagtctaagaataaaatccacaggctaaaagagggttgcagttggagggaaaaaatgtacttgctatttttcaaaaaagagttggaaagatttggtgtcaacctggatgtgaggatgaagacaagccagctagaataaatattgattccaagattgagggcagaggtttctgggagtgtcactgatgggaacagacaaaatggaaaaagacttaatgaagaagataatatcctcaagttttgacatctctaatttaaaatgtcaacaagctatttaagaggaagtttctttgtgttgggagccaccttagttgtccagccatattaaggggctgcaatacagtcatgaaggctataaccagcactatggtatcatgcccagtctaaaatgaggctgagctctgaccaatgtgggggctgcatgtgccaggaagaaggggtgccttttctgactggcacaaagatgttgtgtgagctggtagggggcctggccattgcctcaaaatcagtgagagagacaatgtgatgtctggtgaaatgcacaaatttggtttagattagagatggaaagttagtgaaggagaaaaggctttagtaagttagatttctttagggtgggagaataggcaagtcacttaaaccttctgaatctccttttccttatttgtgtggcaggatgcttttcttttctccactccctcacagcttcctcgtaccaagatatgatagctgaatgagatatttggcaaggcagagaaaagagatggagacgcttagcctaattaatgtgctacacttatgccaagaagggattctatgcttacctagcagataatttaccctgaaactggactaggcaggtcacctttttcttcattttattcttgcatatgcaagatctaattatccagacgtatccacagagagaggaaccagatgaaatgaggaaagcacggttcaccttcaagagaaagaagtaggactctggggttttaagccgaggcatgaaatgtaccgattaatagcgtcattttggaaacacaggtctcaggagttttgggaaggttagtatgagcttgtcagcattgcttatgaataacagtgagattgctgctttgcacctgatctcagtcagacctcagaggctcagccactggggctggttatgcagcaggaatatatccatgcgaccagcagggtgtaagaagtccaggccaggacgggcgcagtggctcatgcctgtaatcccagcactttgggagaccaaggtgggtggatcacaaagtcaagagatcgagaccatcctggccaacatggtgaaatcccgtctctactaaaaatacaaaacttagctgggcctgggggcgcgcgcctgtagtcccagctactcaggaggctgaggcaggagaatcacttgaatccaggaggcagaggttgcaagtgagccaagattgtgccactgcactccagcccaggtgagagagcaagaatccgtctcaaaaaaaaaaaaaaaaaagaaaaaagaaaaaagtccaggccagactccatctcaggctcactggttccaatgtgttccatccatacctcagtggctcttgatttagggaaaaaagcacatcctgctatttaatttgcaaaaattaaataactacttgatgtgtcttttgtgcagataatacccacaaaatattagtttttgccctttttcccttataattttaacatacttattttctttacttgtctcatgttttctttcagagattctaactctctttgctaaatggatataggaataaatactcttaaaatacattttttattgtattgatgtggaaaatgtagaaaagcacaaagggatttttttaaaactctgcaatatcatccaccagtcataatcattattaagatgttttcacagatattcccagcttttattctataaataagactctcatgattcacttatccctcacttgtctaactattttatactttttgacgcactaagattctaaaatgaaccataaaagctggcacatatttatagtaatcagttttcttatttaagaggatgagatagatgagtgtaaataatcttgctatacacaaaattgtttctgctactctgaagacaaggtgttcttacatctcggtctttgagcatatatgtaataaagttttgtgtaaggttgcagactttgtctttaatacaaaggaaaacaacaggtatagccttcatataaattatctcatttaatccataccgtgattttatgagattggtactgttaccttcatgttactgatgagggacctgagccaggagaggcaaaatatctcagtcaaagtagcccagctgctaaaagattctgcctttgaaaaatcgcctgccattgacacctttgtcaccgtcacctccatctctgtctgagccaccatgatcttttttgacctattgcaaaatctatttaacggctacctctaccttggcccctgtatagtgaccaaagtgagcctttcaaaaacataaagcagatcatgtcattcctctgcttaaacctttcactggcatatccctcagggtaaaatccagagcattagtagggcttctaaggttctatttaatctattccccactccctcactttcccagtcactctggtctcacctctccctcttgcttcctgaactcagtgctgccattctccacacagcttgacatgttcctacctcagggcctttacacctgctctgtctcctttgccagaaatctatcactttattcccatctctgattaaatgtcactgctccttcaaacccttgcctggctacgctatataaaatagcccctttcccagctttctttatcaattaccccgattcattgtttttcccgtggtatttgttaccacctggcttttatttgtttatttcttcatttgtttattttctgtcttctcctgcaagaatgttactgtatgagagtggggactttgttttatttgttgtatttccaggcccaaaacagatcctgggcccactaaggaaaatttgttaatgaatgacggaaaggaaggagccagatttccagttcacatcttcaccctaagtccaggctatttcctctatgcattctgaataccagagccacttgaaggaaggaacatacagtgaaacaccggtgatattgtaaaccttccttgcaaccctcttcgcttgccttgctgagattaggaagattggaatgagtcaaagccagagtccttcctcggaagatcactctagcatttgctcttctccactgtcaggaaagaagagaaagcatagagaaaatggtacctataacagtgaattcacaagaaagaggacatgagaccatttgattgtacataagtaacctggactttggatcagaggaccctggctctgctgtgtgacttggaaaaactttttaaaaacctttctgaggttgtttttatcatttttaaaatgaaattaatgatccttcctttggtcatgagagtcaggttctccaaaaagccaaaggaactgtttcctcacgaagtgtcagagagatttttgaaagagctagatactgtatctctgggattaaagtgacaaagcatggcctttaagagatcagaagtaaaagatattttagcacagtggattgtcagtctgcattagcaggtggtggaagagctttcggcagacatgcccctataacttcagttagtggcagcaccattggcacaggtacacccccaggcagctggccctggtaacaaggtggcagcaaggggaattcacatttagaggcaatgaaggcagctgtcgccaccatcataaacttctcctcctcctccttactcttcctcataattctcctttctccctcttctcccctcctcctctcccttcttcatcctcctcatccttcttcatctagctgtgatattttttgtcctggatttaggttgtactggtgaggatagagacagcaaatcaataataatattttaaataaatttttaagcacatatacaacaaacgctgcatttgatacctacactgtctcatttcatcattatttaatctcccttaaggtaggtatagtaactctgcaatggagttgagagaaatgaggcataggagggagaatgacttgcttaaggtctcacaattcataagtgatggcaggaggatttgaacttcttggaggttcagatttgaacctggagtctctttgactccaggacacttgttctaaagtcactcagattcaaaaggtagaatcagatggcttagtgattggatgtgtcagggacaggggactgtgaggaggagaaggggtctaaaatacttcctagttttctgatttgggtggcctgttgaaatgttaatggtgctttacccagggtagggacactctgactcctagaaatagttccagcctctaattagtgtcgagatcattttttaggttaaaaatgagctttgggctagagttacaggaattcttatttcaatctttcacttggttttgcctgtaatagactggctaaactgtaagaggcctcctattaattttaaactgtcttgaactcaaaatagtcaaagtattaagctaatgaaagagcagtgttcttgttgttgagtaatccacttatttattctatagcttcctctcccatgctctttgttccctttgatcataattttaatgggttttggaaaaaatagaaacccatgcactacattggctatatttaacaggagtacctataaaatatcattttgtctaatgtactgtaaataattttttccagatgcttgaatgtttttggagtgtatacctttataaattatacatttttatataacacctgtatctgtttttcctttaattgcttctcaatcttgtgtcacgtttagaaaagcctcctcattttaagatatacaaatattcactctcattgtcttttagaaagcgatagatttatttcataaatgaattatctgataaatttttaaatggtgtaatttttttctaccattgattagaaatgctatgtatattaaaataaattcatatagataagtacatatatttatatataagatatacatatgcatatgactcatatatatgagtcagtgtctccctcagtagaatgtttgatttaacaccccagaacatattttaataccttgttttaatatcttttctcatactcctatagtttttctttctttcaacttttatcctttttatatacacagtaaaacaaaaaatttatttttgttttatatgagaccatatagaatttatatatgaatttagaattaccatatctaaaacattgagcctttctacccaagaacatgctatgcaattgaaagcatttaataatctttcataaatcattcattataattttaagattttcttttgttatgcatttataacagtttattccttggtgttttatcttttgggttactattgtaaataaaatattagtcttcattttattttctaaacgacatttatttcttattggaaatctatacatttcttacaaagatttgtcagtagaccacaaaataaaattattttatttctaataagttttttaaatcaattcttttattttactatattcataatcatatctataaaccacaataattgtgtttcttcctatccaatttatacttcctcattttttgacttgtttatatacttaaatactttcaggagcctaaattaatagcaggcattattgattgtaatgcaaaatgctttattacgtcaacataaagctaaataaaaactactttttatctggtttaacactttctatcctaaattccaccttgatatatcaagtctgtagttccagccttgttctcaattaagatctctccagtaagtttttcggttgtgtgtttttgatccttctaagtcaaagtgttataatgaacctcttaacctagaattgctcttactttgatttttgaggtaatttaatagatgttaataaccaatatgtcttttatgtgtttataatatttttgttttctattttgaaatgtgaattgtgttttatttatttattttgtggtttgtgatgttatttatttcttataattttgaaatatttgtctgcttttgatcctctattatacttttaaaggtgtataatctacttagctttgtacttcctgaaatggatacactaaaatcaatgagaccaatattttctattaatagtgcatttttggtttttgtagcacacactttacttcatacaatggaattcataatgtatcctacctacacacctaatattaaaaattaaccaagataattccctaactctaatataaaaagtataagagaccactaatttacaagaccactatttctatacaaaaaatactaaggaatgactgaactagaagatacattgaagtggttagctctttgcactcatacacagaattaccatgggtttggtagccataaataaagactgataatagtcatttcctattagacactcaagtaggatgatgtatttttttcaatatagttaaaaaattctaagaaatttctgaatgaaaaatatttattgacttaacataaaaaatttattcctgatatagtcaatgattattaaaattgtgtaaaaatatttcatgccaatatgtgacatgaaattcagatctaggcttagatattcatatataggttttatacacacattaacatatgctgtgacttttagaaattgtgcaatctgtgaaaaacgtttgctttgcctgaactgttctgtgcattgaaagatttataacattcatcattcactacccatatcctaaaattaaactgttccagtcaattattctgaatattgacaatgactctagaagttcccaagatgcctctagaagacaaaatactctccctgaaaattactgagctgaaataaatttctccaatttacaaaagcactcatcacttttcacccaaccatgtactagtacgtctagcattttgtcataataattaataaattcaaataaattgtaatatatatgtgtacattgatattgagtactaagagaaatggctatcagattgaaagcttttcagtgagtacatcaattttgctaaaatatcaattttgatgaaaattatagtaacctataaatgttactgatatcttgaaaatatgtaaatctaaagaaattttctttgagaaatcaaattggactaaaataatttatgaatgtattgctaactgtattaaatatataaattttaaaatataaatgggaaacaagtgaataatatgatagaaagtaaaaagcagaagcctactaggtaaaattctataagttaaaaatatgatctgatgtgaaaatattataattattagttttttatcatttatgtttttaatgaaaaaaattctaggaatagaaaaactaaaattattcctttacacattatcctgaatcctaaagttatgacccaaataccatataaactgtggatgctcaattactgttgcattaatatggtcaacaaatgcattttaaacttgagcaagctatgcttaagacaaaggtcaccttttaaagattctgcataaaaggctgcatgaaactccaagtcttagaaaataatttgaaaagcaatgctaaaaggttatacctataaaaacgatttaaatataaatttaaataaaaatctggcttaggtagtataaaactatataacatgcacaagtcattttattgtttgagatatgaaattgaagtatgaaaagtcataaaacctgaagctataatacggtcaaactttaattttaaatatataacgtatgtatttgggaaaaatatatgagagataattgtgtatagatgagttaaatttcaacccatatgaaacttgaaactttattattcaaaaatgcttcatttaatgaagtttgttataataattttggtatgtgtatgggtaatacaatgatatgtactctagaattgcttaaatgaatgatttctatatcattttactataaggatttaagaaccaagattatttggttttctagagcataataaagagagaaaatatatcagtgtatgtaagtgccttagacaaaaagatttagacacttgatctagtggtttcaagactggccccaacccaaaaatacattcaatatgacactttcatatgcagttcgatatcttttttgctttaaaggtaaaaatatacccacataaaacttttacttgaaggcagaaaagtttgcatagtatagccaaaataaataaataaacctaaaaccaactattcaacttgttaataaaatcacggacatcacggcagaaattacaatagtcttagaataaataattattagacttttgggatcagaaataatttaagaaaatcctggtcaaattatactatacttttgtgccatattcacataaagctctatttttacaagcctcctgactctacagaaatagtttttgaaacttcacctgattttcttatggacttttagattctacactttgaaacagaactcttacttataactgaaaattatgttttggatatatttaacattacacagaaaatgtgaatctcctaaaatagcctgtaaaggaaacaggttaaatttaaaacttccagaaagaaagccagaagacacactgctataatcaagcaacttgtatgttcagaaagtgaaaaaaataattactttagtactttaaaaatgtgttcactttctaaatgaaacagaagaaccatgagatgtgttctgaagagtgtataatcttacctatgtatagtacattacctggggacaggtatcatgtctcattgtcataacattttgaaaaatatcttccagttagaggagattcaataaataataaatgtatgaatgaatatatttcattctgttatgatatttctggtagcaagtagggattggtgacttagacataaatttgaggcttcaaaaacaggtgggagtcatgaacacttcacagtctgggcatggtattaagaaattaacatcccagacttagcaaatctttcctggtcttaagtaacaatatggctggtatgatttagtctttggctcattaaacattttataaacccccagaaaaattttttgaagatttcagggcaaaaaaatgtggtaatatgcagacctgtttgcaatacatcatttatataatgaattttaatctgcacccatttaaaatacactttaaaagaaaatgtttatacgctattcattaactttgtgtccgttaacatcatcaacattattagtgtctatcattataatactatcattattttgccttataaattgagtttaattgaaaaatttctccatcccgaaatcacaaagatatttttctacatttctttcatttatatcgtcattttaccttaaacttttagatccctatacacatttagagtctacttctatataaggtataaggttgtaatccagtttcatttaaggtcttattatgagccatttcctcaataccatttactaaagaaccctgtatgttcaaatgagattatagccaaatttctcatatattgagttcccgtatatactcgggttgttgtcagagctctctgttgacccattattattttttttcctttaaaggcacccatatgtgttatgtagtctgtcatgtcatatggttcatcagatcccaccccattagtcttccttttcaaagatgacttcataatttagaaaatattattcataaatatatataacatgataattagtttctaaaataacttgcaatatttttactattgcattaaatgtgtgaattaatttgggaagaattaatattttagctaatttaaggcctaatatttaactccatgcattatatttccatttattcagtgtatatataattttctctttttcattgagcttagtggtatatagagggtctttttaatggagaattagagcatcttttttttaattctaaacattttgcatatcttttgacattataacaggtggtatcacacatataatttctagatattgcaactgatatagagaaacttaattttatataaaatacttgtatctgcaacatttgttgggctccattgttagtattaattatgagacaatatcaagaactcattaaagtgttgataaattacaaaaattttgtaatttatccaagattctctggatatcaaaaaataatggcaaacaaaagagaatcacaaaatcagaaaaaaggaaataacatcacaaaacgaaggataattttcttagtaaataaaaaagcttctgaaaatcattgtttcattaaacaagtatttgttgagcactattctatgtgtcttttgtggcttactacttttccttatcaaaatgttttcaatgtttattcgtattgaagcacatatcagtaattcatctttgtctattgctgaataacatttcattgtatggatataacaaattttatatatccattcatcagttgatggtcatttgggttgtttcaactttttgactctttcgaacaaaactgtaaacattcacatataaatttttgtaaagaacatatattttcaattttttgagtatatactagaagtagaattgctgggtgtaaagtgttatctcattgttttgatttaaaattccagtctttcagcctttcaccgtaaagtataatgttagttatgtttcttcattcttcttatttttttttaacttctcttatcagattgtggaagttcccttttattctttatttgttgagtgtttgtttcataaagtgttgtgagattctgtaatacaatttttttctccatctacattatcatgcattttcttctttatttattctattgatacattaaattacattaattgattttaagccactaaatcaaacttatattcttacgataaatcccacctggtcatgctgtataaacctttctatatgttgctgaatttggtgtggtatcaccgtgttgaggattcttctgtgaattaatttgggaagaattaatattttagctaacttaaggcctaatatttaagtctatgcattatatttccatttattcagagtatatacaattttctcattttcattgatcttagtggtatacagagggtttatagtgctatatagagggattgaaaacatagatttgcctatagttttcttgtgatttgtctggttgtgctattgttgtaatattggcctcataaaatgagttgggaaatgttctcttctcttctatttttggaggaggtggtgaataactactcttaattttgctttaaatatctgttacaatgtctcagtgaagtcatctagccatgaacatttcatagtgttaatttttgttagtttgtttaattactgattcaatctttttacttgttataggttagatttcctacttcttcttgaatcaatttcagtagttggtatttttctattttatcgaagttaactaatttttttaatttacagttgttcatagcatttctttataattatttttctttctgtaatttcagtaatattttatatcttattcctgattttagtatatttgttaatgtttaaaacaaatgaaattttgttttttgatattctttattgtttatctatattttattttattaattttactctacattttatgatttccttctttctacttattttatttaggtttagtttcctctcttatccattgtgttgtggaagtttaggctattgaggtatttacagctataaattttattcgcagcactgcatcacccacatcccatgagttttggtatccattttcaataatctcaaagtcttttctaatttctcttgcaatttcactttgattcattgtttaataaagattgtattatttaacttccatgtaattgtaaatttatcaagttacttattgattttgatgtttaatctcattcaattttggtcagataatgtcctttttattatttcaattttttgaaatatattacagcttgctttatagcatagcgtaggatatgatctatcttggagagtgtgccatgtacatttaagaaggttattctgctgttgttgggtaatgtgttttatagctatctactatttctagatgatttatagtgttgtttgaatctcctatatcttagttgatttatagccaagtgttatatctgctattgaaagtagaatattagagcctctaattgttattgttgaattggctatttctcccttaaattattttttagcttcattattttgaggctctgttgttagttgtgtatatacatatatatatacacacacatatatgtttgtaatcactaccttttctgatagtttgattcttttataattataaaatatctttctttttctctactaactgtttcattttttctcttaaaatctattttttccctgatgttagtataggcactccagttttcttcttgatgcagtttgaatgatatttttttattgctttactttcagcttatttgtatctttgaatctaaagtgtcttccgtaaaccatatatatatatatacacacacgtatacataaagtgtatcttctatagatcatatatagttgactaaatcagaaaacagccagtctaaacgtctctaaattttgactgaatttctgaaatcactttatttaaatatttttgatatatttgaatttatgcctgccattttactttttgttttccacatgtcttatatctcttttgtacctgtatttttttcattgtaattattctaatactagtttcttttatactaagtaaatctctagggcaatattttattttattgtatttattttctcatgatagggtctcactctgttgcccaggctggagtgcagtggcacaatcatagctcattgaagcttctaactcctgggctcaagtgatacttcttcctcagcctcccaagtagctagggctaggagtacaggtgtgcacaaccacacctggctgatttttttaagttttttgtagagacaaattatcactatgttgcccaggctggtctcaaactcttggcctcaagctattctcttgccctggcctcccaaaacactgagattacaggcttaagtcactgtgccagaccctgagggcaacattttaattttgttaatgctaattttactaaagcatatgagtttttgtttgttttgttgttgttttttgtagttgctttggagctaatcgtacacatcttaacttagcagaatttaccacagatttatgctaacttaattctacaatgacatagagaagttatttctatacagatatattccttcttccctccttttattgtgctagaattgttatacataacatgtattatgtaacataatatataataactatatatgtatatgtaagtgtttgttatggaaattccaatcattttaatcaacaaaaacattgttaccatgaaacagttcgatgactatcaatttaattataactttttgatatgtgatattatctgctcaaatgatacataaatacctgggtctattaatttcatctttacaaacagcttcatgttgacactcattttcttgatcatcagttgtattttccagatacatgttgccagcccatctgagaaaacatagataccgatattcctgactgtcttcttcactcaaacaactgcatccatttgcacaaatctatagcaacgaaagaagtaaaaatgttatgaattcccatcacttactacaatattacaattgtgacctgagagatcatgatagatgcctctctgtctactaagatgaaacctagggttaaggaaacagaaggtaactattggacaagggttcaaagcttggctggcacagcaattccctaaatttctagagctacaagaaaaaccacacccttgctaaactccgtaataggagctatcagtcaaattgtcatttcatttctaactctgatttacaaccaaggccaccataacccttatcagacagagaatcgccttacaaaacacttttctgataagcaattgtaggcctcaaaccagtttcagccagtttatacagacaggacataaactgtctttgtgtcctgtagttcactttttttatgtgaactgccaaattccacctcattttaaagctaaagccctgcttcaaagagaacatgggatgtatgttacatacatgtttactcattgaacatgtgcttgcctgtcccccataaatatgtattgctttccccacaaacttgctgaatatgtctgactctattttgaacacagaccttatgaggcacaaaaatcaccctgccctttaccacttctaggagagcaccctgggtccacatcagagatgaagttttcccagttatattattttgctctgtttcctcagccaaatttcatgttgaattgcgattctgactgttggaggtggggcctgatgggagatgattaaatcatgggggcagtttcccccttgctgttctcctgatactgagtgagttctcctgagatctggttgtgtaaaagtatataacacctctccctttactctctctcctgctgccatgtgaagaccatgcttgcttccccttcactttctgccatgattgtaagttttctcaggcctcccagccatgcctcctgtagagcctgtggaactgtgtgacaattaaacctcttttctttataaatcaccgagtctcaggtagttcttcatagcagtgtgagaattgactaatacacccagttagcgaactgatatcacaaataaactcttctttctactgtttagtctttttggtagtcttttggatgacataatcatttcaaagtttgaatttcaagctttcatttatttgttgaaataatatgtttctttagcaaaggttaaaaaaatcagttttgatttatgtcaaaatcatttttaatagtcaaattgtttatactcaaattgtgacagaaatatatatgtatgtgtaaatatatgtatgtatatatatgtattgaatatatgtacatttattacacaattttttaaaattccattttattttaaccaaatttttatagacattatttaaatagtaactgatgtgatggaaatagcattgtattgatagacagatccatggaaaatctatttgtggttttgctaaatacttttatccttcagtggtttacttgttttctcctttgaactgatagtaaagctttactggattccttattaaaagtaaattaaataatatctttcacacatgtttgtttaatattttcataaagttatgatgctatgttttattgaaaattataattatatttttaacagctttaaaaatcttccacagatatgcccagtggattcacctgatggttaggtaaactgtcagaagagaaatgcacttcttatggagtgcttaaacacaggtatatatttatatatttacatatacatatattcctaatttctacaagtaaattcaaatgacaatagaattttactatctttaaaatcatttctctgcatattttcacattttctttttggttttggttcatagccaacaagttattttccatctgtagcaacaaagattaggaatttggtttcatggtctgatcctttattgatatctaaatagatgaatgtttcatagagattcactctctgttgaattagaatcaaatgagaatctgtcttttcactttctacatagagctcaaaacaagtaagaaagtcaaatctactaggaagtagaatagttctttgacatgaacagataataaagtgttatttacacttgccccaagtctaaaatattacaactgaagctataagttttctctgtgtctgtatgtctatgtgtttgtaattcacaaaggctttcatttctgtttgagtatgtaatgattttctacatccagaggatattagttgtaaagttttttttcaattaaaggagcacttttataactggcttacaaatttaataaacactcgtataagaagcaacaaattctagcattttatgacactactttatttttctatctatctctaactctatatctacaggtagtttagcttcctgagatttgagactatattgaacataacttactgtgcttttctttaaaaaaagagaatattctcttttgttacctcagaaaagttaccaaagttagaaagttgacttggctataaagctatattttctagcttataagccgtattcaaaatttgttaatttttaaaatattctttatggaaaaatgcctaatgtattatttctgcaccttatatataattagaaaatatgaaacaccaaaacttcaaactacccattgtatttttaattattatatatttattacaaaataatacataatgaaatcttgaaagagagcaatattttaacaaggaatattagtatgaaatttggaaaacacagacttacttcatataactatgtgctttcccttttattttcaaaataattattactgggatttaagaaaatctgaaagaactaaagttgaataatgagtttttctcttggctatacctcaaaaaccacataacattttgtctaagggatgtgatatgaacacctaaattatatctaatgctctggttgaaatacttttattaaatggaaaagatggtgaattattttatgctgcagttatgtactatatctaaaaactattgcaagtaatttctaggactaaaaaataattttggatttcaacatgatttctcatctgttcaggtagtctagacatctactagaattttggttttctataaaatttacacataagaagtctctcagaaaaattagcaagagagtaaattatatcagtagacatatagaaacttgaatctgccttgtaaagcagaggaaagatttctcaactttgtgtatacagagaatcaaagatctgcttaaaggagtccattaatctttaaaaattttatacaaaaaattctattaaacattctatcaaaacattacatcaaacatgttaacaaattttggactgaataggggtcggcaaccctaactcctgtatttcacaggtcaactgtatatatattatgtacataaaatatataattaattattaaactttgattgcacaaaaacctcaatattacaaaatacacacaaattaaattagaagttttattctagatattttaaaatgtttacttgatgaaggaatgcaataaaatcatgattttgggcagtggaagatcttttcttcccaaaggaaacagaagtaaaacaaacagctggaaattccctttttgataattcattactagtaatgtatatacataacacaatattattaccccaaagtcacttcatctgtagagaaattaaccttcctgaaggatatttataacatacttacagaaaatgttctgcataggtaaataaacaactctagttaaataatgccagctatcatttcagggaatatcgtgtaattttctagaaataattttgtcatatccacattatattagtacatagggtcacttggcaaaggactctgtgggaaaaaattctgtaagatctaatatatgccctttatcttgccattttgacccttgttattaaatagataaataaagtgacttcagaggtgaaagtgacttttcttaatcatgatacgtagaaagctggatccttaaaataatatctgtcaaggtaaaaattgcaccaaagttagataggtaattaaattttattaaagactattgaaataggggagagaaactaaactcaattctccaaaaatagaatgcaggagaaattttaattgcgaacttgaactaataaaaaatgacagcagtcctcccttattgttggtttcgctttccatgatttcagtcaccacggttcaaaaatatgttagtatggtttagtaagatatcttgaaaaagagagaccatagtcacataacttttattatagtatactgttataattgttatatttttattagtaattgttgttaatctctttttgtgcctgatttataaattaaacttcatcataggtatgtatgtatagaaaaaaatacagtaaatacagggtttggtactattcacagtttcaggcatacactggggtcttggaaagtatccctgcaggtaagagggaagactgttatacttgatgtcactggagaagagtttgatcaatgaaatgtgtcaagcagattgagttattattgagtttgcaaagattttgctctgtgagtaggccttctgtagagtacacagggaagtaagagtactattttctttgatgtttacatttcagagacatggttccaaggtccttgatacagacatcccaggcatccttaaactggcaagaggttggaagaagatttatatacatttcaaaaaggcagataatttacaactgcaaattttttaaagtacatcctataagaaaaaaagagtgcaggggcctgtaggcaataagaaacctgtctgaagtttagtcaaggtgagggaaagaggaaggttgttttggctctatatttagctaactaaaagggaacagattttaaaaatcatatctggatgaattaaagttcaaatttatactggattaagacctagtcataaattctgaaataaaataaacttggtaaaaacctttcacatcccaaattttagtgctccatggactcttctactttgtttgaaattcaccttcccttcccagtaactcataataatatataatttcataacatttttgtagcatggttgtagaaaataagataaacttatttgtaattatgtgtttccattccagaagcatttgcatttaaaaggacctcactcagagaaggaacacattttaatacaaaaaaaattaaaacaacactcttggaatttctgtctttgatgatgaaaactaaaataaacctaatttcccatcataagtttcaaaatactgagaaaaagcaagactaacttactatttactctatgaaatacttgcttctggaacataagactgtgaaccaactaaaataagttatttacaaaaactaacagtttgcacataaagactcactttaaagattctcagtatattgtgccaccaatacgaagctttccttcataaactctaaccaatccccactaaataccctctacaactgactcaaggctctacaccaaataaataactttccacaacttctcccatctgatgcactactaagactctactaaggtgttgttttcccttattgaaagaagtctaaaataattagtttttctccatcaccagaatagtctggtggtcttttggagggtaaatagtgaataaatccaaagtttcacaaaatctcattaaaatgccctcactctcaaggctggatagcaaccaatgcactacgctgagaccactggatattctctccaactgtgaaagtgacataggtacagtatcaagtctaaactccaatatttttcatcaacttcacaaatgtcatgtttctgttgtttcttaagaataaaaaaaattcgaatatatacaaataggaaaactctccgtcttcatcactttttcaggtgagtctataagaggaagctcagctgggagaggaaagcgtgggttctataagtacatcattcaagtgttctaaataagcgatgagttcagatgatcacatcactctggtgttcctttgggcaacatttttattgtcaccttttaaaaaatcttctaaacagtcttagttgatttgaaattgattgatcttttgaattttctggagacatgatattgtacaaatgcttgctgacataagttttcacgggttcttctcagtcttttatacctggacaccacacattcctcccctcatattgtaagccatatacatatctctctaattggcataatttctcaaaggacaatgtgaaattgcagtgaccaccctggggaaattttgacatgaacaagattatttatttgacagatctaatagaacaaaaagggaaaaatcctcatgaggagattctctgtcctgtatatctaatagagagattactgtgtattatacaaaaccttctctttcattttcatgcttctgggattaagaagcactagatttttaattatatggctctgtggaattgtcaagtatgtgagttgtttaaactgtctataataatttgttcttatgtgtttgaaaataggtttttcttcatttaagcatctccaatgctgtgcagaagggagataatcaaactttgcaatcataattttacatctaccagaatctagataaacttcatttattcatttttcactttttctccttttctgttttgcttagaaaaaatagaaattaattgatcataaatatttttataacattctatattgccattctaggatgatttttcagatagtcgacattttacaatgaaaggaaacgattaactgtgctttatttacatgatttctcttcccaaattttaacaaatcaggaaaagcattcatgtgtatgggtaatattgttagtcttttagttgagaaaaacattgggctccacagagctttggcttaatcctaaagttctgatttttcaaaatacataaatactgaggtttgctcatttatattagtacatatgtatttatttattctaaagaggcttatttatttaaaaaggactcatgtaatttttaaataaatgacacttcagaaaaattagcctgatttaatttaactttaagagaaatattctataattatgtcctcaaattgtctgattacacaatctaaaattgatataatcgaaattttaataacagatataatttaaaagggttgaatcttgtgaattcttactaattttactacactgatgtattagaatgttttattgatgatactacaaatcataagaacttaaaatgattgtgtaagtttacaatttctaaatatttagtcaacattaagaacttacacagatatttaatcaaattagtcaaattattttggatgcctgaacaattaatcaaattaatcaaattattttggttgcctgaacaattcctaattaagaaaattataaaaatatagtctctaaatatagatttaaattacctctgtccttatagaatggaaataaggtgtgcaaatacagttgaaggatgtgtatttatatttattttgcctatgataaaagttgttaaagttatataaaatgtgtaatcataaagtaataaaatagccaaaatgatcttagattgctatatttgcgtattttcttgagtctaaagaaattgtctaatttaattaaagttggtgatttatattataaaaggatactgagaactagaaatacataaacaaaacaacaaatatgatttgcttgttcctgacaaaggtttacagttactgaattattaagtgtattataatatgtaactatttttaatatactgataaagctaaaagtcttaaagataaagctgtaatgtaatcatctatgtgtatagtgatgtatatgtgattggcaaaatatatatatatgtaagaacgtattaagcttacttcatatatttatgacttgtaaacatatatcaaaatatattttagggcatacttttagatgttctgtggtatttgaagtctttttgcctgtagttgtaatgcctctagatgaatttgaaggaaatagtgacttgtatcagtttttacaaggttgactcaatataaattgatacattaataaagaaaagggcttatgagtctttactgaaatgtatacaatatgcagaattaaaacatggctttcttaaaatgaccaaattaggatgtatcaagacaagataggttacaaatactttgttaattatcttttgggaaaattcttgaatcattttaacaaaaagttcctattcctaagttgtttaaaatgaagattcttaaatttttcttaattattgttacatattaaaaaatataatcttaatttgtataagacagtggtgaggggataaaaggagggcctctcttttattcttgccataggcctcacaatttttagtgatggaactgcctagagattagaaattattttcatttatttttatttattttattttttaagtagcttgctcgtgtaagagattagaaatctctcagagatttaaacatatccaaaagacaaatgcatttcattatgatctgtaagcaaaaaaagtggcataatcacaactgtatctgagaggctttagtcagcctgcaaattataacattaataaaaaacaagaagactaggaacaaaatgattcttcaaaatttttactttcccatattataaatgtatgacgtaaatataaatttccaagtagactgttgagaatttgtttacgaagttatatttaaactatgcaaactatatattttgaatatttaagaatctgtaacctaaacatttctaactttctaaaaatcagacaattacaagctaaagagaaaaatgaaaagcaactacataaaattaccttacctcttttgtgccttcatgtgggaaccaacatgaagaattattatcttcaggatcgttcacataggttgcatcttcagtgcagtttgcagccagaaagaaataggcatcaataaccccttggcacttttcgccttcagatcctttaaaaaaaaagagataaaaaattaaataaactcttacaaacttgaattcagaatgaattattaaggactgtggtcaaattacttgaaaagataaatttgacaacatctgccacaaaataagttcctgtatgcatatgatattgaatttgaagaagacctcaaagcccaacactctcattttaaacatgaactgagaaatacagcatcacaagaagaagaagagacagctcccaggccaattcattttttaaaataatcaaattttgactaaactgtaattaataattataagaaaggatggtagaacgataaaaagaacactgtcctataacaaaaataaaagcagagattgcaaaagagcagaagaaagaagtgacctatattcaagagaatgtgacctatattcaagaggaaaactaaaattttaaggcccagacctagaattctcagacaaggactttaaaatgattatattaaactttctgaaaaatcaacaggaaaagatgaataaaatagataattagataaggaattaggggatgagagattttgaaattgtaggaaaaaccaaacaaaaaaatggtaaatctcagaattgtagggaaaaaggagttaattaaactgggctgaaaacccattattggtcattaatagtggtaataaaagaacatagaagacctgatccaatctttttgtaaacatgactacatctcctagtaaacaaacaaaaaatatttgtcagaggacagtatttatctaaagaatcttttagcaaaatatctctggctttggattgcttatagtaaacaaatctaaactctagggactcgcaaggcatcatttcttggaaaatagaatgtaagctatgcattttacaactgagttgtaaattagaaatgattcataaactgacatctccctaccgtgtgaatatttcaccaagaaatctcacatattactggaaaaaaagaaggagctaggaaccaagcacaatatcccaaatctcttcaatcatatgtatgtaatttgactgtttataaatttaagattacagaaaattatggctatgttaataaaacaattaatggatgagattatcagatcaaacacaagagaagaaaagatcagtaaatttaatgataggtcaataaaaattctacctgtaacattctgagagtaattaactcaaacaggattatgctagctccatataattaattgatatgtgttcctccctctgtgtttttgtgcaaatttatgtagtattagaatgaatactttattgaaaatttggagaactttaatagaaggccatatatttcaagtatgcttttgtgggatgatttttaaaactattttattcagttatttaagaaattgtaggattatttagaattgaaatttatgatttgctcagtttttccaactagtatttttttagaaatttatccatttcatttaaattgtccaatttattagtataaagtttttcataatgatatatctgactaaacattaggatttaactcttaacgtcttccctctgcctcccaagacctcaaaaaaacagagaattaaaaaaataaataaaacaaacgttttaacccacaaaaaagagtgagaagatgaaaaaaaatgatacactgactaaattagcagaaaggctacagccaaaacacaaatgaggggatataattatgaaaaaaaaattggactagcagaaatactgagatgctctgggtttaaaaagcatctgagaatctgatactaaggtgggctctggaaacacgattagctgacactgagagtctctctcccaactcagtgatccagattattattctaactcctcactcagctttacaaacaaacaatttccgaggtttgttttcaggagttaaagaatctcaggagcgcctgccttaaggataccaagctccttgagggtcccctagcgaaagcctagttgccatcctgcaaccctgtcatagagctccagtcatcatggcccatccttgtatggtcagtttccagtcagccttcttagttcctctccgttaaatatgatcaccccacatttggcagaaagactccaaacgagagagaacaaatctttataaacagtatttacagaaaactgagacactaggcaaaaaagaagaaaattaaaacaaacaaaactataacatttttagagagagaagaaaagtcattttacccttattgaaaaaaaaaacaaaaaacaatgtccgaagtgtgtataatttaaaggatggaaaactgccctagattattacaaatatagtaaaacaaattaaaaattcaaactcattttgagatattcaattggaggaatggagtagaaaataaagcaatatgaaaagaaataggaaagagaaaagaaattatgagaaaacgaggggatcaatttaggagatgtgatacccaatttttggaattggggctacagaaaaaaacaggaaaaaggactttttaggggaaaaaatacagaaactacctaaaaatggaaagacccatgcttccaaatagaagagtttaacaagagacaacaagaacatactatgtaaacgtttcaacattgtgaaatttcagaacactgagcaaaaaacatggaaaagtgttccacagaaataaacacaaattatatataaagaagcacaaggttgtctactatacacatgattctacactgctgcatgcctttctttcaccttatcatgtatctcagtcctagatgagttctacattcatttccatatttatgtttactctttttcttaataaccaatgataccaggtataaaattacacctatattatttagcatgtggatgtattctcaatgatcagaaggttaggtcaaatggtatagaatttgtaatattgacggatattgcaaaactatcccacttagatattatagtgattttacagtattgccagcaatggatagtcattaaattgtccaattctaaaatttttaccaggctaagaggagaaaaattatatacttacagtgttttttaaatttgctttgattgcattatgaatagagcttagcattttccccacatatttagggatactctctgtgtcttcgtatgtaaactgggtgtttatattactgacttacctttcagctttttcagtttttccttcttaatttctaagttattgatatattctcgatcctaatctatcttttgtgaagtaaaatgtttgtgcagtgtttcttttgcattttgatttttatgtctttcataagcagatatttttacttgtcttgtagtgaaattcaccagtcttttctttctgacatcaacatttttagtattaactataaacatcttccccatccattttttttttttgtttttccctttgagtttttgtgggtaaatactaggtgtatatatttatgggttacatgagatattttgctacaggcatacaatgtatagcaatcacctcagggaaaatagtgtatccatcacttcgagcatttatcctttcttggtgttacagataacccaattatattcttttaattacttaaaaatgtacagtaaattattgttgcctgtagtcaccctgtggttctatcagatactagatcttactaattatatctaattatatttttgtacccattatctatccccacttccatccacctcactatccttccaaacctctggtaaccatcattctactctctatctgtaggagttccattattttaattttaagctcctacaaatacatgagaacatgtgaatttgtctttctgcgcctggcttatttcacttaacataatgacctctatctagttccatccatgttgttgcaaatgacaggatctcatttttttatatagctgaatagtattctatttagtaaatataccatatttcccttactcattcatctgttggtggacacccaggttgcttcaaaatcttggctattgtgaacagtgctgaagtaaacatggaagtgcagatatctcttcaatatacttatcccctttcatttgagtatatacctagcagtgggattgctggatcatatggcagttctatttttagtattttttaggaacctccaaactgttctccacagtgattgtactaatttacattcccaccaacagtgtacaagggttcccttttctatacattcctgctagcatttgttattgcctgtcctttgcactagggtgagatgacatctcattttagttatgatttgcatttatctgatgactaataatgttgagcacattttcatatgcctgtttgctatttgcatatcttcttttgagccacatctatttagatcttttttcccatttctaaaaatcatattattattttattcctgtagagttgtttgagctccttctgtattctggttattaatcccttgtcagacagatagtttgcaaatatgatataccattctgtgagttttgtctttgttgtttcctttcttctacagaagcattttaacttgctgtgagctcatttgtctattttttgtttgattactagtgcttgtggggtattactcaagaaatctttgcccagtccaatatgctggatagtttccccaatgttttcttttagtagtttcatagtttgaagtcttagatgcaagtctttaatccattttgatttgctttttgtatatggtgagagataggggtttagtttcattcttcccccatccaaatttacaaagcatttctccaacattctctaatatttttatactttctttttatgtattaaaacttgtatctatttcaatttaatccagagaatgtttaaaggtataaacaagtcgaattttttttcagatggctatccagttgttccatgttaattattaaatagtccctacttattctaataatcggagatggcagttttattatatgttatatattttttcatgttttggattcattttgagactttgtgttttgtcatatttgttgactaccaatgcggtggtgccatgcttttcattaatgaagctatgtaatctaatttaatatatggcagagctcattctatacaccacttgtccaaacaatgcacttttgcagagtacacttggctttatttgtcttttattccatgtgaacattaagaaataagatgtcaatttcatagaacacaaagataacaccattattttattaaaatctcaataaacctataaaataatatgaagagttgaaatctttaaaagttgtatgtccagtataatataagtttttcaggaggaaggttattattattttaagtttacagatgaaactgtatgtatcatacataaggttatgattatgtatgtatgatatacaacatgatattttgaagtatatacacattgcagaatgaccaaatctagctaattaacatatgcattacctcatatagttatcatgtttgtggtaagtacacttctgaaattataaaactcactggcaaaagtaaacacattgtaaaattcagaatactcaaatactgtatggtagtgtgtaaatcactaatacaattagtatgaaggttgaaagaaaaaactattaagaataatagtagctacagtgtaatatatctttagaattttctttcagattatgtatgcatgcgcctatactacagcaatatctaaagttttctccatgtagaagttgcatgtttttgttaattttagtccaatgcattttaacattttaattcttgtttgtaagaaatattttcttccttatgatttaattagcttgattctgtttattaaagttgtttatttctaattagtgacttaattaagagaattctctttcaaggcatgtaaaaatgctttaaaaacttactataagtgatatgaatgaaaaatactaaaccactttttttaatactcagatttttaaaaagccttcaactaaagattaaaactaaagtccctaaaatacttaatagatatataaatagcaggcatttgacaaaagaagacttgaaggtagaacaatatactaagaaaaatagattttgataaagattgctttgttgatacagcatttcctattttcacaaaaatcgtttaaaatttaagaagtaacgtataatgcataaattataattaatattctggaatgtcttctaccagaagatccattactttataaaggaaaaataaaactttcaaagtaaatatttgtttgcaatatcaactcacaaatgcaacaatcactatttatttaaaaaaaaagttcactagtacatgttaagtgttttaactctatgtttaacttggataagcaaactgaaataacgacatgcttcaagaagaaagagatttaaaagaatttctcttattttctttttttgtctaggattttatcttttcttaagcatgattcatattgtcttacttcacttcgcaactctttatccactctgtcagtagctcttttcctcaaacttaataatacacataatgaacatagatgatgacattgaaaagaaacagtgcatgtcagctctttctcaagatgtgcactgtcgaccaattgtccttgaaggggcttcttctaattaatcaccatcccttctctgtagagcaatcatattggcaagaattgattgggcgtgtaagacacttaatttagttgttagaaaaatcccttaattaaaataatcttcctgctggtaaaattaatgcaccccatgcaaaattaccagcatgattttaaagttcctcttcaattacattttatatttcgtgaggaagaagtaaaagaagatcttaatggcaattatcaaaagaaataagaaggaattttgcaatacataaaatgtataattctatttacatatgttttcatttattttaacttctattttgttttgaaaacttgagaagtttcactgctgaatcttcatattgaaattcaaaatgagtttaagtgttttacttaaacattcattcagtctgtgcattatcacactgtttcttttccattggaaagcccaagtcatttagattctcagatgtagcggtcacataattttaatttttgttataattagctatattcagtaagttctgtccagtaattcaggaaggaataatgattaaatatgcatacactgttttgaagataattgctttctgctaagttttccatgagtaattttaactttgtattacaccacccattttctaaaacatatatttgttattttactgccattcataaagttgactatatttgctcaaagctgatttatccatgagcaatttgacttactattactccttccattttccctcaaaaatacttctgccatttcatcattgtgaatatgttccctgtagcaatttatagttctcaaaagaagtttaatatttaaaaataaccaaacatatgaaagcattattcctactatgagataaaggaaaatgaagtgcaaaaacgatgcaagcactgaaatatgtgaactaatttggttgtaacagtagagagcatttctcaatctgcacactgaaagcatgtagggaacctcaaaaaatactctgtgtccatctcactacaattccagtttgattgttctgtaatgagagttcaccattagtatgtttcaagagctccttcagatgattctaatatgtggtcagggtttaaaaacaactgaactgacacaatccctaaatagtcctgaggttaattcctctaacctcaactatatttatttctttgtttcgtctgattgtgtcatttataaaatagtaagtattcataacagagtctctgaaagttccttttagcatcaacatagtataatcaacaatgctttgctctcttctaccacttttggtcttcagtgtgatctgattaatgaactgataactatttctgtcactaaaggttgttaactctacagtatactattttatgagcatggtgaaataaattatcatgttttctgtttaaaaggctaattgttagtttacttcaacactgttgtgatgtaatacaatgttagaaattcagctgctgttggttagctgttactcaaaaacagacacatcaaactgttaatttgctggttgtttgtaaactgaagtgccaaaatatcactgtcagaggaaatattctttaaaagaatgaaaataccatatagtcttaagaatgtaaatcaaatttgcatcagctaagttaaataatattagaaatgtaatcaaagaatgaaaattaagctcatcaaaatagattgcgatagaaattgaaactctataatataaacaaaaacatatatgggaacacaagtgctggaatgatttcatttcaagtgtgtaagacagaaaactaggagtcctgttgacaccttcatcacttgctatttccaattcataaacaagatcttccatttatttcaagcttccagcattatgactcaccttattactccaaccaactccctagcttttttccttctcttccatgtgtttctctacttgttataaacttatggaatgtgtcaaaacctatagtaattttctattccttttagaagagaaatcaaaatatctaacccagcattttagttctggctttaccccctccatggaattgttattagtcttttctcacagccccagacaggccttcaaagaagccatttcttctaatataatgtttttacaaatacaattccctcaacccagaattctctcttctccaacttctctgccatgacattattctctatatctctcttcaggggtcattttctcatggaaaccttttctggcaacccaactcaatatctcaattgcccagtttttttttctttttttctaaataggctcattgcttataagcattcatggaatgctacctgttttcataagagcattttgtttttaaataaaattacatagttatcactgtatttgtccattaaccactcccttccaacaaatggatttatgaaagtaggaaatagctctagtttacttcactattatctctcttgcaccaagtagatttcctaggatgtagttggtgttaaacacgtcagttaaaggaatacattagaaaataagagtattaattttatttttagtttatattacgttttgagatataaaatactttgtgtgtttagaaaatgaatacgtgactagcaaattttgaaatgattcaagcagattgaaaaaaattacataaatttgttacctgcaaatcccaattgccacacatattcaaattgagcaggacctttatcttggcaaataccatggaaggtgactccacagtagcagaggtgttgatgaattaggtaaacattcttcaaaaaccaacatggattttttgtgcaccctggaatgcatacatactgcaaaaaggaaacaaggaaaaatggtaaattcttttttgatatatttttcaatatatacatataacataaacagctaatttttaaaaccacagtgattatagaaaactttatgggacacactttttatacttctctttatttcttctatttctttatcttttctttctgtactatcttttgtcatatccatgttcaaaagcctatatgataatcttttagctttgactcactctcaatatacaacagtccctaatcttctgtttgatgggctataatacatctttcccctcacaaatttaaaatacctatggtataaattaagagatacaccatttaaaacacttataacggttgaattagcacaataaatgtcatggtgtgttcaaattagacttttgctatcatttgaaaatagttgaagataatcagggcatattgtctaataatatgatttgtttatggtaatctccagcatcttcaaatacaaaaatcatatatagttatatccacaattgaactaactaaatgtaaaccattttaggtcacattgaggtcatcactaagttttagtacatgctgcgctacttaggtattaggaagacatcaaccagcatgaaatttaagccctagagacaaactagggctatgtattctctttagagcatacccctcaattatttctacttctccacgttttttattaacaaatctcccttgaatttggcagagaaaaacacagctgagacatgcagtacaaggaatctgacagttccattaatgaaattactacactaagtaagcattgttctgtttcaagtcatggtggtctacctggatttgcaatcacaatttcctaattgcacaacaaccttaaagtatgagtcaacactaaatgtgaggaaaaaaaaaaattggcgaggcgtggtgcctcatgcctgtaatcctagcactttgggatgccaaggcgggcggattacctgaggtcaggagttcaagaccagcctggctaacagggtgaaaccctgtctctactaaaaatacaaaaaattagtcaggtgcagtggcgtgcgcctgtaatcccgcctactctggagactgaggcaggagaatcacttgaaccagggacgcagagattgcggtgagctgagctgagatcacaccactgcactccagcctgggctacagaataagactttgtctcaaaaaaaatgaaaaagaaagaaaaaaaagaaataatttaaaaaataattaccatttaattatattaaatgattaccaaaaaatacaattttatgatatatttccaagttgtgagatgatcaaaatctttaacccattacttttatactgagacatcaaatgttgaagtctacaaatggcattaaccaatcttcactgtcagtggagattgtctttattggatttgggtcctcattgtgatagaaaatatgaaggcctaatgaattctgaatatatgactgtacaaaataaacttagcagaatagtacattattcatattgataggatcctgtagagtcatttcttcacttaaaacttaacaaaacaatagacagtttttatctgtcatgtccctctcacccttccctctgagtccccaaagactgcatattgagtacagtgcacactgcttcagtgactggtctaccaaaatctaagaaatcaccactaaagacttattcatgtaactaaaaaccacctgtacccccaaaagtattgaaataaaaatttaaaaataatttcagaatatcctcttctggacactggcctaggaagagaactcatgactgagatctcaaagtacaagcaactaaaacaaaagtaaacaaataagacttgattaacctaaaatgcttctgcacagcaaaagaaataatcaataaagtgaacagacaaccttcagattgggagaaaatatttgcaaattatgcatccaacaggggactaaaatccagaatttataaggaactcaagcaactcaacaacttcaaaatacaaccaaataacccaattaaaaagtggacaagtgacatgaatagacatttttcaaaagaaaacatacaaatagccagcccacatatggaaaaatgctcaacatcaccaatcatcagagacatgcaaattaaaaccataatgagacatcatcttataccaatcagaatggccattattaaaaagtcaaaaaacaatagatgttggtgaagatgcagagaaatggaatgcttatgccctgctgataggaatgtaaattagtacaaccactgtggaaaatcgtatgggaatttctcagagaactaaaaacagaaatgtgatttgatccagcaattgcactaccggatatctgcgcaaaggaaaagaaatcattatataaaagagataccagcacaagtatgcttagattcattattcatgataccaaaaatgtgggatcaatctaagtgtccaccaattgatgactagataaagaaaattgtttatacacacatacacatacatatacatacacacaatggaatactatttagcaataacaaagaataaaatcatgtcttctgcggcaaaaaaataacaaaacagcaacaacaaaaactaagttcgaattaagtcctgtctaaggtattttgttttgtctgcaattgtttttgttcttgtttgtttgttttttaaactaagaatatcagaggaagttggatcaaggatacgaatccctgtttctgccactcaggagctaaggaaccatttaaaaatgagacattaagtattctgtaacaaccttgagagagatgagctgataaggagcaatgagagatgccaggaaaaatgacacaaataatatgaatccctgctcacaggggtgctgtggtattcttcctactactttaacctgaagaccaaatttgacttctggcttttcttaatgaaaaaaacaaagtcacccaggatatatttcaatgggtgcctgaacaatttatctgtacttatacccttctatactgaataaggacactatgaagatattataactttagataaaatttggatttagagggagttatttgtgattgcagctcttaatacctttttaaaattattgcaacaccagtacattatcctctaacataacaacctgaatgttaagagcagttaatttaaaagagcaatttatttaagccatatgtagaggctaggagtgttgtcatataggtctatctctgattctgacctctcatttataccttgtgtgttcatgtgaggatgctgacacacacacacatttcacagcaccaacatgaaaatagatgtacaatataacttttaaagcaagttaatataagtaaagtatgatggtgagatggaagagtggaagcactttttgcataaaacatttaacttaatggcctttgggaggaattagatgcatcaccgctgtattacaactgagccattaatcttgaagcttcatcagtattaacttggttcactttcatcatgttgttgagaggctcatcatttctgtagaggttcaacagaaaagccttctgagcagtgtacaagttctttttgtatatttacaaaagctttattcagtttgttaacttcttaatcattcataatgtttatcttcttaagaagattagtggtaactggtgttgctttgattttagtcttaaagtgttttttggcttgctatatgaaatacattcctggcctttgctctcttaatttgttcttgtccatcgtctataatacgcatgtgcaccttcttaagcttcaagtgatgcaatctattgagtgaataaactaaatgtttgtctttaaattgctctgacctttctagaagccaagggaaaaggggaaacattaaaatataccacagctgtttttattgattaattttatactggtagattcattttggtttattggatgaaccagatttccagttgatattcctaaggaacaattgttatatggtggataatataaaacaaatgacaatactttggtaatactattatgaaaaaatatttattatatagaccaggagtctgcaaagtattctcttaagtactatgttttacaagtaagatgatttttaactaaatcaacttcctgtttttgagtatgaagttcaaaaatgctgccaataaaagaaaagtaattatttcaaattcacagtgaaatggcgactaatgtaatgctcattgcttgctaaaacactattttttttcgtttttgtaaacttaaataaaaagacaattaagtgagtcaaacgttatttgtatgaccagataggtgtctttgtggaattcagttattttaatgtgacctctcttttaaaatgaagttaactttcagtagaatgatgaccttctctgttaagatatcttaagtttcacagcgacctcaggtactacggtaatattaactttggcccatcaatcttatttagaacaaaagagattaaaaattagttagtttacatggaagtgttcacttagtttgattttttaaatttatttaaattaatatttggaactgatgctttaaaataatcccattttaaatactatttcccatttaattcatagattaggtgacaaatatttaacagaaaattttctgtggtctgggaatttatatcaaaatttatacacttcaaactttacctctgaaatagaagtatgattatcttcatttaaataagttcacttattatggtatggcgaatttaaggtgatcaacttaactgtttgcctgggactttctgtttttaaaagctaaaagtcttatgtctactgaactactcattcctaggcaaactgggatggtttcttttcctaagcgttgattataaactcaaagctttatttctgaaattaaggaggatgagtagtagagctgtatttggcatgccatgagagagagaaatgatcctctgttgctgtaggtttctgaagtgtgtgtgtgtgtgtgtgtgtgtgtgtgtgtgtgtgtgttgggagaaggggggatttagttaccatagaaaaacccaacttaacatgcttatcagaagtttcctccacctataggtgagactaaactcattatcaaatatattaaattagaccttatactataaaatgtatagctcatatttctataagaaaataaaaattacattaattgcagtaaacaataggtgtttataagttgctaataacaatatacatgaaaaatagcaatgtgttaatctatcctgtacttgacagcccactcgatgtataaaaactgaaaagaggaatcaattcagcatttgatctatttcttcttttagtgagttgaatgccaaggtttggaaatacacaaacatgcctttggaagcaaacatctatcttacttttgacagtgaactaattaaatggtacatattagacaactaaacttgaactgactttgaacctcaataagcttgtgagaggagtaattctggtaagcaaacagtgaaattaagacaaagatgaaatggtttcacaatgacagtaaaaagaaacaagagaatcaagaaattgtctataaaaaggaaagtaatctatttcttgtatctcatgtcacatcagaaataagcaaattttgcagtatcaaagttttgtgatttttatttgattgacacaaaatacatattcataacaattttataaccttaaccaactgatttgtcatttcatgtgccaaatatattcaatgttgctttccttaaggcttttctattttataagggaaaactaattttgattgctagtatgaagaggattttaaaacaactttagatgctgatttcttatttcagcagcaacctttcttaggaaagataatgatttccattagaaatcttgcttttcatgatgtattaagcattgtaaacttctctttcttaaagaaactatatcatgaaattatggcatatacctagaattacagcatctatattccctggtgattctatttatatttatttaaagcatttgctagtttttagaaaccatacagaaaaatgaaaagaaattccttcatataggcagatattaatagtgggaaaacctcacctctctctctttctcttttttcttagtatttgtatatgtggccattttaccacatatgtgaattcattgttcaaatgggttcaaaagcattaactcattctattcatttcatcatttttttcagtagcctggatagaatatttgtatattcatttccatacttcagataaggaaataaaaattatagaatttttttcaactcacacacctcaattctcacaggtctaagacataaaacctttatacttaggtttcaaatctcatcaattgttactttattttaaaatttattctctattccccaataaaaatattttcaatggaagttttaattgacacataagaactattattgttaaaaattggaagtatataaccttataattctgatgttttattgtttttatgacgccaccttcttgctttgacatcacttattcacttatccttctgaagtttaagtactaataaattattaacagattatttctaaaatatcttattctatccaatttaaagaaatgtaatgatctttcaaaaagcaatgatgaatttacataaattaatgttcaatttccactcatagtcaaaaccttctatggaaaattaataaagtaaaatcaatagtaattatattatttaaataaaaaaattagcattattattcctctagctcttctaggtagcacctaaatttaggaactgtatccaaaaaacatagaataatgcaaaatgaaaaacaaagctggcctattttggctctctggggaccaagggaaatctgattttaacagaaaattctcaagtagtttgggaaattatataagatcattttctggtctcctattattactttaacatttttccataaatcacagtagttgctgacaactccgtgaccatactatattctagagaaatgtgaaaattcaacaaatattttctgaaatataactcttctccaactgttatgctaaaaagagacaaaaagtttaaattacggcatccttgctctcactgagctcacagtctaatgtgtgtttacagtcattccaagaaatcccatttagtgtagtcactgctatgtagaaagacagtattgcaaacaatgggaacagaaaggaagaagtagtcgacataatcacaaatgttgtgaggtagtttcattctggatgaaggcatgtattgggatagacatgaaataggaaatgcaatcttttccatatttccatctatatttctacatataaaattgtgactggagttcaaggaatggtaggtgaccataaattattgaatatctgtacttttacccaaggtattataattaatttctaaatttcctttagaaataccatcattctcagcaaactatcgcaaggacaaaaaaacaaacaccgcatgttctcactcataggtgggaattgtacaatgagaacacatgaacacaggaaggggaacatcacacaccggggcctgttgtgaggtggggagtgggggaggaaggatagcatttggaggtatacttaatgttaaatgacgagttactgggtgcagcacaccaacatggcacatgtatacatatgtaactaacctgcacgttgtgaacatgtaccctaaaacttaaagtataataaaaaaaaagaaatactcatatatggatatgtgaatgatcaatttaatttaatgacttgtgaggtgactgacaggaatttctttctctttttttttctttccttccttctttcgttcgttcgttccttttttttttggtctgtgtctctctctatcgcccaggctggaatgcagtagtgctatctctgcccactgcaacaacctccacctcctgggctcaagtcatctgcccatgtcagcctcctgagtagctgggactgcagacatgcaccaccatgactggctatttacatattttgtagaaatggggttttgctatgttgctcaggttggtctccagctcatgaggtcaagtgatctgtccatttcagcctcccaacatgctgggattacaggcatgcaccaccatgctcatcctgaaagtaatttcttagactacagtgattcattatctaatgtttccctccaaaaataacacagataacacaaagcaaaacaactaaagcctcttattttctaattatgagaaaatgactgaagaaattgagcaaatactggaatttttcatgattgtgaagaaatgtacactattctaaaacacatacgagtaactaatttattattcacaatctgtagtatctcataaaagtgcaccatagctaatggccagagaacctgttcttcccatattttcatttatttccttttaaagatttctttgattttcaaaagtattactacaagaacaaaaatgtggctacctaattcatcaccaagtatttgattttctcattttaagacatgataatcactattattcaagatcacttctttattcaataggtatttattgtaagtatgctctggggagttattaaccacatatggcacaaataaagtaaaagaatgaaattgtcccagttctcttagatataactttaaaatgaacacaaataaacaaatgaaaatctcacaattcctaaaggcaatacattctagaacatcgttactccaagatgctgcaagttgagtatgtcatttaaacacacatagatatattttactatttgggagtaaagtaaaattgacatatatgtatttatgtgcatgtgtatatatatgtgtgtgcgtgtttgtataaatgtatatacacatgcatatacattacatatatgcatatatgtatgtatacacattacacattattatatatatacatatatgtacgtatacatttatatatatgcctatatatgtaatgtatatgcatgtgtatatatgtaatatttttactacaagtgcttaaagattttcttcttaggagacagtttcttccccttcttaaatatatacattttctttaaaaatttctacattagtattttatatcactgtagacaaagtgtaatattctccagtgctatactgttctctgattctgatgtatttattttttctcaaggactttcatttttaaactttataaatacagtgtctcttattaaactcttatcattgctttaaattcaaaaaaagaaaattagaaaagttatgggaaatctttagagaatgaaatcacccttttcttttcaacaggaaagcaagcagtctcaaagaaccatgaaaatgatctgattgcatttagtcctaaatcaactttcagctgctgaggtaaaaatgcctttgccatgacattacacctttgtagttgtctctcacatactacatagacttgcatgccaaatgtcattcaacttcaggaatgaatgtgatcatcagggctacaaaagaagataaatgattatcttactcatttaaaatgatattaaaactctttttttttgcagttaaatcttccttttgctcttataggctacataacatctatttatttcattcttctatcaaacaaatgactgtagaaaaccaaaatccctattttcctttcccagctaattgctaatgcaaacttcttataatagtggcataatattaaataaacaatcaattaagcaattaaatatatagctttaggttcaagataaccaacattgactctactcattttttgttacagttatatttaatcatttcagaagaaaaataactcctttaagtatatgtcattttgtttccacaacattgtaaatgttatgattgatgttgtttttcatggcgtagacagacatacttgataacgttgccatctcaggaagagtacatctttaacaggctaaaagtgactttaatattctttttaattttcataattagttaaaaactttgataattgacgatttaactcttttaatacaagtcaagtttatttagtagcatttatttagataacttcaatctatcagtagtttgcattttgtaatttaactaaaacttagattaaatatatgtgtcacatattttttccaattgtagaagtgtatgtgaactaaattttccctcaaaataccttattataattttttaatatcatttttgtataatcaaattttaccccactgatttcagtttataaattcagaaaatgactttaaatatattcttgcatttgattttctctattttaatttaattatcttttttattgtgctacaataatatcttaattattggggctttataattaattttttcacctggtattccaagtacttctttggtattttttcaaagtttccctatatatttttaaatttgtttttccaaataaactcttggatgttttttcttaaatatcccttatatgtaaattattaaataacatctgatacatcacatcatttgattttgtctttgtgaatttttgaaactgtagggtaatatgatttttctcaggctttgactaaaaaataaaatcaactaaatgttttttttttcaattttttttcaatttatggtagaacattgattagaacatttccttccataagaagtagtaaataatcaacctcagaattgtattagtcattacataggaaacagttacagatatactagagtaataatacagaaatacaaaatgaataaaactttaaaatatgataaccttgcatgagttgaaaaaaattttttcaaatagtccactcattacagatatgcacttcagatatgttttaattcatggtcctcataaaagagatcaaattggactatattaaaaatattaagacttcttatgatatccttctctttaggtttgattctaggtaattttataattatttcagatatttcttatatctaccttttatatcaggcattttaacgagatagttcagggacaatgttctctcctgggttaatttgggtacttttaaagttcagctccttctccccggatgacaccatggagctctcaacatctttacttaaagagataggatacatgtattaaaaacaagtacttggccaattagaatattatggagttagaagagaggcagctaaatttttaaaaaatgaaatgtgtttcttcagatttctatattcattattcaaatgcgaaaagtaactttttctttggatgaaaatctcagtgatagtgtgtgtcaaacatttttggtacaattgcataattaaactctccacctcattttaaggaggtctggtcatctgcatactgtcaaaaggatttttttgtgagttgagatagattgcttaaaaaagtcatcctaactctgaagagcagctggaaaaataaacagtcaggacttcagccaactatcaatctagggaaacttggtaaccaacaaagaatgaataaattcctttctctgttcttatagcagaagtaagaatagtcaagaactgacctatatttgctgatagtaagcttatccaaaatacaatagcaacaaccaacaaaaaactcactcatatttttccaggacctaggaggattcctgttttggccctccatctgcctgccttcttacgcctgaaaaattttctgcctgatcccaggtttagattggaaatgattatgaagaactgagcaaaagatagaaaatattaacctgtggatctctgtctccatctcctgtatctccccctgtgtgagtgcgtatgtgtggtcagtccctcctcagtaataggtggacactattttcaaatctgaactttcagaaattgatgttaggtttctcttttattttgtttgcaattaaagttaagatatatatctcattgagtgactattacaaagcctaaggtaagatcatggcctgtcttcctcaacattgtgtgcctggagttgagtttccacaatgtaatgtttttgatattctttcaatgagctgtactagttacatagcactaagagattacaaaagaattagagagagattttcctgaaagacaagtgactaaagatttcaccaaaacttactgaggctaaacaaaagttacttagtccatgggcctcttgtaatacccgtgattacatctgcaatcagaatgttggctgtctagtaaattatgtatgattctcactttgtaatgtggattgccttattttttaaatcagtgtttctgttgacttttgagtacaaggtgaaaacatgactttgcaattgttatagataacataagaatcatgtagataccaatttctaaacattagatgttcatattgggaagaataccagttagtgccttttgtgtaaaccagacctagtttaatgcctgttactccagccaagcaactgttcggaccctttttccttctcaaatgtgtcctagtatgaatgataaattagtaaagtatgtacacatgcaggatatggcattagcacgggctattcctgtctgcgttagaaatgggacagcaaaatgttacaagccaagatctcatttgtgaaagtctgcagtttcactaagcagttgacaaatggatctgctaaacgtgccaaccatgtcaaggtaaatgcagaattttaactaatgaaagttaaatccatttgttctgagatatgcaactaactaaacatcttgctgcttttggtttttcctgatctacactcaatccacttgtatcagttggttcagatggatctaaaagctaagactaaaaatgactgctaagaataaatcttgattgacttcttttgtgtattttatatacatttttagagaggacctatcaccatatttacattcaaatttatgtgttcagttagagagcttctttaatgattttcagctagcaagtttactttggtgtaaattttaaaataaaatttcttgaagcctttgtggatttgctttctattactactgtaatgaaacactacagatgcagtggcataaaacaacatttattctctaacatttccggaggtcggaaatctggaatcagtcttattaatgtaaagtcaaggtgtcagcaagactggattcttctgcaggttctgagggggaaatctgtttctttatctttttctcagcttctattggtagcctatattatttggcttgtaccttccttccttcagctttaaaaaataacactccaatctctgctttgttatcatatcaccttctctgtctctgattctgtatgcaactttttaataaggacctctgtgattatatcaggccccatctgataatcaggataatctctttatctcaagatacttatcttcaacgtatctgcaaagtcctttttgccatgttagataacatccataggttatggggattaggacacagaggacacaggggaaaatttgggtaccattattcagcccagcatactctggatgctcagaaactgttgaagaaagtttacgttctggtttctttcccaaatatttgtgaaactccttctaaagtactgagctttaccatatgtacagatagaatggctctaaatcctgttaataagcatcttggtagaagagctgctatcttgaggatccaaaacataatatgaaatagattcacataaataacctgaccttattttgtttttctttcacaaatgatttattcttaaccatagcaggcgaatttttaaataataaaacttgttaaaaaaagtttttttcaattatttttcctgtttcagcactagtaaagacatagtgacattctcaatttctctaagacatttaaaatgtctatatgtttcctttaaatataaatgttttaactattcacaagcattgcactaatttgaatgaattaatctatcacttcttatagttgttttaatttattttatcacttacaaaagttccgctgaaaaaaagcgagatacaagataagcttgcaactcctttggtgcttactcttgtaaatgaataatagcataaaaatcaaatataaaagtgtgagagaagaagcttatgaattcattattagaggtctcccttaaacatttcttactctatagctaatatcaattattatagccaatcaacagaaaacatgtggatttataaagtacttctcattggaaattagtcaatttacatatcatgcatgtaaaggtaacattggcatagcagtaattcctgagcatttctgtattagtccattctcatactgctaataaagacatacctgagactgggtaatttataagggatagagatttaattgcctcacagttcagcatgggtgggaaagcctcaggaaacttacaatcatggcaaaaggggaagcaaatatgtcctttttcacatggcagcaggaaggagaagtgctgagcaaaagggcaaaaaagctccttaaaaaaaaccatcagatattgtgagaactcactcactatcagaagaacagcagcatgggggtaaccgcccccatgattcaattacctcccactggttccctcccataacacatggggattatgggaactacaagtcaagatgagatttgggtagggacacagaaaaaccatgttaatttttatttttgtcctagatctattaagatactggtaaatttcctgtacatcaaatccttcacacataatggaagttatgtggtaactttgatttctattaatcttctcagttgaacacatctgaagctttattattgtttgctgcctaggaaagaacaagccaaaagggcccagataatactatttaaggttgaccaaaaataaagtttctaccactttgaatgactaacaattttatggcaataaaaccacatgagaatgacttaaacatgaatcctgtgaaagatgcttcttacgttatttgaaaaaattcttccaagtaaaagcacattgttgtttgcttatttaaaatatgagagtaatttaaattattaaaatatatcatagaactagaaaaacagtaacacatgcacatgaacaatatttaaaagtgaacagctagtttgaggatgctgctctctttcaagtagtactttaagcataagccaacttccctcccaagagtcagtacaagtacaggataaactactcaattaatgaagttctttcagagagccattgagaaatatgtccacgaaagagagagatgagaggagatgtaaggcatagaacaggacatgaatgaaatggatcatgatcgtatggtattattgaagctacatcagagcaattcagtggctatttgattttgttattttatgcttaatacatctgggatcctacctctttctccccgttttcttaaaaatgaagtggagcaagctctctgttattatcacacaagttcattctacttaacaaaactctttcaaatttttcacctacatgactaataatatacatagaggaaaaaaatcaagcaaatttaatgtaagcaagcatttcagaaggaagaactgaaaagcaaagtttgtgaccaagcagtacatatatatatatatacacatttgtgaccaagcagtgtgtgtgtgtatatatatatttatatatattatatatatatttatgtataatatatatattatatatatatatttatatatatatatatctcattctgaaccaaaagtgcttagtctgttccaacaaagcaagaaaataacaagaaaacaatttgtcctaaccaattatgtgcatctaactgtcagacgcaatgcccacatgaaccagaaaaagatttcccaatctggaatctatctcctgttattatggtctgctagtctgaaacagtttttcttttgtaagtctggggttctctaactttcataaagttgtatgcatttgatctttccttttttcttactattttccactttctgcaacctaaacttcctctaaggaagaatttttcaaccacaacgatattggcattttggactcaatattgctttattgtaggaaactctcctgtgcactgtaggatccttagcagcaaacttggcttctatagccaaacgccagtagcagccctgatctctacttgtgacaactaaaaatgtctttagacattgccacatattacctaaggggcaaaatcacacttggttccttcagggatcttcctgattctgactctaactattccttttcaaagatgtctgcgactctcagcacaaattatggcactgacaacccagtccctaagtgtgaagaaactgtctccgaagactgataaataatgaatatattggtgtgtttatttggtttggggtacaatcagaagatatctttcacagattaaaatgtaattggtaaggtgatagatggtcacagtatttctgtttaattcaggctttagtagatcagcatagcatgaatttcagattttgcaattttgtgtatatttgaatactaatattttgagtgtcataacatacttagcttacgcaatgcctcttctttctttctttccctccctccatttctttctttctttcctttctatttctttctttctctctcttttttttttttttttgaaacaggatcttactctattaccccaggatgaagtgcagtagcacaaccatagctcactgcagtcttaattcctgggctcaaagtgattatcctactccagcttcccaagtagccaggactatggatgcgtgccaccagatcacactaattaaaaaaaaaaaatagaaattgcatctcatgatgtattccaggctggtctcgaactcctggcctcaagccatccttctatctcagtctctttgttagtttggattacaggcctggctgtaacgcttctttctttgaccgacttttatattttttgacataaaaccataatgcaaattttttttatgtatcacttaatttttcccaccttgcaacaaatgcatcttttcccatgttctatgtattgctataaaatgtaatctggctttccaggcttggtcaatttagctctgactatctcattactaagaaagagttctcctgctcagtttctatagtctgcgcacttcctataagggagtccctccaaatagggttccaccaactacatttggcataatttgcctttagggcaatttttctgccttccctggaagaaagttagtaccatataaagaaacaaatatatctttcttcatagagattacatttcagcctaatctagtcttctagtcaataaaaataatgtttgaagaactatgttgtaaactgggaagccagatggcaataattgtcaagaaaaaaaaaacacagaaagtggagatgacacatatgggctggatgagagtatgggagtgtggctggttctccttctccatgagttctgcatccatggattcaaccaactgtggctgaaaatattttttaagacaaatgatggtggcctctgtatgaaacacacagactcctttttcttgtcattattcctttcaaaatacagtataacaacatagcatttactttgtgttaggtattacaagtaatctatagataatgtaaagtatatgggaggatgtagactggttatatgaaaacactatgtccttttatataagagactggagcatccatgaagtatccaagtgggtggaggtccctagtaccaacactccacggatacctagggaggactgtatataacattttagattgggtttctacagaaggacaaaccgaggatgtaacatttgagaaaatacctacacagaatgaagaaactgatgaataataaatgtgggtgaaaatttgggtgtaaatgctcacaaaaaaggcctcaagcaggaatatgcctgagttcttatgggaacttccaggatgatatcaatgttattgtagagcaaaccaggagaagtatgataatattgagcctctggttaaaagcttacctgctttcctctctgcaaagtttaattatgtgagccttcaaattcctctctctctctctccctctctctctctctctctctctctctctctctctgtgtgtgtgtgtgtgtgtgtgtgtgtgtgtgtgtgtaatgggggaagtggggacaaggagagagggacagacagaatgagagagagagacagagacagagagagattttctttagattttcaattgttgcaactaaaatttaaaacttttaatcctacccgaatgcaaattgtactcatatggaattctaattcgagctttacttcttccagcgtgagtttacataagtcactcttgttgaggataattgtaaaaaaaaaaaaaagcaaaactgatttaactggaggatagaaatagaagacagaaataaagcagatggtgaagttaaagtagattagttttaaattttgtgtttttttctttgttctctaatgaagccttataggagatttaaaaaaaataagataaaacataaacagaatccttatatatacacttctgagccagttgcaaaagaagagaatcaaaggagctttgtataaagctccgatgctattttctttgatataacaaacaacactcgataactttaagtcataacattaggaagttatacaatatttgaatagacacaaaccagaaagtgcatttctaactatatgtattaaaataaaataaatgaaaataaatgtgtcagtaaattactgaaactctaaggaaaagaatgcctgaatcattgcagtaaggcataataaatagtatttaattgcatagtacctgtattttacaattataatgtgcataatatcaaacatttttaaatgtattggatgccatttatttatataaacatgaaaataactataggatttttttttgccatgagctcttaatctcttcaatagtttatacatatgtggtggtgattagaaacctaacactctcaattgtaaagcaacaattgttttatcattgaggccatttatattattaatattgagaatgcaattgacattgtgaatgtgcttgattagatattcctcatcacaatttcaataaggaagttcgccatccttatgccacttcaattataaagaaaatgaattgaaaatagagaaatttaactcataatgaagagcatgacttagaattaataaggttctgacctacagggtttttttatctcctcatattttccagcctattttattaatatcagcttcctaatcttaatgttactatgaagaatgctttattcttcataaaatttcattaaatgcatattaaaaaagaaatatatttttgttctctttttaattttagtctaatcccattaacaagagtaaaccactattaaatttgttggtttattttcttatagcttatttaatacacatctgcacaaatacaaatttcatcctggcccaactggccatcaaaactctgattaaacttggtcttaagttaaatcctcatactaacagagccactctgtgaattccaaatccattcttccacatgtttctctttggatccttgcttcggtgtccctgtctgtttcaatttatccctgggccaggtaggtcacaggctttggaaattttaatgtttccatcaaaccaaatcaaatatgctaagaaaatttcatgttaaatgctaaatgagaatggggatggatgacatcaaataccacatcaccttttgccatctaaatggctcccctcccttatgctttctgctgcttgggaaagcctctgctcctgatatataatattttctagtgtctgtaacactctgggaggtaaaatcaatttctgagggagcagtcctggaatgacttctaacattttcagcacctcagaaaacacataaaaattaattttttacaagtggataaatacatacaaatatctaaaaccaaataatagaatgatacaggtgcttttcacaaaacattttaacttgagcattttcaatatgattaataaccttcaaaaacaaggccaaatggattcatcttttattatatggatacactatactttttaatattcttgttgtttaatttgattaattttcctttacaataaataatattataatgaacattttatatgcatgttttatataatcttttaaatttactttagatatttctagatactgaattattaccggttgaaaaatttcaggcacatactgctgaactgccattcagtggacttattacaagtcatattttccctggatacatgtgaacatactgtctcaattttcctttgtgatacagaaatataaactgcgtatgcttttatgttctgtgatatgaaaatatcaaatgatatcttcatagtgccttaaataatatttcattaattttttgacagtttggattaccaactgtagtaagatggctgaataggaacagctccactctgcagctctcagcaagactaacacagaaggcaggtgatttctaatttctgtatttccaactgaggtaccctgttcatctcattgggactggttaggcagtgagtgcggcccaccaagggtgagcagaagcagggtggggcattgcctcacctaggaagtgtgagtttacataaggggtcagggacctccctaccctagctaagggaagccatgagggtttgtgccatgagggactgggctatctggcccagatactacacttttcccatggtttttgcaatccgcagaccaggagattccctcgtgtgtctacattccccgggccctgggtttcaagcacaaaactgggaggctgttggggcagacactgagctacctgcggagtttttttttttttcgtaccccactgatacctggaactccagtgaaagagaaccatttactcccctggaaagtgggctgaagccagggagcaaagcggtctggctcagctggtcccactcccttaagtccagcaagctaagaaccactggcttgaaattctcactgccatcacagcagtctgaagtcgacctgggatcatcaaacttggtggggatggggtatccgcctttactgaggcttgagtaggagagtttcccctgacccttctaaagactgggcggaacgcatcacagcacagcaaagctgctatagccagactgccttgctagattcctcttcactgggtagggcatctccgaaagaaaggcagctgccccagtcaggggattataaataaaactcccacctccctaggacagagaacctgggggaagggccggctgtggtcgcagcttcagtggacttaagcattcctgcctgtcagctctgaaaagagcagtggatctcccagcacagcgctccagctctgctaagggatagactgcctcctcaagtgggttccctgacccctgtgcctcctgactgtgagagacctcccaacagaggtcgacagacacctcgtatgggagagctctggctggcatctggtgggtgcccctctgggacgaagcttccagaggagggaacaggcagcaatcttttctgttcttcagcctctgctggtgatacccaagcaaacagggtctgcagtggacctccagcaaactgcagcagacctgcagaagaggggcctgaccatcagaagaaaaaccaacaaacagcaagcaataacatcaaagtcaataaaaaggatccccacacacagaaaccccatcaaaaggtcatcagcctcaaaggtcaaaggtagataaatccatggagatgaggaaaaaccagcaaaacaatgctgaaaattccaaaaaccagaatgcttcttctcctccaaatgatcacgactcctctccagcaagggcacaaaactggacagagaatgagtttgatgaactgacagaagtaggcttcagaaagtgggtaataacaaactcctctgagctaaaggaagcaatgcaaggaagctaagaaccttgacaaaaggatacaggaattgctaactagaataaccagtttagagaagaacataaatgaccggatggagctgaaaaacacagcatgagaactttgtgaagcatacacaagtatcaatagctgagttgctcaagcagaagaaaggatatcagagattgaagatcaacttaatgaaataaagcgtgaagacaagattacaacaaacagaatgaaaaagaacgaacaaagcctcaaagaaatatgggaccatatgggaagaccaaaggtatgattgactggggtcccttaaagtcatggggagaatggaagcaagttggaaaacacttcaggatattatccaggagaacttccccaacctagcaagacaggccagcattcaaatccagaaatacagagaatgccactaagatactccttgagaatagcaaccccaagacaaataattctcagattctccaaggttgaaacaaaggaaaaaatgttaagggcagccagagagaaagttcagattacctacaaagggtagcccatcagattaacagtgggtctctctgcacaaaccctacaagccagaaaagagtggtgcccaatagtcaacaatcttaaagaaaagattttgcaaaccagaatttcatatccagccaaactaagtttcataagtggaggagaaataaaatcctttacagacaagcaaacgctgaaggattttgtgaccaccaggcttgacttacaagaactcctgaagggagtactaaatatagaaaggaaaaactgataccagccactgcaaaaacatactaaaatataaagaccaacgaaactaagaagaaactgcatcaactaatgtgcaaaatgaccagctagcatcataatgacaggatcaaattcacacataccaatattaacattaaatgtaaatgggctaaatgccccaattcaaagacacagaatggcaagttggatagagtcaagacccattggtgcactgcattcagaagacccatctcatacgcaaagacatgtataggctcaaaataaagggatggaggactatttaccaacaaatggaaagcaaaaaaagcaggggttgcagtcctagtctctgataaaacagacgttaaaccaagaaatatcaaaaaagacaaagaagggcattacataatggtaaagggatcaatgcaacaagaagagctaattatcctaaatatatatgcacccaatacaaaagtgcccagattcataaaaataaattcttagaggcctacaaagagacgtagactccctcacagtaatagtgggagactttaacactccactgtcaatattagacagatcaatgagacagaaaattaacaaggatattcaggacttgaactcacctctggaccaagcagccctagtagatatctacagaactgtccacatcaaatcaacagaatatacatttttatcagcatcacatagcacttactctaaaatcaaccacataattggaagtaaaacactcctcaacaaatgcaaaagaatggatgcaaatgtaaaaaaacagcctcttagaccacagtgtaatcaaattaaaactcaggattaagaaagttactcaaaaccacacaattttgtggaaactgaacaacttgctcctcaatgactcttgggtaagtaacaaaaataaggcagaaacaacaaagttctttgaaaccaatgaaaacagacaacgtaccagaatctctgggagagagctaaagcactatttacagggaaatttatagcaccagatgcccacatcagaaagcaggaaagatctaaaattgacaccctaacatcacaattaaaagaaatagagaagcaagagcaaacaaattcaaaagctagcagaagacaagaaataagtaagatcagagcagaaccgaaggagataaaggcatgaaaaacccttcaaaaaatcattgaatcaaggagctgttcttttgaaaagattaaaaaaatagatagaccactagccagtctaaaaaaggagaaaagagagaaaaatcaaacagacacaataaaaaatgataaaggggatatcaacaccgatcccacagaaataaaaactaccaacagagaatactataagcacctctatgcaaaaacaaaacaaaacaaaaactagaaaatctagaagaaatggataaattcctggacatatacatcctcccaggaggaagaaaatccgtaactaaaccacgaagaagtcaaatcgtgaatagaccaataaaaagttctgaaattgaggcattaattaataccctaccaaccaaaaaaagccaaggaccagacgaattcacagctgaattctaccagaggtacaaataggagctgggaccattccttctgaaactattctaaacaatagatagacaaatgcgatctaattaaactaaagagcttctgcacagcaaaggaaactatcatcagagtgaacaggcaacctgcagaatgggagaaaagttctgcaatctatccatctgacaaagggctaatatccagaatgtacaaagaacttaaacaaatttacaagacaaaaacaatcaacctcatcaaaaagtgtgtgaaggatatgaacaggcacttctccaaaagaagacatttatgcagtcaacaaacatatgaaaaaaagctcatcatcactggtcattagagaaatgcaaatcaaaactacaatgagataccatctcatggcagttataatgacgatcattaaatgtcaggaatcaacagatgctggagaggatgtggagaaataggaacgcttttacactgttggtgggagtgtaaattagttcaatcattgtagaagacagtgtggcgattcctcaaggatctggaactagaaataacatttgacccagcaatcccattactgggtatatatccaaaggattataattcattctactataaagacacatgcacacaaaagtttattgtggcactgttcacaatagcaaagacttggaaccaacccaaatgcccatcaatgatagactggataaagaaaatgtggcaaatatacaccatggaatactatgcattcataaaaaaggatgagttaatgttctttgcagggacatggatgaagatggaaaccatcattctcagcaaactaacacaggaacataataccgaacaccacatgttctcactcataagtgggagttgaacaatgagaacacatggagacagggaggggaacatcacacaccggggcctgtcagggggtgggggactagtggagggataacattaggagaaatatataatgtagatgacaggttgatgggtgcagcaaaacaccatgtcacatgtatacttatgtaacaaacctgcacattctgcacatgtaccccagaatttaatgtacaataataaaaaagataaacaagaaaaaataaataaataaaataaaacagaaaaaaaagagagggactcctccctaactcattttatgagtccagcatcatcctgattccaaaacctggaagagacacaatgagaaaataaaatttcaggccaatatcactgatgaacttcgacgtgaaaatcctcaataaaatactggcaaatggaatccagcagcacatcaaaaagcttatccaccacgaccaatttggctttatccatgggatgcaaagatagttcaacatatgcaaatcaataaacacaatccatcacataaacagaaccaatgacaaaagccacatgattatcccaatagatgcagaaaaggccttcgacgaaattcaacaccgcttcatgctaaaaactctcaataaactaggtgttggtggaacatatatcaaaataataagggctatttatgacaaacccatagccaatatcatattgaatgggcaaaagctgaaagcattccctttgaaaaccgacacaagacaaggatgccctctctcaccactcctgttcaacataatgttggaagttctggctagagcaatcaagcaagagaaagaaataaagggtattcaaataggaagagagaaagtcaagttgtgtctgtttgcagaatacatgattgtatatttagaaaaccccatcgtctcagtccaacaactccttaagctgatatgcaacttcagcaaagtctcaggatacaatatcaatgtgcaaaaatcacaagcattcctatacaccattaacagacaagcagagaggcaaattatgagtgaactcccattgagaattgctacaaagagaataaaatacctaggaatacaatttacaagagatgtgaaggacctcttcaaggagaactacaaaccactgctcaaggaaataagagatgacacaaacaaatggaaaaaaacattccatgctcatggacaggaaaaatcaatattgtgaaaatggccatactgcccaaagaaatttatagattcaatgctattcccatcaatcttccatcgactttcttcacagaactagaaaaaaatactttaaatttcatatgcaacaaaaaaaaggccatatttccaagacagtcctaagcaaaaagaacaaagctggaggcatcatgctacctaacttcaaactatactgcaaggctacacagtaaccaaaacagcatggtactggcatcaaaatagatatatagaccaatggaacacaacaaaggattcagaagtaacaccacacatctacaagcatctgagctttgacaaacatgacaaaaacaagcaatggggaaagaattccctatttaataaatggttttgggaaaactggctagccatatgcagaaaactgaaactggacctcttccttacaccttatacaaaaattaactaaaggtggattaaagacgtaaatgtaaaatttaaaaccataaaaaccctagaagaaaacctaggcaataccattcaggacataggcatgggcaagtacttcatgactaaaacaccaaaagcaattgcaacaaaagccaaaattgacaaatgggatctaatcaaaatgaagagcttctgctcagcaaaagaaactgtcctcagagtgaacaggcaacctacagaatgggagaaaaattttgcaaactatccatctgacaaagggctaatacccagaatctacaaggaagttaaacaaatttacaagaaaaaaacaacctcatcaaaaaatgggcaaagtttatcaacagacacccatcaaaagaagtcatttatgcagccagcaaacatataaaaaaaagctcatcatcactggtcattagagaaatgcaaatccaaaccacaacgagataccatctcatgccagttagaatgatgatcattaaaacgtggaaataatagatgctggcgaggatgcggagaaataggaatgcatttacacttttggtgggagtgtaaattagttcaaccattgtggaagacagtgtggtgattcctcaaggatatagaactagaaataccatttgacccagcaatcccattactaagtatatacccaaatgattataaatcattctactataaagaagcatgcacacgtatgtttattgcagcactatttacaacagcaaagacttgggaccaacccaaatgcccatcaatgataggctggataaagaaactgtggcacatatacaccatggaatattatgcaatcataaaaaagaatgagttcatgtcctttgcagagatgtggatgaagctggaaaccatcatcctcagcaaagcaacataggaacagaaaagcaaacaccacatgttctcactcataagtgggagttgaacagtgtgaacacatggagatagggagggaaatatcacacaccgaggcctgtcgggcagagtggcaggaaggagagggagtgtattaggacaaatacctaatgcatgtggggcttaaaacctgtatgacgggttgataggtgccgcaaaccaccatagtacatgtataccaatgtaacgaacgtttacattcagtacatctatcccagaacttaaagcaaaataaaattaaatttaaaaatttgagacagtttgaacatttaaaatgtgtatttacctttattttcatttatatctaaagattatctatacaatatattttctaattttatttgttctttccctttaaaaattaacaatataactcacatatagttttgcatgaagaaacaaatacaccccaccatgaaagaggatttattaatttcttaattttaagaattttaaaaatcagaattttatgatttctgattttaagttttaaggtctgttttacataaaagtaaggtaggcatcaactggtttctggttagtatttctctcaattttttccatcattttgtttcaataaagacattttatttcatattatctcatgtgaacagtacatacctctattatgattatgtttatttctaatataaatttaggtgggtaatcactggttattgttgtctttttaaaaattactttgatgcacagaagtttttaaacttaattaagttcaataaaccaattaatttgtgccctatctaacaaagtttagtctaatacatggtcatgaagaacctcatcctttggtgtttttttttttttttttttgctccattttattctcaagaagttttataaatttctctttaactctcaggtttatgcttcatgtcaaattaattattgtgtggtttgacgtaggggatatggactcactttttttccatgtgtgttgtgataagatgttcctttgttagttaaattatcttagtgtttctgagggaattcaacagaaatttccccgtggatctatctttgaagtctcctttcctctgtgtgtgtgtgtgtgtgtgtgtgtgtgtgtgtgtgtgtgtgtgtgctcttctagttcatccttatgctatgtattagtcaaggttctctagggggacagaactaataggatagatttatatgaaaaggggagtttattaaggagtattaactcatactatcacagggtcccacagtaggctgtctgcaagctgaggagcaaggaagccagtctgagtcccaaagcaaagaacttggagtccaatgttcgagagcaggaagtatccagcacagaacaaagatgtaggctgggaggctaagcctgtctagcctatttatgtttttctgcctgctttatattttggctgtgctggcagatgattagatggtgcccacctagattaagggtgggtctcccttccccagcccaccaactcaaatgttaatctcctttgacaacaccctcacagacacacccagggtcaatacttgacatccttgaatccaatcaagttgaccctcagtattaagcatcacatgctagtaccacattgccttgatactctagcttgaaagtaactcttgaaatcaggttggtaaaatccttcagatttgctgttatttttgattgcttagctatttgaagtcctttgacgtttcatatcagttttataatcagcttacccatttctacaaaacatttgttaatatcagtaagaagaaaggacatcataaaatattaatttttctatttcataaatattttataactttatttatagggcatattccatttccctctaatcttttttttagttttcagcatagagatcttagccacattttgttaaatgttttctgaagtgttttgagacaattataatcatactttatttcacttttatagtattaatttttagtgtcatgtcttaattagttgttgccatattacagaagcactattggtttctaaaaagttataatgaatcctggaattttgccatatttaacttcttagttctactttttaatttttatagcattccaatgaatagtaatgaggaatgcttatcaaaaccataccattttatttattctatcttcatgttgtatttatttttcttgtcttatttctcaaaaaaattattttttgaaaaaaaaaagctttgcagaaacattggaagttccctttgtactctccctgatttcattctcccatctacctccctatagtttgcctttcagataaagctggtgtgtgtaatcctcaagtttataaaattttaaaattcaatatttttatatttgtaagtattaatacatatagctattgtctattcattttaactagtttttataattccattgtgagactacaccatgatgaatttgtccgttctcttatttaccaggtttagtttcagatttgaagtgaaaattcctgtgtatgtctctctcagtaaatatctgataatttctctaatagacatacctacaagtaacattgctaggttgtggaatatcccttaccatgtgtagtacagacattttgtatttgtaaagtaatttcaaaaactattcactaaaaaagcatattttgtggaccctaacaatcaaccactagactgattttatttctcatctagttaaagagcttaaagtattagtaactggggttttatatactaagaagtatatcaccaggcctcaattagctttatacttactttataataaaaacacctcctagaacatttattaattccctcccaacataattcttataaattaaaacccctattgctaagctttacataactcacatttaaatatagatataaggatatgtttctctggctaagattaataagagcatttgaaatatagactaactgagtctattgtattttgaagggctaacttatgttgccatgtattaaattacttactttgaatcttccaattatattgaaacaccattcttcattcagacagttgatgctgagcagtttacagtggtcaattgctttctcacagtttttttcagtaaatcctgatatacagctgtaaatacatcagtgtaaattagaaaaattataatttaaatgttttcagaaaagcctattaacattattccaaaaggaataaggctttgtttaaattatatggtattattaatcattttttaatacatacctgtgatcttagccaaaaagctcctatttatgtatttggaaagaattacagtaaactacattttcaatgtatgctcttaatgatctcttttgggaatttaagaataaaataaactttggcctaaactgatacttaacaatacagtatatgttttggaaaactagtgaaatatgaagaaaaaacatgacaaatgtgattttttaatgtttagtagagccagtatatactgatgatgtgctagcaggagttaatgatgactacatgaatttgagacaggatagagtgccagtggatgataacggtctagttatagttgggctacttataggacttctgtttgttagttgtcatttttaaaattgtttttcaaacaatctatattccagtctactgtatttcattaactgcaatctataagttgctaaagaacacacactggtgttctggcttccactgccctcacttctaattaatttgtaggaaacagtcctgtgccttaaatcatatttagtaaactttctattataaaataaatgggaccccaaatgaaagaatgttttttctaatgtaaacaccaaatattttaagaccaaaaatatgacttctcatgactttaagttggtagaagctgatttattaatgaagtgaatttaactatgtatttattattttaaatctgttataagaacacaaaataatttcataaaagggatcaaaggccatgttggcacaatttcactgaaatagcatcaataaaatgctttagtaatttacctttcctatagtttgaggcacacagctttgcattttcatcttgcagaattaaattatttctccattcatatcagaaataatcatccactttttttcagcacccaccatatgccagtcactaggctaattacttttacacaattttcttaagttctcattcaattattgtaagttgtgaaatacattattatttatcacttttataaatgaggaaacatacccatggaaattacattagttgctttggccatattacttacaaattttacagtggttaataaaattaagtttgtcctaactttaagtgcattattttactctgctattccatagatgaagacctttatgtattttactctactactccacagatagtaagatatatgtactttacgtctctcattctgaggggctagctagatatccagaaatcactccaaataccaacttaatgaaaggtagcaacccttcctattgaggatgagcatgtaatagcatagagaagaagagaagagctttagcatatcctaaaagttgatgagtttcaattttccttttgagttggaatggactgaattggccaagagcagttaaagacacatgtgactttcgggcttactttgtgttgcagtttccaaagagcaggatcaggtctatgaattgaagaaccaatattcagccactaagaagaatcagacccaaatggtgttgaatgaacactgggcagcagcaactctgagaaagtgtttctaaacagagcaggttttattgatccaaaaaaaaaaaaaaggccaaagattttctactctcagtacacactaggtaagagaccccccaaatactatctgcaatgtgtggctcagagaggtttgacccaaaggcggaggactaatgtgtactaggcttaatacctggatgataaaataatctgcacaacaaatccccatgacccaagtttacctatgtaagaaacatgcgcttgtatccctgaactttaaagttttttttttcaaaaagggaaaactttcctactgagtttcaggcaatcatctccaatcccccactcccagtgatggcttgaaatctaagaagcacttccaagtcttactcataagaaaaatgtcatcctatcaactcagcctgctgtcaaggaaaaagaaagtttcaatagtagccttgacatttaagaatgtaaaacagagaaaacaaaagcaaagtaaacaaaagcaaactctggaacaacatggacctttttaataaatgtgtttacaaaagtgcattaacttctgttgaaatgctcagagagacttatagctaactaatttgagctactctaggtgtccagcagccattttagtcagaggccaattgttttaaatacagggggagagaaaaggaagacctttcagattaccgtgtttctaaaatgtccaatttatagtttgtttttatgtaaaactattttgagactttagggtaagggtaacctcaggattgtgatggaaatatttaaggtgtcattttagtggtaaaatgggaaatgatacataggaaagcagcgaggatctgtgaagatacatgaaagggaaggaaaaaaaataatgaaaataaaatataatagtggaaaagaggagacaaaaacaatactcttatcctcttttactttttccttcctaaaatgatttcttaccactgatttaaatatctttctattattaggtttccttttgccaataaagccaacattcattagttaattagctttatttcttggacatagcattccaaacttgtccagtgacctatggaatgcacactactgattttaatgagaagtgtcaggcactgttgggaacacagcatgaatagagtagggacagcaatatcagaacaaaattccatcaccagcattttggtaaatgttttatgtaatacagaactactagtatttataactgctatttatttttaaagttaatttataagataaaaatcagtgaaacaatatttactacattttaaataggtttcaaaatgtattttttcaaaatattaagaaaagcccataaatttaatataattaaaaataaaatgttcaatattttactaacagtaaaaattattactgtattaaaataataatttcataaagcaaaaaattagaaaaaatattttttaaagagttaacttcaaattggaagtatacttttgcttaaagttttctagctgctgaaatagctttttcaaattctatactattctagtaaatggaaaggagatagttataaactaacttcagatagttttctctgctgtggtaacttgaaatactctcatcacttgtttgtaaacttggaatcaacttttgatacatttttttccaggaaatgaacagttatatttgtaatttttataatgtttaagttgtaatttttgtcttaaagcattgtagttcacatttgtctctttggtttcatcatgcatacatggggattctgatggaaagttacttgtatcagtttcaatgctgtcattgaacctattccgctacttgggcaaaaaaccctttgaagtaaattaagatttattcttataatagaatctttgcaatactattgcatgcttacatactgtgacttgtgtgggcatagacaaatgtccagacctatggactacttcatatgatgaatttatcttttaagcataaactgagcaacaaggtcactgcctggatttcaggaagcaaataattcagatgtaaaagtgatttaaagatgaaaataagaatcttagacaaaaccatctgtatttgataattaaaattaacatgctatacctctatcctagaatatagaaagctagtattaaacctattaaaacagcaactcctctgccttattatacattagtttatggggaagggagagaaaattataaatacatgagtatagtgacagatagggagaggtgctatataattaataaattaaaaccgataaaagtggagggagaaattgagaagaggtatttcaaggctgtgtcaggatcaacaggaaagacatctttgaggagataatatttgagtgaatggctgaaggaagtgtacaaattgctactgtgctgtctgggaaatgtgcacttcagaaaagggaaaggcaaataccaaggattgaagcaagaggtccttgagatattcaggaaacatctcaaagaccaaagtggtgacttagtaggagatggtggcagagagataggcaggaggaaaatatggctcaccttgtaagcatttaaaatactttaggttttattaatgcacgggaaccccctgaatggcattggcagaggaataacatgattttaaaacatatatattcttttttgtggataaaaaatgataaacaagcaaactattttacagttactttacctgtaactttcagcatctaaaataatcacaatctgttttctagtttctcaggtcaaaaactatagagccaatatatttgttctttttctttctcattcaatccgctctaaagaaacattgtattgactccatcttaaatatacatccacaatccaaccccttcttattatgccctctctccaattctaatctaagtcactgtcctacccagtttactatactgtaattactataatagcttattaacaggtctctttgcatgtgcccttgtgtctgtacagtttcctttcaaaacaacagtcacacaacaatttaaaaatataaaccaaataaagtaactcatttgccagcaacactgcaatacttgccattgtacttagagtgaaaatgaaggactttacaaaggcattcatgatctaaagctgccccagattctggtttctcttctaacttcatttctgctacttcccttgctttctccagagcagttagactggactcatgcatggatagggcctgaataggccaaggattttgcaataggtactccctctgccatgaacactcttcccttagacagctgcacattccctcgcatcattcaaatctccgccaaaatattagcttttttgatgagacttccattcactatttgacatgtacctgaatgaaggttcaaaacaatgaggtcaagagggaggctattgaaatgttccagctgagaatttggcttgaacaagggtgttaacattcctaatgataaaagtgttcatatccatgatatgtagttatgggagggtttaaaggatttgttgatggacaagacgtgtcaaaagagagaaaagaagaaatcaaagagtaatgtaaatgaatactggcagaaaagaagctttgttcagggctcagtaatcaattatgaatttggaatacattaagtttgagcttctatattagatatatataaaatggacaagagtttaacggtaggatgagaattaaacaggtttggtgttttcaggtcaatggaacatagaaaaagagaatcaaggaatttgaaagtggatgtgtaagtatgttttttaaaagaaaatggggacctgcagggggtactagacacaggaatgtcaatgtagtcatataattggaggtcctgttgcttttttaaaaatttatgaaattttgtcattacagtacatgagtgagtgaacttgaaatacaggaagtggggatcagagagtgaaagaatttaaattaaaggtatttcagggtgtgcaattacaggcatgataacttataggataagaccatgggagatggactgaggtgaaggagagggggaaattagcaaaataattatcaaaaaatttaaacaaccaaagtgagtggatttccaagagggataccaaagttatcaaaaaatatgaccacagtggtgataaagaaaaggtcagcaaactagatgctaaaacatttagtaaaggataagcagaaactgagagaaaagctactagaaaaggagccagggagagggggagggggagagagagtcagagagagagagaggatacagctgctggctagggttttcagaaggagaagggaaaaaatggtttggatatggcaacaagggcaacgctgtctatacacttcactgcttgtggtacacaactgtagaagaatgaatagtgaccaactcagaaggctacaagaaaaactgtcctcaggtttcagtgagaaaaaaaaaagaaagtgtagaaaaaatattgtgggctgggcatggtggcttatatctgtaatcccagcactttgggaggctgaggcaggaggatcgcttgactccaagagttccagaccagcctgggcaacatagtaagaccccatatccacaatttctttttttcaaaaaattagccaggtgaatagccccagctactcggttacttgggaggctgagatgagaggattgcttgagcccaggaggttgagactgacatgagcttggttcacaacactacatgccagcctgggtgaaaacatgagaccccgtctctaaaaaataaaaaaataaagaaaaaaaaatacattgtggatacttggaaaatattctgtggacaaaatgagatacagagggcacagtggaagaatactggatattaacaaatattggaggttgtgcaaagcattatggggctaaggttcctttaatcaggtatgccaggaagacttaaagatttcatgatgttaattcaaattttatctgcacatgtctgtacttattattttttatatggaaattaatacattgaaggaaggaagaaagtttatactgatgagaacatatgttcttaaatgaggcatttagggggccagattacaggatacctcctgtcccctataacaatattgcagaatgtaaagttgtactaatagtagcaaaagctactcttgatgagaaaatggcaacaatgtcctagatatttttaatagttatatagtttatgaccagaaactgaagttaaaaactatatttaaactttaaaaaacttttccctatgttaaatttcagaatgattgattcaaaaaaaccccattgtctcagcccaaaacctccttaagctgacaagcaacttcagcaaagtctcaggatgcaaaatcaatgtacaaaaatcacaagcattcttatacaccaacaacaggcaaacagagagccaaatcatgggtgaactcccattcacaattgcttcaaagagaataaaatacctaggattccaacttacaagggatgtgaaggacctcttcaaggagaactacaaaccaccgctcaaggaaataaaagaggatacaaacaaatggaagaatattccatgctcatgggtaggaagaatcaatatcatgaaaatggccatactgcccaaggtaatttacagattcaatgccatccccatcaagctaccaatgactttctttacagaattggaaaaaactactttaaagttcatatggaaccaaaaaagagcccgcattgccaagtcaatcctaagccaaaagaacaaagctggaggcatcacgctacctgacttcaaactatactacaaggctatagtaaccaaaacagcatggtactggtaccaaaacagagatatagatcaatggaacagaacagagccctcagaaataacgccgcatatctacaactatctgatctttgacaaacctgagagaaacaagcaatggggaaaggattccctatttaataaatggtgctggggaaactggctagccatatggagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaagcaacaaaatgggagaaaattttcgcaatctactcatctgacaaagggctaatatccagaatctacaatgaactcaaacaaatttacaagaaaacaacaaacaaccccatcaaaaagtgggagaaggatatgaaaagacacttctcaaaagaagacatttgtgcaggcaaaagacacatgaaaaaatgctcaccatcactggccatcagagaaatgcaaatcaaaaccacaatgagataccatctcacaccagttagaatggcaatcattaaaaagtcaggaaacaacaggtaatggagaggatgtggagaaataggaacacttttacactgttggtgggactgtaaactagttcaaccattgtggaagtcagtgtggcgattcctcagggatctggaactagaaataccatttgacccagccatcccattactgggtatatacccaaaggaatataaatcatgctgctataaagacacatgcacacatatgtttattgcggcattattcacaatagcaaagacttggaactaacccaaatgtccaacaatgatagactggattaagaaaatgtgtcacatatacaccatggaatactatgcagccataaaaaatgatgagttcatgtcctttgtagagacatggatgaaattggaaatcatcattctcagtaaactatggcaagaacaaaaaaccaaacaccacatgttctcactcataggtgggaattgaacaatgagaacacatggacacaggaaggggaacatcacactctggggactgttgtggggtggggggacgggggagggatagcattgggagatatacctaatgctagatgatgagttagtgggtgcagcgcaccagcatggcacatgtatacatacgtaactaacctgtacattgtgcacatgtaccctaaaacttaaaatataatttaaaaaaattagccttataaatgtgactattgatttcaagcaaagaaaaatatagcagcccagcttttgagataattaactccaaaagattaagctttcctgttgaaaattattgagtgaccaagtggaagcattccattaattaatacattcctcatgcaaatatgtgattgctattttaaaaatcatttttcaaaattaataagaaaatataattttattatatgttgaaatatgtcaacctatgcatttctgcaaatgcagtgtcttatttcatagtcacagtgcatacttagttagttatatttgtgacataaactgaaaaccttagttatatttgtgacataaactgaaaaccttaactttacccatgactgatgtggtgagatttatcacaagccaaataaaataaatgctgaagctgacttggggatgggggtgggggaagttatgttaatacatcaaattgaaatttaagtagtgtaagttataataatctaaatccagtgagtagaaaacaaaaaaaaacacaataagctgagaatataaaagagaatatcattatcgttgaaatatctcagaattttggaggagaaaataaaaggcttagaaagcaaaattctctatatcacaacatttctgatttttaaaaacatagtattcatatttctctaatatttagtcagtggcatattttacaaagttttctcccaattaatttggttaaatagttgattttcagacttgaaaaatttttatgagaaagacaccagctggtttaacaaaactttatttcctggctcatttcctcattttactctaaatagtaaaaatttgatcctcctgatatgttgagaatattggagtcattgcattcagtaaaaattagtgtgtgtgtatgtgcgcacgtgtgtgtgtgtgtgtgtgcaaaatggcagtattaataatgtagttcatgataatcttcaaagccattaagtgattttggtgaataaacactttctactctacaaaagtgggaagtatggtggagaattcagaaacctacatgtcaggtcacaatgactttcccttctctactcatgaacctccatccaagaggtgatcagagaccctaggaagcatcagtggagctgtgtcctgtagcgccgtggacactgccacctgtgtaagtgaagtgcagcacagagtcctgtagctgtagcactgcctttggagaaatttccaaatgtctatcgagctctgtgagctcctgagagaacccagcactattaactttatgccaacactcacaatcaacccactatgatctacctttgaggccattaaaattaatccctttttaccattacctcagatatcccaggaagccagtggtttccaagtcatccctcactgtgtggttcttttcccccaagcagctctgtacacttctttcatattcttcttaggaatctctttcctttgactgtaaactctcaagtggtggttattctttctccctcttctctcacagcccaatgtctacatgttgtatagttgtcttcatcttttcctcatgtcccgtcctcttccttaaaagctttacttatttcaagatgatgccatcaaaccatgctacccatatcttctcctgtcatagtcatagccaaccttcctgagcatcccctctaattctttaacatttaacctctgacatgttatatctttctctaatgtaatcccaaccttactttatttgtttgtctgtctgttttgagacagagtttcgctcttgtggcccaggccggagtgcaatggcgcgatcttagctcaccgcaacctctgcctcccagattctattgattctcctgcctcagcctcccaagtagctaggattaaaggcatgcgccaccatgcccggctaattttgtatttttagtagagatggggtttctccatgttggtcaagctggtcttgaactcccaacctcaggtgatcctcccgtctcagcctcccaaagtgctgggattacaggcgtgagccactgcgcccagcaatctcaaccttactttgctatttttttccaactttatcgaagcataattgacaaagttgtacaaatttaaagtgtaaagtgtgataatgacttggtatattatatagtgtgaaatgattatccttagttaacatatctgtcaccttgcacagttatcatttgtatatgtgggggatagcaggtaagatctattctcttagcaaatttcaagtatgcaatgcctcatttttagctatagtcattaccttgaacattaattccccagaagttattcatctttttcgtctttatttttttattgataaatactgtttgtacatatttatgagatacacgtgatgttttgtttcatgctgagaatgtgtgataatcaagtcagatttagggcatccatcacttcaagtatttactatttctatgtcttggaaacatttcaagttctcccttctaactctactgaaatatacaatattataaccctttgaacaccccccatttctctcaaccccaattgcctgaaaaccagtattctgtttctatgactttgacttttaaaaattttacatattagttagatgatacagtgtttgtctttatctggctgattcatttcacttagcataatgccctcaacattcatccatgctgccgcagatgacaaaatttccttctttatgtggctgtgtaatattacatgcatacacatgcaaacacatcacatcctctttatcacaatagccaaggcatggagaacacctaagtgccttcattatttcaatatctgcaaagtttatttatttgcaacattagcatctcctaggagcatactgtctcaactcaaagatctgaatcttccctctaactctacaatctactcctactctagtatgctctatactaccataatatataactacatcatcttctcaatgttaacttacataatcttaatgttaagtattttatattctatgcacggcctcatttctctttctaatttactccttgtagtccttttctcccccaacgtttattccatcccacaatccattgaccctaccaatcttcagtgtctgtcatccccatcatactctctgttgcctccttgtgtgaattagattacaccttttacttctataatcactaattgcatacacccttaaatcactctttcccctccattgtcatagcctgataaagctcgaccctactttaattcaacaccctagctatttctgacgggtatatgagtaaattacacttggtttgagattgacacatattattgtaggctgaacttactttaaatccatgttcgctaacttcaaggagatgctgtagcatatcagtaatactctattttcctcatactcacttggattactatttcattagacatttttgcttatttcacttgagtaacagagccatcagaagacactttccaaatgattcaacaaccacacattcaaagcaacctattctattttttcttctattacaattcatttaacatctgccatcctatctaagctaactcttctgcttgtgccctatatcccaacccatttctactactatctaaatataaactattttgaactttccttagttgccagtttattagcttctctaataattgtctgtatttttatcatcctaactcatggagtccttttaaatctcatgttctaatccattaactccctcaaatatgagtgtcccaagtctcagtcgaaaaccttctcatgttcctatctgggttcaatgtgaggtaatttcattgagtttcctgttgtatttttattttttctaagctaacctcttttatttatttatttattttacatttagagactacaagtgcagttttttgtttgtttgcttgttttttgttattttaacatgggtatattacatagcggtgaagtctgggcttttagtgtacccataacccgaatagtgaacattttacccaatagttcatatttcattcttacaccctctcccaccatcccaccttttagagtctccaatatctattattttaccctgtatgtcaatgtgtacccattgtctagtttccacttataagtgaaaagattaggttttttactttctggttccgagtcatttcacttatgataatggtctccagttccatccgtgctactgcaaagacatgattttattattttgggtggctaagttgtatttcatggtgtgtgtgtgtgtgtgtgtgtgtgtgtgtgtgtgtgtgtgtgtgtgtatcatgtttttaatccagtcatccattgatggacacttaggctgattccatgactttgctattgtgaattgtactgtgataaacatatgagtgcaggtgctattttgatataatgattccttttcttttggctagatatccagtagtagcattgctggataaaatggtaattctatttttagctctttgagaaatcttcatactgttttctatagagatgtactaatttatttttctatcaacagtgtgtaagcatacccttctctctgcatccttgccaacatctgttgtttcttgactttttagtaataaccattctgactggtgtaaaatggcatctcactgtggttttaatttgtatttatctgatgattaaagatgttgagcattttttatatgttttttggctgcttttatatcttcttttaaaaaatatttgttcatgccttttgctgactttttagtggggttatttgattttttccttgcagaggtgtttgagtttcttgtagattctgaatactagccttttgatgtatgttttccttgaaaatgtttctcctattctatagtttgtctgtttactctggtgacttaaaattatactaaaaggttatagtaaccaaaacagcatggtattgatatataaaaatagacacatagattaatgaaacagaatagagaaccacatacctacaacaaattgatctttgaaaaagtcaacaaaaatatacattggggaaagaacatcctattcaataaatagtgctgggaaaaataaagaattatatgcagaagaataaaactagacccctatcttttaccatattcaaaaattaactcaagttagattaaaaacttaagacctgtcattttaaaaatcctagaaaaaaaaactaggagaaactcttccagacattggcctaggcaaagaattaatgactaagttctcaaaaggaaatgcaacaaaacaaaaatagacaaaaattgaatataattaaactaaaaggtttctgcacagcaagtttcctggttttaaatgtcatgtctctggcactggcttccaaatttatatatttagcccgatagcttctctaaaatggaaacatacttgatatctacttcaatatctctacttggctctattaggtgtcttgtctaacatgttcaaaactgacatcttgttttacactcctgccaaccaggcccttctttctacagatttttccattttggaaatggtattagaaaactgttaaggtttatttcccaacctttcaattgagcaaacaaccttagagttacccttgacttatttctgttacctcacatctaatccttcagcaaaagattgaactattcttagaaatatattccagatctgatccttaattaccaccatcgcgagtcatcttgatggcagtgtcagtcaccaccaactctgggctacatactcatagtagctttctagctggtctcccttcccttgggaacatacacctacactctatttaataaaattgagtcagagtgatcatttaaagcagtatctgcctactggaatgtaagtttctaatgaaaagagctttttttctttttaatttgtttggccttttttatggttgcagaagagttttacttagagtaggaaagtttctgaaaaatatataaatattctttaaattaaacaaattagtcatttcatgtcaccgcccaagtcaagaccttccatttcaatcagtaagatccaaaatcattattataaacaaattatataatgaatcaaataaattagttagaaaatattctatacatagcatagtaaaataatttagaaatacagacatgaataaaacacattcttcttgaatatcttacagtagagtagaatttcttagtaattcaaaatcattttcatagtcagcaatattacagaaatatttgattttcttttagtagataactaataattgagtgagcaataaaactacttgtatggctgaagattaaccatttaaaatatgtgagcaatctaactcagtggtttgtaaagaagttcagtatatttacgtggaaagttttcagttgtaaataacataatcctaactcaaacagactaaaccaatgcagggaattattggctcatattgttaaactgtctataggtagttctttcttcataaacaatttgatcattgttctggctctccttttaatcctttcagctctatatctgttttggctttgtctccttgctggacttcatggttgcaaaatgacctccagttgcccaattacatgctgcaatacaatttcttagtgttactgtagagtgtgactttcatttccctttaaaacctctagtaggagtttcagtgttaatcttaagtgcagactttcttccaaatggttcaagtatcaacatgcaaaagtgccaaatataccttgaaaaaatttacctgctagggccaaacaagcaagtagggggtaaaaaagttatttcacttttgtagacggaaagcagtaatgctggagaagagtgagaggaattctctaggaattcctagtatttggatggctaaaccaccacccaaatactggtcaagtatcctttttaaaatatttgtttctttttttgcagttgctgtatttcacaaactccattttattttcaaataattttccaaagtattcacataaacaatcaaaccattcttctataatttaagagagtcaccaaagttgtattctatctgtctgatacctccaagacatcaattattccttttcctttcctatcagactctacttgtgtgctacctgctcccagcattgccacttttgatactttacaactccttctgctcataataataacatttttatgctaacttcccatagacacctaaagctttcagtcttctaggtggtaaggaattttctgatttttaactactggagaaaattaatttctttctaactgtattgctttaagttactaggtaccaaataaaaatttccataaccaatgtttcactgtctttctcagggaggtaattttgtttcagtttctctctcatctacccatataaatttagatctatagcatatgttcaggtagggaaactaatatcatcataatcactctattcttctcctttccacatttgactccttttcaccttgacacattttttttctcccaaattcagaagagtaaaacttcagtagaagagtagttaaactagttggaaggtataagacaatttccctcattgaagctgtttaaggccaagctcatcttgactaatagttctcaaagtatggtgtctccagatcaggacaatcagcatcacttacgacttgattggaaatgtacatttgcaatcctcatcccagatctattaaattataaacactagagacaaggaacaaccatttgtactttagctcttcaagaagttctaatttcaaagtgttagagtcactgacctaggaaaacatacctcataagttagtaacacacagataaatccttaacataaaagcactgaagtcaagtcgtttttatttttattattatattcactgatattctttgactcatatgagaacagaaaaatagatttcaagattaatttcctgtcatttttttcaacttcatacttaattaatatttattatatctctattatttcacctgagtcagagttagcaatttttttttaatcagtcagttttatgtttggggaggagatgtatttgtttttttttttaagttgatcacttttctaagtacattcactaatctactagcacattgaggcatagaaatagaattgtaaattaaaagtaaatatttttaaagggatagtattcaggtttattgatgaattaatatacaattgaaggcatgcaaaaatttgacagaatggattacagttttcaatatcttgatataatgataaggtttattgtcagttcttttgaaaaagtcacatttcaaaaggttaatttaaaaaaaatctttaaatttggattcctttgaaatagattaaagtatcatacagtgtgaagtggatgcatattctaagtttcttttcagtgtgttccaaggctattctgtaccccacatgttaattttctgcctttatgaatattctaaaattttgaggctacttactgcttttcaataatgcccaacagaatttacttgaagcagtcagataaaagtcaggcaagtgtgaagagtataaattgtatttcttaatgatgtgagaaaatgtctataaagctatttaaaattgactaaattatacacccagattcttgggtcacttctgccatttataaatgagtaatctgtggcaaattattacttaaagaaagaatgaattcctaaaagtctgcctaaagaccctaactaatatctatctgctgaggtttgtgaaacacaggaagaaatattctattattttaaaatatttcaatattatatatgtataacaaaaataatactatggagacatatctctctcttttctttctagatcttcaattattatttgattatattaaaacctccattattaaacaaagtattttttaataaccgtatacctaaattatgcttgagaatttctcaatttctcaaatatttattttaaattaataccacaacaattaacccaaaacatgcaaaaaaaatttactttaacttcaaatagaatattatataccattaagtaaaagttagggttaaaaccagaacatcattatatttttgttcacatgatttaaaaatccatgtactttgtattaaaaataaacagaaaattaattatacctgcaaggataatctttctcacatttcttacatgtagcattattcctcaaaggaaatgactcacatgatgtttgaatgctcttacaaagcaaatctgtaaatattggtgaacagatgcacataacatcctaggaaagattaaaaaaatatttttacaaagtattatggatatttcaaaggtaatgaatgggttcttacctggagaagggttaaaattattttcatgaacttggagtagaaattatctgtcagcaatgtggcagattctattttccaaaatgtcacaacaccatctcccatctcacacactcttcctgctatgtgaaatcaaagctcctctattaagagttagcaactatattcccttcctcttgaatgtaagcaagattgtgatcatggagacaatgatgctttaaaggccatatagattctatctaattatcttagaatgcttgctctttgaacccagccaccatgctctcaggaagcgcaggccacatggagaaatcatgtttaggattgtggctaataggcccagttctgggccaagctaacagccaacatttactaccagacatatgaataagaaaaccttcaagatgaagtccaagtctagacactttccgatggcaacctcagagggactctaaacaatatcctagctgagacaagtcagctcacagtaccataagagataataataaaataattattttaagccaccaagttttggggtgactatgcatagaaaataaaccattggcacctgaaacaagtccatgcatccatgggcaggtaaaaataaaatgaaattaaatttgctgggcaaaagttaatttcacctgcattcaaaatacaacctaatcatcatatttcttcctcttgctgtcctccttattttttcctctcttttttctttgttatccttatcatcatcatcattaccatcattttcattatcatatttatctgaacaacaagatttattaagattccaaggtaaaaagcccgtatacttaaaattgatgatttttttattctcattgaatccaatcaaaatttatttaatttaacccaaaactaacgttgaaagaggtatatagcttgcccaacctcatacatggtagcagtacaaatgataacatgtacaattttccaagtaatttatctacaaaataattcttctaatgaataatagagaatattaaataatgagaatattaaatagagaatataaataatgaataatagagaagaaaaatagaattaaagtacttctatgaattaatagttaagcatacatccactaaaagtcgcttcttatattaagattcttttaactagtaaagttataacatgtgttcaattgttcattattgtcaactttaaaagcaaaacattttaaacgatactattaatagttcttgatagattattgtattagttttctatttatataacaactttttatttaaatagcaaattcttacaaacttagtagcttgaagcaacaacaacaacaaaaaatcattatcttagagttccagaggtcataagtctgaaaagtttcagaaggctaaaaccaagatgtctgctgtgtcccttctgtaggctctacaggaaaatgttcccctgacttttctagcttattctagaggatgcattcattttttcatttatggtcccttcctccatctttaaaaccagcctcattacatcatcaaatccccctttgactctgattcttccatctctctcttccactttaaaggacccttgtgattacactggatccacccaaataatccaagataacatcagctgattagcagcctttgttccatctgcaatcttaatttcctcttgctgggtaacataacacatgcacatattcccaggattagtgcatggacatttttatttattttatttttattttattttttggtggaggatgaggggcatacatagtctgcttactacaataatagtttccttgatttttagaagaagcatgtattattgctctttgcccttgtatctccaaatatttgggtctagtatatggtacattggtaacaaatctttgtatattgtagaagaaatatcaggtggagtaaaaaatgttcttctataaacttttatctgtatattatgttctatataatataactaattcttctcagcaaaagttcagcaatttttttgataaaatggacaattctccaggggaaaaaaaattccttttcagagtgttagtaacaaaaagtttaggaggttggaaaaataatctcttaaggttctttaaagaattaatgacaaatatgaatctaaaatgaaaagacagtaatttgtgagaagagctaatgaaatatttcctactcttatttatttaaatgttaaattgaaaagttaaagtaaaacaatattgaataactaaaagatgaaaaaaagcaataagtagaaatgaagagtgtacaaatttatattcttttaaaagggaaaatactgatggaagagcaaagttttttcctatataaataggaaaaattaaaataagtagaccgttcttgttcgtctgagtttaacaattaaactaccttaataaggattctaattatttattcttttcaaattgcttggtaatagtaaaaaaaatttaaaaccactcacttatatgttagattgagacttacatttgatattttgatgcagtcagtaccattctgacatggtactaatgaaaactcactgacatcagtttcaccattttggctggaagatccttttgggcattcataagtataagcagaactgctatttgggcaaattcctcttttccaaaaaagcagagaaacacaaggttttgctgacacctcacagaatggaccttaaaaaaatcacacacaagaaaaaaaaagaaaaggaaggaaggaaagaagaaatgagcatagatatgtagcaaaacattctagaaaatttctctagagtttatgaaatatttttatttaacaaatgtattgcagtgtaagttatatattataaaattcattcattgcaattctacagtaacttttgcaaatgtatagagctactcaagcatcatcacaatacagttttagcacaattccattacccaaagaagagctcttttgtagtcaatctttgtacccaagcccagttccaggcatttcattagaaaggtatgatggagtatttggtcttttgcgactggcttcttttgcatagcaattttttttaaagaattttcacgttgtatcatatatcagtagttggtactttatattgctaaagagtaattcacaatatatacattttgttaatccattcatccttcagtggacatctgttttcagtttttggttctcatgaatcatgaattcatatacaattattcgaaggaatatgctttttttatatttcttgaaaagaatcccaggagtggaattgctggattttatggaaaattcatgtttaatattttaggaaactgctaaactgtttttcaaagtagctgtgccattttaacattcccaccagtgatgtgtcagatttatgtttctccacattcttgccaacatttgatattgtccgttttctttattatagtcattctagtaaatgtacaatggtatctcactgaggcttaaattttcattcactaatgactaattatttttagcatcttctggtatgtgtattaatcatttgtatatcttcaaaaatgaaatgtctttttaaatctattaactatttttaaattgtgttatcagctttcttatgattgagagcattttttgagtgagttctttgtatatattgaataaaagtcctttatgatatacgtgatttggctttccattttctcacttgttgacatttggatagcaaaagtttttatttcatgaaatccaatttttctacttttcctttaattaagtccattttgtcatttttatgtcatatattttggtatcatataattggtgtctaataatattttgcctaacccaaggtcatgaagacattttaatatattttataattttagctcctatgtttagattcctaatccatttgagtttattttttatatggtgtgggataacgacttagcttatatgtttcacatatacacatacaattgttatgacacttttttcttttaagactgtccttccctcatttctttgtttgtttgtttaaaaactgttaaaactgacctattatatgcctttttatgtgcaataaagttgcacatagatatgcaagaaagttgatttctggcatatctatttttttcctgatttatatgcctttttatgtgcaataacccattgaccagataaatacataatgcatatagctatatagtaggttttgaaattgggtagtcattcaacctttccatctttttttccaaaaatatttttggctatgctatggattctttttatagtttcctataaatttttctatgagcttgtcaatttctacacagaagcctgctggaatattataggaattttattaaatcaatagataaaattgggaaaaatttccatcccaacaagattgaattccaatcgatgaatatgcaatgtatctccatttctttggctattcttgcatttctctcagcattgttgcatagctttatgttaaagtcttgcatttatttgttaaattcatatctaagcattttgaaggtcatgtaactagacttgctttcttaattttatttttgaattttatttttattcatttatttttttcagtcatagtctcgctgtgttgcccaggctggagtgcagtggcatgatctcagctcatcacaacctccagctcctgcattcaagtgattctcctgcctcaacctcccaagtagctgggactacaggcatgcatcaccatgcccagataatttttgtatttttagtagagatggggtttcattatgttggccaggctggtctcgaactcctgacctcatgatctgcccgtctcggcctcccaaagtgctgggattacaggcgtgagccactatgcccggccttgaagtattgtttttaatatacagaaaggcaaattacttgtatatgttagcttgtagtctgaaaacggtataaacccatttactagtgctagtagttctttggggggattccttaggattttctacatattagatcatgtcatttgtgaataaagacagttttactgctttcctttcaactaataagtccgtgtgtgtgtgtgtgtgtgtgtgtgtgtgtgtgtgtgtgtgtatgtctaacaaatagcctggaacttcctatgttccagtgttaaatagaaatggtgaaagtagatatcatagtcttgttcccaattcttccaagaaaagctgtcagcctgacacctttaatgtggtgttccctggacatttgtcatagatgctttttatcaggctgagggattgtgtttctatttctaatttgttgagagtttttataatgaataggtgttagattttgtgatatgtttttcctgcaactattgagatgattatgtaggctttgtcctttattatattaatatggtatattacattaattgactttcagatatcaaacttatcttgaatcctggggaaaaaatcgtactttatcaggatagaaaaaaatatgtttatatgtgattggattcaatttgcttatattttggtggagattttctatctttattcataagtgatattggtctttagttttcttgtggcagctttgtctttggttttggtatgagggtaatactggcctgatagcatgacttcaaaagtgttcctttctcttctcttttttccttttctcttcttttaagagattagtgccagttatcgaggattggtactaatctcttaaatatctggcaggtctatatgaattttccatttcttcttgagtcactgttagtaatttacatatatttaagaatttattcatttcctctaagtcgtcacatttgttggcctaatgttgttcataatatctccttataatcttttaaagtttgagcggtcattaatgagtcctcacttccaatgcttattttatttacttgtgtctttccttgtattttttccttgttcattccgactaaagatttgtccatttcgttttcctcaaaaatcaatttttttgtttcattgattttctctaagaagttttaatgatttctgtgcaaatcttactgtcctcttttgtttgtatgctttgcatttaatgtggtttttttccatttatttaaggctgaagcttaaaatattgatttgagagttctttttctggtgtagaaacttggaactataagcactgttataagtacttaagcacagtataagcactgttttagctaagcactgtcttagctacatttcataatttttcatatggttccatgttatttttttcttctttactctcaggttatttcagaaatatgttgtttataataatttccagatatgtgaagatttctagaaacaattctgttgttaatttctaattagttttgtgagggttgaggaacatatatgatatgatttgtattcctttagatttattaagactaattttcttgccatgcctatttgtcaatacactatcaacagcagagttgtacagtgaggtttggcacttgaagggatgtgaaagcaagtgcctctttaaacttgatttcctaggcaagtcacttgcctccccttagtccccaccctactaagattatgcaaatagagttaacaaactagtattattaaggcccaagcctggggtacccactgcagcttgtatagaacttggatcagcaggtgtttcacttcacagttaacaaatacttgtcaatctgttcaatgtgctgtcattaggcacaccatagtgacattaaaacgtaactgcagtagtaggctgacaggccttgccatctctgtgaacttctagattttgaaaacaaattttactcttttactcctcttaccttgagtaaggctttggacaattgatacatgttagaaaaaactgaaaagggagacatctgactcctagctaaaaatgatatacgtggactttgaaaattaaggtattcgtacttcaagtttataaccattttcatccaaatcactatatagtgcaagagtttttagtaaacaacatatttattgaaaaatttcttatatccaactcatttattactatgtgaagaggagcatcaagaaatacttatctacaaaatattaagttacttagtgacaacttactagccagaaaacactgcttagattatataatattaactcatttggattttggattgtgtcagtttgtaaaacagacagtcataaaggcagtataaaatgttcagtgaccacaccattgacattattatttgaaaacaactcaacctttaatttgtggatatttattaatatataagcatttattttgatcatacaaagagtaaatatgtatttctccatgttatgatacattaacataatgttttccttttaaataatcaaatattgatatttgattagatgtttagtggtacttaattagacataaatattatttgaaattatagtaaaacattgtttgaatgatactaccttataagtatgtaattcttggcatttccatagtgcttacatccataaagatttgataaaattcttaaaacaaaacctgaaatttatagaggtctattcttacccagttttattttagttgacacattgtaatggtacatatttattgagtataatttgacattttgaaacatacccatgtggtataatgatccaatcgggatagttagtatatctatcacctcatgcctttatcatttattcgtggcaagaacattcaaaaccatctcttctagccgttttgtaatatatagcaccttacttaagcatagtcactctgtgcaatcaaacagcaatacttcttcttcttatctcattgtactttgtacctgttgacaaacctctacccattttccctcttccttcccctccccagtctctagtaaccactgtcctacttctatgatactagctttttttttttttttttagatttcacttatgagtgagatcatgaagtttttgcagtttttgtgtttctgtgtctggcctatttcaattaacatgatgtatatctccaaaaggaattgaagtcagtataccaaagagatatttttaccccctgtttattgcagcatgatttataatagccaaaaaatggaatcaacctaagtgttcaacaatggaagaatggataaagaaaatgttaactatatacaaaatagtatactattcagccatataaaataattaaattctgctatttgtgagaaggatggaaatggtggatattatgttaagtaaaataaatgagttttatattttcattttattttatttaaaagaaactaatttttctagatgttaagcaatttgccacatgtcacacatctggttaattaatggaagattgataattttaaaaactgcataccacctaatcccataataattccatgctcttttcacagcaatacttgcccagattaattctgtacaaaaaatagaagactcaaataccatttgattgttagtactagaccaatatttctactctcagataaaatgttgttcaacatcacatgttgaatataaaaatatacaaaaacaaatgcattttatttggcttcttccagaaacaaacaaaattctcccaatgtataaatatatcctgtgtgtatatttgtcatggcagtttccaaagtaatccattgggtaacatagtaaacagtgaaatgtgtgatttttcacatttcattttgaaatagtaatagattcatagaaaattacaaagttaataccaggaaatcctgagtatgtttacatcttatgtaactataacactatatcaaactagaaaattggcattagcataatatttgggtatagttctatgtcatttcatcacatgtgtagattgaggtaatcaccactataaaaatgtgaaccattccatgattacaaagatctctctcatgctaccccgttataatcttacccacttctctgccctctaccatttcctgatcactgacaaccatcgattttctccatctctatagttgaactattttgataatgttctttaaatgaaaccatacaatatgtaactttttggaattgtcttttttgtccctcttgttataatgcccttgagatacattaaagctcttatgtgcaccaatacgtctttttttttttttcggttaattggtaaatagtagtatctggtatgaatgtaccacagtttgtttaaccattcacttattgaaggacacttttattgtttccagtttttcactattacaaattgctagggactgaaaatttgtgtcccccacatattatgttgaaacctaatcctcaatacaatagatttggggtgggaattttgggatgtaattagattatgacagtggagctctcatgtataagattagtacccttataataatcagatagcttgctatccctctctcagctctttaccatgtgaggatacaacaaaaagacagccattgacaaaccatgaagtgtgccttaccaggcaacagatcttctgagaccttgatctctattgcccagccttcaggactgtgataaataaatgtttaagccacttaatctgtgttaatttgttatagtagcctaaactgactaagacacaaataaagctaccacgaatattaatatataggcttcagtgtgaaagtaaatttttatcctactaggatttgctgggtcatatggttaaggcatgtatagtttttaaagaaactgtcaaattgttttccaaagtggctgtactagtttacattttccacagcaatgtataagagatttagttactcctcatatgcaccagcatttcgtgttatcatttttttattttagctattttaataggtatgtagcaacatattattgtggccttaatttgcatttatctcatggtcagtgacattgaacatcttttcatgtacttatttgctatccttatagcttcttcagtgaattttctccttgtattttttgtctattatttattgagatttttggattttcatggtattgagttttgagatgactttctgttatctatatatgagtcctttgtcatatatgtggtttgcaagcctatcacttgtcttttaatcttcttaacatggtatttctagaaaaaaatagtttatttttatgaacactgatttatctatttagtttttcttttatgagttgtgcttttagtgccatatctaagagctcttgcagtgatccatcctcataagcttgaccccaagatttcaaaatggggagaactgctttttctgaggtgaaagcattttgttgtgcacattttaagatgtgattttctgtgccttggatttttaatttacctgatcccatcacttctcaatttccccagaatccctgaataaaaagtctgataatggtctccatgttatgcttcagaaacaccatatttgtttattttaatggaatgtttgatgaaaagaaaatgatcatatatgcctagacccccaaattaagatatcagactttttcttatgtaaaatattcttcatcacagctatgaagcaattaaaataatactttaattaatttagaataatgtgtctattgacactgattatatgtcaagaaatattctatatacttggattatagcaatgtacaaaatagattttgacctcatgaagtcatgaatttacaaggaaatagaacacatttaaaatacatataatcaattaattatatagtacatttactagtaataaatgatgttaagaaaaataaatcagtaaaaggatttctaagaagagtacttaagagagggggcacattgtgcagcctcaaagatgcaaggaatatctaagatttatagaaataatggaatgagtcctgtggataggttgtttaagagcaaagtgggccaggtgctgtggctcacacctataatcccagcactttgggaggctgaggcgcaccgatcatgaggtcaggagttcgagaccagcctggccaatatggtgaaacccgtctctactaaaatacaaaaattagccagacatggtggcaggcacctgtaacccctgctactcggaaggctgaggcagaagaattgctagaacccaggaggcagagcttgcagtgagccgagattgcgccactgcactccagtatgggcgacagagggagactttgtcttaaaaaaaaaaggaataatgtgaacaccaacttcccacatcttgttgtatttacatttttcagttcagataatgttctaaaataatatattatataaggatttgtgtatataatttgttgccttcatttaaatataagctctacttgggcaggtaattctgtttgttttgttggctgatttattacaagcaaatagaatgctgctaccccacaatagattctcaataaatatttggtgaaaaaacaagtaaatgaataaataaagagcatatcaacagagaaaacagcaaatgcaaagactttgagttgagagcatgcttaggtattcaagaaacagaacgaaagctaagagactgagtcaacaattgtatgggtatggagatgagctcagacgaggatgtaataaactatttcaggaattctggcatttactgcttttagattctatggaaagattatggagcattttgttctaaatagtggcatgatttcacattttcaaaatatttcttcacaagtagcctgtagatgtccaagaaggaaagcagagagacaagattttagactactgcagtattgcagtaatggaattatagagactggattaggatgctagtgaagaagacagtgagaaaaaaatcatgctctaaatatattttgaaagtacagtcatctacatttgttgatggatttaaagtgaaggaaaaggaaaaggaagatttaatcttttttttttatgtaagtaaccagaaagaaaggattaatcttttctaagataaggaaaaagaatttaagggaagaaatcagaatcacttttagatatgttaatttcaagatatttattacacatccaagtgaggttggtttataggcagttaattagagtgatctgcagtttccggggtgaggtcataagtgaagataaatatttgagatttgcctgtatgaggatagtatttaaagccaagagaacaggtatgatcctttagggaaaaaatggagagagagatgacaacactgatatttaatgttactatagcagagttgtgctatcaatgtatagaatgtgcacttcagtgtatagaaaatataaagatgggaaggtacctgaaaagttattaagaaagaacaaccaaggaagggggaatgtaggagaaacaagagtgtgatgttttaaaaatacaaaatttgtcaaatactgcaaatggtttataaaagatgaagaattagactgaattaattaaagattaaatttagcaatggcgatttaataaacattagtagaactgtttctatggtatagtggggataaacattagttgcataggttcaagaggaaatgagaagaataaaaatggaaagaggtagtatataattcctggcaattcaaaggatggtcccttaaccagtagaatcaagatttcacctggtatctcattagaaatgcactccagaccaactgaaggcaaatccaatttaaccaagagtcccacatgattcatatgtaaataaaaatttgtgaagcattgatccaaatatctcttctgagttgtatgaagtacagtggtatgaagtagcaactagggaggtcttagaggttgtcaggtcatatttgtgaacagatgggatgcttaactagagaaagaaaattgataatgaatgcaataaaggggacagattctagattaatgtctataggtaaggtagagtgacacatggaatcccgcccaccggtaaagggattatcaggtaagagacatcaatataacaggagaaaagacaaaaatagatgggcaaagaatcaagttaactggtggcatccaggcagagcctggagatctctttttctgattgtttctgctgtttactaaaatatgaagcaaagacaaaaatgaagtctaatgaaaggggtggaagtttgagcaaggaagagacgtaataaatggttgcttagcatattgagagaaaaaaatgcacacattagaaaaacctatcaaaatttatgggcagtgtctacgaactccttgcaattagtgaatatatgagaccaggtagcatggttccatgtatattttactgcaaacaaattaataagtagagataaatttaacaggtttgtaattttgcagggggttacaacgcgaggagagaggaacaagaaattgagaatgtgaaaaagtggtagtaatgacacaccatataatttaattgcacaagaagagaaaggcatcacaaggaggaaataatgaaagtatggtaaaggctcaatagtctttgttgtttgagggaatgaaaaaccaacagaatttggaatcctagaaggaacaaatttgaaaaatgagacagggttatattcttggagtagaatgcttaaaagtttatctaaatacaaaaaatacatagtgtgggtttgctataagagtacagtacatttttcatagtaatagtaagtgtggcataaataaggagccatttattaaaagatgttcatgataaagaaacaattctccaagtgtaagttattatcatttttatctcaaaaaagtctctatctctctctcatacacacacatgtacaaacatacagacataacccaaataatttgaagtaaaatatttaagcagcaacgctattaaaattatctaagtaatttttattttagtagaaatcataatggggcttctataaaacaaactagctctgctatcctaacaatgtgcatatatccataaaaaaatcacaatgaataaaagattattttagaccattatgttttattacaatttcagtaaattcttttggtcagtcctctgatgaagtgtcaaaaatttccgaagcaattctgtgtaaaataacgcactgcagttagttgagtattttattcactcaagttcgttttagtctactttcctgtaagaatgaagctattatactcttaggataggcaacacaaagacatcaccaagtaggatgataatttgcctttcatttctatggggagagaaagaaatggttgctaggagctctgttcaagaacttgaaaagtgacagaagaaataaatacaagaaaattgaagaaagacagctaacttgtttacctatgtttgattacatttttaagagtttgccaagacaaagaattgctccaaaataagaaagaacatttaatgaaaatactcagttattcatccatggtaaaagtaattatgtaaaaagttgctagtttggcatttcagataaacaaaataattattttaagttattcattgtaaagctgtagtagtattcattgtagtagtattcattgtaaagttgtagtaaaattgcaatctaaacatgtacaaaaattcacacaaataaatttatagtggtcaaaaataccaataacaaaatataatttatcaaaaaaaatcagagaattaacctccaaaaacacattgagcctaatttaccttaacaaataccatttaagtaaagttattatcttgttattaattcagttttggccatgcaggatatgaaagtttagcagttaaaagtactgactttgctaagtttctaatgtgtgactctcaccactcagctcttccacttaaattactaggattgagcacacaacctattgcaaggagattaaaacccaatatattcctccattgtatggatctgcaattttttttctctaaagaagcagatagtaattattttgggctttgtgggccatcaggtctcttggattattcaactctgctcttgtagtatgaaagcaaagattacacataaatgcataagaatgattgttatattgcttttcatctatgtctttaataaaccacacagtgctttaagccctttatatgtaataatgcagcaacttttataaagtagatattgtcgttatgcctattataagcaaggtgactgaggcacaaggaggatagtctagaaacattccatctctacattattcgtcagaaacttcgaggaatggctgccagaagcccaaaatgcaatactggatttaagaaagtacctaaaaacatgtaaatcatgcatagaataccaacaacaaaaagcacatggggagcaaatagatatggcccctaaaataaatccattcacatctcttaatttgaagaagcaggagactgaaataaagagggctcccagagcactgaattatgatatgagaatggtgtggtagaattcaaaacagactgtgaggtataatttttggaaaaatatgcatatgttacatatcctgttgtgcaattttaggttaggctacatgggactacgttgtacataccagcctaagttcctatttaataaattcaagtattcctagtagaaaaactacatttccagttagaaaagtaattttgagcaacacaatcaaaatgatgtaaacaaaaagtaatacagagaagacctgtcaaatggtatttctggttctagatccttgaggaattgccatattgtcttccacaatggttgaactaatttacatttccaataacactgtaaaagcattcctattattctgctataaggacacatgcacacatatgtttatttcagcactatttacaatagcaaagacatggaaccaaaccaaatgcccatcaatgataggctggataaagaaaatgtggtacataaacaccatgaaatattatgcagccataaaaaggaatgagatcatgtcctttgtcctttgcagggacatagatgaagctgaaagccatcatccttagcaaactaacacaggagcaggaaaccaaacaccacatgttttcacttataagtgggagttgaacattgagaacacatggaaacagagacctgttgggggttggtaggtgaggggagggaacgtagaggatgggtcaataggtgcagcaaaccatcatgacaaacgtatacctgtgtaacaaaccttcacgttctgcacatgtatcccatttttttagaagaaataaagagaaaaaatctgtcatgaatactaaaagtatggtctcaagccacaataagcgaacctccaattgtggttggacagtgaagcctctctacatctaattttattttcatgtttcatcaaagccttaaagctttgatcaggggcttgcctaatctctggctgaaagcacctcaacccctaataccatgcagatttagtcatttctctgggagaatgagaaaataaaccaggtatatgaagagttaatattcaaaagaaaagttgaaaaataaggcagtcatttttttttcaggagcagagctattggaaggtgaataaaatataaatgtataacttacggatgtataaacccaaacacgaggctttaaaaaacaaataaagcaatcagtcctttagtagttcttatttaaaaagtgagagaacatatctacacctcattaagaatattaaaatagaaattttataatttgattatatgtgttttaaaagactgaaaatacaagagaatgattaacaattctgttctagtagaattgcaatctaaacatgtacaaaaattcacacaaataaatttatagtggttgaaaacaccaataacaaaatataatttatcaaaaaaaaatcagagaattaacctccaaaaacacattgagcctaaattttgattctttaaaacctgtgtaatctgtacaattttgttcattatgttctagaacagctccattcaagagaaacagaatatttcacatgcgattttaaattttctagtcatcacattttaaaaaataaagcaagtaatattcattttaataatatgtaatgtacctcaatatatccaaaataaaattatcataacacattatcaatataaaacattattaacattatattttaaattttgtttatactaagtttttgaaaaccaaagtggtaaagtgcatacaggcatatcctggagctattgcaggtaggtttccagatcactacaataaagtcaatatcaatctgaagcaagtcacacaaatgttttggcttcccaatgcatatgaaagttatgtttacactatattataatctattaagtgtgcaataacttcatatctgaggaaaacaatgtacatgccttaatttgcaaatactctattgccagaaaatgctaacaatcatccatgctttcagcaaatcctaatatttttgctgatggaattctttcctcaatgttcatggtcactgatggatcagggtggtggttgctaaagattggagaagctgtgataatttcttaaaataagacaacaagctttcatttcatgaaatatttctctgtagcatgcaatgccatttgagagcattttgcccacaatagaacttttttcagaattaaagttggtcctcgcaaaccctgcacttggttttaccaaccaaatttatgtaatattctaaatcttttgttgtaacttcaacaatgttcacagcatcctcaccaggagtagattatatttgaagaaaccactttctttgctcattcgtaagaaacaatcttcatccattaaagttgtatcacgaaatggcagcaattcattcacctctttaggctccacttttcattctagtgttcttgctatttccactacatttgcagttgcttcttctactgttgttttaaaccactcaaagtcacccatgaaggttggaattactacctccaaattcctgttattgttgacattttgatctcctctaatgaatcacaaatattcttaatggcatctagaatggtgaattctttccagaaagctttcaattgactttgcttagatccatcagaggaatcactgtctatggaagctatagccttacaaaaagcatttcttaaataaaaagacttgaaagtaaaaatattcttttattggtgggctacaaaagggatgccatgttagcagttatgaaaacaatatttatctccttgtataactccatcagatctcttgggtgatcagttgcattgtcactgagcagtaatatcttgaaaggaatattttttttttcctgagcagcaggtcacaatggtgggcttaaaatattcactaaactatgctgtaaacaggtgtgtggtcattcagactttgttcatccatttctagagggcaggcagagtaaatttagcatctttcttaaggaacctaggatttttggaatggaagatgagcattggcttcaactaaaattcaccagctgcattaacccctagcaagagaagcagtctgttctttgaaggtttaaagtcagcattgacttttcctctctagctgtgaaagtcctaggtggcactatcttctgatactaggctgtttttttttcacattgaaaatatgttgtttggtataacaaccttcatcaataatcttagctagatcaggaattcctgcttcacattgcactattatgttatggaagtagcttttttccataaatttcatgagtctatctctgctagattcaaacttttcttctataccttcctcacctctctcagcctttatagattgaagagagctagagtcttgctctggattaggttttggcttgaggaaatgttgtggctggtttggtcttctattcagaccactaacattttcttcatatcaacaataaggctctttaggtttcttaactttcatgtacttactatagtagcactcttaatttccttcaagaattgttcctttgcattcacaacttggctaactgttaggagcacaaggcctagcttctgggctatctgagctttccacatgatttcctcattaagcttctttctacaaacatacatgtctcatttgaattgagagatgtgtgacttttcctttcactgaaacacttagaggccattgtagggctattaattggtctaatttcaatattgttgtgtttcagggactgtggagacatgagaagagggggagagaaagcagaacggtcagttggaagcaatcagaaccacacgacatttatctactaagttttccgtattatatcgatgcagttggtggtgttccaaagcaattacaatagtaacatcaaagatcaatgatcacagagccccatgtagatataacaataaaaaagtttgaaatattgtgagaattaccaaaaggtgacagagacacaaagtgagcacatggtgttagaaaaactggtgctgatagatcggcttgactcaggattgccacaaactttcaatttgtagaaattgaagtatctgtgaagcacattacagcaaggcacaagaaaacaatgtatgtctgtattttatgcttatagcatatttaactttgaaataactaaatttcaagtgctcaatagccacatggcttgtggttctatactgagtagcacatttttagagcatggaaaataaataaagcttccaatctaatctcaagaagttattgtaacttgatacaaatacttacaatgtaccatatttaattctagtcccatgactgactaaagttggaagaatcttaaaagaaatatgagcaattacattttattagtattgacatgtagcaataaacagaaccaaattggatccactttaatactgaaaattttagaaaatctgtgaatatagtaagttacattcatactcaataggaaagaaatttaataagaaaaatacacttcacatagaaaaaatgcaaatgcccaataaacatgcaaagcttttatatcatcaataaacataaaattaaacaaaaaaactgctgctacctaattgccagagtggctgaaataaacatctgtgacccacagagtaatgtgttcatatgaagcaacaggaaatatcctacacatctaacaggagggtaagttggaacaatcactttggaaacaatgtgttatcatttaataacatttaacaaatacataaatcaggaccaaaaagcctctctctatatagagagacatatatatatatacatatatacacacatatgtatatatgtatgtttatgtgtacatcctacaaaggaacaacagacaagtgcaagaaagcttatggtagcatcattcataataactccaaacttaaaattacctaaattctgtccatcatcattataacatatatataattttgatatgttcattcagtcaaaaagcacatgacaatagaaataattgctaaaactaaacacaacatgatcacacaaacatcctataaatagaaaaaggataaagagaatagagaatatactgcataatcctcacccacataaaaattaaatgagggaaaacaaaactaaaatttaaaaattcagattggtttttatcgttggggcatatttactgagaagggggaggagtaaatatctgagaacgctggcaacattttatttcttgatctatgtcacatgtatgtgggattttgctttgtgagaattttgtattcaaaatgttaaattattcaatttaaaaatacatgtaattaaaccatgcataaaattaaaaggcaggtaatttgttaaaatgtaatgtgtgtgatgggcagatgttcttcagtgtttttagctgtttgcttgtgtcactgggagtcaaatgttagccaatgtcagaatcacagggtcagctttttagaacagatcctgggacctagcttccaaaacttctgattcagcgggtctacattaggtatcataaattgagaatttttattgccatgttcccaggtgattctgatgctgctgatacagaaccacacattataaacctctggcttttgctatgcccattgaaatatacttccctccatcctcacagtcacctagctaacccacttttacattcaccctaggcccaactcaagcaaggccacataattaggttaccctctcctcccaaacctactattatcttcagggagcccgcttctattctttcataatattttcctgagaaatttacttaagatattttatctctctgtctagtcttctaattgccctgctataagtgacattctctagggtttactttatccctgagagtgtttatttaattatatttgttgaataaataaatcccatccattgacttttcaattcctttcagttgtcaatttctcttttaggttcctatgtgtcttgcctttagccccctatttcaaagtctaactttaatcctagctttcttgggaacaccttccttccaggtttctaaggtgtaatgaatttaacgtgaaatttgtgtcctggcagcctccttcatcattaactcagccaaagactgccaacatttttctatacattcgaagttttacttgcttctttcttggtagggtgcactgtccttcttactaagttgccagaagattaacaatccataatctccctttcattatgttccctagcaattttatttctatttttttctttcttttcctcatataaccttgctcttaagatttttctgatggtctgtgaattatcttattattttctttagtcttactctccacaaaaatactttatggaaaatgaatatttatcctatgtccttcactttgtggctttggaaataatgcttcctttgttacttcctttctctcttcctttcacggccattgaaacctatttttaatacacagtattaaataaatgcattcatcctcttgtgcttgaaaatatattacagattttccatgtttaatgaaaggcatctgttttatattacatcaaatctaactcattttaccaatcagtacacaattatatttttaagaagtgaggttttgagagtaggtatcctaagtttataaatgctttggtattttgctgctacctcagaaatatttaaatattctggtatccagatgatgtgtgttacattaactgaggcatgtaccggttaatggatctctcacctctgtctgaagatggaagaaatagtatgccttcaataaccctcaaacctagaagctattattaataaaaagcagggagattttctctgcattccaacctcaagtgcatatgaactattactctatattttctgcccaaatgaaatttactccgggaaggcaaataataaatgaagctagagattgtttttcttgtttggtgtctctgtgtctaagggtgttattgcagacatttataatgaataaaaattgaatggctaatataattatatgtgcaattcagtaccaaagcgctcctttgaccaactatcttggtcagctgaaaagcctttagctgtataaatgtatatttgattacaaaggtaatgttgaatattgtggttagttattctttcaacagggaaggaaaatattatttttgtatatgaataatgatggtaaagggtacattaaaatacttgaattacaaactaatctgtctctagatgtgttctccatgatcatgaagagaattaatatagtcaattttaaatagatatagtaaacgtgcaaaacaagtaaaatttggaaatgtgttttctggttcaagactgtggcttccatatacacttgttttctttatgtttttagagcatattaaaatggtaccattaaattactcacatattgaggaaagctaaagaatcaatagactcagattgcaaagaggctgagtaggtaatttaattgtttttgcttttcataattgttggggaggctatcttgctttataaaacaagattaacttcaataatatctatgtgttttagaggtgaaaacaatgtctaaagcatttatgttaaacttggttggatttgacttcttcttatgaggttatccttccattagaaatttaaacagtgagcagaggctaagaatccttttattactcataaaattttggctttgatggacaagtgtttatagttcatggcgagggaccagtcttttaaagcattttcatctttgccaaagtctcttcctggatttaactggtcatctcagcaggtattggagcactttatggctttatgatgacgaattttttctctctagaagtgatggcagaaattttaggtgtttttcagctgtatttatccaccaaactcaagtgcatgtaaccaaactgaagactacagaacaaagacttcttaataagtcaaacagaagaattccattttaagttttagaaagagggtctcactctgtcccataagctagagtgtagtggcacaatcatagcccactgcagcctcaaactcctgggctaagtgatcccacagcctcatcctcaaaagtatctaagactagaggtgtatgccacctcacccagctgatttttatttttgtattttttggaggtgggttcttgctacgttgcttaggctggtttcaaacttacggcctcaagggatcctaccttggcctcctaaagtgatgagattacttaaggcataagccactacagatagccaaaattctattttattattattaacttttcatttcctgtgctgaaacaaattgctctccacctgttgttggctactaaataaaatacaggggtaaccttgcatttagtggctctgatgtatggatatacataaataaatatattttattattatctttaatgtctaaaaaaacactgaatgaatgagattgtcccactttggataagaggcaatgtggtaaaatgtctgctagacctaagcagattaattttctgatcctatattctttggagcatgttttcctaaataaagttgcctgctgaatcacctccactttttaaattgccctgttctttttgtctatcaaagctgattttataaaagctaattaggaagaacagagataatatgatgaataaatcgtagggttgtgagacttttcttttactatatacccttctacactattttcctttttaatcataggcaaggaatttacaatacatattgtaatgtaaaaattttgttttaggagtttcaacagatgttaataagttataaaccttaatttagtaatttacatgactaaatatgtaacatctaaaaatgaatcttttgtttacatacatggaaatgttgtggcttgatttaaactttatggatttttaattattagaagttcttaatattaatgtagttaaatacataaatattttcttttaggtttaattttggaatgtgtgtgttgtatatctgtatgtttttaaggaaatatttcccatagcgaagccatagtcttctctattataaccttaaataaaatttgtaaagtttagccccctgaagctttttctttaaatggtgtagggtaacccttactctagttccaccttcataagtagtcttgatatctgccaggggatttcacttcactttttcttcaggagcatcatagttattctttggccttccattcaaattttgtaatcattttagcacatttcttggaaaattcttttggaatattaattaaaattatagatcaagttgaaaattaattgagatgatgaagagtctccttgtgcatgaatatgctatttccctcaatgcatttacacgtttaaatttttcaaaatacagatatgcattgactatctcatgttagatttgtttcatagttaatatgtatttttggttaatattataaaatatttctctttaaattgtgttttcaatagcctattaatgtaattataaacacatattttaaaaataaatatgtacataaaaaatagaattatttttttcattacaggggtagaataagaattacttcgaagataggcagcatatttgagtcaacataaaatatgctctcatcaattgcagacatgcaacagtaaaaggggcaccattatggtgtagaagtaccccactgaatgctgaattatatcattcagtattaactcaccatctgtaataaaaattgcaaaagaaattcatacagatttgaaataatcaaaatagtataaaatgcaatatatgatttattatattcaggatataattcatgacatactaaggagagaaagcaggagattcaaaattatatatttaggatgcttccacatatagatgatatcaagaacatgatatataattacaaaagtatacatgatacattctatggtatgaaagtacaaataaagaaaatttcattttattagtaataaaatgtaaatttaaaatattaacacgttatacataataagtgaaatttgatgttcaacttagcaaatatttttttaatttttggaatgatatcaactactgctggtgagagtgatgtacaatggcctcttttatacagcaataatggaattacaaacttgctcatcaattctcaaagggaatttcttagtatgcttatgttcattattttgaacattgacccagttattctatgtctgaaaatttattctaaaatacaaatatatactcaaagatctagatttatatgacagtattttttaataaaagcaatgttaaaaagtgaatatatacatagaatggttaaataaatacattgaaatgataaaaggctaagtagtcattaaatttcataataattacatcaaacacttgtattgcgctaattatgtgccaatcattgctattcatttttacgtatattaactcatttaaatatcacatatttttctatgaaatagtcactgtcattaaactcatttttttttttagcaatattgaggttaagtaactatccaagctggaattgtatgccaaatctatgctgttttttgattctccttcttctcaagccattaacagacaagataatggactgaccacttcgacgcataaaattctccttcccttaaactccacccatgccctcaggtcttcaataaaataatacaaaatatagataatcttacatcatattgggaactgaaaatcactgaggaattttttttaaatataatgtaagttggatcaaattgcagtaaaactatcaaaaactgtcaaatgcatcaaagaaacactgtgcttcattgctaataaatcccccacatgaggcaccaatatgaaattgtggcctataaataaaagatgttctgagccgggcgtggtggctcatgcctataatcctggcactttgggaggccgaggcaggcagatcacctgaggtcgggagttcgagaccagcctgacaaacatggagaaacactctctactaaaaatacaaaattagccgggcatggtggcacatgcctgaaatcccagctactcgggaggctgaggcagaagaattgcttgaacccaggaggcgggggttgtagtgagtggagatgcaccattacactactgcctgggcaacaagagcaaaatcatctcaaaaaaaaaaaaaatgttctggcacaacacttgtagcaacagttaactggaagagaaattaccaggggccagtgcatggtgtgcaactagaaatatactatgtggaatctccctttaataatcactaatcctcaaacgtattataaagccgcttactcttccagcctctgggattcttccacttggatataaaaaattgaaaccaaaacaaaacaaaacagtgaggcagagttattcaattcattttccagcaggcaaagaaatgaagctaaatactaacagcttcatttcttatagccttatagctaaagagaaagctaaatactaatatctgagccctaccatagtggcttcattgtccgtatacagtagtatcaagcacactctaatatccttacttcattggttccaaacccaatttgctaatttatgttggtaacaccaaccctccagattacacactataaacaaagtgatattgggacttgactatacaataaaacaagcaaaagagaataaaatgtattatctatggagaaacattgagaatgattttttttttcttatttatgatgagtttccaaaaacagatacacaaataatttcaggctaatgaaaatgtcttggaaaataaatgaagaaaataacacttgatagagaagagatacttttaattattgtaatgacaataatagtcaatgttttataataatacttttagtaatacttttagtttactacgccaagcagtgttccaatacctttacatggatagctgttttaatcctcataataacctatcagatagtagcattattattcccattacagattagtgaagcataggaaagatgagtaatttgctcaaattcacactgctacaaatgataaactcttgtgtctgaaccaggggttgagaggtagagcaagatggcagaatagaaggctccatcaatcttcccccctcttcagggacacaaagttaacaactatctacaaaggaaaaacacgtcacaataaccaaaatcaggtgagcactcatagtatccttttttaacttcatatcactgaaagaagcactgaactcagtgctgttctgttagagcagaaagaaaaaccagaccgaacaccgaactcatctgacacctgcccacaaatggagcatttaaacaaccctagccagaggtgaaccactaatcccagcagtcctgacttgagtgcccacaaacctcacactgaggtccaaaatgccggtctctgagtaaacttgaaaggcataaggcataagtttctaggccatagggactgcaactcataggcaagtcctagcactgaactaagctgatacagttgacttgtggggaacgtgacatacaaagacaccagctggggcagctaagggaatgctggcattacccctcccctagacccaggctaaccctaaccctttccttctgcttgagcagaggagagaaaagagtggggaggactttatcttgcatctttgatcttgatcagccacaggataggacactggtcagagtcatgaggcccctgttccaggccctagctgccagatggcatttctaggcacatcctgggccagaaaggaacctgctgacttgcaggaaaggatccagtcctggcagcattcattacctgctaactgaagagcccttgcgtcctgaaaaaccagcagtaatacccaggtgctatgtggagggccttgggtgagcctctgagacttgctgtcctcaggtgagatgcagcacattaccaaccttggtggccatgggggaaaaacatccttcttgaggaaagcagaggaaaaagaagagggaactttgtcttacactttagatacgagtactgccacagtcaggcagagcaccaagtgggcacttaagaatcttctacactactactttcaatttgccttttctaccaccactccagattgtggacaagatcactaacaaccatcttacttcagaatccgttgtgaactctttcaccatttttgttaattgacctgtcagcaaagcagcatttaaagtgtgggtcataacctccttttgagaaacaccttttcctttactccttaatatcaccatcctgtatcttgggttggtacttctcaatgccctttgtgtcagtgtctctttgtcacatacttcactttcactttaattgctggtattcctccttattctgttctgaagatagttgtcttctattcagcttttttcctttggtggatactaccagatcccaggaagtcaactaatatgtatataatatttatgacaataaaataaataatatattatttgtaatttactattctctcttctggggagctttccttctttaaatatgttgaaaacactacattatttatcataaatatttgttcattatatatgacagtaacattattaggtggaaatattatgtgttggaaaaaattgctcaaattatattcatgatcaccggctgttctaaaatcaattttattaggtaatatctgtgtcacattatctctaaatttccgtaattttcataatgaaaatgaagaataaaatcaaactaagttttaaaatgtgagctagtaattttagttataatgtttattttaacattaaactcatgaataaataacaaaattaaatgcaattcatcattctttgaacatttctgaatttttgaagatcaaatataaatctttcacaaggcttgtatttgacaatgttgagcaactatctctggtgggaggttgttattgtacattttaaaaataatttagaataccaaaaacaattcctcactagattccttctggaaaccaagaaaatatccaataataatggcattctctaaacccagttaattaaaatcttatgatccataaaagtaagataaatattactcatatttgtagatagaacattagaggattgttgctgtattttcagagtaagggtaaagattaatcttttcataagtcaggattgcaatagctgttttataaatagggtttttggaagttaattatttatatgaaacataaaattattgtgtcagatgcttttctagggactggagataaaataatgaacaaaacagataaccatatatcacctccttgaacttaaattctggtgggagaacacagaaaaataagtacatacataggtacatacgtacacacaaaacctatgattatgtaataaccattataatttataataatttagatgcagacgagtattacgaaaaaaatgaaacaaaagagggtggggttgctcaggtatgggtatagggttcatttttaaataatgtggtaaggaaatgcctaactttgcagaacaagaaggagcccaagatgactgtgaaagaatgagaggagtacagacgtgggagagtgggagaccaggtccaaaaggaaaggaggtcagacaatttaggtccttatagggcattttgaaggctcctcttcttagtgatataaaagcttctacacagaaggggatttagcaaactgacatgctctgacccacatttgagcagaattgttctccctgctgttggaggtaaaaggcagaagctgacactgacatggcagcaatgaaatgggtgagaagtggtcagattttaaatgtattttgtaggtaagagcaacaaacttttctgagggattaagtaagaatgtaagagaaaggagaagtcaagaaaaaaaaagactgcaaggtttttgtttgttttttaaccttggccaactgggaagatagactggtaattaagggaggaatgggagggggtggatatcacgtgtttgttttgtgcaattaagttacagtgttgaatttaagatacatcaatatataataggtaccattaaggaaacacatcaagtgggcagttagatacaaaactatggagtccataggaaaagtctattgagccttttcaggttatggattgtttttaaatatataaaactagacaagaatacaaaggaaatgaagatagcaaagacatggaagccaatatgtagtgtcctggagtccaagtgaagacggtactttaaagggcaaggaaggatcaattttatgacaatcactagctcttctagaatgtcagtcacttcatctgcaattggaggcattggaacatgacctgatggactccattcattccgggtcttaacattttgtgggactcaccagggtacatgatttaaaaaaaacagaatgcttcaacaagattatattttcatggtcatctcttttcagtgctttaaatttgtgattaagagaatgtttgagattaatcatggaaataattaaatcatgtctaaactcattatatgagagatgaaagtaataacacccagccaagtttagtggctgtgaaacatttaaaatttggggtcagcctacagactcttagggacagatttagtacgttattcagaaggcaaaatagaaatatttcgggagttgttaataatttgatagctttataagattatttgttaataaaaatggtactagaatgaaccaagtaatgactttaacatttgaatatgcacttactttttattttacttgatcacgatttggctctttaattaatttcatttacttttaatctttcttttggcccagaggaaaaattaacaagttgaaatgccatgtttgggtttaatttgagaatgagatttgaaatatgaaatatacctcttcttcaaatcacttctgtggcttaaagaatgacaaagacctctatttcctaccacatcagtcacagctcttcctaagcatcacactttcaacagaaatacagctgacctcataatcatcccagataaaccattttttattttccctgatcttcagtgaacattttaaaaaggcagagtgattggagagcaatgtggaggagtgaatagtgcagcatagtgctgagagccctcaagaactaagctttgctaagaatgtggaccttgttgaagacgtaagtcattatccagagatgaagagaagcaccaagtattgtgacataaaattttgcagaaggaagaggcaatattaaaacaacaacaacaggttatatcagggacattttcctaggtttgcataattttttttttttttttgagacggagtctcgctctgttgcccaggctggagtgcagtggtgcaatctcggctcactgcaagctctgcctcccacgttcacgccattctcctgcctcagcctcccgagtagctgggactacaggcgcccgccaccacgcccagctaaatttttgtatttttagcagagacggggtttcaccatgttagccaggacggtttcgatctcctcaccttgtgatcggcccgccttggcctccaaagtgttgagattacaggcatgagccaccgcgcccggccacaaaaatttttaaataaggaaaattttaaaattgtcacttcaacttaaatgtttcatctatgagaggctgcatagcgcctaaaatctctcatcatacttcttctcctgaaagatgcatttaatgctagaaacattgacatatgctactctttatatctaaaatgttcccttaatatgaaaatgtattaatattttaaggcttaatttatactgctacttctctgtgaagacctgtttgtctcatttcaattaaatatctctttcttttcgtacctttattatctaattatctctactattcctagtattcttaatatttattatacataggctcttggggacagaaggactagtattctgcatagcttgtattttgcattattactgggttagtatattaaataattaatagatgagtaaattaatatcacacatctaaagtcaccagattttatgttaaataagatattttctatctgatttaagaaaaaaaattgaaagacaaattactgtacctattgggtttcattaattggttacagagttataaaataacctcaaaaaacaacatgtttaaaatgttacctatataattaaatgttgaccttgtgggacagtagatgaaagtatcaatgtaatattaattatttatgatgataaagcctttatgagacttaaaggaatttctgtaagtcaaagattataacagttcacatgttatgatttgctatttagtagttctattttcacaaattttctaataaaattttgttttatatatatgaatacaaatacatattatttaacaatagatgtctttttatgggctgattatcacaaaaacttaaaaggaaatgattatgtaagcatgtttacagtctcttatggaattactaagtaaaaagagagagattaaattgttaactttaaagttaacaattttaactgggtgaagggcccatggaatcctcctttattattttctacaagtgcatgtgaatctacaattatctctaaatgaaaaaaaccttaatagaaatattttcacacttactaaggactgaattgtgtccttgtcaaaattcatttggtgaagtcccagcccccaccccaataattcagaaagtaactgtatttttacatagggcctttaatgatataattaaggtaaatgaggacatgtgggtgggccctaatccaatatgattagtgtccttataagtaaaggagattaggacatagaggcacagagggaagaccatgtgaggacacaagatggccatttaaaagccgaaaacagagaggcctatgaagaaacaaccctgctgacactttaatctctaacttctagtctccggaaatgtgaaaatattaaattttagtttttaagccatccagtacatggcccttttttttacgattgtcctaacaaatcaatataacactaaacagagcattttattttaaaatacatataaccaaaagtagaagaaaagtctaatagcaaagaaaactatcaatgtaattggccatattagcagatggaatgagacaaaatcatggctcatctttttggatgctggaataaatatttaataaaattccacatacttttgaagattaaatgccagagcatttggaatgaaagggaaatctctaaatctgacaatggctacttactaacaaccaacaacagacattatttttttcatcatttttaagggtgaaacattacaaatgttttatttgaaaatgagaagcaagagaaggtagactgcaatcagcacatctattcaaagccatatgaaaggactcggccagagcaatgtgacaagaagaaaaaagaagaaaaaaaaatgatgttttgattgtctattcagtgcttcccagcatttttcatttcaggggaaacacagaaattgctaaaggaaccagatcaatatcttccctcacttgtaaaccatttgtgacacagcagtattctgctgcaaatggttgagaaccctgttctatattgtaaatcaacatagtgacaatctttcagaaaaagtattcatctagattgctgagaaaatatcaatatacaaaatagataaatgtcctatataccttcaataaataattagaaaagatgttcaagatatgtatgaagataattataaatctttcttgaaataaaaaatatctgaatagatataaagaatggttgaaattttaatattttatttaaagaaaccattctcccaaaaataatttacaaattcaggaaatttctaatcaaaacttacaacttaatacacaaaaacggagtcaagaatggccaagacaattctgtagcaagcataaagggaaagcaggttttaacaggtatgtaaagtaaaaattagaaatctacagtaagtaataaagtatagtattttggtgtaagctggctgattggtagcagaatagaaagtctgtatataaaaggaaaacttaatttattatgtttctctttttctttatactacagaaaatgttgcagatgattccactgaatttatgcaactctgctgttttactaaaatggctcataatgtgaaatttatttcaaaataataaagcaatatcctaacaactgcagttatgggtgtgctcagtgtcaaaaattaattacaggattaaagagagaaaaacatatattagtgttttttaatggtaacatgagattaaaagctgttttctattaggatacttgcaaattcatgcatgaacattaactcttagatgatagttgaaatatagaaagaaaaagggaattttgggatttcttcagtatgcagttttttcatggaaatcagtttctttcattgttatcgccacaattataatgggaaattgagaaaataaagatactaatttagattggttaccatatgatatttaagtacagaacttactttacccacataataacatatggacatgttaatataacttaaaattttaaagagtacttcatgtatgcttctttaagaactgtatagaagaatcttctttaagaaacttggcatccaaaactgttacaaaaatattttcaagtggggaagattcatttttattcctattataatggcttagagattttgatatctcctttatgcaaacgtttgataaaacagtctctggcattatgctttttgtcactttcaaacacctccaaatttaaacattcatattttgggttttatttcagtttttctttttttcaattatactttaagttctagggtacatatgcacaacgtgcaggtttgttacatatgtaaacatgtgccatgttggtgtgctgcacccattaactcatcatttacattaggtatatctcctaatgctatccctctcccctccccccaccccacgacaggcctcagtgtgtgatgttccctgccctgtgtccaagtgttcttattgttcaattcccacctacgagtgagaacatgtagtgtttggttttttgtctttgcaatagtttgctgagaatgatggtttccagcttcatccatgtccctacaaaggacatgaactcatcctttcttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttataatcctttgggtatatacccagtaacgggatggctgggtcaaatggtatttctaattctagatccttgaggaatcgccatactgtcttctacaatggttgaactagtttacagtcccaccaacagtgtaaaagtgttcctatttctccacatcctctctagcacctgttgtttcctgactttttaatgatcgccattctaactggtgtgagatgctatctcattgtggttttgatttgcatttctctgatggccagtgatgatgagcatttttttcatgtgtctgttggctgcataaatgttttcttttgagaagtgtctgttcatatcctttgcccactttttgatggggttgtttttttcttgtaagtttgtttcagttctttgtagattctggatattagccctttgtcagatgagtagattgcaaaaattttctcccattttctaggttgcctgttcactctgatggtagtttcttttgctgtgcagaagctctttagtttaattagatcccatttgtcaattttggcttttgttaccattgcttttggtgatttagacatgaagtccttgtccatgcctatgtcctgaatggtactgcctaggttttcttctagggtttttatggttttaggtctaacatttaagtctttaatccatcttgaattaatttttgtataaggtgtaaggaagggatccagtttcagctttccacatatggctagccagttttccctgcaccatttattaaatagggaatcattttcccatttcttgtttttgtcaggtttgtcaaattcagatggttgtagatgtgtggtattatttctgagggctgtgttctgttccattggtctatatctctgttttggtaacagtaccaagctgttttggttactgtagccttgcagtatagtcaggtagagtgatatctccagctttgttcttttggcttaggattgacttggcaatgcaggctcttttttggttccatatgaactttaaagtagtttttttccaattctgtggagaaactcattggtagcttgatggggatggtattgagtctttaaattaccttgggcagcatggccatttttcatgatattgattcgtcctatccatgagcatggaatgttcttccatttgtttgtgtcctcttttatttcgttgagcactggtttgtagttctccttgaagaggtcctccacatcccttgtaagttggattcctaggtattttattctctttgaagcaattgtgaatgggagttcactcatgatttggctctctgtttttctgttattggtgtataagaatgcttatgacttttgcacattgattttgtatcctgagactttgctgaagttgcttatcaggttaaggacatttgctcttatgtgtgtcctcacaatttcaaccccaatcatgcccagttctcattcctgtatttcaatttaattaaactcaacaaacattcatagacataaaactataacatgaaaagtactgtaatggatctatctttaaacagcagctgataaaagacaaatgagtgaacagttcataatggccagatgaaaccaaagataaaaggtgacagtggagggcaaataagtgcttgtcaagcagactaggaggaggaggtgtttcagacaaataaaacagcattggaaaggttaaacagctgttttagtgcatagagttttcagagaaaaaattaagtgattcaaaaaggataaatcacataattgtgaaagtcaatggaacaaatggataaatacagatgagcttaaaataaaggtgaagttaaagttgcagtggctttttaagcaattgttcaagcatgcattttactctataccagtgatacgtaaacaatgctcactggacagggccttctatgcataaatagttccaagatgaacaggagtgagaaacatttgatagattcaataccatatgtctacttgaaactgtcttgaaaacttacaatgcatgttagtttataaacaaccttcaataaaaaaaaaaaaattaaaaccccaaaaacaaaaccaaaaacccccttgactttaatttaatacattttctaaattttatgaaaatgaaaattttcctcatttggaagacccattataatatcaagaaaaaaatcccagagaatagagtttgagaaacatattaataggacgtgcaagctggtgatatcttttactttactgctcacaagtaatttttgcttgtctttaatgagtcttccccacatttcctccataaacatcctcataaagctgaccatgtaaagctaattttttttgtactcacaccatatacttctacactggaaggtgtttgggatgtagcatatagtatcgttgagaaatttttttgatatggctaataacattaatttatattaatgtctgcttcaccaggaatacagttttagtaacctgacttaattcctttgtgtagaaaaaaaatatgtgtatatatatatatatagatttatattatatatttatattatatatgtttatgtataatatatatataaacagtatatatataaaaaacagtgtctgtatatgtatataaatatatatatttaaacagtgtatatatatatctatatatattaaactgtgtgtgtgtttggcacatcataggaactaaatatatgcttcagaaaaataataagattaattaattaaactcattaatgacttgatttgtcatgttttgtgaatcatggagcaataagaaatgtgtgtattttgctgataatattttttgctacaaaccatttttattagtatttattttcaatgtttaatatcaacatagcataatactaaattttatgaaattcactcattgcacattatgtctcttcaggatttaaatttttatattttgtatcatctcaatatttatatttttaagaacttttactttttaatatttttgcactatattttgacactatatgtgttagttttagatctgttctatttacgaatgttcatgaacagattttcccattttctaaaactcttatttgaaaatgcattatgaaagaattgtattttagaaatcatgactcctctgatatggaatgacaaaatctttccaggacttataaaaaattcactaaacagttaggtctttcagctgttctatgtgttgacagacggttgcagatcaaaactgtgcatcaaaaagattatgttaatataattacagtggaaaatattctgaggaacacaggaacttttccttagcaccatttaaatgtgctaaggaaataggtaaagtaagcaaagtcaacctacaaaataggtaaagtaagcaaagtcaacctaaaaacacagaactgtagaacttgaagggactaaatatatatctacttcaaattctcctgctttcagaggaggacactgagaaccagagaaatgaattgacctttgcaaggacattcagaagtactattttctaaatcctgctcagacatatcaaggaatgacacaggaagttcaaggccaaagtcatatctgaagccgttaaatttgcttgcttgaaaaactaaatgtcatttcttcatagaggccttctggagatctttttcttttttgtgacatgattcattcccaaaaatatgactgtactgtaactgaaagcctggtttatttacttcatacaccccgttagaatttatagtaattttatttaaattgtgttgcttttagaccattgaattatttgtgttttcttctttaaaaaatatgactataatttttctaataattagagttcttcatatatgaaaatttctagctcagcatttcttagtgactcctgaaatacctgatgctttatttcctatctaaatatctatatcttatagtcaatattcagtacttggtctcacctcaggactattgattttgattattgggtttgaattatatgggcttagaattctaaattttgaatattcttatgcattctaaagtttaagaacttagaaattttattatttattttatggtaaggcaattttattacttcatactgctgtaaactactgtttttcataaattttaaaaatgaataggccaggcacagtggttcatgcctgtaatcccagcactttgggaggtcaggggggcagatcacgaggtcaggagattgagaccatcctggctaacatagtgaaaccccgtctctactaaaactataaaaaaattagcagggcttagtggagcatgcatatagtcccaggtatctgggtgtctgaggcaggagaattgtttgaacccaggaggtggaggttgcagtgagtcaagattgtgccactgcactccaggctgggtgacagagcgagactccatctcaaaaaataaaaataaaaaataaaaaattaaaaaaaaatatatagacacacacacatgcatatgtgtatatgtacatatatacatacatatacacatacatatgtacatatatacatacatatacacatacatatgtacatatatgtatatatacatgcacatacatatgtacatatatgtatatacgtatatacatgcacatacatatgtacatatatgtatatatacatatgtgcgtatatgtatatatgtacacatatctgtaaatatacacacatatatacacagacatacgggagcatgcatatatgtgatatgtatgtgtctatacatacatgcatatgcatatacatatatgtggatcatatatgtacacatcatacatatatgtacacatcatacacatatatgagcacatatgtgcacatcatatacatatgtgcgcacatatatgtatgcatcatatacacatgtatgtgaacatatagacatatgtgtatacatatatgcaaacatatagacatgtatgcatgcatatatgcatacatgtgtgtacacatatagacatatatgcatacatgtatgtacacatatagacatatatgcatacatgtatgtacacatatagacatatatgcatacatgtatgtacacatatagccatatatgtacatatatgtacacatatagccatatgtacatatacgccatacacatgcacatatatacacatatgcgcatatacttatatgtatagacacatgtatgtatatacatatacttatggacacatgatacgcatacatgtatacacacatatgtgtatatacacatatacatatacatcatatacacatatacacacatataaacatgtgtagaggcacatatatgtgtctatacacatatacgtatacatcatatacacacatacacatatatacacatatgtgcatatacacatatatacacatacgtgcatatacacatatatacacatacgtgcatatacacatatattcatatatagttacatatacattatgtacacatatatgtagtaatattcccttactgttaagaatattaatcaaatataagtctaaattaaatgaaaaaaatctaagttaatcctcatgttagttcctatacctttttctttatatccataagatcagaagaacactttaaataattaacctaagctggatggaacaagtaataataatagtaataatagactttaataataattattaaagcatggttcaatggttaaaagtaaggtccctgtgtctgtgtctgaaatctaaagactgcagttttattagaaggacattaattatatgcatattactgaaaattgctgtcaaggaaacagagtagtcaatttccttaacccacatattcccattgtacactagagtcactattcttcaatatagtctcaaaatatatatttttactaatttcaggcactattttttaaaagcttatcttcaataaatcttcccatactaaattttggctttgtggattctaaagacaacaacacagtgctaacttttgactttaaacaagtacaggatgggactcaaagtcttctagtttaaagttgatgtaattgatttattctcccctccttcacaagaaagtttatataaaaagaacataaacaagtggtgcttactttgccacaaggcctactaatacagggagaccaggatgctgggcagcttagcggaaaggtcagtctttggagagggttggattgtaatcctttaaggcacctataaactatgtgactttaggccaattataaagtatttctaatcctccttttaaatattgggttttgttgttctataaaataaaaagaataataccaggtaaacattctgctaggcagtctaccttaggtcttctatgttaggagcttctattctagccaagattaacatttagtataaatattattagttgcaattatgacattttcttctatagagcctaacaggtcatctttacaaattcctttatttcacagaaaagtaatgaactatatcaactatttgattatatttatacttagatgctagaagcaggaccaatatattgcgcttccatttctcaatgatgtattcaattaattcatgctttttcagtcttcactagcttgttacctgtctacacctaagaccttatcttgtttctattttaacatccaaatactttatgcatagcatttgtttctcgattaatctgacaaaagatctctagaataaatgctgcattaacaaatgaaagtgaatttaatgcctgccaagttagtacctgaaaaaaaaaaaggtcttttaaactccttggatagttttgattgttaatgttttgataattatttttatggttatttaagtgttcctagtatgacaagccaaaggtctaggttcatcaatccaccatgattgaatatttcttataactttttgtactaggtggaaaatgatcacttttattaatcctgtgtactgatcacataaaaatagctaaggcttgctttgctcaggcctatagtttaacttaatttattagggaagtataatagtattcatctttaacaactaaactataaagttctcctaagagaaaatcagagcaataaatattttgaataaaattttaccacttttttttaaacaaaaaagcataaaattaaatttgcctgctaatttatattttaacttgttaaacttgtagccctttttggatctaatgatttcctccttcatgtgattttaggtttattcaaacttacttttgattatgaaaaaatttacctgacagccaaagcatacattcaaacagatagcaaaatcattggttaataagatgtgtactaagacacagtctcaacagtgcagaaataaaccaaaaaggtattcttttaaaatatttgcctttatatagaaataatatatcatgttttcatatttaaccgtcatggaaaatcttgaattcagttctactttattgatgttctctgaacttcctttttaagagttaatattttagaaacaagttaatatgtactgaatgtttaaattcctaaactatttgtttccataattttatgatatataattttccacataaaatttcccaattagcttataatatcaataagattcatgtttactactcataatttaggagaaataaaatttgaactaaaagtagtagagtttgaaaattttcatagtataaataacatggttttaacccagaggtttttttaatcaatcatagcgaaatattttcaaaaactcagtgactttgcctaatgtcaattagtggacccaattgatcacttgttttatcatatatgtagcaaatttatagtttatcatttgtccaaagggtgttaagacacaagagataatacatcaatattgagtaataaacacagaaacagtagttttagaaaaaacaataaaatgttaatacttttaatgaagccattaatttttttggcaaaatcaccttcaataattatagctaattaatactttttcatcaagtaaaattttaccagatagtgtgtttaaactatattaacttcaaagagaaaactgtcagaactaaaagtatttttaagcctgaaagtttaaatgatataaatgtttttaaatgctttgatttgaagaggtacaatcctctgttttcatgactttgattcattgctgtgtacacagaattaaactcaagataatactgagagttgtgctagctgttaagttcacagtgattaatggcaagacaagatatcaggcatctaagagttgagaaagtattaacttgagagaaagctgaaaaagccagagggaaataagtcacagtaacgaaaagcaaagaaaaagcaaaacattgttcttgattgtactttgatacattcctgaattcatcctaaattgtcaaaagacatgttaaagcagtgttcatgggatctaaatctaaactggcctatgaaataaataactaatatattattacataaaaattaagaaacataaaatattacaagcaaattttctgtttttgagtacaaaatgtaagaaatattaattcttaaaactttatgagaaaaacagaaggcacagaaaaaaagccattctaataatttatacagttttcatataatattagttatcaattattaaagacttctcacataacagacatcgtcttagatgattgtatagcctatcttaatcctcataacataatcaccagtatgtgagaggaagtgtctccttttaaattttatatattttgtaagctaaaattcagaaagattcagtacttttttaaaggttgcacagaagtaagactttaaatacagttcagatcagtaattaaactttgttttattcatttgcttaatcatctgtcttccccaatgttgcaatatttgtgagggtaggtaccaatattggcttttctacttctaatttccagcaattttcacagaacctgactctctttctttctctctctgtgtgtgtgtatatatatgtgtgtgtatatatatatataaatatatgtatatagttatatatataaatatatgtatataattatatatataattagaattataaatttactgtactgagtcataaatctttcataatttttttagtgtatatgtgtgatatttctttcaaaacaagagcactttcccagatcaaacattgtaacatgtatttctatgtatttatttttttgcatagatttactcactttttcatgtgctctttgtatttttttatttgacattaattgggcacttaatgaacacatagatttcaatgtgctagagtctccatatgtaaagatgaataagaactgattcattgtctgaaggcagcagcatgcaaacaacattaaatcagacaaacaggtgcacacattgtattagtggaatggtttgtgttttgcagatgcagagagataaataactaatgaatcatgagggagctagggaacactttgctaaggaagccacctgtgggctgaaactgggaaaagtagttagttgtctagcttcatgttggcagagaatggaagaaaggaaaagcatttcaggaaaaggaaacaatgtacaaagacccaggttaaagaagataggatgctcagtttgcctgtgatgtagtgtgtgaattagaatgaaatgaatgtaagctagcagaaatacagtcaagtcagattacgatgaagtgttgttcagcagaaatactactggcaatttggacaaatttttctttgttcagacaaattatttgagggaagttaaacatcacttgccctatccactaaattccaagtactccctagtatttgcaaaaagctgatacaaacacaactcacccatttctcccatcacttttccaagtgcctccatcaggaattgtaatctcacacatacacacactgcacggcattaagggccaacgtgaagtactgaggaatttggacaatattcaatgacaaatgaagataaagaagttagatgactaacatgattgtattatgctttataattttccaattttaattccttaatatgattagcccaaactgtaagaggaaagctgaaatcattcttaaaactgtgaaaagttttattaaaattcattgagattgcagttatgaaatgtgctaattttcaggttaggacaacttaacacttgtccattactgcttcattgacatgaaactgcattagaacatgtccttattctattaacacttttttatggccttcaaagataaacacaataggatattttgttcattggcacacacactcatatacatacacagtcacatagacttgtatacactgctttactgctttataaagctcttacaaacatatttttgaagagtaagtttttgacttctttgaaataatttttttctatctttttaacaatttggcaatatcaaatgcaatgtttttggtaattttattatgaaaacaaaaagcaacttaagacttgatgaaaatagtggtcaaagcaaataaacacagtttatgtttcagccaaattattgcattcaagaaggctgtgttcacaatgtatgattcttttcaacatgattacataatcttatctgtaagcaatacagcatgccattctagttagaaacaacagttctgatttaatgttaggtttgtgaatttggttctcaccttaagaaactaacacccacatccatatgcaatgcttaatttgcttccactttattcactttctttcataagctatggaccgagcacaaaaataacctagtccaaaagattcttggggccatctgctctgttttgccttctgaggcttctgttgttttcctttactaaagaatggtttccttgatgttctcaattacctattgttttgctgatggttatcttggctctcttcctgtaagaaattcaagaattgtctccagctgcctatagcatagacggccagtcatatgacatttcccttattgggatgcatataagacaggtgaagaactttctaattaaaatatttgagttgtcaattcatagaagaaaataatttcttaggagatttttctgcaatttttataattaaaagaatgcattgggttgttatctttctcaaaccttataaatttctattgaaatctgtacaattgaaaacaaaagaacaacactgagattaaggttagtatacattgttgcctataattattaagtattggaaatagaaagctactagtagctgaatggaatttcattttggtcagattcaattgtgagacaaaatcaaacaaaatcaaacaattcattcaagtacacaaagatgattttggtatctcattttaaagcaaaggcaagaaaaataagccttacgaagaaaggaccttgttcatttcctccctttactttcctcagaatattttgtttcctttttttcctctcattttccaccttctgttcttcaattctactcttctctgttttaaagtaatttcttcctttagctgggcctctcaactttttatcttcctggtttttattacaacctctctaggacctcttcctcattttagatgctaattagcacttactaattgaaattttaaaagctgagtattttaaacactttagcacatcaaaaaattctgtgatcataggcagatttcaaaatagtttagtgtgtaaaacagaagatactagagactgctgccttttaaagaaagtgtgaaaaacaagatatgtgtctaaattttacacttattttaacattgcatgtctaattctgacattcttacacagtttgaaaacaaaccaggtttttgttgggttctggcttgtgtgattactgtcatcagaatcctagcctattcatttcttcagatacaacacagttatcacagattttatagcatttttttctagattctgccacgtctgttccatgctttctacagaaaatcagctatgaataaatgtaactttatcctaggtacagggggaaaagcagtcattcttatgaagtgcaattttatatataattatttttaaaagttacattgtatttacgagatgttacagattggattctctgggaatcagatgttgagacagagtttaatgtatggaatcaagggggaaagaaagtagtcctgacagaggtagaagtggatttccatatggtgaccagaaacttagctgacccagtgatttatgaagctaaaaatgaccaatcagagttgttttgcttgaagtggaagtggcctaggcctttatatccctccctctttcagtcacagatatgcagatgtgctctgctctggaaatgggtgtgaccttgagcagggcagcttctcaactcaggcaatcccttaaggggctgaagctttcctgccacttacactcctaagaccagtggcaataggatactccctgcgaaatgtgggtgacccatctccacatccaacacctaagaaacatttaacatccctagacttatgctgaagaattttgttttaaaatattgatgccttgttagctcatcattaatatgaaaatttctgagaaactcaaaactcacccttttttggtatcacccattttattcacacataatttatctcccttttaacttttattcatgggtcagagatactgctgtatatacatgctttgtactcacatagttcttttaatttttgctttatttttcctttggcatacttataattataaactactggtattagtgttgttatcacttattcttcacttatctttgctattttctagattaatagaatttttctattctattaatctagatttctagattaatagaaagacaatgcatgcagataagtagtgtagccaattctaagttggagcctttaattgtggcacaaagtagagaaagataataaagactcatgtttgtagtgtttactaatagcacatttggggataaatgagaaaataccattaatttgtttatttacacccctcacacacaattttgaccatgctttcatttgtttaattcaaagaatttatgtatttactacctcaatcaaaatgcattatttgacactctagtaacgactcagatgcccctttagcatctaataattcttctttcaatgtaaatgctcaataaataaatatctgaaagatacacaatcacagatccttaagagttctttagggatatacagtattgtcaaatactttagggatacatagtactttagagatacacagtattgtcacattttaaactcacataacttggatttgtcattagcttaaagagtttgctcaaatacaataaaaaataaagttagcaaacataaagtcatttgagtatgaaacacactgtttttttaattgctacttccacagtgaaaacttctcattataattagcacttcttaaatataggcactgatctatactttttatttctttttattaaatgcatattccaacattttatctttataaatattgattccaaattaaagtgtctaattttttaaaaaatgtattcaatggtatgttattaatgaacaactgttatttgaacaattcatttaaaataaataattttatatcttttgccttgttaaatgttttaaaggaaaattaatttttaatttgaaaactattcatagaaactttgagaagttttactaatcttaatttttaatatgcttaaatgcaactattagtagaatttaataataatttaattaaattagttaatatatgtcatacacttgtaatagtaccttatgacctcacacttagtgtgaaatggaggtcagctcttattaatagcaagaagtaaacaaataactagggtataataaaactttctaatagtaagattatcagcctaaaatttaagggatatttttatcatttttatagaaaacaatgtattttgattttaataaaacatgaaaaacattttaaagaaagaagtaagaacatggaaagatttttttttttacaaaattaaatattttctgaattaaataagatgttctaatattgagccagatttatctgcttaaaataattaagttttttagtgtgtatcagacatatgtatagaagccactaaggtaggattaattaaattatagcttgcaatgtattacctcattcgagataataatatgtaattagttgacttcactgggaattttcaatttatattcctaataaaaaatattatgtaattgaaaccaacatctgcctaaaatcaaaatgtcatttagaagatttgcagactactgctaaagtcaatggacattgtccctaaggaagttctcaaagaagtgttgtagtaaagagctttctgtgcattattccagcctgagggaactatgttagcaagtatcttacagtccaagatattggtcttcttatatatgggcaagtaataaatcactgtacttgcatatgtcatgtacgtggcccatatcaacaatcagagaagatgtaaatttgttgaatacaaatatgaacaaacatccattgaccaacaaactgtaacaggcaatcaatctgataatgagaaatccaaaagaagactttcttttaaagaaagacatgaaggacattagatcacagacaagctccgtaaggttctcaaaaaacaaattcatctacaaagcacagggaagcatttataagtacacagcctgaagttgattacttgtttgttcatatttttcaaaataaatggtctaatataccctaaaagaacaaattttcacagacatatgtgtggttggtatgtatgggcaggtttattgttcgaagtccatatacaaacatagcgtgtatttaactatttatgtatttaacttctatactgttttcaagcaaactgtactgtctaattgcaccatgtatagaggagtaggctaggacatttagatagcatttggcattttattccaaattctaggaggaacaccaataatctcagcttatgtatttaaaaattagaactgattttaaaactcaaatttatttaaaaaatatttgttttcttaattgacacattgtaattgtacatatttatgaggtacactttgaggtttcaatacatatctatgctgcataatgacccaatcagggtagttagtgtatctgtcacttctgtgcatttatcctttctttgtgatgagaacattcaaaagtctatcttctagctattttgtaatatacaatattaaactgtaaaccatagtcaccctactgtgaaatagaacaccaaaatttattctttctatctaattgtatctattgaccaagctctcctcaacctctcctctcccctcccccctacagtctctggtaaccattgttctactctaagcttctaagatatcaacttcttttattttagataccaggtatgagtgagatcatgcaatagttgtctgtctgtgtctggcttctttcacttaacatgatgtcctgcaggttcattcatgttaccacaaacaacagaatttcattctttttgatggctagatagtattccactgagtataaacaccgtattttcttcatccattcgtcccttgttggacttttaggttgattctatatcttggaaattataaattgtgctgtaataagtatgaaagtgcagatatctctttgaatactgatgtcattttctttggatacataaccactgggggattgttggatcatatggtagttctatttttcattttttgaggaacttctatacttctttccataatgtctctactagattacaatgtgtgtaagtgttcccttttccccacatccttgtcaacacttgttttctttagtctttttgataataaccattctaactagagtaaagtggtatttcattgtggttttgatttgcatttccctgatgactagtaatgttggatatattttatatacctgttgatcacttgtcttcttttgagaaatgtatattaagtttttttgcccattgctaaatcagattatttgttcttttgctgttaaatttcttatatattctgaatataaatcctttgttagatgtataatttgcacatattttctctcatttgtaggttgtttcttcaacttggctaatagtttccttttctgtgtaaatgcatgttagtttgatgtaatcaaattagcctatttttgcttttgttgcctgtgctttagaggttttatttaaaaaaaaaaaatccttgcccagcccaaagttgtaaagcatttctcctgttttctaatagtttcatattttcagattttacatataaatatttgattcatattgagttgattttgtatatggtgagagtttggggtctagtatcattcttcttcatgtaaatatccaattttcctggcatcatttgttgaagggattgtcttttcctcaatgtgtgttcttcttacctttgttgaaaatcagttcactgtagatgtgtgaatttatttctgggatccctattgtgttccattgattcatgtatctgtttttatgccagtaccatgctcttttggttactttagttttgtagtgtatgttgaagtaaggtagcccgatttctctagctttgtgatatttgcttagggttgctttggctatttagcgtctttttgtggttccatataaattttagaattatttttcttttgtgaagaatgttactggtattttgatagagattgtaataaatgcataggttgcttagggtagtacagccacataacaataccaattcttcccatttgtaaacatgggattatgtccgtttatttctgtcctctttgatttcttttataaaaattttatacttttcagtttagagatctttctccttcttggttaagttgattcttacatatcttattttttatagctgttgcaaatgaaattgctttcttgaattctttttcagatagttcactcttagtgtatacacatactactaatttttgtatgatgattttacatcctgaaactttactgaatttattagttccaacagtttttcttgatagaatctttaaggttttctataaagaattttaagatagaaactaaaaacaattttaaaggtgaacaaaataaagagttggatgactgaaaagataaaattcacaaatctttaactaaactaaaaaaaacgagagaagactcaaataagtaaaatcaggtgaaaaatgcatcattacaactgacaccacagaaatacaaaaggagatgtgagagtattaagaacaactatatgccaacaaattagataacatagaaaaaattgatatgtttctggatacgtacactctgctaagattaaattttgtagaaatacaaaatctgaacagaacaaaaattagtaagaaaattgaatcggtaacaaaaagtcttccatcaaagagaagctcagggtctaatgggttcactgctgaattctaccaaaaatttaaagaagaattaatagtaattttcctcaacctattccaaataattgaacagaatgaaatacttccaaattaattttacaagagtagcactactttgattttaataccggacaaggatgcaggaaagacggaaggaaggaaggaaggaaggggaaagaaagaaagagagagagaaagaaaaagaaagaaagaaggaaggaaggaagggaagaaagaaagaaagagaaagaaagaaagaaggaaagagagagagatgcaagctacaggccatatctctgagggacacagatacaaaaaatttcagcaatatcctaaaaaattcaatcccacagtacactaaaaagaacaggccgggcgaggtagctcacacccgtaaccctagcactttgggaagctgaggcaggcgaatcacgaggtcaggagagcgagaccattctggccaacatggtgaaaccccgtctctactaaaaaatacaaaaattagctgggcgtggtggagtgccggtagtcccagctactcaggaggctgaggcgggagaaccacttgaacctgagaggcggaggttgcagtgagtcgagatcacaccactgcactccagcctagcgacagagtgagactctgtctcaaaaaaaaaaaaaatttactcttaatgacttaatacaattcagttttaattttaagattcattaccactgttcttgtacaattattttataattataaaaaaaagaacattcactatgatcaagtggaaatcatcccaggcatgcaatgagggtttaatttatgcaaataaatacatgtgatacatatcccattaacagaaagacaaaagcatatgataattttaatacatgcataaaaagcatttgacaaaattcaacatcccttcatgataaaaaaaaaaacctcacaacaaattagaagtatgtaactttatgcctaatttcaccatttctattcagcatagtactgaaagttctagccagttattaggcatgagaaagtaataaaatgtacccatattagaaaggaggaagtcaaactgtccctgtttgtagacaacatgatcttatatagagaaattcaagtgtttctgacttcaaaactgttgaagacgttagtgctacttaccattatctcctgagcacatgagggtcagtatagaacttctttacccccttgagtttaggcatagctttgtgattggttttagctaaataaatctatgcagatggaacatatgccatgtgtcacttaaagatggaagcaattaattgctgatagaagactctccaaggttgttttctctcttttgttgttgttgttgttgttgttgtgttttatttatttatttttttagactaggtctccctctgtcacatcggctggagtgcagaggcacaaacacggctcttaaagctttgacctcatgggcttaagtgattctcctgtctcagactcctatgtttctgtgaccacaggcatgtgccaccatgctcagctaattctttttttttccgtagagatggggtctcactttgttgcccaagctggtctcaaattcctggcctcaagcaatccttccacctcagccttcctaagtgctagaattatagatgtgaggcactgtgcctggccaaaggttctctttcaatgcagcagcaatcctcgattggaattgatgttggaattgcaaagttgaactatcctttgcttgatggttgtcttggaatatcatctgaaactgcagtttccttgtataagtaagaaataattctttcttgttctaaataagtgctattatttgttttgttatcctaaaataatctagcacactctgacgaataaaaaaaaatcaagtttaccctaatatgctacattgtcacggaatcaagctgaaagttaccaagctaaagataattaatattttcacctacaaatcaagcttaaacattcttatatatgttcctagacctaattagatgtgtacaagtttggtacaaattctcaaatatcagtcatcttatctttttaaatggcccacagtagtagccattgaaagcttgagtagctgctcaagctcagcaagtacaaaattagaccactatttctgcctaccctcaaacctatattaccttcttaatcatatccagggagaaccagggagcaatcctgcttcttaactcttcatccctccccactcataaaaagctatatggaaaatcatgtggattttgaacatgtatctatcattgtctgtttccttattggcactactaagtttggaccaacatctttggaatataactaggttagttgcaacctcctaaactctgaattatcctctactcttgtcattcaagatatcactgtaaaattcaaatctgatcatgcataaagtactttactgaatgtttgttatagcaaccatatattctctaccgtggcacatcacatcttccatcataatttctttgtatacatttctgtcttcattctccaccaacctatgacttgcttgaggacagaaactacggattcatctttgtagtcttagttctcaatcctccctcacccatcttatacttgttcccagcctaacctcagggaatatcccatgagaatcctagctgtcaaataaagacaaaacattaatacctaaaaacagcataatttatgctgactcaaataaggtgctctcagaaatgtttcgagaacttcaggactaattttccaattcctatttatcacttcaaagctgaagtaatgtcacttatttctgttaatagaattgctcagaaatagtttctgttgttaagttcaggatttacataatttaatcaagtacatgtaatgcattaaaagtttgtaatttagggtatacccaatctaagctacctgtttatatttgcctacaaagcacatacacacttatcttataattgtgaaaacagtttgggtagacaaagacattttttgttgcctactaaaaatactgaattttgccagacactgaggagaaattgcaatgtttcaaataaaacatcattgcaggtactattgtaagcctaatagcatatatatatttatagagacagaggtaatagagagacttattgtcacaactttgtaatgtacttgcaaaataatcttacaaaaaatttaattaaaaagtatagaatttttaaattgttgatatttaataggatttgttctaaaaaatgcttttatattttccttacgaaaatcagagaaaaacacttttgctatgatagaattatacacacagtcattaaaatctgataagatggctcctgctaagtgaactttgccaaaattaattgagcaagatgcacctgctggtttgaaaggccagctgtaacagtatatgaaagaatgagagagaggatgtgctgagtgtatatgtcacagagactggggatattcaattaatattttcacttattagaaaagatgaagcaattgatgttcctagtgatattttaaatgccagtggtattaattctgaataattgctgtcattatctgtatattattttgcacaggtaagcagagtaaatttagagaacattatagtttaagtgtgaaacaaaatgactaaagaacctactataactttcaaaatcaatatttggaatatgcaaatgattaagataataagaatgtacatataatgaagagtatatgatattttaaatctgacaatttaatgaatgaaaagataaaataaaatattattatacaactttataccaaagatgctaaggcaagaagtgcctgacacctggtagatgtttgataaatatttgttaaatgaatgaatggataaaaaagagtttcatagagagtcttgaacagaagactgttcaagagatctcaaatatctgtttacatggagagacaaatattttttagcccataaatatttaaaaccaactgaaatatttgaaaatatatttacagtcatagtatgataaattgtccattctcacaaagtagtcactgtattttggttggctttcttaaacagaaattacctaaactaaaaggattactactgtatcttttcttatttttccatactttttctggtgcgtgtgtgtgtgtgtgtttgtgtattttatatatatatatatatatatatatatatatatatatataattttattgtatgtattaatataatatatatcactgatatatgtgtgtatatatgtatatatgtatacacacacacacacacacacacacatacatataaaatatcctctaagagaaaagacagaatggagagagaaaaaataaaaggaaagaggaaattatccagagagacaccatgagttatggtatctactctttcctccctagagataatcacatctttctaaacttacatataaattaataaatccacaaagtaagaaataggcaaaaatttctattatatataaaatacaaatttacactagccatactataaatgtttgcattgttaatatgcagataaaaatgtaacttctgtcaaatatctaagaagataaagtccccttgttctcccatcttgattaattattttctcttttgagaacatatggtacagaaagaaagaactctccatagttgtgaaactctttagctcatctcatcagacctgataatttggaccttatgaccaggccagttgaaaataattatagtgttaataatggaaaaaatgagattaaatcaaaattagttctatttagctcagattcatgctgacgtagagccaaaagccagctttagtttactcagccttcctttggcaatttttcagtcaagtacatgaacatttattccggtaatatctagtggtgttttggcctgaacaaatcaatggattactacaaacaacacaatagttgccaaataaacttaaaatatagatcaattagttcacatacaaacacactgactgcttcacactatattattaaattgaaaaactattccattaacacgatgcattactataaaagaattggcatatatgaatttcttaacatgctcccaactctacttctaaataaggaagtttactaaatgatccataatattcttcatacatgaaggtcaaatactgtttctatatcaaacattaaaataataaattaccaaagatgtattttccaagtttggtttatccagatattgataaaatattatgattctctattcagaaattgtattactcaattgatgtgattgattggatcaaatgccatatatagttgtactttcttctgtcatataaatgaggcaacaatggccttggtaaattaactctaccattgtttacttcttcacagaaggctaagaccattacctcaaaagcccaatggtgccaaacataaattttcacacatgcaattgttctgaacaaactcctgataagcactatttttagcactttagagcctagctccattacatatctaggaaaacttcactcaacatttgttagtcatagataagacacatcctgaggctatagatgacaccaagcgactgttgatctttggagttctctaactcatcgacttccagttatagtgctgagctacatcacccagatgtataagctcactctcatattcctttcttcctggagctcctttgccctctctgcgatttgggttctggccttctgcttctgtttctgaaacatctgctgtgtatgcccctcccacgtaatcctaaacctacacaattaaatgttattgccacttcatgatcatgtctttttccttgatcagccctgaaaccctcaagttttaagcataccttcttaagttttaagggcactgaataaattttaaatataatcgttaaaatattttatatcacaagctgcttgctacacaattattagaataactaaaacaatagaacagtaaaacaaccattattaattaaaatgccaagtaacagggactctcatactttactgataggaagtagtattacagtattgccattccaaaaaatgatttatcagtctcttataaaattaaactatactttcatatgacttagcaatgctattcttgggtatttaccatagagaatgaaaacctattactctagagaatgaaacattaatcgtattcatgaacacttatagcagttttattcataatcattaaaaatggaaataactcaaatgtctttaaatgagggaatatcttatactggccactgcataacaaattttgggacatttgtataataggaaactactgagaaataaaaataagtgaactataaatataaacaacacttggatgaatctcaaagatatgctgagtgaaagaagtcaacttaaataattcatgtaatgtatgatacttttatataatgttcttgaaaagtcaaactataatgacaaagaacagatgagtgattggtagggtttggagtgagggagagtgtggctgcacagggatagtgtgaaggaagttttggtgtgaatggaaatgttttgtatcctaattataacggtgattacacaaatctttatgtgtaaagattcatagaactctgcacacacacagaatcaattttgggtatgctcctttaaaaagttaaatttaagtctttacattgaacaataactggaagtagaaatattagaattctatttattatttatagtatattttattatttgtagtgtattatttacagtatattttctcttaggattgtgtatgtctttactacaagatacaagcaactgttgaaatattccattattattttcactgtgttttgatgtcacaccattactcttaaattttacaggaactttaatgtctataatttcatagtcattaaatttaaaactattcattctctcacaatagatatttaaaattgtgagttatatggcttacattttaaatatgtatactttttatggttcttaatatgtgttgtcaatgtgtcaaatttttaacatgtacacatttcattctcattatatttacattttatttggctgaatttttttctatacttcaataatcaagcttgttctcttgatttccaaggtattcaaaataatattatttcatggaaaatttcttttctcacatggataactggagaagacatttaactggctttcctgcttctattcctgccctcatctctgccgtatttccctctcaccacagcagtcagaatgactgtttccaaacatgtcagaccatgttacccctctgctcaaaactgcagtagctccccatttcagggtcaaaattaaagtctttcagatggtctctgaggttctgactcttacttgcttatctgacataattctctgttattaccactctttaaattgcacccctgacacactcctggttgtgcactagctgtttcttttgtctacaactttatttcccaaacaattgtcactgttcattgcctgacacccccaaatattagatgaaatatcactttctcgatgagatttcttctaatcaccttgtaaacaattgatataaaattggtaaacctattctcttagcatttgctgattttctcatattgttttactgttttctatttttattaacctatcatatattaacataaaattatttatatttccaagtacctaatacagtgcttgacatatagaaggtgatcaatacatatttgttcaatgccagagaataatttataaactaatttgtgcaagaagtattttatgtatgcatataaaaataataattcatgatcaaatattgcttgatgtgtttatttaaaaaagtatggtttgtctccttaaaatatttgtcaggaaaataaacgttgagtttaaaatcaaatataattatgtaaatgacaactcagtcttgaacattgagatatacttcaagttccctcttgacccatttatgcctagtgttccattattggagtgctaagcatgtgggagttatttgtattctattgctcaaggtcatcaccaaggtctgactgcaaaaattcaaaaaattgcaacctcaggcataaatgggttaactgtgatggtatataattttaatatattgtgatactatatacttttaatatatttaatttcatacaaatgtatgatttggtgcttttatctttatcctaaagaaaaatctacctattttcttttttcaaatttcagttatgttttcaattttcttctatctattggattccgataaatggatgtaaattgtcatgtagtctaatcttatgcaattacgcggtccccagttaatgcagagatcattcaaaagtatacacattgatgcattttaattgttattttgtacatacaaccaagatcacaggagacacaggagatatgaagcaaagaagactttttggatacagtttgtaagattagatatacaactacagggggtagatatttctaatatttatcttggctgtcccatgaaggtagttaaattttgtttactacagaatagcaaattacactgtctggcttaaagaatgcctgagttgtagtgcatgataagatatctcccaaattatgtcaaatatatctgtgaaaactgaaaataagactaaagtttgtaatacaactaaatgccaaagttgaatctctaccaacatcaaagttaatgtaatcaatatacaaatattttgtcttctcatcatctaaaagaaagtaaaaagtttcatcatccgtctacatgccaccttttaataaattggagccctatctcctctaaaccatctcctctccccagtcgttttgcatctattctgaaacagcaactccatatgatactccaagtgagcatacaggagagagtctggaaacttcggtttttcatgcttccattgattcagagcatagaagcagaatccaccacagtagactagagaatctgtagatgttcaacaagaaccaatgactaggttggaaacttaccttgtgttccacgtgtgggactgagaaatttattttgccattactcagtgaagagagatgaggcttaaaggtatccacatgacctaattactaaaaatttctgaattggggtagctttcacttctttaagtaatgttgaaaaaacaaacagcaatatttatagatagttctacaaaaatagagaatagaaccattgttctgaatactgaaataaaatataatttagataatagtctactgcgttaataagaaaaaccttttgccatattcaagaacatacaatgtctataaaatgaaaagagaagaacaccaagagagaaataaatgagataaaaagatagcagaaaccagttgtggtgcttcacgtctgtaattccagcactttgggaggctgaagagggaggatcacatgaggccaggagtttgaggccaggagtttgaggccagcctgagcaacataatggtacctcatctccccccattttttttaattagccaggtgtggtgatgcacacctgcagtgttagctacttcagaacctgaggtgggaaaatcacttgaatccaggaggtccaggtggcagtgagccacgattgtgccgctgtattccagcctgggtgacagagtgaggctctgtcacaaacaaacaaacaaacaaacaccaaccaaacaaacaaaaaagacagataatagaatgaaatggaaaagaagggtaacataagttagaatttatagacaaataaaaattggaattaaatttacatcagagtcagagaaaagcacaattagcgttgagataaataaatatatttttaaaattcaaattggaggaactttctaataccaaaacaaaatcaggccacgcatggtcgcttattcccactcttgtaactgcagcactttaggtggccaaggcaggaggatcacttgagtccaggagttcacaaccagcctgggcaacatcatgacactccaactctacaaaattttttaaatcagctgaatgtgttggctgatcccagctactcatgaggttgtggtgggaggatcccttgaggctgggaaattgaggctgcagtgagctgtgattgtgccactgccccacagcctggatgaagagtaagaccctgtatcaatcaatcaatcaatcaatcaatcaatcaataataaataagagaaagaaaattctacaattttgagaaagaagaaatgttaatgggacagagaattagaaaaacaatttagaaattgcattgccctcagcaatataaaatgtataatagtgtaacaagttttaataatttttctagatcattatattataatgtatatatgatttcaaataccaccactaaaaccaagaattggaactaaaaaaggcattgaggtaatggaagcagtaaatataagataatattttattgaagaattttgtatatactgtttttattaagggattcagttaaagagatatttcattgttgacacttagacctagaatataaaatacgacattaagcaaatgagtcgaaagaaataaatcctcaaaataaaatataatatgtaccatttattagaaacaaattcattcaggatagttacaaataaaaccatgggagaatatgttggacaatgtatatttcatatgaaatggaaaaattaaattaattccctttaatatgaggaacattgttaaaattctcactgttacaaccatttactactgtcctagaggtcttggtcaaaccaaaatgaaaaaaaaaaaggaaataagagatatttggaaattggaaagatttgggggttgatcaaggaaaacagatgtgatgaaaaaagacagtaatgcacacacaaacttcattgaatggcacttggacagggttgcatgagaagggacgtctctctaacttaagaccttcagacactaattgtgaggaggccaccatccagaagagaaggaacacaaggaaactcctgaggtaaaagggaatccgagagagacttacttgtccaagtgataactaagcagcaccacggaaagtttctgggtcagagagctcttaagggcagtagcagcttaggctttatcaccacaaagctctagctcatcaatgcccagcagatgctatatgtagttttacaggttatacaaagtaggcaggctctaaatattagtttggtgcaaaagtaattcaggtttttgccattgaaagtaatggccaaaaacacagtcacttttgcacccacctaatagctaaaaatcttcttgtttggactatttttaaaaccattatgtatgtaaaaattttaatgtggtaccagctggcatttgagctaacagatatcagtctgtagtgaagaaatatcaatgtaggggccaatatacagaggcctttttgcctcacttatataacaaaatttaaaaattggaagataagttagttattctaatcatatgcagagaaactggattatctagcaagtaaatgcatagaacaaataggtaaaatactgaatgaatacaagatttccacaaggttgcagaatacaagattgatgcccaacattcaatgccatttccttaccaaaagactaacagttataaaaaaaaatcagaaataagatattattccctagaatgacaaaactgatacacatgactatttaaacacacacacacacacatacacacacacacaaacactcatacaaaacccatatgagagaaactatcataatgaagatttaaaaatctgaataaatgaagagatatgtcactttatgagatttcatgaattaacagtatactgtctgttctctccaaattatcctattaatttaagccaaattaaattatatatttaataatgcttaataacattacttaaaaatacataggtaaaaaggagccgcaaatgtaggttaacactagaaaataatagtgtgggggtaattgtccagacaaaataaaaatatatgacagaattatattaagaagaatgtgtagattttgattatagcttttcttttgattaaaaaaagccatagacaaagataatatattaagagatatacctaaaatgtctccaaactagaagggattaattactatcatgcacacattacttttgaaaataaagaatgcacatcactgactgtgggaactccaatgccctgtttgctcctttccccaaagtctcaaactagactctcagtggtttctctgttgggtttataccagagaagaactaagggcagctcaggaaaattaacctcctgagcactcctatgacactttatccttaaagggaaagtaacaaaaagctgtttccagaaccttaaacagggaatcatggcaagagatgttctgatgcttcttcctaatcagagccgaagctacaagaagagacagtgacacatataacttatttttgctgttttcttttttcaaagccttcttctcatgctttttggggcaagaataggggaaattttattcttacttcctctaggactttgctattattcccactaagctagattagctactttacatttagttaaataatactatgcacagtgagggagaagtctacggcctgggtgcttcaggatggacttacaacataacagccagcctttaaagttatttatttatttatttagttagttagttagttagttatttagttattttgttgcatggccctattttgcatgtcaggacctgaatataacctcctttttcattatgactcttatgtattccagcgtccttttaagtatttgggtgcctttggttaattcgaacaaaagttacctattaaggaaatcacaaataaaaaacatataccttgatatacctatgattgcaaagcagtgtaagttttatggaagcccaatagaaggagaattctgagagagaaatttcagttctggtgattgttacatttcaagaaaaaccaaaactgaaactctattctcttccacagaaatgtctcattcatttctgtgaaggatatctttaatgtccttcacagatgttaaaactttaagattctatgagatatggcatcaggaatatctcactctttttaatattttatgtagtctctacttaaatacttttctttacttctttgatctaatgaatttttctgtgaaacaaagaagaaatcaaagttcaaattcacctctagggttgccagataatatatatcgtacactcttaaatttgaatttctgatagaacaatatttttcagtataagtatttcccattcaagatatgagatataataatacatccattccttttctgaaattcaaatttaactggacttttttctgtttttatttgccaattctagcgaccttatataatacatcaaattttatgagttcataaactttgttaatcatgaaattggaagaagtatggtaacaaccaattttttgacatgtaatatcataagtagttcaaactgaaaacgtttaaaacaacatttttatttcagtgaaattctttcagttatacttttgaatcttcataaaaaatattttcagtctggtaaatatacatagatatgtatttcttttccattaaaatttttaaggacataatgttttcatatattcttttatcaaatattttaggtcagtgaatctaaaaataggatcaaaactcaatgtatgaaagaaaatgtatacaccttcaaatctatgagtcacatgaacttcaccaaaatcaaattttgtttttcttttaaaattattcttctctgtattttttatttcttttattttcttgaaaatttgtatttttcaagaaagagggacattttgccattagtactggtgaataccattcagctcttttttttaagtcacaaaaagccagaggaattcaaacttcaacatatctctcactatcctcaaaaaactttcttcctcagctatacataggcatctattctgccaagcatctgctgaggaaatgatgtaagtaaatttccaaagattttaagtccctagctttagcctaagtatagcaattgccagattgcactgtgacttaaaatcatatcaaagaaaaatgcccaagcttcctccacatggcattttaaattttatgtatggcttttaaaaattgtctatataagagattagatacaaaataatactttctcaggaaaaggatgtttctagaggagtttatggtaataccatcttccttaaaatgtgcttactttaaaggaccgatagcaagcaagagaagagtatatgccagcaattaaaatattgtctccaactgagtatcaaggagaaaaatatgctgatgtcattaatgtttaaaaacattccttttaccacaagtaaggtatagacttaagaaatttttaaactcatgaaagccttctgagctttcttttctctaattaatgggtgcaatgggaagtaaagtggcaaatactatttggtatcattctgaagattaaatgtaaataatgcataaaatacaatgaacacattgcccaacatgtagcaagtactcaataaatagaacttattattatttttaattcaattttaatttaatatattagattggttttaaaatttatgaagctagatgtccttgatgcagtcttaccaatctaaatatacattcaatttttttgcattaaaagcaatactcattaatcaagaatacaatatattgtcactaaccattctatacaatagatatcacatttaaacgttaaatgattacatatggctagtactgtgttagccagtccaaagacatgaaaataatctgaaatttttaagtaactgagctgacagaaagactgatgattatatgttagtactataatcaaagagagctaactgtaaatctctggaatttgacatgtcatccacattaatgtataagttgttaagtgtgataccaagaagagaaattgttacctacacgccaaagtcacttaagaagatggatgtggatatagtgtttagttctaaaattaaaggtgaagctataaaaaaaggatggcttgggaggctgaggagggcagatcatgaggtcaggagtttgaggccagcctgttcaatacagtgaaaccctgtctctactaacaatacaaaaattagctgggcatggtggcacgcacctgtaatcccaactacttgggagactgaggcaggagaatcgcttgaacccaggaggcagaggttgcagtgagctgagatcgcgccactgcactccagcctgggtgacagagcacgacgccgtctcaaaaaacaaacaaacaaaaacgaaaacaaaaggatggcatagaatgtttacaaaagcaccagcctgggcaacatagtgagacctcatctttacaaaaaaaaaaaaaaaaaaaaattgtcagatttgttagggtgcctgtggtcccagctactcaatggctgaagtgggaggattacttaagcccaggaggttgaggctgctgtgggttgagatcacatcactgcattctagcctgggcaacaacgtgagaccctgttttaaaaacaaaaacaaaaaaaaggagtttataaaatcaactaataaaataaagataaatgacgatgaattctgggattgttttttatattagtacaagagagtaaaaccaatgattttcagatcttggacaacttgcttagcatatcacaaccagcttttcactaactcctgctttgacatcattgtaatttatgttgacgtaattgaaaattcagaatatgatctcattacctctgtagccagagccattagaaagaaaaatattccttactgtaaaataaatgatatggaaaatactagttgactattttttctcttctatgaatcataattatttgtattcttgttcacaatagaaatcatgtgattatgtaaattaccattactattctatttctaataaaatattttaagatattttaaccttaagataacatggtattgtcatgttaaactatatttcataatatttttcatggcattatccttttaaatgagacatatttaaaaactaaatatagaacctaaatgggagaagaaatttggttagattatgctatgttttatagtgttaaactcttctatatatagtttatatgaagatgattgcatttgttcatcttgctttaattcatattactcagtgcctgaataaacagtacatttttttatggacacaaactaacatcatattgtcagtttccatgcactttgaaggggatcatgtgatacactgcaatatgtatttgtttaattacttctcaaaaacgaaatcatagagttggaagatccatataaagaagtgtgtaccaatgttgaagatgaaatgtaattataacaaaatattttgtaagtctgaaagccatttatgtctggtaaacataaccatcatggaagaatatgggtatgtttggcagatccatgttttctcttggaaggcagtacgttaggatgatcacaaaacaggagatgttttataattattttgcaaattatattttcaatatctacactaaaatgtcagatacatattcttatggaaaagtttgtggaacaaatttaacttaaaaattttttaatgtaagcagttacaaatttgatgagcttttgaataacatgccttgaatttcctgaacaactcttcattatgacttacaaattatttggaattcagtaaagtataggatccaataatatagcacataaacagaaatataaagtgtcttatttgtacaaaaatgtgattgtactgacaggaaaaatttacagatgagataaagttcaaagagaggaagtcaaacactaaactacgtatatttctgtatttgagagccatcactccatctcattaactggtttatgtatttaggcatattttatttaaaactcactatttttcttacttaattcctaggttggttcttgtaaatattgtctttataaaattgtttctctcttaagatttatttttttttaataatatgctcttatttggtatatcctctcttgtgggtccaaactcctaaggtccctaggttatgctttcataagcaatgacaccggtttaatgaaatgaaacaatttaccctcataggtagtctacttctatcaagtaatatactagaattaagtcactggttcttagacattaaaaaatatatagcaaataatgaatccaatggtgctaaattcatgtgaatatattacatcaggctatcggtaaggagagaaattcaggtcagaatgttattactatatgtagacagattcaagcaaataaaactagagaaaaaggtaagggactgtatggttaagaataaattgataaataatagataaatttgatatgtcatttctgtgtaagagataaaaacaatatccttgatgaggatggagtaaggaaaactttaggaaagagaaattgaacaaaaggcaaacaaacccaaaaatcttggagaatttgaaaaagaagcaatagaatattaaagaggttactgtgtcaatacctaagaaaagatggaaataatgtattggcagtagtgctgagactagaggccactgtatttttaaagctataaaaaatgttgggatttccaccaactgtggtcagtaactgtgacacctggattttgattaattactaaagaacaaaaatttatgcaagagaaaaccaataattaataatttggtactatctagatgctaagcacaatatttatattttagatacaagatctaactaaacttcagaataattatcttttttgttttttactcaactactgcacatgaaaaaatttagcttcagcaaagttaaatgttttggacaagattaataaatagtagatatggggtgacattgaagtccttgaacttcaaaagaaatattttcccagcaaataaaatttcctccacaggaaaaataacaatgttggttatgggatttttgtctcaaaaaaaaaaaaaaggaaatgtagaatgattcagaaagtgagagaactagaaggataacaaggcccagtgttttttagagtaatgatgaggttcttgggacttttgtggatgagttgctacattaaagtggttgtgattttccttgcagttaaggagaccaaaaaatttgaagtaagattttaaaataccgatgacaagttttgtatttgaaaagaaagactatcaagtaggtgtatccatcaattagtgaggagaaaccaagaagacagtaaatgacaaagttaaagcagtagcaaagctgatataaggtgacatggagctcaaagaagaagcagattttgaataatatgtgtaaagcaatagtttcataaatgcaactgttagcttagagaaagtaataatgacccccatggggaatggtacatggtagaatgcatagctttctatgattctgtaacaaactgcagaaagagaaaaaagaacgtgtggtgtggtagactatcaaaaatagtttcagcaaaatttccaaccaaaattggtcttacagacctttctctacccctttatcctaaatgagcttctataaaatcctcagcaaatataatatacagagaatgacaatgtatgatttctgaagatgtcataaaagttaatacagctcattgtctctattgaagcttattgtggaatttagcaccatgtataaggaagccaatgccatgtagaaagtcagtatgtaaatcttccaacagatagcatcagcaacatctaagccaatggctggcatcaacttccagatttgggaggaagcaatctttagataattctagcacccagtctttgcaatgacaatgatcagagcaaaatcaaaataaaattgctgatttatgaaaataaatgttgtcattgttttaaaccacttaatttagggttagtttatcacacagaaacagatgaccagtaaaaactttgagtagtgaagatgaaagagcactaagaattaaaagtgctcaaagaactggaagtgaacgacagaggaggaaaagttaggaaagaaatgagagctccggagaatgtaaaaaacagagagacttgcattttggctgaggataagaagaacatagatcaaaggcacagagaaaaaatatgcttgtaatatatactaaaatcccagagtttcagctattgataaaagtcagattttttcagacaaaagtattttatcagcattcaaaataaattactcagaaaattatagtgtctcttgtgggaaaactaaccacctcctagttcaactgtcatatatatatatagcacttaatggttattgtatttattttctcatagttaaaatcactgaaggccatctttgtatgaaaacattgtacagagttcaaaacactaaaaatacacaagtagttcttggttttgggtcataaaaacaaactacattaggtgagataaaagagctactgcttttcatttattcaataataggtacattgaatctttctagcattggtctttatatatacccagtggaacaatgttaattaataatattttgaaattttaaaataaaccgaaaattcaaaattataggctaaatttacacataatgctatactaataaaattctgtgtggtcaaggatatttatttgaaaataattttatatttagttaatgataagtagccagatcattacttttctatgaaaaaattctgaaaagtataagaaggcaccattttcaaattaacatctgggatttactcagaaagtcattggtcaataactgttttaaaataactgaaataaaaatcatctgacatatgttgtttaccttacctaaagtatatactcattttataaatttttgtaccccctgacagacagacagacagacagacacacacacacacacacacacagagacagagagagagagagagaaagagagacattagcacttttcccagctttctcttcatggagtaattaaatttattccatttttaaaatcttagactcagaaaataataaataaggaatattacagaaccgattacatgatttcagtaagccaaaaatgatgttcactctgtatttcttactatctcaatgatattcttcattatacaagtataacacctcttaagagcaattatttaagtaaaattttgtcagggagaagatatgaggattactctcttattaaaaaaaaatttaaaaaaaagtaacttgccaaaaaaaggcatgattgaattagagaagctcccgttttttgcgaccctgctcctgaagtgaaaccttgggttctaaacaccaaatggtggcctcatctaccatgacgcatgatatttgttttatcaaacagaataaactctattaaagatgctccttaaaagctctaatttcaattataccctgctatcagagttggtctaccatagatagactaacaaatactaatagaataaaatctaatgcataaaggacagaaaaaggtattacatttttccccaaatttacaaaattgattgttcattaagatatttatatgtacatcttaatttaattcacttatctcagattatttttaaatttgcttttaaacttgatggaaaattctcctgaattgtggcataatttgagttcaaaatatattaattatttccaaatctttatcttgaatcaggaaatgttcatttattacaagctatttctaaaactgcttttttttttttgagacaaagtctcgctctgtcaccaggctgaagtgcagtggtgcgatctcagctcactgcaacctccacctcccaggatcaagtgattctcctgcctcagcctcccgagtagctgggactacaggcgcgtgccaccaggcccagctaatttttatatttgtagtagagacggggtttcaccatgttggccaggatggtctcaatctcttgaccttgtgatccactggccttggcctcccaaagtgctgggattacaggcatgagccacagtagccagcctaaaattgcttttaaacctataaaataagaatttgattgggttattaaggtaagcctgaatatgatgaagtaggttgtaaaaatttcgaatttttattcatgctaatcaaatcaacattctaagaaatccagtatggtatctattgaaaggatgatgacactttaataattatggtattgtgcttttatagccagcttctaaaactgtcatatcactgagtatcacagacaagatacaataataaggttacccacagagaaaaggtaaaatgccttgtaaatttaactttctagattttcattttcaagtttttgtactaaataaaaactgaagccatatgttcagaagtgttcctgtatctgaaaaataagcttatggcacttccccataaaacacatttctaagtcccaagatggagtaattagagagatgtttctacatggagttctataaattgtcacacctgtttagttgaacaaagaatgaaaatatgcagacttcaacagaattcaagaactcattaaaagacttacactttaccagcagaaattacttaatataggaaaaacgtcagtcatttttcaggcagtcatgaagtgatttttaaatcactgaaaatgacaaattagaagtggaaaattatcacaattatataagcagtattactgcgatgtatagaacatctgcccccagtgatagccaattcaacattctacaagggaagccaattgacgcattcaatattacaaggctaaaggcagttattacatttttttcacttttaaaacaaagaaagcaatcatgtaattttcagttagtataaaaattgaatacactctgagtcaaaaataagcaggtatcatattttccatatggccatttgtagcaaatcatacatttcatttttaagaaatgatatatttttcaatcttttttctgtgtgttaataaaacatggagagaaagctgtgattcttttcgttctacacatggccataagaatgtcagtactcaaatataactctgtgatttcagactaaaaaattgtgtcatacctattttcaaatatgtctgtcagaagagaatgataatactttgaacttcttttaagattaagaacatccccacatctcatattctcctgattatcaaacatttattcaataccttatatgtgctgtaaaatagggctgtaaatttgaatcgatcacaggctttgctgtcaagaactttgcaaatcagtaggaggagtaaaggaagtggatttttgcagaagtgaaggagaagaagagagacttcattctagagaagatataatatatgaatgacagcagagaaaatatgaatgtatatggcttgtttatgacacaatcactaagactagttgattagagcaaacgactggttaagaaaatattgaaaaatgcttataaaagtagatagacataaattacataaacacctgaatgccataaaaaggatactggatttggctatattcacaaaatggtggacataaaattgaatgagaagttgttatgccaaacaataacaaaagtagcaaaagctaaaattaattatatgcttaccaagtattttacatgaattggttcatttagtcttaagaaaaacacatgaaagatgctactcaattctctttccccttaaattcaccctcttgacagtgctccatttactggtttcctcatttatattagtgaatttcatttttaaacaattaccaaattatagtgaagtcaggaccactttacaagaaattgatctttatgcctaattatacataattgattttagttaaatatcccaaattactgtttctacttggaagggccctgtttagaatcactgaagagttgcttgtttcactgaaaacacagaaaagttcttaaaattaaaaagaaaaagagagagagaaagccacattgacatttgctattctgtgttggtggtgtcgcttttttcagatgaactctctcactgaaaactacaaaaattctgtataaaaacacacagaaatctgcacaaagtcctttaagaacgaacaaaaccaggcaaaaatagaatgcatgagtaaactcagaaatttatccaacgaaattatctaatctgtagaatagtgagaggaccacaaatggttgaactaaaatgaatagagcctcagtgaccagtaggagaattcttaatctaccataccataaactcagaaatttatccaacgaaattatctaatctgtagaatagtgagaggaccacaaatggttgaactaaaatgaatagagcctcagtgaccagtaggagaattcttaatctaccatacgtgtaactgtagaaggaaaggaaggagacattttggcaaataactccttggcatatatttggcaaatatcaaaagaggctgaattaaagttctggtagaatttttaaaataaattgacgagtggattctaagatttatatgtatatgcaaaggatctagaattgtcagaacaatcttaataaagactaagaaactggaagatttgttttatagaacctcaaatttgatataaatatacactaaccaagaaacactagcattggctaaggaaataaaaatagaccaatagaatagaacagagattacagaactagacatacacacatatatgtttaatttatttatgataagatctcaagcaaatctatgggtaaaaggaagttgccacatggtgctgaactgtatttccatatattaaaaattaaaccaaccttctatgaaatgcgaaaattaactgagtggattataaacctaaacagaggactaaaactgtaagtcttctagaagaacgcattggataaattctttgggattttggaacatgcaaatgtttcataaagaaggcacaaaacatacaaaatgtgttttaaaatgataagtttattttattaacattgaaaacttttgctcatcaaagtacatggaaaaaaattttaaagtatgctgggtgtggtggctcacacctgtaatcccagcacttggggaggccaaggcaggtggatcaggaggtcaggagatggagaccattctggccaacatggtgaaatcctgtctctactaaaaatacaaaaaaaaaaaaaaaattggctgtgcatggtggcacgtgcctgtagtcccagctacttgggaggctgaggcaggagaatcgcttgaacccaggaggcacaggttgcagtgagctgagatcgcaccactgcactccagcctggtgacagagcaaaactccatctcaaataagtaaaattaattaattaattaattaaaaggcaaatcagagacagagaaaaatatttgtattatatgcatacatgacaagtgacctctatccaggacatatacagtttttctacatatcactaataaaaagacaacttaaaaatggcagagtgagtgagccatattggctttcaatgactacaggatattacgggccttatataaatatacacagatactaccatattattaaatatttcattgacattttcatgaataaaccagagaagcaacatattatattgattttagatcaaatcactggagtcaaataattccaaattatacttatatttctgccatttcctcaaatggtaaaatagagatgagattatctattttatttactactttatggactttctgataagaagaaaggtgcatattaaatagtagttaaaaataaccaaaggacattaaattagtataccaaagggatagctgaacccccatatttattatagcattattcataatagtcaatatatggaatcaacctagatgtccatcaagagatgcctggataaagaaaatgtggtctatatacacaatggtatactattcggtcataaaaagaatggaatcctgtcattcctggcaacatggataaacctgtaggatattatattaagcgaaataggtcaggcacagaaagataaatactgcatgttctcactcatatgggagaactaaataaaatttgagctcatggaagtagtgagtagaattgtgagtattagatgctgggaagggtagggagaaggaggatagggacagtttggttactggatacaaaattatagctagatagaaggaatggtttatggtgttctacaacattgtaaggtgaatgtggttaaccgtaatttattatatattttcaaaaagctagaagggagtattctgaatgttcacaacacaaagaaatgataaatgcttgaagtgatggataagttaattactctgatttgatccttacatattgtacagatatatcaaaatatcactctgtatcttataaatataattattaagtgtcaaccaaaaaaagcaaaaggaaaaaataagtattctatacattgaacaacaataaaaagacattcaaattggcatatatgtatatctgtttaataattttagctaaatttatgctttattaagcattcagctcttttcattttataatcaatttacactctcatttctcaatacaagcaataaagtttcattagcatcctgagatctcataattatcaataattactatttattaagtatagtatacactaccttgttggcagacacaaactattttgagacaattttttgtttgttgtttgttttgtttgttttgttttgagacggagtctcgctctgttgcccaggctgaagtgcagtggcgcgatctcggctcactgcaagctccgcctcccgggttcacgccattctcctgcctcagcctcctgagtagctgggactacaggtgcccgccaccacgctcggctaattttttgtatttttattttttattttttatttttttaggagagatgggatttcactgtgttagccaggatggtctcgatctccttacctcatgatccatccgcctcggcctcccaaactgctgggattacaggcgtgagccactgcgcccagtccaattttgagacaatttatagtagggtggagaacacttggaaataatgttttgccaataaatctatggaggattcatcacaatggaagaaattaattggaagattcagaggaagactcagttctttatctggatggaatacggtagcaaaggaaatttttcatgttagtaattgatacagagcctttgcttttaaatgttgtgttattgtggattatgctgtgtttggaaataacagtcaccatcaatgctaataattatcatagtgactagagaaacaagaagaaaaaatgctacaaaataaagtttgacaatgtaaaactaatagcaacctagaataagcttatataaacacctgcctattcaatgccttaaaaattatttacattattaaatgtgttaaacatttgccataaattatcattccaaattttataaatactaagctttaacattgactatacatgtgtgcttatcagctcatgtgactccattattttttaaaattccacttatgagagcaaggactagttcaattctctgcatggcagggggttagagatagggttaaattgacagagattaattttccaaactctatcagaattgagtctcaaaataggattaaagttcaattattaaaaatgaagaaagttatatctgatttagctcctgcctgcttttctttccatgagcaaaattctattcttcacaaattctacccactggtgaggattactcaaatggagaaatatgtactttacattggaaaatattctgtctaccctctgatctaaactgctaactaaatgtcttacactattctctactagtcagattggatctcttgttatctgtccaaaatggtagctgaagttaccatcattgaatgccattgcaaaacctttttaacatcactcatcttggattcaaacatcccagcatccttacaaataaactttcctatcttgaaactaaatgtttatggtagctttaatttagtgaaactaaaaacagtttattttctgacaatcacctgtttctacatcaaattcacacttgaaaatgtgtcattaactaataatgtatagcataataattttaacatttcctggcattaatcaaaaatacacatttaaaaatttagcaataaatcttatagttataaaatttgaataaatcactttctaatggatgcataaatcttacataacatttcaaatttgggattacaattaagaatacattttcatgtggttttatattatattttaattcttaattttacttttataatgtttgaaattgaagtttgaccttatggctaatgattcttatttgtactctatttcacaatatgtgaaatatctgaaaaatcaagaatttgtttttctaagggctcttaagttttgaaatatgattggcatgctctacaccatatttatttgcagccttaatgtaaatttgcattaaatgtcagttattaaactgctttaggtatgacaattataatattccaaatgatatgaattccaaaattctgtttggaaggaaattcaagagcaatgagaacttgacataatggctaattttataataatcactggttgatacggcattaggaatattaattttctatggttttactatggctcattagaacataatattgattatgaatccagactcatatttcaaataatatatattaatatgcacagttgatcatggtagaaaaatgtacatatattggtttctgaagagttttgaagaaacccataataaaatattagaaaatatgtatcaaataaagagatagatggtgtattagttcattttcatgctgctgattaagacatacctgagaatgggcaatttgcaaaagaaagaagtttaacggacctacagttccacgtggctggggaagcctcacaatcctggtggaaggcaaggaggagcaagtcacatcttacatggatggcagcaagcaaagacagagagcttgtgcagaggaactcctttttttaaaaccatcggctctcgtgagacttattcactatcatgagaacagcatgggaaagatgtgcccccatgattcaattacttcctaccggctccctcccacaacacgtgggaattcaagatgagatttgggtggggacacagtcaagccatatccgatggatagatatagacatattttatacatcttttaaatgtgatgcttcctgtacacatttggcacaggctgtacatctcaaaatatttcaaaaaaaaaaaaccctattatagttaccaaacctttatagggtaatcattctagtttgctcaagatagcaccagtttatgctcatggggtagaagacagaatattgctgaagtatctcagttctctccaaatattaaaatgccatttgtcctggatgttttaaccaagtactattatttatggttgcactaaaacaaatagggatgagtttgataaatcaccacttggtattttatattctgccatcatcttttccagaagtgtgagatatagagttatacataagcagaaaattatttttaacatgaggataatatggtaatataaccagtaataacacacctctctttttcaatgctttccagatgcagattttattgtatcaatcattcaaagacagcttgttggactttgaagacccaagcagacaaaagtaggtaattcctccttatttcagttggtatgcagagaagctactaataatgctactcttccagcacaatgtttccaggctgccagtgagcttggtcagtaggaacgacaggaaattatgagttatgtctatgttatatgtgagaggaaaattgaggctactagttttgtcatagggtttatagatatttgtctgtatgttcttgctatagaggtttggtcaattattgtgtggtacaaaacagtggtcagtaaactatagctgtgagctgaataaggccttccacctatttttgtaaacaaagttttattgatatagtgaaatccacacatttatgtttgtctatggctgctttcatgctgcaatagcagagttgaatcattgtgatagagaccatatggatcaagaagtctaaaatatttactatctaactctttacagaaaaatttgccagcccttggtataaatctacaactatttacatattttactatgcactgatgaacatttcttattctacaataaatacttactttttaataaaactatgtttcaaatttgtttccctagaaaatcaatgatgaatatgtagttgcccctaaactgtgccactattaatgatccactgtaggatattagtgacattactgactgtatacaaaccagaatgcatacattaattgagcaatcatcagcatctacttttaaaaatgttagtaaatattttagaagactgtcttctgatgatgagctaggtgcataagcagaaggtcttcttacatatcactctgtgaagcacgtcttttcatttagatcaaatgactgtcccaaaattatttttctcattttttattgcaagttcctctgtgcatacaaaaagtaaagtgatagttgtcaaagtgtcagctcagctagtagacaacttcacttacagttaaaaaatgccagctttggctgtgcgtggtggctcactcctgtaattccagcactttgggaggccaaggcaagtggatcgctggaggacaaaagtttgggaccagcctggccaacatggcgaaatcccgtcactactaaaaatacaaaacttagccggctgtggtggcatgcacctataattcaagctacttgggagcgtaagacaggcaactcactggagctttggaggcggaggttgcagtgagccgagattcaccactgcactccaacctgggtgaaacagtgagactgcctcaaacaaaaaaaaaaatgtgagccatattaataaaagcagaaacttcaaactgataatcagttaattccaacaatggttttctttttccctccaattcattaaattaaaataaagttttgcaagtttattctgtcaaaggcaggacatctgacaatattggtagtgccattgggaatttgtgaatttagcaaacaatattcaaaaataaagttattggttcctgtggtgaaattttaaatacacattttgttaagtatgtggcataatacattgttttgatcaaatatagaaaaatgtggagcagaaaatataggaaatgtattgtggttcacacatagttcatattttgtttcaaatcagtcatgatattcacacaactaaaataaaaactgtagttgcaaaattcacaaataattttaaatacttatagagtaatggaactaatttgttgtgacaaaactattattgaaaaaattgtaacatggcataatgtgctttttttcttgcttcttttcatcaacattcaaagtttagaaatgtttaagtctctaaagaatgactttgaaaatgaatctaagggtgcagggaagctttgacattttggtaacagaatgctctagctgcatcttgctcaaaatcagtttcaaaaatttgattaaacagctaaaaaaatttaagtaccaaagaaatcagtttttgaacattacagtaagttgcattttttagataaagcattgaagtttattcctccatgattcaagaaagacacttagcaaatttaataagacttcaaaagtatctaagattttaaatattataacagtgctttggaatagctgggcttgtgggaagcatttgagggggctcctaaatttcaaggataaacttacatactagagcataatggaaataaattgagagagtcaacaactttgcagtatctaaatttagccaaacgttctaaagaataataaatagaaatcatttacttcatgaatatcttggaaaatgttatctaacaaactgattttgaataagtaaaatatagaactcctacaaaaatattttatccttgaagaggtccttcacatcccttgtaagttctttcctaggtattttattctctttgtagcaattgtgaatgggagttcactcatgatttggctctctgtttgtctgttattggtatataggaatgcttgtgatttttcaacaatgattttgtatcctgagactttgctgaagttccttatcagcttaaggagattttgggctcagacaatggggttttctagatatacaatcatgtcatctgcaaaaatagacaatttgacttcctctcttcctatttgaaaacctttatttccttctcttgcctgattgccctggccagaacttccaacactatgttgaatacgagtggtgagagaggacatccttgtcttctgccagttttcaaagggaatgcttccagtttttgcccattcagtatgataccggctgtgggtttgtcataaatagctcttattatgttgacatacattccatcgatacctagtttattgagagtttttagcatgaaaggctgttgaattttgtcgaaggccttttctgcatctattgagataatcatgtgctttttgttgttggttctgtttatgcaatggatgacatttgttgatttgcgtatgtttaactggcattgcatctcaggtatgaagccgacttgatcttggtagacaagctttctgatgtgctgctggattctccttgccagtattttactgaggatttttgcgtcaatgttcatcagggatattgacctaaaattctatttttttgttttgtctctgccaggctttggtatcaggatgatgctggcctcataaaatgagttagggaggattctctctttttctattgatcggaatagtttcagaaggaatggtaccagctcatttttgtacttatggtagaatttggctgtgaatccatcgggacctggactttttttggctggtaggctattaattattgcctcaatttcagaacctgttactggtctattcagagattcaaattcttcctggtttagtcttgggagggtgtatgtgtccaggaatttatccatttcttctatattttctagtttatttgcatagaggtgtttatactattctctgatggtagtttgtatttctgtgagatcgatggtgatatcccctttatcattttttatttcatctatttaattcttctctcttttcttctttagtagtctggctagtggtatatctattttgttgatcttttcaaaaaaccagctcctggattcattgattttttcaaagttttttatgtctctatctccttcagttctgctctgatcttagttatttcttgtcttctgctagcttttgaatgtgtttgctcttgcttctctagttcttttaattgtgatgttaggatgtcgattttagatctctcctcctttctcttgtgggcatttagggctataaatttccctctacacactgctttcaatgtgtcccagagattctggtacgttgtgtctttgttctcattggtttcaaaaaacatctttatttctgccttcattttgtgaaggacgtcttcaaggaaaactataaaccactgctcaaggaaataagagaggacacaaacaaatggaaaaacattccatgttcatggataggaagaatcaatatcttgaaaatggccttactgtccaaagtaatttatagattaaatgttatccccatcaagctaccactgactttcttcacagaattggaaaaatctactataaacttcatatggaaccaaaaaagagcccacatagccaagacaatcctgggcaagaagaacaaagctggaggtatcatgctacctaacttcaaattttactacaaggctacagtaaccaaaacagcatggtactggtaccaaaacagatatatagaccaatggaacagaatggagacctcagaaataacaccacacatctaccatcatctggtcttcaacaaacctgacacacacaagcaatggggaaaagattctctatttaagaaatggtgttgggaaaactggctagccatatgctgaaaactaaaactggaccccttccttactccttatacaaaaatcaactcaagatggatcaaagacttaaacataagacctggaatcataaaaatcctagaggaaaacctggggaataccattcaggacataggcatgggcaaagacttcatgtctgaaacaccaaaagcaatggcaacaaaagccaaaattgacaaatgggatctaactaaactaaagagcttccacacagcaaaagaaattgtcatcagagtgaacaggcaacctacagaatgggagaaaaattttgcaatctatccatctgacaaagggttaataaccagaatctacaaagaacttacaaatttacaagaagaaagcaagcaaccccatcaaaaaatgggcgaaggatatgaacagacactttgcaaaagaatatctttatgcagccaacagatatgtgaaaaaatgctcatcatcactggtcattagagaaatgcaaatcaaagccacaatgagataccatcttatgccatttagaatggtgatcattaaaaagtcaggaaacaacagatgctagagaggttgtggaaaaataggaatgcttttacactgttggtgggagtgtaaattagtccaaccattgtggaagacagtatggtgattcctcaaggatctagaactagaaataccatttgacccagcaatcccattgctgggcatatacccaaaggattataatcattctacgataaagacacatgcacacatatgtttactgcagcacaattcacaatagcaaagacttggaactaacccaaatgtccatcaatgatagactggataaagaaaatgtggcacatatacaccatggaatgctatgcagccataaaaaaaaaggatgatttcatgtcctttgtagggacatggatgaagctggaaaccatcattctcagcaaactatcgcaagatcagtaaaccaaacgctggaagttctcagtcataaatgggggttcaacaatgagaacacatggacacaggaaggggaacattacacattggggcctgttgggggttggcggctagaggaggcatagcattaggagaaatacctaatataggtgacgggttgatgggtgagcaaaccaccatggcacatggcatacctatgtaacaaaattgcccatccttcacatgtaacccagaacttaaagtgtaatttaaaaatatatatttcatctgcatattttatatcaaaaaaagatgtaataatatcttcctttagcagactttttttaaagaaattaacagaaacctcaacatgtgttcagtgaaaatgtccataatttaaaatgtaatggttaagaagtgtcaaataaacacatgaacaatttcaaattcattggtcataaatgcaagtctgaagaaagatgtaagtaattttatggtgaaaagcatgtgaactgttgttcagactcttcttatgctataaaacatttagcagtaatatgatttaattgtattaaccaaattgatttattaaactttaccataaaagagttcagtatatataccttctgaaattgtatttttcaataataaaggaaatatttcacatttaatttgaaatacatagataaaattaaagttacttgtgtatatggttgtatacatatgcattttttacctgaaaattgctcatcacattcacaaatgaaactatttgaagtaatattgctgcagtttccatggaaacagacatgtggttgacactggccaattatttctgagcaattctttcctataacaatgaaaaaaagttttttttacattggatatcaatattataaccatcagttttccctcaattctttaataatgaaaatatcaaattctgactaatgtaatttcagttatgaaaccatgttatacgatgatgcatttaaattgaaataaaaattaattttgatactttacataagtttttcatcttctgaccccagactataatatccaaatattttttctggcttgtagtatttgagctttatttaatttacataatattttaaaattttaattgtattttcatgatagataatattcatatatttaagtaccagtttttcaacatacattgatagtattgcagtgataatttacaaaatgacacattcaaatgtgtactgtttctcagacttaccccctagccaagggaacaattcaaaagcagaaatggctgcctggattctcagaatatgtgcacaaacttccaaattcaacacttctttgcacttgctggcatatcaaattttccaaatctcacttacacatactattgtggtcccactatatcagttatatacacacacacacacacacacacacacacacacacacagccttccataacatactcattctatgcatatttaatcatcttataataccttagtagaggaatgtgccttgaaaatcccagggcatagcaagtggacaaatgctgttacaaaccaactgcatgtaatttggcaatatgtttttttccccagtttaattaagctcttaatttaatttatgagcagtttttgccattatcattgatgtctttcaaattccttatatactgacatccctgcctcactaatgcagaacttttttcttcatttgcctccaagcaaccctaaatgtaatgaaaatataaataatgaaaatataaataaaaatcattgtgtttcaaaaggttctccaaacataaaaattaaattaacagtataatgccaataggccacaccctaattaaaacttagtgagttttatgagctaaattgtgcccacccaccgccgccaaattcatatgttgaagtcctatccctcagcatcacagagtatctatatttggagataatatctttagagaagtacgcaattaaggttaaataaggtcagtagggtgcgtcctaatccaatgtgactggtgtgctttcaagaggagaacatttacacacagatacatacagagaaatgacaatgtaaagacacagggagaagacagcagtctatggaccaagcaaatagatctcagaagaaaccatatctgccaatctttgacttttggcatctaaaactgtgagaaaataagtttctgtttaagccatccagtctatggtactttgttatgacagctctagcaaattaatgcagtaagcattctcaattgttttgacaattctacatatttcattatcttcttcgatttttaaaattgaagtaattatttataattaaagtggcaaatggagtattcttaatgttataaaaataagtaagcattatttaggtattttatagtgctcaaagcttaacgatttaaagcacctatggctgtaagaaagagaaagagagagaaagaaagaagaaagaaagaaacaaacaaacaaagagaaagaaagaaagagagaaaggaaggaaggaagcaaagaaggaaagaaggaaggaaggaaggaaggaaattgagtaggaagcaaaccattctatgcagttataataaaaccactaaaataatatcccataaactatgaatgcatacacgcaaattaatattctgacacatggtagaaattttctggccaaatgttctttaaaactctttggacaggtgaaaatggatgctttaaagactgtctattaaattgctttatcattcactccaaatcagcagtttgagtgttttcacatttcctctagtctgccttaactttaatcacctgatataccccagcggaaagaagaggtataacttgcaccttctatcaccaatgccaacacagtcaaatgagaatttgatccacgttatagagacaatatattcagtggctattattggtattaacttctataataatcttggtactaagctatcaagttcaaaatgactatttgaaagattggatgaggtgaattttacagcctacaatggcttattgaggtcttctattacatctttttattttatcttattttattttttgagacagtctcccttcatcgcccaggctggagtgcaatggcgcgatctcagctcactacaaactctacctcctggttcaagggattcttccgcctcagcctcccgagtagctgggattacaggcacccgccattatgcccagctaatttttgtatttttgtagagacggggtttcaccatgttggccaggctggtcttgaactccttacctcaggtgatccgcctgcctcggcctcccaaagtgctgggattataggcatgagccgcctccaagtcggctcccattacatgttatcacacagcctctttaaacttggctccaatggagtcagcctcaggcacaggggagaaggaatccccctaaagcctgcctaacaaaattacagttaaatccctgcaggtgatctgctctagatatagctctgctttaaccttccttcctcttttatgaccaaaatacataccaatctgctgttttcgtatactattattatcagctgtgtcaaatatttctctttgttagatcatcgtggtcttatttcacttgtaactctccatgccaggtctgtcaaaccctcaaataaattcttccacaagtttccaagctttaaatgttccctacattttttcagtctttctcctcactttcctccgatgaccccagaatcctctagtatattctcaagtagagagagttttattcccttcaaacttcacgttagcctcaggcagcatcatttacatttttttttagattgcctttcctctggcttaattactcaccaaacatctttttacaaccttttctgattattgccttttattgagcttattacaaccgttattaattataacatcttctttccatccttgtcactatcagttataaatcaccatttggatgccacaccaacatccatttaaaacattgctcttggctcacaattatctgttcctctccaatcctgccaagcagcttcaatcacttcccttcaaccatagttccctaacttcctctactgagatgcataatttattttcaagttatcacctatctaaataccataatcttgggaattcattcagtgactaaaagcttttatattattctgataatcttatgttttaatgtatgagacgttaagaatggatgttgggaaagatgtaaatatagatatttcactattaaacatgtttctaagagccctccttcagttaagcaaaaagcttattttggaggatccctgataggatttgtatatgtccagaatctatatccagccaaatccaaggaatctattaaattttttatttatttttatttatttattttattttatttttatttttatcttttttgagacggagtctcgctcttttgcccaggccggactgcagtggcgctatgtcggctcactgcaagctccacctcccgggttcaccccattctcctgcctcagcctccggagtagctgggactacaggcgccctccaccatgctcggctaattttttttttgtatttttagtagagacggggtttcaccgtgttagccaggatggtctcgctctcctgacctcgtgatccacccacctcggcctcccaaagtgctgggattacaggtgtgagccaccgcatttaaaatgtactttgatttctgttaacagtttataaatgcactgtgtttctctattttaataaaattatatattttaaacaatcttacctgtaaatggtgggtgacagacacattcatatgcttgctcatcccaattttctcttttattaatgcaactgccattatttttacatggtttaaaagaacatgcatcaagttcctggcagtattttccagaaaatggaggctggcaatggcagctatatgtcttgctccaagcttcactaagacatttaccatgaccagagcaaaattctgaactcagagattcctggcagaactgctgtttcactgtcacatttagtcgaagtcccagtggacaaggtgatggaccacttgccataactgtgataaaataatgtgtcccaacactcagccacttagaattaacagtgtgcattccttttagtctgcagccaaaaagtaactgatcttccgttgtggtattttgcacacagccaacgaaagatgtttcagaaacattcatcaaatttatttctggaaattgaagagatggttcagaagaaattacaaggatatctcctaattgaatttgcaaagggcaaatctggggaacagcttgattgcctgaagtatctattttagtgtttacacccaaaaaccagcaatctctgtagaagtccaagcagatgttttctgttagtgtccaatttaccacatatgatgagggttgtggatgccattcttccaccaattgccgtctacatgtttttccatttatgaaagagctgtgaaaaaccatcaggctcagaatgacgattgatttgtcagtcattttcgggtagctgtattttacagtttatcataaagaattgctgcaaaatggtgttttaagtattaccggaaatttccaagtaaagttgtggttaaggattcctgggaattggaattgaccttttttctatacccaaagtagctttgatgacaatgtgctttgatggagaaacaggaattcaaatgttgtaaatattcctttaaacagaaaaaaacatatattgttagtgaagttttccctaaattaataatatagaaaatgctagctctttttgtggatttcataagagcctacactgcaaagatagtgtcaccagcagctggggaccttctttgggaaagaaggccaagaaaaacatgatcaagatatgttgatctggtcaagctttatatagtcacctgattctgaaaagttctggtttcatgacataattaagccagcaacttactgcggtcttttgtgttttctctttacaccaagcttcaatctaatcaaaacacagcacagccaagattcttttacagatggtttcaattttcttgggagataagcattcctcttctgattagttttcaaaaaacacctttaaaacgtagaagagtaaacaccatttaaacatatttttcatgtaatattttatataaaaataagccttaaaataactcatagtgataatcatgttccttttatgataatccagaggatgggaactcccatatatatgaaaattctgttgtgcaaatgactaacctagaatgagtcttctgtaggaatggtggaaggtgccagataaagagggaaaagaaagtcaaaaagcagtaatgaaaagattataaatataagtaaataaagtaaaaataaatataagttaaatggtagtaactgaaaggaggggtcagcccatcaattctgttgttccagagggcaagaaaacataaaggatttctgagtttaatatattgacctatttttttttaaaaggtaactaccaattattgaaggttttctctgtacaaatcactctactacttgattaacaaataaactgcaatcctcacaattaaactcaaattttgagaggaaaggtaaatgatgttagtgaaaaaaacgtgttctttggatctcagttatgttattcatttgtttaatgtccttaggcaacctgagatttaattctctccactttcaaataggtacaccagggagaagtacacctaattaacaaggtagtattgaagatggaatgactacgtaaacatatatgagtcactcaataaatagtagcttttatttttgttattgtacaatttcatccagcaggtaagtggtatatgttggattaaaattcaggtttgtcagattcaaaatatcggcattttctactgtactataaagatcaattaaatgttgttaaaatacattatggtatgccattatataatttatttgttaattcatatcaaatctttatggtaagtctaacattttaatgggtattttagatcaggcagaaatcaaatttgaattataaattacctctttgcaatttcagttctacatattataaatctatgaaatataaattcatgtgacaaataacacaaatatgcatatagaaagataaaatacaacttctacataattcaatgttctacataatcatgtcaatttcaaatatattaatcaccttgttaattttatagatttaaattatcaatcttgctaaaggtttaaaaaataattcaaacaagtaaatttgagctcaatctatgtgcaaggcaatatgctcagtaccaggattcatcaataatcagttggaatagggtatcaatggaaggaattaagaactcaatgaaggagacagatcattagacaaggaacatcatcaaattgctatcaacaaaatagtctaacagtctgagacatgtagcaaggacatttagtccaatccaggaaacaaaatctaagctaaaatgataaaacggaatcacctgggaaaattgccaaaggaaaaatgttccaggagagagcatctacatctaaagattttgaggtgaatgtgacactggatgcctttaaggaagtaagagaagtggagctttctcatcaaagagggaaaaggaattacaattaaagataagcactccatttaggaagagattatatcaagaaggagcagccattctcagtaaaggagctcatattttattcgagagcaatgaagagcctcttgaagatttcacatggatgattaacaaaataaataaataaataaatcctcacttaactttgtccataggttcttggaaactgcgacttcaagcaaaacaacatatgacaaaatcaattttgttctctcttcaatgttttaatgaaaagacagagaaggaaaagatgttgaggaccaacatgttgtgtcgttttgcttaaagtcacaattttgaagaacctgtcaactacattgagaactcactataatttaatagcattagtctagtttcaaggtgaggaacatattggtgagtgcaattaaaagaattgagacacttgtggaggagaaaacaacactaatgtagtgaaacaataatgaagactaattagtacagaggcaatacaaatataacactcgtgaagtccataaatattgaaatggtagaattactacatctccaaggctgttggcctaaagaaagagaagaaaatccaggaagaccagttggagcagtaagacggcaaggaagaggggagaagtctgattcacttgtgcatacgctcagtttaaggtctatctgagtgattttctagcacaagtgttcagaaatcacaagagagaaagtgaggttttagagaaagatatgaatcactaggcaatattgaaatacttttgtacctgtaaatcacaaatttacagtagtagcaacctgcacaggtgtattattttcccagcagcttagttgaaaaggatacactaaagattaaatagcaaatgagttaaacacagtcacaaatttatttccacatgtaaatgcgaggaaacaaattacatttgcattgaagcaaaattaggcctatgtgacatttttagactgactgcagatgtgagcccacattattgtggggctaatcccatggttcttagagcacgctgggtctctaattattgtgcatttatgttttcaaagagaaagtggcttgatgcattgcatttccaccttgtgaaaatttaaataaatgaaaatagcagcaaaggaaaaaaaacactaacacaaaaacatctattaagtcaatgtatatctatacatgctgaatacaaaatgctttggattttattgggaactagagtaatataaacattataaatttgaaaaaggtgatgtaattttgaccccaaaggtatgatgttatgtgtctcagtttttcatttataaagacattcttcaaaccctgtcaaaatagcaagccaaatggcattctcctcaattctaaacacacatattgattaaaatcaggaagtaattttatcccaggtgatattactattaatatcttataaattcttgggccaagaagtccagaaacccagaactacgatggagccattgacagcatttcacataattacaaccataacatcacttgacaggttacgttaccagaaaaatattcacaggaaaatatgtgtaatttcagaactgtatgaactgtatcacttttatagtagctttgtagttaggttattctaacaaataaagtccaacttaaattcagtagttaagaaaacatgaacaatatttcttctttcacaaacagctgtcatcttaaattacatcttttaaaaaaacaaggtaataagtttaaacaaataagttttatataagccaaaaaataatttgaatagaacatgctcattataatagttggcatataataggcattcaattaaagatagttgagtagagattggagatgatggatgtaatttatttctatttgcactcaatagacaatattatgaactgtggaagcctttaataagcttgtagttgattctacatacctgatatttttcatgtttcacttctttaagaagtatgacctccacaataagcagctttttatttgtataaattatacattgtactttcaaaacatatacaaagaggaaaattagaaatagaagagataaaattaacagatacaaaagttctcataatttatgcctgtgctctagaaagtaagcaacaaattttacctaccacagattggactaaaattataggagtgaaaatgtgtgtttcagaaatgctaccagcagtgtgaatgatgaacattttagcaaggatactagaaaagggaaaaaaatggtaaattttaaaataaaactgagagtactagagaagagacagcagatttattcatattttttaagggagtagtgactgactttatcgattatgctcctactattgggagacaccggtccttctttagtacactgtcttgattatgacaatgatcctgtgaggtacatagtcatggccccattttaaaaatgagaaaacttaagtcaccatagtgtccaaagaaataagaataaaaagagtaaaaaataaaaaataaaatgagaaaactgaagcacagaaagattaaggacttgcccaagctcacacaatcaataagcagtggtgcatgtattgacctgactccaaaacacatgttctcagtcacatttaccatctcatacacaaatgcacacacccagttaggcttctgaggcaaaggaggcaggtaatttaggagaaagaatattcacaacatgattgccaataaggcataggattaaacaaagcggctgaggcaaaagatgataaacaatcctggagaacaataatattcaagagacaagtgaaagaaggtatctcaaattatccttgcattttgttaagaaaaacaaagaaaagggttttcagaatttttagagttggcacttttataaattatgaagtgagttttctatatttcattatcataatggtggtaaactcagtaactggtcagttgatgctataagcgcaggtagatttgagtggtatggtgggattatgggagagaaaaatcaaattcaaaaaatctttgaaaaaattgtctatggaagaagagtaattaagtaaacaagttgccaaaatagagttaaaatctcatttactacatcaacttcttcataaagctgtgtttaaactcagatctctagcttgagcaccactctacaagtgccttcacattatagtatcctttttgaagaagaaataataggcagaaatgtaccttcattcaattccctcttatttctctctcccaggtttatataatcctaaagtaaataaacggtcaggaatgaagtgattgtagggaatgtgcaagggtcagtgatgtcaggaggtagaaagagccacaagactgtcacagatgagctgaagaatgaagtgcattgtggattacgcttgggggtgggggaaagtcagaactttttgttttgctcatcactcagctacttacaaatgtataattttataatgctttttaacatgcttaaatgtttagggattaaatttaatatgtcagtattttaaaaatattttcctttttaatccacacactctatgagtaggcctcagaaattttaaatagctgtattaaagagtacttattagaaacagtttgtcttctgtgaagtgaaatcggttttctgtaagtaatctagaatggaaaataattgacaatagtatcactatatctgtgaatgtccatgtatacatgtgcgtttgtctgtgtgtgggagaagggaggtgtatgcagccttcatctcaatttgagtcatcacagcatattggtattgttagttatttctcttttgtagatgattaaaatgagaatgtaaatgattacattgaggtttcattattcaactcttttaagatcatatttcctatctcttaacagagataatatattttttctagaatattttatattttaataaggaaaaactacatttaagaaaaacacctaaattatcgttgccattatacagttggtctatagtatatggattaaaagtggtaaaggaaatggaaagaaacatcaatatattgtaactggagtaaagaatgacacttggtaactcactgattatagagtataaaagatttaccattcaagatatcatttcaatttcaattataaattttgtattaacatttctttagcttgtggttaaatttttatcaaaatatataattccatatatgacattataaaaaagtatagagattattgttgacatattaaaatatgctgtaagaaattagtttttttgaaacactttaagcttgccttaaaaaatattatctagacaactttgccgttatctagagggtgaaaatattattattaaacagaaatggatgagaccatagcatcatacatttaccaacagcattatttgcttttaaaaaacagagctggttttataaaataagattttaaataaattatgccttattttgtacttccttttcctttctccacatatggtcttatagattattgattttttaaaaaatataagtataacttattttccattgtctatgttttagctttcatgaaaaaaggttctctgtttaaacattgacctgtcattgaaattaagatagcttaagtatataaaagtcaaaggctatatgcgacttatagacaaaaatgttttgcttccatgttctgacaattatgaataaagctgctataaagagcataaggatgtcttacaaaacaaaacatactcttaccatgtgatccaataatcatactcaactcacacaaatcatactttgggtattaactcaaagaagttgaaaaattacatcccagaaaatcctgcacatggatctttattatattaactttttaaatacatattttgttaaaaaaatttagtagagttttaaatttacaaagttattaggaagagagtgccgaatgttctcatgtgtaccatattgtccagtttctatgatttttaatgtttcatattagtataacacatttgtcacaattaatgaattaatattagtatattaactaatgaattttacttaatgtcaatgctttattcagactttttcattttttacattatgttcccttttcttttctaggatcctattcaggctactacattacatatagtagtcatatcttcttaggctcttcctggttgttacttgccttgttttgatgaccttgagatttttttaggactattggttaagtatttgtagaaaaccctgcagttatgattcatctgatttcttttccattgttgtacaaaagtaatatgtactggggagaaaggccacagaagtaaaatcttctttaagaagtgaagcagtaaaatgtcattttcatcacatcatatggtatataagtagtcaccattaatgttaaccttgatcacctgtcttgaggtagtatttgtcaagtttcaccaccactcttttaaccctgcctccattgccatactaattctttggaatgtaataaactatacttagttttggaagaaaccattaaactgttttccaaagtggtggtaccatgatttttaaaaaatgtttaccagcaattaatcaggagttattattactttgcatctttgccagcagtagcagtgagttctttggattttagccatttaaataggtatttactggtatctcattgttgcttgcttaaatttctaatgacaaatgatgttgaacacctttttatatgtttatttaccatctgtatattttgggggttgaattgtctattcagatcttatgcacgtttaattagttctttgttttattattattgagttttaagaatccttttacatttggataaaaatcctttatcagatatgtgttttgccaatatttctccaagtagttatttttgttctcttaacagtgtcacttcagagcagattttacttttaaaaaagtccaaatttccattttctgtcatgaattatgctttcggtgttgtatcaaaaaatgtattgccaagcccagggtcatctacattttatcctatgttttctcctagaaattttgtagttaagtgttttacatttaggtatgtaattcattttgatcaaatttttgtgaagagtgtaagttgtaaattcaatgcctatgttcattttatttgcatatgaatatcaaattcttccaaaaccaattaataagaagactatacttttggctttgaattacatttgattatttatcacagattagttgactacatttgtgtgggtctatgtttggactatctattctgttccattgatctacatgcttgttcttttgtcaataccaggctaccttgattattgttgcttaatggttaagtgttgaaataaggcagagtgtattctccaaccttattttcttcagtaatttggtggttattctagttttttgccttaccataaaaactctataaccagggtgccaattttggcaaaatagcttgatgtaattttgattgggattgtactgaatctatggatcaaacaggtaagaagagccttaattatattgaggctcccaatcaatgaacatgaaatctctttctatttatttataatattcatttaggtttttatcagagtttagttttccacatataggtcagtacatagttttgtaggtatatacccaattatttatttattttggatactattacaaatggtattatttttcctttaaatattagttgttcattgctgttacaggggaaagcagttgactttgtatacagtattaaattttatcctggacccatgctatactgacttatttaaggcattttttaatatttgggaatacagaccattttatgtctttcttattagtctgcatatattttcatgcttttattttctaattgtactagctagaatttcctagtgttgaatagcagtgatgagaggacattcttgccttgttccagacctttggaggaaagtatccatttttctacacgaattagcataactgtaggattttacagatgttctttactaaattgctgtttttctcctctatttttggccttctgagagttttcatccagattagttgttaaattttgtaaaatattttttctgtgtcagtttatataattataaaaaatttttcctttagagtatcgatatggtagattacaatgattaattttaaaatggagacctaactttgcactgtggaataaattactgtttatttatttctataataaataaaaaaattattattctttttacttattgttggattcaagtttaaatatttgttgagaatgttgtgtctatgttcatgagagttattagtctatagttttcctttattttaatacatttgtctacttttggaattagggtaatgctagcctcaggaaatgacttaggaagtgttccatctgcttctattttactggaagaggttatgaagaattggcatcatttctttctttcacatttgatagaatttaccagtgaattaatctgaggtgacttcttttatgaaagagtattagttattgattcaatttctttaatatatgtaggcctattcagatgatcttttcttgcatgagtattgatagtttgtgtcactcaagaaatttgtctattttatcaacattttcaaatattgagacagaaaattgtttttagtatccttttatatatcctcttaatgcccataggaacaataatggcaatccctgtttgatttattatattaataacttgtgtcctctctctcttttctcccttgattagcctgactagagtctttaccaattttattaatattttcaaataataacttttgtattagtttattttctttattgtttttctatttttaatcttactgagctctattctaattttaattatttctcttcttttgcttagtttggctgttatttctctagcttcttaaagtagaagcttaagttattgattatagattttactttctaatatatgcatttaatgttatacgtttgtctctgtgcactgctttttctggatctcacatggtttgaccagttatagtttcattttcatttagttcaaaatattttttaagtttctcttcagacttctttgaccaatgtgttattcaaagtacactgttaaatttcaaataatttgacatttcttcaactatctttcttttactgaatcctacttttattccacgtggcatggggatatatgttttatgatttcattttgtcttcatgtgctcaggtgtgttttatagtctagaatgtgtgctatcttgctaaatgttctacacagtctcaaaagaattcctcctgctgttggatagactataattgccaattatatcaagctgttttatagtgctgactggtcaagcatatctttatgaggtttctgcctgcttggcttatcagttacaaataggggtatttaatgtatccaaccgtaatggtgggttttctcttattcctgtctgttttatcacttgtctaacatattttggcataacgttgctaggtgcatgcacatataggattgttatgtctgtttgcagaattgattccctgaagaccgctttatctgaaattacttgaggtactgaagatttcttttgattagtgggagcataatatatcttttctcgtctcttttaacctacctgagtctttatatttaaagcgtttcttgtaaatagattataggtgggtcttgtttatttgtttttctccactctgataagcaatttttttgtaactgtatttcactgatttccatattcctctttctatgtgctctggttttagttgggtactttacatgattatttttatcttctcttttagagcaccaattacacttcttttaatgattgtattgattgtcctgaggtttacaatatccttccttcctttcttttttttttttttttttttttttttttttttttttttttggcagagtcttgctgttgccaaggctaaagtgcaatagtttggtcatagctcactgtaaccttgatctcctcgactcaagcaatcctctacctcagcctcctgagtagctgggtctaccagcacatgtcaccagaccagactatgaattttttttttttgagacaaaatcttgctatgttgcccaggtcttgaactcctgccttcaaatgattctcttacctcagcttcacaaagtgctgggattacaggcatgagccatcacacccagtcacaatatccttttttaactaatttaatttgatttttaaataacagtattctgcttcatgtgtagcacctgtaccttgtaacagaatattcctaatttatctctcctgatctttctgacatgactgttatttcacctatccataggctacaatcacccaatatatggttatcaggttatcattattactttgaagttatttctataactattaataaggaaaagaaggcattttgttttatctttatttattccttctctgtcttcctttcctcatgtagatctgagtttctgacctatattatttcactctccctttttcaatattgtttgcatgacatgtctgccttcattaaaatctctcagattttgttagtctgagaaagtttttacttcttcacttttaaagtatcattttactaggtatagaattctaggttagtgggctttttctcttgaaaggtatatcattgcactcttctcatttgtatagtttctgataagaggtgggctgtaattctgatccttgttcctgtatagaaaaagtgtttttttaatccctctggctttaagatttttcctttgtctttcattttctgcagtttgcatatgacatgcctagagaaatttttttgttttgtttttatctttatagtttatttagcttagtgttctctcaacttccaggacatgagaatcatttgtcactcattttggaaagttttcagccattattttttcaaatattttttcagctctgttctctttcttctccttctaatattacaataacacataatacactttttgaaattgtcccacagtacttagatactctgctgtgattttattttattttatttttcctctttaagttttagtttgggaaatttctgttgatatattttcaagcccactgatctttccttagctttctacctatgtccattctctaatgaacctatcaatggtctttatttctattatggtattttttatttctagcattttctttcagttctttcttagagtctccatctccctgtttactcatttgttcttgcattctgtcttccttttttattagatctcttaacatattattcataggtattttaaattatctatgtggtatttacaacatcctcgtgatgtatgaatttggttctgatgattactttgtctcttcagattattctttctttcctttaggtatgccttgcaaatttttgttgaaattcaagcatactgtatcgggtaataggaacagagatgaacaggcctctaatgtggagatctctgtcaatgtggttgggctttggctttatttagagtttgctgtacctaaaggtgcctaagacttgatttcaaattcctttagtgtctggttttgttgtcccttttgctttggactttcctaagtactcatctacagagaatgtctatgatttgcagctttcaactattgtcttttatggtactgaggctctgttggtttgatggtaacgtataagagagggaaatgatataatctatgatctatggtctatgatcctccagttaaatctcagtcttttcttgggtctgtgtctctagcctgtagccttaagaaatgtttcttctgccaggagtggtggctcacacctgtaatcccagcactttgggaggcctagacgggcagatcacgaggtcaggagatcgagaccatcctggctaacatggtgaaaccccatctctactaaaaaatataaaaaattagctgggcgtggtggcaggcgcctgtagtcccagctagtcaggaggctgaggcaagggaatgatgtgaacctgggaggcagagccgagatcacgccactgcactccagcctgggtgacagagcaagactccatctcaaaaaaaaaaaaaaaaaagaaagaaatgtttcttcttatatgaatttcccattttcattgagatagaaagtatacagggggctagagtatgacaaatacccttgctaacagtcctggcatgactctggccaaactcttcctcactggagagtaggcctttgttagaaagaagatctgggttcatttaaaaaggataactcttcccctccccactccctggatcccacagaatcattctcagatctttacagtgagaacgtggagaaaaatcctggaggaaaagcctctgaaagtgtggggacctacctaagactgcagtgtagctccggggagattctccctcacacaaatcacatgaatacataaagtgtattttgttagatgactcaggacccagaggtacccaatgagtaaactggagatgaaaataaacataacataagaggagtaacgtactataaacagaaagaacatacatcttcctttcgttgattggatgacagaagaatgccagaaaggaagcagagcctctgcaggaggtacagactgacagctcataacagattctccttagagaatttaagatggttgatgtggaatctagacaatttaagatggttggtgtagaattctagcttttctctaagatttttttcatcataaatggtttatattacacattcccatcagcagtttttgagggttccagttactctgtatcatctccaatacttggtatgggtggtctttttaacttttgctaaactaaaatattttattgtggtttaatttaattatcaattatgtcaaacatctttttaatccttgtttgccaccttcatatcttctttggtaaaataactgttcaaacatattgcctactgttatttgggttttttgtttttgtattactgagtgtttagagtgctttaaacattctagatgaaaactctatgctaggcatatgacttgcaaatatttcctaacaatctgtggattaaattttcattttctgatgaagtagctcttaagattttcatttgataatgtccaattaataatttttctcagtactttcaaacttaaatgtaaacctcctgtcaatatggtgaaatacagcaagcaattcctttctgtttacttgtttgtttccccactgtagactcccaccttggaatgctgcaatgtgaagtgacttcttctagatgttaactcagctgtacttctgaaacctcctatcagcatcattctgcctattactattgcctcacttctctgttggatccttgtttcctggaccacacatattattgttataatctctctttttgctggagaaaattttcttttttttttctttttttaattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgttctcattgttcaattcccacctatgggaattgcggtgtttggttttttgttcttgcgatagtttactgagaatgatgatttccaatttcatccatgtccctacaaaggacatgaaatcatcatttttatggctgcatagtattccatggtgtatatgtgccagattttcttaatccagtctatcattgatggacatttgggaaatttttccaataggtctctcagcaaggtgaaatgggatatacatttttaaaacttcaaatatctcaaaaatatcatttgattcacacttttgattaatattttttgactgaagtagagtgctgggttgaagatcattttcctgtaggaaaggtatttcttcatctcttccagtttttttgatgtaaaagtccattattattcttacttcaaatcctttgattatgaccttatttttggtatgtttttctcccacaaatccttatctctattgttaaaaaattttcagtgattaagacttgaagtatgtcagttttcattcatttagatgtatcaaaataaggcatgtatgtgtgttgttgttaatttagaaatttgttatttaattctaaaatagtattactcaaggcaattatttcattcaatggtttcttattccattggtaaatatggtgcaatgtttgatgacgcacataatattctctgtctgcctcttggtctttttgaggctgaacttcaaaagcattctttgactgtacttaaaacactttaaggcgagggttaatttgtgaagaatttgtgaataggaattactttctcaccaattccttaaggatatatttgtttttaaatttaacctacagagattccaattccattctcacagtcgtgcaataaaattgacaaacagtaactagactattttattttcttgcaataagaatacattatacatgacattacttaaaagagctgtaggaaaatagcacacctgctgcttttcccactaatggtatatgcttttcatctactagggagaaattattctttaaagagtatgtaaataattctattttaaaccagagaaaattattaattaacactattaacttcttaatacaaatgcattctgtgtgtgtgtgtgtgtgtgtgtgtgagagagagagagagagagaaaagagagatctaaaatttaaatactcacctatctaggacctaaggttaacaacctaaccttctctttgcttgcttcatctcccatctacatgcttctacatatgctttatcacacagtcttataggcaaactgctaataatatgatgtgtattgtggaatccacctgccctaacctagattaggtaaatttttttaattgttatttcagtcttcccaggtaggtacaattttattccaatttatggattagcaaaattgatgtcaaaaagatccaataactcaggacaggcgaggtgactcatgcctataatctcagcattttggtagactgagacagggggctcacttgacgtcagaagttcaagaccagcctggtcaacatggcaaaaagtcatctctactaaaaatacacaaactagctgggtgtgatggcacacactcctataatctcagctacttgagaggtcctataatctcagctacttgagaggctgaggcaagagaatcacttgaacctgggaggcaggcggagattgcagtgagccgagattatgccactgcactccagcctgggtgatgcagcaaaactctgtctcaaaaaaaaaaaaaaaaaaaaaaaagaaatcacctaaaatcatataacttgtatatgataaattgaaattgaggattcaaaacccagtggctaactctaataagttgatcaccttcaggttaccatttctgtgaaatttttccctaactttccggcacacttagacattactacctgcagttactcatacgccttacagatcctcttagtataaaaattacattgtaggccgggcacggtggctcatgcctgtaatcccatcactttgggaggccaaggcaggcggttcacgaggtcaggagatcgagaccatcctaattaacacggtgaaaccccatttctactaaaaatacaaaaaattagccgggtgtggcgagcacctgtagtcccagctactcaggaggctgaggcaggagaatggcatgaacccgggaggcggagcttgcagtgagccaagattgagccactgcactccatccagtctgggcgacagagcgagactctatctcaaaaaaaaaaaaaaaaaaaaattacattgtaaagtaattttaattataaaaatgcttcttcacaaatgtaaaagaacagaaattataacaaactgtctctcagaccacagtgcaatcaaactagaactcaggattaagaaactcactcagaactgctcaactacatggaaactgaacaacctgctcctgaatgactactgggcacataatgaaatgaaggcagaaataaagatgtcctttgaaaccaacgagaacaaagacacagcataccagaatctctgggacacattcaaagcagtgtgtagagggaaatttatagcaccaaatgcccacaagagaaagcaggaaagatccaaaattgacaccctaacatcataattaaaagaactagaaaagcaagagcaaacacattcaaaagctagcagaaggcaagaaataactaaaatcagagcagaactgaaggaaacagagacacaaaaaacccttcaaaaaattaatgaatccacaagctggttttttgaaaggatcaacaaaattgatagaccgctagcaagactaataaagaagaaaagagagaagaatcaaatagatgcaataaaaaaggataaaggggatatcaccaccaatcccacacaaatacaaactaccatcagagaatactacaaacacctctacgcaaacaaactagaaaatctagaagaaatggataaattcctccacacatacaccctcccaagactaaaccaggaagaagttgaatctctgaatagaccaataacaggctctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattttaggaggccagcatcatcctgataccaaagctgggcagagacacaaccaaaaaagagaattttagaccaatatccttgatgaacattgatgcaaaaatcctcaataaaatactggcaaaccaaatccagcagcacatcaaaaagcttatccaccatgattaagtgggcttcatccctgggatgcaaggctggttcaatatatgcaaatcaataaatgtaatccagcatatgaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccgacatcatactgaatgggcagaacctggaagcattccctttgaaaactggcacaagacagggctgccctctctcaccactcctattcaacatagtgttggaagtcctggtcagggcaattaggcaggagaaggaaatcaagggtattcaattcggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgtttatgggtaggaagaatcaatatcgtgaaaatggccacactgcccaaggtaatttatagattcaatgccatccccatcaatctaccaatgacttttttcacagaattggaaaaaactactttaaagttcatatggaaccaaaaaagagcttgcattgccaagtcaatcctaagccaaaagaacaaagctggaggcatcacactacctgacttcaaactatactacaaggctacagtaaccaaaacagcatggtacttgtaccaaaacagagatatagatcagtggaacagaacagagccctcagaaataatgccgcatatctacaactatctgatctttgacaaacctgagaaaaacaagtgatggggaaaggactccctatttaataaatggtgctgggaaaactggctagccatatgtacaaagctgaaactggatcccttccttacaccttatacaaaaattaattcaaggtggattaaagacttaaacaatagacctaaaaccataaaaaccctagaagaaaacctaggcattaccatttaggacataggcatgggcaaggacttcatgtctaaaacaccaaaagcaatggcaacaaaagccaaaattgacaaatgggatctaattaaactaaagagcttctgcacagcaaaagaaactaccatcacagtgaacaggcaacctacaaaatgggagaatattttcacaacctacttatctgacaaagggctaatatccagaatctacaacgaactcaaacaaatttacaacaaaacaacaaacaaccccatcaaaaagtgggcaaaggacatgaacagacacttctcaaaagaagacatttatccagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagttggtgtggtgatacctcagggatctagaactagaaataccatttgacccagccatcccattactgggtatatacccaaaggactataaatcatgctgctataaagacacatgcacacgtatgtttattgcggcactattcacaatagcaaagacttggaaccaatccaaatgtccaacaatgatagactggattaagaaaatgtgacacatatacaccatggaataccatgcagccagaaaaaatgatgcgttcatgtcctttgtagggacatggatgaaattggaaatcatcattctcagtaaactatcgcaaggacaaaaaaccaaacaccgcatattctcactcataggtgggaattgaacaatgagaacacacggacacaggaaggggaacatcacactctggggactgttgtggggtggggggaggggggagggatagcattaggagatatacctaatgctaaatgacgagttaacgggtgcagcacaccagcatggcacatgtatacatatgtaactaacctgcacattgtgcacatgtaccctaaaacttaaagtataataataataaaataaaattcttcttcaatatactaaagctctttagggaaatattatatatgtaatccacatcccctaggcacatattaagactgaaaaatatttatagaatagctaaataaaggaagaaaatgaatgaaaaagaaaagaaggaaggaaagaaataagaaaggtataaagcataaggatgctgaaaccattaaaagagaacatatatattaaaataattctggcacatagcaggttttcagttaatttttgtataatgtgacaaattagttccctgcccatgtatatgaataaaccttttatttatatacttgcatgttctatatgtgaaagccaatatttctcatggaaatctgtctaattctaagaatttaggcctgtggctagacaaagaccactgctaatcctcacagctatttaagtacttttaatgatgataggtttaaagtccctacaaatgtgagtttaataatgaagggagaaattatgacatgtaaacaactttcagaagtcttgtttaggattaggactgacaagatatagtagaagcatgaatggtagtttatgtttcaggagaaaatatagggaaatagacaaatagatatttcagtatagagtgagataatttcttaaagatgtcagggcaagagttacaattttattaagggcttaatctgcatcaggcccaatgataagtgttttgtatgttttattcttttaatctacagtcttcgaaattagtacaaatatttacatccattttacatgaggatgtacaaaggcacaaggatgcctggtattactaactcttcttttctccaaaattctctaaaaattatcctcaaaaaatttttctcaaagagaatacaatgcaaaaggaagaagagtttatgagaaaacaaattagattctactctagattctgacacttcctagtcagagaatacaatctcttactgggaacaaaagagtttcaagttaacacacacttttcaactatgacactgtatgatgttgttatttttcctttaaaatgataataaaaatactatgtggataatagctctattatttatagtgctctcaatgtctattacatgaacttatttatccatttgcaaataattcttagcctcagtttccttagctataacatgatattaatgaaaaatacttgctcttggaacatggaaattggatttaaaccaaaggaactactgcgtgtggaagggctgtatatctaaggatattatattattttattttccattataaacctaggatatattttatacctcatattttaatagcttattttctgtcccattttttaaataaaaataattgtctgtaacaaaagtattttggaatctgtttttttcaaaacaacaacaaaaaaaaaacaaaagctcaaaccttaaaccagtttctttgaataactaaaatcaatcttcttactctacctgaattcatcactcaaaaatctttcacaatgaattaatctgcctttacatccaagctaataaaattacggttgaagcaatacttacgtattatgtaaagtgaggttacgggtaaacaaactattttaaaatgatgctgtaattacatcctcatgaggtctatggttaggcaagtcattttgggctttttatcaacttatctgtgctaaataaaactaacattttaaagtaaaataacttaaataaaatttacacttggaaattaacatttaagaatagtagtatgaaactacagtttaattatttcaaccaagtaaaggtaagtacaggcatacaggacaccaacgacagattattaccattgttgtgaattacagatgttaatcattaaagggaataaaaaaattcaagaatatacaagttttcacatgtaagtttgaggcaggatagtaaaaattcaactccaaacacgttctatgtgtaagagtttccagtgatttggaagtggttcctgcactcaacaatcttgatgtttagatagaaaaaataaacaaaaagctaaggataataaaaataattaacgacatgattcttaatagacactcttcctttaacaggcttaacatatatacattatctaaatctcacaacagctttaagaggtaacattattacctctatttgataaatgaagaaactgagtctcagaaaagtaatattcccaacgtcttacagctggtatttggcagaatccaaacttatatccaagcattctgttatcagtgcctgagtccttagttactgtcctagagtagactaaattgaaagaaaaaatttacttctataaaattaacatattatgaaaaatctggagcattacccatatcttataaaaattatggttttcacctccaactttccaccttcatctcttctccaaaaagggcaggcaatacatctcagtttttgtatgtgtatttcactagtacaacaagttggcaaacacaaggtaaatgttcaataatatattaaagcgtcaaaggtttccatgaacattaaagaaggaaatagacattttgaaatatgtctgttctatatttagtgaacacattatctaatcaaaaaggtaagatttattttatttattttctttaggtcatgcaaaattgtggtatcatcttaaaattagaatataaaccccatgagggcaaaagttattgtcttttcttgttcattgctataaatatagcaataagtgtatattagtaggttctcacactgctaataaagacatacccaagactgggtaatttataaaggaaagaggtttaatggactcacagttctgcagggctggggaggcctcacaatcatggcagaaggcaaaggtgtagcaaaatcaggtcttgcagtcccctttacacaacatcagatctgtgagacttactatcatgagaacagcatgagaaagacccgcccccataattcaattacctcccaccaggtctctcccatgacacgtggaaattatgggagctacaattcaagatgagatttaggtggggacacagccaaaccatataaatgtgtaatgcccatgtcagaaaaaaaaattgtgaaattctttgaaatgaagaaaaatgattcttgtgtgttctatcaagcacatccttctgggatatccctctctttcattgtgtttgagttgttttacaatttggtaaattgtagcacactattaataatgctaataatgcttggtcgttgacatgcaatttgtgtccaatggagatacaattgattattggattgtggatgtttatcaattttgcatctatttgtacattcatttcaatatacattgttgcctctgtgtgtgtttgtgtgtgtgtgtgtggcggtggtggtggcaaattaaactttaaatgagttcgaacattgtgctagttttctcttcaattgatgagttaaattaaacttttatcgtgtattgatatgtaagagttatgattttaccttaaacattatttttaacatctaaattagtaaacaaaggcataccaaatactagataactaataaatatatgtatattaatctataaaggttaatataacttaataatagaatactaaattaataattgaattaatgagtgaataagatatttttcatgaaatatcacagttaatttttatggtctctattagtctgcattcattgttataatatgcttggccaggtgactgagaacacttgcaaaaactataataactatatatatatatatatatatatttttttttttttttttttttttttgagataagatcttgctctgtcacccaggctggagtgtagtggagtgctcacagttcactgcagcctcaacctcccgcggcttaggtgatcctcccacctcaacctcctgagtagctaggattacaggcacatgccatcacacttggctaatttttctatttttttttttttgtagagatgaggtttcaccatgttgcctaggaatcaatacttttctaaacgatgtatggattttcactctttatagattaattttactctttatagattaattttactctttatagattcaccctttaagtttactatgcatattagattaacttttcaaatatgcacaacatatttcatgtatttcagtagtacttgatacatatcaccccctctggctatccaaaataaaataattgtgttatatagaaaatgtgtacttgcaaaagaattccattataatttgaaaactcagaaagcatatggggccaatacttctgaatttggccactgtactttttgatatcagataagatacagaaataatttatatatgataaaaagaaactcaatttgatttccacaaaatttatagttctagacatttagaaatgtgtttatttttaatgagtgtaacaaggctattgctaagataacaagacatatgttgaactggctaattttcttcaagatgcaatgagccctcttgggaagtaggccttgtgctggacactaaggaaatttgaagttataatgtctaagttttcataatatagtgcagaatatggaaacatgagaagtaaaaatgttacacaatatgtgttattgcagaggtacaattatatatacacatatgtatcatttatgtaacagtctattcctgatatatacatatatgtgtgtatatatgtatatacatatatcagaggaatataatgtatacatatatacatatatgtatatatcaggaatagactagaataactattgactgataattgtgagttactgttatgtctatcctatttacagggtctctaagcaagaccagtgtcattgtctgcaatgcttcttctatcttcttttttattaacaacataaatcatggattttacagagtgagaatttcattggacgaagggtagtccaattttagtgcttgattgcatatttctttgcaattggagaggcaattaaaaattaagagtaacaaacatcttctcaaaatagtaaatttgaggacaaatatgaaattatgactgctgatggactaggctcacatgttccaatttgctgtttgcaaggttgacaccaaaaaattattacaatttctatcattctgaacaagtttatatggatgcatttgctgcaattaagagaaaaatatagtttgttcaggcttatcaatttttattctcacataattagatgctgagtaaaactttcattttagagatgtagaaatcatgatagagaatgaccatctgctcaacatatatacgtgttgtatcaaatcactgcagtacttaagtacagaggctctagagtcaaaaaccctgggggaagaaatcttggtgtgtttgctttctacctttcttacactgaataaattactgaacacagtttccccatcagtgaaaagaaggtaatgcttgttcttatcccacaaaatcattgtgaggactaaattatataaatcataaaaatacttttgagaactcagaccttccaaatagaaagttagtaaatttattactttaatgaaatagtatatgcgtgaagaaatccaataatcaggttttgttaaaaaacccctctatcccatatcttagtctaacttacatagccaaacatacctgacagttcatataaaaaaatctacattaagaaaattttgacaatttgaataaggtttcttatggaattaggtctcattattttggaagaaagtaatttgtttgattggctatatttaaagtattcatttcttctaatcttgttttatcacacttagcagagttacagaagattgtaaatgtaattttttgattaatgccactccgtgttaagggtcctcaaattatgaagggcagagattctaatatctcctactcatcaaaatattcccagtgtctcgtagggttcttggtatataacggatgttttaaaaatattttatttgattaatagtcaacaatgtaagtgaataaatgataatttaattcatttttgctcataaataattttattgttcggagtttgaggaattttaccttcaaatttcctgtgggtctcttcttacaaaaaatcacttttaacatttattacaattctatcaaatcttggtgacgtgttatactttcatcagcacttgcaaaaatatttagtatttctaaaaaaatactctgatgtaaatctattatgtaagctttagatttcattctacttgaattatttatctaaggtatatagagtaatttttctggtaaattgaaaataagattctatatattctgatctctgaaatgaattatatatccctctgtaatagtataacatagtttttatagctgtaaattaaatgagaaattagtgggccagcacagtggctcatgcctgtaatcccagcactttgggaggctgaggccagaggatcgcttgaaaacagtggctcaagatcagcctgggtaatgaagtgagacactgcctgcacattaaaaataatagtgaaagtattttgtgtggattgtctttaagtctgtgtgtggagtggggtggagatgggttgtttgtttttgagagagtcgatctgtcatccaggctggggtgttagtgttcttaagttttgaaatatgtatgcatatttttgtatcaaaacacataaaagcataaatactttaagaatttcaatgcaattttgcttccaaattatatgctaatttttattatgtattttgcatattatgtatagtttaatctttgaaagttattgaatatgtatttgatttaatttgatcttcccttatattctcacatttttgataccttttgtgcagctgtgctacaaaatctaatgcatctgaaaatttttataataactgaacttttcacattttatggctaattctgccttttaaccttttccttgatcctctatgaacaatttagtgtaacatttaattataattaccagaacacaacaaaacatgaaaatgaagttaaatgtaggatattacatttttgtgttcaaatagtttcaatttttaatttaatatctgattattttgtgagaattaaatgtacaattacatgtaaatagaaccttcaaatacatagattaacaattaaaaaaacacttgttgtcatgacatgcaaaccccaagagcaggcctgttatatatgatttttttaaatgtctatgatttttattagtaacattttataaatgcattatggggtaatgtattctttaattacctacattttaccattccacaacatatacatacctcaaaacatcatactgtaaattataaaaacacttatgtgacagttaaaaaaataaattgtgatacacacacacaaacatagagagacagacagaatggcgtactattcagcctgaaaaaacaaagaaatcctgccatttgaaacaacataggtaaatctggaggacattatgctaagtgaaataagccagacacagagagaaaaatagtgcatgatctcacttatatgtggaatctaaaacagtacatctcttagaagcagagagcaaacagttgttatgaagaatgaggaggtgggaaaatggggaaattttgggcaaaaagcacaaagttgcagctatgtaggatgaataagtctagatgtctaatgtaaagtaatcatttcactatgtatatgtctataaaaaattgtgttgtatacgctaaatatgcccaattttattaaaaataactttttttaaaaaaaagtttaaatgtttatatactgctagatggcaggtgggtggaaattatatagctacatcaggggtagtctacgttatgagagaacaagttctccagacggatggtttgctgagttagtgtttctcaaggatatattccagacatacttttccttacagccaacgtggaataaaagtccaactttttgtttgagacagagtctcactcttgtcgcctagtctagagtgaaatggcacgatcccagctcactgcaaactccgcctcctgggttcaagtgattcttctgcctcagcctcccgagtagctgggattacagacacacaacaccacgccctgctaatttttgtatttttagtagagacggggtttcgccatgttggccaggctggtctcaaactcccaacctcagatgatccgcccaccttggcctcccaaagtgctgggattacaggcttgagccaccgcatctggccagaagtccaattttcctatagcagtcagaattaatcaccctggcctgcacagtaactctcttctttgtctgtttattcagaggcatgaggagtccaaagtggccatatggcagtcttaacttccatttcaatggaataattgttgtgtctcctggtggaagcattctcctttttggaactaacggatttaggccagcagagcacaaggtcacagaaacaggaagtaagcattttgctactgggtcagtaggagtaacagtgagtggtaccactttcatttccactctctaaatgttggaccgtgaatcatatacatgaagcatatacagccttctagagaacattttcccagcccttcaagatgttgccacctagctggtactgtaaccagctcttcaaaacacaatttcactgttttatcaaaccacttacttcaggttgatgggaagacatggaaacactggtgaaatctatgagtgtggtttcactgccacacttcatttgccatgaagtgaattccttagaatcaatgttgtgtgaaataccatgatgatagaaatgtattctgtaagcccatgaatggtagttctagcagaaggattgcatgtagggaatacaaatccacatccaaagtatctaatatagcaagaacaaaatgctgcctcttttatgacagaagtgtctcatgttattaacttgccatcagaaagctggctgatcacctttgagtgtcatgtgagggcctcagtgtttatcgttgctgctggcaaattgagcactgagcgatggctttagccaggtcaaccatggtgactggaagtccacgttgctgggcccatgcataatttccatccttgccaccatggccactttttctaaactgatttttttttttttcaattttactttaagttctgggatacatgtgctgaacatgcaggtttgttacataggtatacatgtgccatggtggtttctaaacccattttaaagtcatatgttgaaagcatttgaagatagggctcaatgaaaccactgagaagtcactgaaaaaactggggaatcatgactggtatccatagaaaaagtcatcctatcaacttgattattgtaatcatcctctgcagaggtcactgtttaccaagcatctcagtgaaaacaaatattttcacattatttgcccattcagaaaggtctattatacacacctcttaccagacctcctcaacactgattttccagccaagtcacttccaagtgcctggccatccattctaaccggaaaattcaacttaactcatgatctgctagccttcccagccttctgattcccctcgcccaccatcaattactctcacagtcatctctctaataaaatctttgattaatcctgtcttattgtttgtttctcaaataaattaatctaacaaaggtattgttagtggagatcagcaacacagagtacggcatttgacatgaaataactaatcactgactcttttgttttccatatccataaacaggaagtatctaaagcagtttacttttagatgaaatggacaacagtatatctttacagtcttgcctcatggcaatgagtgctcctactttatctaacagagtagctcagaagtcttgattgttttggaatttcacaaaatagcactcttgcccatttataaattatattctcttaattagactactaataacataagaaatgtcttaaatgttctagtaattacatacatggcagtgagtctggagtgttttagtccattttcttttgctataattacaaattaccctgagactgggtgatttataaagaaaataagttattttggtctggttcctagagactgagaagtccaaggtcagggaggcgtatctggtgagagccgtgtcctaacttagtgaagggtatcacatggtgagagagcaatagcatgtcagttagggcttttcttcctcttcttataaaaccacctgtcccgttatgggcctcattctattgaccttatctaatcctagttatcttccaatggcatcaaatctgattcccattgacatatgatttggggaattaagttttcaatacatgatatttacagaaaaaatcaaaccacggcaggtgtagaacacaaagattcagagatcaattgtaagtaaaattttgagaaggtcctttggtccgaaatatcttagaatatttcttttctcttaaaagatgccatcactcttcttatctctcatcaccaagcataattcacagcacttgataagtctctttagatttgtagctagcaaacatttggaaacactgctccaacctgtcttttttagtttattcaaaaggctgcttggctcacgcctgtaatccctgcgctttgggaggccgaggggggtggatcacgaggtcaggagattgagaccatcttggctaacacggtgaaaccccgtctctactaaaaaatacaaaaaattacctgggcgtggtgtcgggcgcctgtagtcccagctactcagaaggctgaggcaggggaatggcgtgaactcggaaggcgaagcttgcagtgagcccagatcgcgccactgcactccagcctgggcgacagagcaagactctgtctcaaaaaacaaaattaaatttaaaaaagactgctaatcttgagtggaatcgaaataacgagagggcactgcataaagtccaggtggcagtataagcttctctaaaactcaacccaaataattcagtatattttataaagctataggaatcggtgttggaacaggagtgtgtggagttttgggtagcccaaagggatgagtccctaggtttctggagaaaggttaagcaattttctccttctcatcacttaaaaatttccatgtctgttactggaccatagtaaaaactaagtgtcagtccatgggacagaatgactttcaatgaggtgcatgtccttaggtacataaaggttagtcaatctcagcaacaacctcttgtggcctaggagtagtatattctggttaaccccaagtaactctagaaagcattataaattacagacacctatatcacctccctaactcacactatattcacaaaaggagtttccttatgactaattaatggtagagaaatatactggggtatgactcacgtatgggttggtttatggtagcactattgaaaactgcacatcttcttcattataggcccacacaggacagcccagtaacatgatggagaacagaaatcctttcagaggatagatctctgagcactaaattgatcacacctttcaacagaacagatgacataccttttaaaagtcatccagtttctcttcaggtcaccccagtgttagcacagaaaagtcataaatgtcatggtggcacaaaaggttatgcacaggcccaataatacagatgccttctcatccaaaatgatctagttatttccactagtctatgtctgacttgccagtataattggacgctgtctttgctatcacactgttactcagggagaccgggcatacacctattacaatcaaatgcattgacacaaaatgaaagtcattcatccatagtagacatgataaactgtgtagatatgggtttgattttccacacatgggacctccctaaacagctttagttaagggttacaaagtaacacatccatcaacatgataatccatacaacattgtctgaaattaagaagctcattttatggcaaaggagttggttcaataggctcacgactattggattcactggttgtgccatgtgaaatagcctaggatcagtttttaaaaactattaactgaatggctgaaagtgttactaaggtatcagctcgagcactatactttcagtgttgagaaactgtccttctggtaacagcacatatgttgaaacaatggccaatataatgagattgtaacttaatatgaattgagaaaataaaggtgaaagtagaaataatttatatttcaaaatgtccatattgtggaattctctcctcacaaactcagtctctgtttctgattgttaggagcaacatttctccaaggggaacacagaaaaaaatttcactgaaatagaattgataactacaatctaccaactaggttctaatgctattgataagcagacaaaatgtatttgctgtgcaggctgggtgtcctggttacaatgaggatctatgatggatgttatctactatggtttgaatgtctgttgcgttgaaatttaattgctgttgtaacacaattaagaggtaggacttttaagagttgattaggctatgagggctctaccctcctgagaggaatgggttcctttgtaaaaaagtaacttgaccccctcttgccgtctctcaccctcttgccttctgccatgtcatggcccagcaagaaggcccttgacaaattccagtgtcttgatattgaacttctctgtctcctgaactatgagccaatatatttccattcattataaattacctagtctcgactattctgttatagcagcacaaaacggactaagacactaaccaatcaattggggaaatttatttacatataaagtaaagagaagtcactcattattccatgttccttgaaaattctttatggaaatttcaataataaaccaataagaacatggtaattaaagattcagacccttaagaaataaacttctaggtttcttttcttggcaagctctgagacaagctaaagtcttttgcaaattttcagaaatctagaatggatgattcaagagaaagataagaaatatcaattaattgctcaagaggagatgcagaagcaagtattacagatgacttctttaaccgttttaagttctctagaagatcaaaattaaccgccatcttgaagtggatattatgactgattaggctttagatttcctcttgggggcttgctattcttaaaaaaaaaaatagtatgggatcttggcataatgaaaggacatttcaagcaattgtgaatgttgcaaggagtgacacattttaagctttacctaaaattatctcaaccttatgatgttctggcttttggatgcttacttcctcataattctgtgtaagtaaccactctgttgaggcctatatgcttgtatcacctaaagcaaatatctggagtctctgggctcagatgaattaccaaagaatgtgaagaaagatctggcttcccagaagctgcttaagataccaggtgatacaattcagaagtacaggagaactaaaatcccctagaacaaactttgacagatgaaacacaggacaccagaggaagttgattaataaattgcctgtctattactccccctgaagcaataatttcttatatacgttttcctcagagttgtcttgtaagcatgaaacacatgttcttcatgaaatatcaaccagcctgataacacattattatggactgaatgtttgtgtccaccccaaattaacatgttgatatcataatgccaggacgaaggtattaagtgttgggcctttgtgattaaatcatgatgtaataatcattacagccctcatgaatgggattaatgcctttatgaaagagaccccagagagctcccttgctctttccatcatgtgaggacacagtgagaatgctgtctatgaatgaggaagcagaccctcactagaacccaataatgttggcattttgatcttggaattccagcctctagaagtaggaaaaataattttctgttgtttagaagccatccaatttatggtacttagttatatcagctcaaaatgatgaagaaaatattatcttttgtttgctttttacatttgcctgcctgtctcatatttttattgttattgtttttgtctcagccttgggattgtatcctataataaatcattaaaatcaatctcaggtttttgtttttataaagaaactaagattaatataatgagataatcaacagtgagcttaccatttgtcagtcagtaatttaaatgggaagatattcccaattattttgcttggtagcctacttggtgaaacttctagagagagcaatttctcagtgtctatcaaactctaaattcacatactctttgacccagctccaaagtaggagtcagcaaacaatggcctgtgggactccaaattcagcccaccacctgtctttgtaaatacagtttttcaaaatgcagtaatgcacattagtttaagtattgtctatgacttctaagctacaagatcaggattgtgtcaaagattgcatggcttaaagagtctaaaatatctatctagacttaacagaaatgctggtggacccctggcttaaatgtcaacagttattattatttaaaaaagcttataaaaacataatttttgtatcattccaagaattaaactggattcatactctgtttttcatgactcatttttttcttataataaaatatacctgccatcttgacaaaatcatttagttaacctcagtcaagttactaaactgctttacacctcagtttatgaaagggaatgtggaaagacaacatatatttccactgaatttgaaaggacatcatgtatgtagagtgtttaggaatggccaaaagtttttagggccattcggtctgcatactttttgttccttgtgcttgcacttaaaaatatgaagtcccatatttttctctttaaataattccaataaacatatttttctagaaaaataaagaatctaaattgcctacaaaattttaatatgatagttaatataatcactcgctcctataagaaaaatagtaatagattaaagaattttctgtatttagatctcctttacagtagaaatataaatgaataatctgtgttttttacggcacaatggaaagtgtggatgaccttactgaaatttaattattcagtgcttttaaaactctttgatccatgataccttatgacctctgatcaggaaataaggaatgccacagagttcaggataggaaattttatagaaattaatgttctcccggcaagagggaaataaacaggcatttatctcttaaaggaaatggctttaagaggcaatacctatgttaacatcattgtatttgccacatttatcatggcatgagttataaagaaaacgcttcataaatgtttttcaataactgaatgaatacatgagtgaaatacaaaggtctatgttatgttcagcattcgggattctgggattaaatggaacatgaggcaagaaagaagatacagtgtggcctcattataatctgacagaaccagagaggtataactaactgaaagcccaatccccaaagtcagactacatgaaaggaaacattcaagtcctagtatgcacataggagcctttgttcagagttttaaatggatagggagatccctatgagcagcataaatattaaagtcaaggcagaatctatttcctcttcattttatgcacgctgctcagtgtgggcaaacacggttggtatgaatttgtggactgggtgccagagctgggagcagtaatcaacaggtgcccacagatgctgattgaaagatagaaaacagctaaaatagatttgagctatctaattaggagccaccataagaagcaactgacacattaaccttttgtttcatcggtaatatatagaacatcttgatttttaaaacatctttcattaacctaattcacaagatctggttggtgatgtaaattctttgaacctagaagggaatttgttaactctgtgtaagttactgtgtgatgtggataatatacgttaaaattcttataattatactaggcacttattaaacactctacatatgtaaattattgttgttattatttctattgctgttatagaaaatgtataaaaatgaaatatgaatattttaaatactttaaaaggtggtgttttttattttaatttaaacaattattgaactcaactacctgctaaattatatataatcatatgcttaacaaattttttaaaattaaaacaaaaatctaagattataaccagtattatacctctacatgtaagaaagtctatatttactctggtacgtattttaaagccttcatatttctattcaatctgaatgatctcaagtcataatatttttctttgatccaaaattgtttgatatccatattatggtacatgatgttagaatacttgttttgttctgccatgggctggtgaattaattatgtctaattcttcttgttctgacttagcctttcttcaagattagatcaaaacattattacagctacagtccctgatgcattattagttcaagaagcaatgtaatatcacatttgttactgttttatcaagctaggtataaaaattgctttacgtttaaaggggaaaaagtgaaaattccagcaaagcagcctcgatttcacaccaggacaatcaggaatattttctcacttttgctgtcctggagcacaggtctgacaaataacagagattagaaatgattctaatgcttccctttcccacattccctagatggatatgtactaaaaagctttagagtaaacattaccaacagaaaaaaaatatggcaagtatgtttttagataaactaaagggtataatctctacttctgctttctgaagtttccacttttatactgttggtgagagtgtaaactagttcaactatcctttttaatgaagtttgttttaggatctttaaaaatatctctacaatttattgtaattgcttcctcaattttaactttgcaattgtcgattttatagatttttaataataaaaaaggataaattttgtttttaattaaaaatatgtataaaaattactaatattagctgctttaaaagattgctaagctctatttgtgtgtaatttattgccatattaaatagaaaataagtatttgtgatcataatgaacaacaccgatcccacagaaatacaaattaccctcagagaatactataaacacctttatggaaataaactagaaaacctataagaaatggataaattcctggacacatacaccctcccaagactaaatcaggaagaagttgaatctctgaatagaccaataacaggttctgaaattgaggcaataattaacagcctaccaaccaaaaaaaagtccaggcccagacggattcacagcagaattctaccacaggtaccaagaggagctggtaccattccttctgaaactaccccaatcaatagaaaaagagggaatccttcttaacccattttatgaggccagcatcatcctgataccaaagcctgggagagacacaataaaaaaagagaattttagaccaatatccctgatgaatatccctaatgtggtggtactgagagatgtgaattgggggagatgattaggttagaggcctctgtcctaatgaataagtgcctttataaaagagtcccaaaggagcttgttcacccattcagcaatatgaggacacatagaagatgccatctataagaaacaggctttcaccacatatggagtctgctggcaccttgatcttgaatttctcagcctctagaactgaaaaaaatacatttctgttgtttataagccacccaatttatgtcattttagtacagcagcctgaatagactaagacactcactctggcagaagttattgatgatattgcctttgtccgaggtagaaacacagatcaatctcaactcattggcatgggtagtgatagacaataacattaccctaatttttttttttgtcttttagtcatcctggtgtctgtgccattgctcatacttcttgtacttggatcaaagaaacaagcaagttggaactatttatatattgttttaaagtataagctatttggctctctaaggttaatcttcatggtctatcaaatttgttattttggccttgatttggcaattgaggttcctagttccaaatcaccttataggaactattaatcattctggctttgtgagagaggcatgatgctgcgtgctatctagatttttaaaaggttctgcacatctgctctctagtcagaaaatcactatgataatacaacaaaaaggtcaagaatattttgtaatacagttttatatgaagtttactgaataatctctgagtggtaaagagctggatttgcagctttccttaaattggctaacctcttgaaagtaagagaatgaccaaaaggggtgactatgagccggaatatacaaacacaatggccagaccatatatgaaagtagagctctgacccacctctgcagcaaccagtccagaaagccaaaaaacaaccccatagcaactagctgaaaaacagccagcacttcattgactgacggcttccttaatttttgcgtctgcttgcaacttaggaccaaatgaagaaagtcaaatatgcacacataaccaatcacattggatgtcctggttctagttagcttatctacagcttctccatggcaacagcctccaatcagggcacaaccgaagccttcccctttttccaccgtaaagcttcacactccactgcctgcctttaagtctttgccaaatacaagtgataattcctgactccattgctctgaataaacaacttttacttctcatttgggtggtttatgtttatttctacactcatttacctgatttagctgctgctggaaaacacgatgtttctgttttcacatttcaaatattcttttacacgcatctcattgaatgaaaaatcatactgatgagagacagtctggaaaatgtgcttgtattagtcagggttctccaggaaaacaaaagcaataggagatattttgttagttactataaggaattggctcctccagttatggaggccagcaaatcccaagatctgtagggtgagtcagtaaactggagacccaggatagctgatgttttaatctcagtctgagtctgaaggcctgagaaccaggaatgcccatgtagttccagtctaaaggtcagtggccttgggacccagaaagagcttgatatggtttggctgtgtccccactcaaatttcatcttgaattttagctcccataattcccattttgttttgggaggaacccagtgggaggtaattgaatcatgggggcaggtctttccggtgctgttctcatggtagtgaataagtctcacgagatctgatggttttatagatgggagttcccctgcacaagccctcttgcctgctgccatgtaagatgtgattttgcttctcctttgccttctgccatgattatgaggcctctccagccatgtggaagtgtgagtcctttaaactttcttcctttataaattacccagtctcaggtatgtctttattagtagcatgagaacagactaacatagagctgatattttagtttaagtctaaaggcagaagaaaggccaatattccagtctgaaggctgttaccagaggattctgttccttactcagcgatgtcaaactttttgttctattcatgccttcaactgattaaatgatgcccacccacattaggaaaggccatctgttttactcagtttatcactttaaatgttaatttcacttaaaaacaccctcacagaaacacccagaataatgttggcccaagtatctgagcagcccagggcatagttaagttgacatgtaaaatcaaccatcacagtaatatacaggtgtctagcccctaccacacagaaaagagtggaaacagtgctatcaacggacaatataaagcaggaagtcaaattatctgagataaggaaaaagaggaaatcatggaagaaatttaaatgtggtgacgtgatgatgaatttacttcagatacatttaatttgagatagaatgatacattcaagtaaatatggggaagaagacaatgacactaaatagataaatttgagaatcatacgactatagaagacaagcaaagcatggtgataggagagataccttgttaaagactatagttaaataaaaaaatagcaccgagacctgagttctgagaaattctagtatttagagaccagataggaagataatatagggcaagtggttgagaaggagtagcagagattttttttttttttcaggtagacagggaataaagtgtcttgaaaaacaaatagaggaaatgtttacaaaatctaggtgacacctttatcaaatggtactggggagactaataagttgaatgaatattaacaattatgtttcacaacatggaggtaattactggagttatcaagggctgtttctttagagtagttcaagaaaaagccagcctgatgtggtttgcagagccttcaaacttctggttttaatgctatagtgcactagctatttggataatatctaaaaatgctagaaaaatgtgatagtaatattttttacatgcttgtctgagatggtgtaaaacagaagaaagtagtgaaggccagaaatcaaacaaaaattagataagacctcaacaaagaaaaggataataaacccttataaaagacataaagcatgcacaaccctttggggagatataatatgcttgtgggcagaaagactcaatattgtcaggttgttaaacgtctctaaattaacctataaatttcaatccaaggcacccaaaataaaaatcacaattggacttttttcatagaaactgagaatattattcttaaactcatacggcaacgctaataactaagaattactaaaacaagttttataactaaacagatgtgtattgatgtatgtagccacatatgaatacatggacatagaatgagttcatgtcccttgcagggacagggatgaagctagaaaccatcattctcagcaaactaactcatgaagagaaaaacaaacactgcatgttctcactcataagtgggagttgaacagtgagaacacacggatacagggaggggaacatcacacactggtgcctgtcagggggcagggggcaaggggatgaatagcaataggagaaatacctaatgtagatgatgggttgatgggtgcagcaaaccaacatggcacatgtatacctatgtaacaaacctccaagttctgcacatgtatcccctaacttaaagtataataataaaaaatcatgctatgtggaatatcatacccttcaagtatgtgtatatgtaaattaaaccctaaacattaaacatttcctaagatttatatacatttatgcataaacaataattaaataagacttgtttatgtatacataacacacttgttatgtttatatataacatgcacacacacacatatatttatatatacagagagagaaagagagagagatctgggaggataaacattaaattatgaatgtatttactattagttggaaaatcaaaaattcatttcaaaagaaaacagaaattaaagaaacagacactgaagactaatggatactttaagatgattgtctctgataaaaattattgctaccagaaaagacttgcagatatgcaaaatactagaacacgcttgaatattcatcggatgagccattagcatgggacagctggagaaacagaagatgaataatggaagaatcaaaatccaggaaatatgaagacagattggactttgctgatagcaggatccctgcagtaagtgctgatgctgagaggattttcaaattagtattgagaatgattaagagtcaaactctttggtcaggctgagtctgaatctgaatttcctgctttgcctcttagtagctgtgtaagcctgggaaagttacttacacctttctgtgtgtcaatttcctcattttattaaatagcaataaaaaatataacttgattaggtgagttgttaagaagaccaataaaatgtactttaaagagtttctagcaaaataagtgtttaatattggtggacaattattacaatcctttgttttccacaataaatggtaaggatataagttgaaagaaaaggtaaatgtctttaggagaattaagaaagcaagaagagtggctgaaggaaataataaagaataataataaggaaatatagtttgattgttggacagttccaagggtccaataaaggttgtcaattgagaatctatattttaacaaactgtcttggcattacattatcatacttatgcacagaaaaagatggttacaggtatccaggacatacttatatttagcattccctttgtaccagatcctgttgttaagtgcttcacaaatattacctcatttaacccttaaaaattgctatttgtaaaacaagtacttccaggttcaccttcctaacaaataaaacatatattgagtatctcccaaaaaaagtaggtaattaagcagagaatgtcatgaatagaccactgctatattttaatgtttgaatggataatgacccttataatataatgacccatttatccattcaaacactaaaatatagtcgcaacaattctttcaaagtttaaggagacttttttgtttgaaacccttccatgactcctcctagtattcaaaattccataccataataagccttacaaaccctacatgatctggcatcctgctaagtctctgacctcacccccctgccttcactcactgcattccagccatactagtgttgctacaccttgagtattgcaaagatatatgccatcctcagggactgaaaacacaatttctgttaatattctggcaacaagtttaatgcagttaaagcataagtgaactaaatggaaattaataaaaagaaatagagagcttattagaataattatgtctttaaggtaaattattctccattgtatttaaagtgtttattattttattgcactgcaaaatatataaactctgcagattaaagaatatctaactggaaattgcattaattctgcttctccagtcttgtagctggtgcacaaaaatatgcatcattgcatcactaaggagattcaataatttccaaaattatttgacctcagaacacatctcatagaataatatttctcagaaacatttttggaaatgcactaggagacgaagttcttctgccatctttgttccttactttgatttaaattataacactacataagccaaagacatagttctcattcagtaaaatttcctaaaacaaacttatagaagactaatcagatagcaatttctgagaaagctatgatatacaatataaatatattggaccgattcattgagaatgattagaattaaacagaatgataacactcaacatagtttataatgaatcacatttgcaaatcatgacattataataatactccgaatcaccatgctaatttagacaggtaggcatatatccttaaaatggttcttatatatatcaaatatgtgttgtatttctagctactaagaatgacataaaacaaatgtttgaaagtatatcacggtctgatgaagcttcgttttcaatataaataaatattacagcagtttgctttaaaaaatttagatgaaaactatgttctttgaagtaaaattgatgagtgaaaagtttcaatcttgaaagtattaaaaatattcatgaactgtctactgatcgaattctctctgaagtatagtccttcaaacaccttctgtcatgcatttcatccaaccagatgtgtaagctcaagaccatgaaaagaaagggagaaagctcataatgctttgctgccactatagcacgcagccatctgtgaagccttgttttaacattattgcttcagtgggtgtttatctttgcataaaaaagtttagactgatatattcccatgtctttgcacacactaaacacttacatttgtagtaaaggggaatcttattttagtttttaacagaatcgtaaatccagaagggacataagagaagagctgggtttagatggaagttttctgtccccagctcaatgctttctccattaagccatcattccaatgataccaagcacattgtattctaagaaaatggaacaaactctctaacctgccccactatctagttttagtggcataaatactttgtgggcaacaaaggaaatgaaataaagagggtgaggagaaaggggaggcatcaaaattcagagctgatgctttagaacctcttcagcaatgccatatttgttaaatgcaagcagataaaaacatgccacattttaaagccaatttgtgcctctagagacaagaattataaagtctattgatcagaatgaggtaatgttagaagggaattaattattttagctgatgccaaatatacataaaattcttagcatacttttaaataccaatattaaagcaaaattaatgtgagcacatacttttatatagtaggaagcaatattcttttaaaacttagagaaaggtggccgggtgcggtggctcacgcctgtaatcccagcactttgggaggccgaggcgggcagattacctgaggtcaggagttcgagaccagcctgactaacatggtgaaaccccgtctctactaaaaatacaaaaaaaaattagtcgagtgtagtggtgggcacctgtgatctcagctaccagggaggctgaggcaggagaatcgcttgaatccgggaagcggaggtagcagtgagccgagatcacgccattgcacactccaacctaggcaacagtgcgagactctatctcaaaaaaattagagaaaggtaattaaaaatcactaccataaaactgacataagtatcacaatttttatttttatttagtacttatatttattccttcattttagtaaataaaattgcctatatagtttgcataaatttattcacatcttcaatcttgctgacactttttttcctgttggcctcatattccttttctgcaaattttctcacagcaaaatctggaaatatagcccttaaagttaggtggtgccactttatcacacaaatgtacattaaatagttcaaaactatgttcctttaatctaatatacaaattgtatactgattgtaagagattctgagttaatttaaacattgcgattaatagtgtataaccactgatgagtaagactctttgttgaagtaaacaagtttgatttcagagattattgaattttacgaacatttgttcatgaatcaatatttggccattatgtaagttgtatttttttagaagattaattgagctgattaagccatcttgtttaaactgaatttggaggttaattctgaatctcttgtgtttcaaaatcacaacaatgttatccattattttgttataatccagactatattttaacacatctttcaacttaattgctaatttaatttgaattttaaatattaactttcccatcaaaaaaactttatctgcctttccaagatttaatcactagatgcataacatttttccccaagggttgatacaagctgtcttacaaattagcctacccttgtcccatgtggataatagtgtatttattagaaactatggtcagatcttgtatgctgcccaacaatactgctttaaatagatatataagctatctctttgctcaaaatgaagatgtgttccaataagattcctttgatgaatgcctacagaacatttaagaaatgagtgattgtatattagccaagtgctcaccatcacggaggatggaatgcaattacctgggaacctggaatgatagaaggtttgattttctaataagctagaaggctagtaaagcataaaatttctagcatggttggaaagcttaaagagagcttacacaaatcaaattaataacatttaaatacaaatacattaatgtgcaaggaattgactgcacactttgcaaatatttaacttcatttattctaaatatacagatagatttgactttttagcagttttcattgagtagtttatgaattctaagattatttccaactatgggattatttccaggcacttctttattcctaattggttttaaatacattacaaaaaatatttcataaaatcaactagatatagtaggcatctatcttccaataatagctagatttgactcagacttgatagtttacaaagtattttacaatataccattaaatttgtatttgagtgaacattgtataaccaccagtctatcgaattttaaaatacctaatattcttttccaaatagtatttcatatggagatttttcaaaaaaataactgtggctatggataacaatagaatgtgtgtgtgtgtgtgtgtgtgtgtgtgtgtgtgtgttatgtttggaaacactaaggatatgtgtcaacaccaatcatatgttcactgtattaaaaaattagaatatttggtcttgacagcaacctcggtcatattccaaattccattttttattatgcttgaagattaaaagctgattaattagattttaagttatttaagggatggctcaaagatgatttataaccccaactctatttcaatgacataaacaccggctacttgataaaccttgatattggcaacattaaaaatgacattggtaaatactattatgagcaaatctaccaatgacttgaatttttttaaagacatgcatattttaagcattcaaatatatttctacacaaaatatttatctgcactgttactttgataacatgaataaaagcaccaacatttatactaacatctctcttctctgaactaattgcacaaaccacatgaaaaattaaattagacaattatataattagaatgtgatcacaattctctgttttatttacttttatttatttatttagagacagagtttcagtctttcacccaggctggagagaagtggcgtgatctcggctcactgcaacatctgccccccaggctcaagtgattctcctgcttcagcctccggagtagctgggattataggcacttgccaccatgccgggctaatttttgtatttttagtagagacgggatttcaccatgttggccaggctggtcaggatgaacaacctgcctcggcctcccaaaatgccaggattacagatgtgagccactgcacacagtcagctgtttttttacattattttacattggtattttcctacttaactaattatgttttgctaaatatttatatatattatataattatatatgtaaatatataatatataaatgtatattatgtataaatacattatatattatgtatactatttatatattaattatgtgtgtgtatatatctatatatatataaaattatattatagtcccaatagttttaccatatgggaattgataaaatgtttatctcttcatagaaaagggaatctctcagaccaggtgttttcaagattttgttgttttgctttgtaatcacttcaatctttgttattcattaatcttctccctatgatttaaaaccatagtcagcactgattgcaccagagtctacaattgcttaaaattcagatttaagtagagtcatgactatgatattttttgcttttgctctaacattgtgaatcacaatttgttagtttctaaaccaaaataacagatgactttgagtggaacaatccttgctccataaaaatagtctgctgcagtgaatagtaattcgtcaacttctctctaccattgctggagtgaagggtatgagggagcatagtagagatggccttgcttttgagttgagagtgaaaaatttcagtgtgaacacagaatcaaactttcccacttattactgaaaaagagaaagtgtgtgtgtgtgtgtgtgtgtgtgtgtgagagagagagagacaaagacagagagagagagagaaagagacctctttacagaccctatatggaagatctgttttgttttgttttgtttttccatttaactctttcatgaccacatgggtggcctttggtttgtaacttggatatggatgttgtttgtcattgcactttgtattttatagcagtagctcattactcatgagaacacgtgaagttcttattgaaaaacagtttttaaaaattcacttaagtctattttgcagaatgtcattttgtgcatattttccaatttaatagttgcatctggccggtaactttggctaaaattatttttggactaaagtatcctgtatatactgtgatacggtctggctgtgttccctcccaaatctcatcttcatttgtagttccagtttcccccatctgttttcatgatactgggtgagttatcatagatctgatggttttataagggctttccccccttttgctctgcacttctccttgctgtcaccatgtgaagaagaatgtgttcacttccccttccgccatgattgtaagtttcctgaagcttccccagccctgaagaactgtgacacaattaaacctctttcctttataaattacccagtctcaggtatgtccttatagcagtgtgagaatggactaacatgtgctgagtaaaatttttaatatagagaaaagtaaaaataaaagccatcaaaacttttaaatgtgaaatttcatgccagtgatctaaacagtttgagaaaattctgtcttggtgtctcattgaggcaaaagaataactaacatgattattttaatagattattttgacataattcattctaaccaaagtacatgtttacaaaaatcttctttataaaataatttaaaagaactgataatcacaagacagattactaataatttttaaagttttatgtaaaaagttattttattcaaaagtattaaggcagttacttgggcagtgaatctaattttgctttaaaaataacggaaaattacattttactggaaaataaattgggaaagagacttttcagtactcttacattcattagtttaaagaaagaagatgttaaaaagaaaaaagttgcctctaaactaaaaaattgcctcagcttcccaaagttctagaattacaggtgcgagccactgttcctggcctagattttttttattctgttttttttttttctctgatcattattgcctctaaatattaaaataaaatgttgtttagttagaatatatgactggttgtgaataggtgcttggtttagtactacagattttaaattagtatttagatattaaccaacatttttatacatgtttattttttaaagtgattttatggagcttgatatgagtagcaaaatcacatggcaatgatctcaaaattgaattttgttttaagaatctcatgtcaatataaataatctttcaacccataaatgtcaatgaagaaagtgggatcaaagagtatattatctgggttatgttataattacaagagacagaattacaacttgctgttttaaatttcaatatgtatgttgtatatgtacgtaatgtaaactgataaagaagtatcaaatcaattttcaatacaaatggctaaatcaaaataagctacatatttatggagggattaaaggattaaaagcaatgaacaaacatggaataccttcaaatttaatagttaagaaagaccatcaaataaaatttacaaagaccaattatttcatgactattatggaagatccagtgctgaatacaagattagataattatgcaagattatacaagatttgatgctgattgatgaaatagttacacttgtatacactagcattgctgttgaaccattttagtatttatattatttagcaaacttataagcatcttggcaaacctttttagatttgtaaaaaatttaattaaaaaatattttaacttttttttgttgttttttttttgagatagagtctggatctgtcacccaggctggagtgtagtggcgtgatcatgactcactgcagcctgtacttcacaggctcaagcgatcctccacttcagtctcttgagtaactgggaccacaggagcacatgactacatctgtctagtttttttttttttttttttaatatatagggacagggttttgccatattgcccaggttgttgttaaattcctgctcaagctatctgcttacctcagcctccaaaaattctgggattctcccaaagttcagcctataatttttttttttttaattctaggttttatatctggtcattaattacattgaaaatgcataattttcaaaatggcaaaactgtgactctgtaaatataaaataaacatatgtcattcattttatttaactcactgattaatgtgaatataaatgaaataagtcaattcaaatgagaatttgacttacaaagagttttattctccactagacaacattcatttgtatttttttatttttttaatacaacttgatcttttttttgtttgttttttgttttttgagacagagccttgctctgttgtccagactgtcaagatcttggctcactgcaacttctgcctcctgggttcaagagattctcatgcctcagcctcctgagtaactgggattacaggcgcctgctaccatgcccagctacttttgtatttttagtagagatggggtttcaccctgttggccggggcggtcttgaaatactgacctcaagtgatctacccacattgacctcccaaagtgctgggactacaggcatgagcgaccacacccggccattcatttacactttaatgaagaaaaagtatcttcatggctaggagcaggcagcatttgccgttaagttttctacaactctactactccttcagagttataaatagcttaatcaatctaaaacaactaaaggtacacacttctatagaatcagaaggttcactagacaatgtcgagaatgccactacgaaaaaactgccagtcatctcttctgcctgtttcaagtctgacaaattttgctgactgtaactcccactcctctttataggtcttatctacttcctgccactgtatgcatattcttatgcaaaatgttctttatagagttgagctcatctagtatagccaattttaaatttcactatttccacagatattttcatatcattaggaaatccttagaaagatttcaatggctgcatgatatgaatctactaaaaactatataagccctcttctaatgttggtcatagagggtattcaagtgtttgctatcttaaatggatctgagaacagcactatacataccatattcaactacaaaataaattttaataatattacagtaatgaatgttttataatacttctagaattagatctatgtagataaaatatgttcctgattacttgtatgtgtgtgtgtatgtatgtgaatgtttgcatgcctacttttaatattagtgtatatagtgtctgtattgtattgggattattggattttgtattatctaatatgataggcaaaatacaacacttgaaaaagttgtatttatgcaataactgaaatggaaaatattttatatatttatgtgccatttgaactttttactttgaaaattgtctgtatcttttggaattttgttgttgttattcttttcaggttaagggaatcaaatgtaattggttatagtgacaatgttgcaatttgcctaagccctgtactccctgaaacagagaaggtcaagaaatcttcctaatccttttgtgatttgggcaacagcttctgaaacactcttcccaatatgatttaaacagatacagaggcctccttatttaccttgacaaggctagatagactctccaaattcccattctttatctcataaatggttggctgagctgttttctccactgacaaatttagataaaacttaatcaaactttagtcagacttctctccttcacccaggcccctgaactttgacccacactttggtatatagtttattcttaaattataaaaatagtggtgttatctgctactaacaaactacaaaagtgaaaatgtccaaagaactattctacaaataagtaatgtgacatgatcatacttaatgcagaatttattgataaagaaagatacttatgtaaggaaatgaaatatattttcattatttgtgattatttaaattttagtttgctaaattgaaggtaaattccataaacctgtattcactgaatcaattaggttatcaattatggcaacttctttttctaattattatttttataggacattaaaaaattgcaacttgtcaaagcttttaataactgaattaagtcatttcataataactgtagacttctgtagacccagcacagtagtacctcttgaaaagtaaatgtacacttttatttttaagttgtactgcaaaggaactatccaatggaagtttccacagcgattcaatctgttcctttatcccaatccatttccaagaaattctgtatctgtctgattcccggcacttatctccacctcttctctatgattgtatcctttccaatttgaacccgatgatctaaattcatgcttctccttatgaactcacttcaatattctgcaactgttctacactataagatttgctgagtattaaacccaccctatgaagccctgcttcagcattctctggatacaaatacacagacaattcaactcaaacttgctcaaagactaactcagttttatgcctgaggaaggaggtgtgctcctgatgttctgtagcacagtggttcccaacctttttggcacctgggaccagtttcctggaagacaatttttccaccagatgggaggggagggtggtttcaggatgaaagtgttccacctcagatcatcaggcattagatccctcacatgcgcagttcaaatagggtttgagcaccagtgaggctctaatgcgcccctgacctgacaggaggcaaagctcaggcagtaatgctctctcaccctcccctcacctcctgccgtgaggcctggttcctaaatggacacaaaccggcactggtccctggcccaggggctgaggacgcttgctgtagcagatattcctggactaatagatcttactacaataatctgtatctaattttatagcaggcaatgtattaactaaacctaatgcagagacataaagctatatcaccaaatgcccatggggagaactggagatgcagtatgtttcctatataaactattttaaaatactttggctctactttgttatgctctataccagaatttggcaaactgcagcctgaacccatatatgcctgccttcctgttttggtaaataaaattttatgagactacacctctgctcattactgctgtgtgtagctgcttttgtgcttgtagctgtttagttgctatgaagaccttatctgttgtattcctagggctgtctttaagaacatgtgcccagtgcactcccacagggtaccacacagagaagggcttatatttaaggtctcattttctgcaattacgttattgaaattcttaaaacattcatttttgaattagtgtttataaagtctgctgggataacatatgatatactgggggcttaatgcctcagctcatatgtttttccaacctgactttctcctcaggaagaatttttctgacagcttctcccagtcaaccctgtctgcctatccttgtccttcctgatctggttcaatggctgccgcccattggccagaacagttacagattacattagtcagggagatcgatgttccaccatacagatgtcctggtctggaatgcagggagcattgggctctggagttggccagaaatgtctcagggaggggcaaggtggcaaccatcctccctggaccagtggtacagtgaattccccaaatgactagacagatgctttttgtccactcccatccattatttttcactgagcccttttgtagctgaacctgtttttcccctaagcctgtcagaagttagtatctgactctactatatcttttttttttttttttttttttttttttttttttttttttttggggataagaccatctttatttcccagtctttgtctaggtttctactattctattttctccatgcaacatatctttgaacagcttagactggtcagatatctgcaagattgctttttttttttttttttgcttctgagagttgttttttatttatttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgacaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggtcatgaacagacacttctcaaaagaagacatttatgcagccaaaaaacacatgaagaaatgctcatcatcactggccatcagagaaatgcaaatcaaaaccactatgagatactatatctttctgatcagggagaaacctcaaggcaaaatggattcagattccagacttacctcttatctccttatctttcatggcatctcaaacttgttatctcgactactttgctagctttatgttgtctttaaagattgcttttacatttatttggaactttttcagtgaccctaagcaaaagtgatccatctttattagaagtaagaatccactaactaagaaataaacattgttctctcaagttgttcaagacattttaacaggagtttatttttaaaaatcttgtaatcattatacttaacatgaaaatgaaattggcttgatgattcaaattattttaaataattttactttaaactgcaatttttttttcaaatattgcacaaactaccaattcagtaggtaccatttgaagacctgctgaatttctcatatatcgagaatgacactatacacatagctgaagctgaaattttcaatttattaatcatgtgcagatgcattctctctggcaatttaatttatttaatgcccaggaacaaatggataagatgtttatgtgtcatattaatggggacatagcatctttctcacaaggggttcaaaccatttttaaatttaatttactctcaaactgtgatgatactaatgtaattatctttcatattagagctaagattcaaaataaaaggggtaaccaaaattgccagaaattatgagattcaaatttgtgatcagaggcaaaagcctttcagttctaaggtacttattttaaacaataaagccaaatatcgaggaaattgcattaatgaaaaatatattcactatctgttgtttcttttaaatgaagaattgattcaaatcggcactttggttttgggaacaaggtattggagttagaatctcacctgaatttatatgatgcaagtgatggcagattaattcattgtttttaagtttctatgtccacagctctactgaaatcattctgacaaaaatcattagaaaaatataaattcacttctatagtgatatcctcctaaaatgataacctgacatgtcttatttttgccaagtggcttcatctgaaacagcatattgtaatgtgaaaaggattcagtaatcagaaacagtttagaaatgtcagtgtaggcaacagaagatcacagcaatctatcactgaggttcctttcatgggatataggatagatcataatgttttgttcaataaaaggaaaatgtaaaactgtagaaacatgaaaacaaagtgataaacaggaagctatgtccagcatctaaaacaagaatctggattatactcctgtcaatacttttgtctaaaacgagcacagagaattcaatgatttatatcttagagtgatattgtactattgagggaaatcatattaataggaaaaaaaagtttacctatgagacttttgttattgttaatttgatgaaaatttaccagttccttcattaagattaacacttagaaatcttgcttgtaaaaacaaattaaaacaaaacaaacaaaaacatctctaaaacaccttaataatcttttataaaataatgatgagttatatgtagttaatttttgccaacgtattagaacatgaggtgttctgtactcctttttaagcaattgataatgtccaaatctcaagctgatttttacatttaaataaaggaagttatttattattacatactcatattcattaatcaaaatatataaaatatttaaaaaatatgtcaatggaaagaaacctttctgttataaacttcatatatgtgtccttctaaaattcacaagatgaaattccaactacccatgtgacattaggaagtggtacctttgagaggtaattgggtcatgagggctctgcctttatgagagaaactccagaaaattcactagttctctttttgccatgtaaggatatgagaagacggcaattggcaatctgaagcattccatcaccaggatcctatcgtcctgtcactggatctctgtcttctagcctctggaactgtgttaaatttttgttgtttataagccatccaggctatggtacttgttatagtagcccacagatacaaagatactttccctttcctgtgagggtttttcaaagatttagtatccgcatgatatgttctaacacctatcaagcaattatttgactacatttttattattgtatctttgaacaagaaattaattaaacaatctctttcctgaactttctctcaacctccttctttattttttggcttgcttttatactgatatcagccaagaaaatattcccttttcttttaagaatccttccctagcccatcttgttttgaaagatgcttttcctatatgttcactctattacagtttccataactttgtcattgtatgccatatttgcctacttagctatctgccttctacagtaattactatacaccacttttactttctatcctcttcaccatttcccccagacacaagactgagtacttcacattttgcaggtactcagttgaatagataaagtcctcagttaaaaatagcaatgccctatcagaaagattactaagtgaatgacggccttctgttccctgattcataaaatggcacaaaggctaattacagaaagcaatgtctagccaagaaggagtagaaggctttaagtcagtgcatacagtgtaccacaattaaagttagaagtatcccagttttgtctggtatcagccctgatctcaacatatatttcactacaaaactcttaatttgcacaattatgcattcatatgttgttttcaatttcttcttggtcataaaaatattgattttgtactgtaactttacacaaggaaaaaaaaaaagaaacaattcaaattgtacctggtgtaattatattccaaagactgtttcaaagcaaatttcagagcacaaacccaagatgatcatcaggctatagaatgtgatagttacagtcactatcaatcaaaagtaataaaagtgatttctgaccaaataataaaatttatgttttcattatctttatggtacacttaaaacgaccatgaaataaactaattcattctactttgtgaaataaactgaatttacttcacaccattactagcaattctactttaatagatttataaattaccaaataacattcctgaaggtgtagtaagaaataaatttaccacctagagttttatttcttctcttatcttttacaatgcatatgactgcttaaatgatctatttagccctttactttattttttcactatatattagttcatattacttagcaatatacttttattattatacatttattcaagaaaaatgtttatatatttaattttcactttgcataaaactacatttgacacttttattaaaaacattcatattgtaatttaattttactttgaagttgtgattacttacagaagctggttcaaatattttttagtcttaaaacactcacacttcattattgtctagccgaattttgttggcaaattaataactgtttcttactttcgtaattagtttttgggactctaatttacattttagaattgaactgtctgagacaataatgaatagtcactattagacatgtaaaatttgagtagttcaaattcaggtgtgctgtaagtataaaaaatgcagattttcaaaaacagtaaaaagatgaatactgtaaaatatctcaataaggcaattgaaacttttaaaatatattggagtcaatcaaatatataattaaaattaattttacctttattttcacttttttaacatggctactagaaattttaaaattgcataaatagcttgcctttgtggctcacattatatttcctttggtctgtgctgttctagctttgctcaatggtccttctgcatattgttgccctcatttttctttcaatctttaactattttgtttttccacctgaaaaatactgttttagggggtcattttcacattattggtaccaacctataatacttaaactcttaagttgggtgcagtggcacacacctgtagtcctagctgttcagaaggctgaggcaggaggattgcttgagaccaggagtttgaggacagcctgggcaacatagaaagaccccatttatttttaaaaatatatgcataactgaactcataaaatttcccttacagctttactatttaatatgtggaggagactgctgggtttgtgtgtgtgtgtgtgtgtgtgtatgtgtgactaagagagaattttgaaggactaacatgtgtcagatcctcttttagtgatattacatgagatgtctcattttaattaaagtccatgtaagagagatatcattcctattttacagacagagaaagaatcttgaggaagattgagtaacttgtccagtatgtgcttctctaaagaaaacattatcttaattgatgaaatctttacaataccatattataataatgtaggtattttcagaaaaaaatattagcaatattagttccacgggcattataaattttaatatcctcaaaattttcttgtaatatgtctttagttttttcaggtgtaccttgacttaattttgcaacaattcacttaaggttgctggtacttttatcttgtccaatgttactgtcttttcatatgaattctatataacttaatgaatatgaaccttaaagtgttttaaaattgtctctaatatcacatgtacttaattcttaggataatttggataataaaagtagaaaacaaataccattatttgtatcataacagtatatggtaataatatatgtcatagatctggtttcagtatattaagaactgttttgaaatcaatataaagagattttagtcattaaaaatgtacagatggtatagttatggtaaattgttgatattccaaagtaaattataacaagaattataacaatgtcgcaagatccttcgggtgtcacttcaccagccagacacctctgtggccagtaaagcctctgcttgagatttgctggcacctgctaggcttgctccgcccacccagcccagcaggcttcactcatctcacgctgccagcccagatcccacacctgccaaggctgagccaggtgcagagtggtgaggagtgtgtgcgtgaaagagtgcagggtccagccactgcatacaggcaggcatgccagctactgctactgcagtggggcaggcagctccaggcgctggcacaggtgcgagtttgtgtgaggctaaagctggaccagacatacaacatgccacaagcagtctctgctgcaggcaccagcatccagaggaggagaacgcagtggcaactgagagctcaaagatgccaggaactgcggagccccaaagagggtgttacaacatgtcacagccctggcttgtggagctctgaggtctgggctcccagaactgccactctttactcttacagtctgggagtgcgtcaccacctgcagctcagcaagccagccaggaacatgttacagctcctttcactcccgaggtttggtgggtcctgagttcttttcctgaatccaagaaggatgaggttacactgacaactggagggttagcaaaaggcagagaggagttttattgagtgacagaatagctctcaggagacccaaaatgggtcctttccacagacaggtctttgtgtagaggagacccgaagtgggtagctcctatctgcagggaggtcatcaggaagagtgtctgaatctggctgagtcctggggtttttatgagctcacaagcgaggaaatccatgctgattggttcatgggtggccatgggaggacctggaaaaagtaccataagttctcactctggtcacagactccacccagaactggcatccgagcccccaggcttcaggctgtccattgctcttgcttgaaggtggggtttcactggggaccttctttcctgcctagaaacctgtctgcctcctactgccatcaacatgccatccagcgtgcccaggctgtctgtgccaaggggcaactgcaggccagcaccaagctgacctcagacacctggcctccctcccaagctcaccagcacccaaagcctggagggggtcaaggcggcagtaggggtggtatgtcagtgcagccttgagtgtgtgcacagcaggctggcttatgacggtgcctgggctcggccacaactttgctctgcactggagcaggcattgggagtgcggagaggccagagaccaggagcaggcacttacgaacctgcaggggcagggggtttcccaggatcccaagagcacaaggatatctgggtcaggagccacagctgggtggctgccgctgcacctgggaacactgggcagcccctgccagctccacagattgcacatccccagtcaagcctcctccactgcagctggcttccatgtagtagctgttccagatgggccaccactgccaccaacaagatgaacaacaagaatacagcaagaaacacaacttcggatatagcaaaaagaaaaatgggactgaaagaaattacctttctacttgaccccaagatgcactgtcatgtcatttattctgcaaatgcatcagcctggcctatgtctggagaacacacagaggataattctaacaatgtcaaatctaggtaagttctacactgttttgctccgtaactccagaagagtcacaacctcaccatatcctagtttccttaattataatgagagagtttgatgaaatggaagattttaaacaatctcccacttttaataatatcacagtcctttaaaatctgtttagaaacatcaaagttaatattatacaaaatccataaaacatgaaatagaataaagagagaagctataataaataaaaacctaaggaaaataaataaaagcaggccaggtgcagtggctcatgcctgtaatcccaacactttgagaggctgatgatgtgggcagatcacttgaggccaggaatttgaaatcagtctttagttcttttctggccaacatggcaaaaccccatttctgctaaaaatacaaaaattagctgggcatggtggcttatcctggaatcccagatactacaaaggctgaggcacaagaactgctcgaacctgggaggccaaggttgcagtgagctgagatcacgtcactgcactccagcctgtgcaagagtaagcactatctcaaaaagagaaaaaaagaaaagaaagaaaagaaaaaaaattttttttggctactcccaatagattttgcatgtaactactggttgtttttctgcaggtacagaaatgattgccacatattcactccccaagattaggctgtaaggtttttcatgggcataaatataatttttcatctttgcgtcttaataaccaaacccaaacaggaataactcaatctcagttaactattaataaagtaagaagaaatactatgtttttactatagtttacatcatcaaataaagtatacagttgagcgatcttctgaataattatcatttaaataccatgtttaattatttcattaaatgtatctctgatattttgatacactaataatatagttataaaacttttccaataaagttgtccaatttttgaatttatggtactgaaaattactttatagctaatttttgatgtatattttagcttgtacctttcaagcagcattaatttagaatttacagtcctttgaattttaaaaattagttcaaagatttttattgcagtcttacttaaaatactttctagtttctttaaaatatttcaaacactttgaagacatttttttcaaaggatattaaagaatgtatttcagttttagtttatgttttgtcaaatatttataatgatcaatgatcatatcctatattatatctattactcaaaacattgacaaactataatctgcatttactaatatactaagatgctaatattcattcattcatactaagctatgtcaatcactataatacttgtaataataatatttatacttatatttatattataaaatataattataatatattataattatatacaattattatatataatatataacatataacatattattaatataacatataataatatataatatattattaatataacatataatatgttatatattgtatataatataacataaaataatacattattatatattgtatataatatataacataattatataataacaatattcaaaacttgtatatattgcaggacacaaataaaggtgttagactgttcttggtgtccattattttgtaactttcacttcaaaaatacgtgtgtgtatgtggtgtacgtgtgtgtatttaagcaagacttttactcattgtatagaaaatattgttcaacatgcactgaaatgatggcatgcatctctgccatccaaaggcagacataattctgcatgtctttcacatattttattctttctgaagaatctaaaagcacacaacttttaagttaaagcatattaaatggatatatataatgaatatgcgtaatataatgaatatacaaagtacaacatttacattaaagagtataaagtgagtatgtatattattatatatactggtcccatacacagtatcttcttattctatgggtacatccatgtcattatattttttaaagctttccagttgttgtaagttgcagagagatttgacaaccaatggtctagccataatcttcaagcctgaagatttttttttaaagacctattggtactttgttattttttcatcatctcttattttgattgttgctaccttggataattcacagatattctcagattaaaagttgtttgctcttgaatttactctgtatcttgcggacaatactaatgaaaatgtgattggaaagacccagagcatcaatgttatctcctgccaaggctgacaatcaactttgcccccagtggcatttatttttctacaggcaagttgggacccacatcttagactgccatccataggcagagataatttaaaactccatgttggatattttcatgtaagctctactattaacattacactctataacacaaaattggcttaggcaaacactttccattaaccaaacctaaacctttaatgctcccaattagctgaagagacttcttgagtcaccatttacttctctctcaagggtccctctattagttctatttctcaaatatttatagtgcagtcccccttttctatttcatttgtcattgaattcagaccctcattatctcttacattttttgttgacctaattgttcactcccaggtgtatcacattcgtgtgtctcattttgcttttccaatgggtaatggtatgtattaaatggtatcttttagatatattcaaaaggtaatgtaacagttttatttttaagtgtcaacatgtacaatgttttagaaattaccacctttgaaatatttaaactaataaatattagatggcatcttaaaaatatgtagggctgtcaacggtttttcaaaatacttttgggggttagaaatgcaaaagcaatgaaaaccactactctacttctattacaaatcttttaagatacatgttattataaccttgaaagtgctgattcataccatgaatattatttagttaatattaataagcagaattttatataacatttaatatttttatcagaaagtaattttctaaattaaatggttataaaaatacagtattttaatgtaaatattttacaatatcctaatttctccaccaactttttcattgtaaaattttttgtatattatataaacatgctatatatgtatataataatttttgtatataataattacagaaaattaccatatacaccatatacacatatagcatgcatgtttagtaaagacaagaaaaaattagcctactatctgactactatatttcctctggaagaagctatgtttgttcaagaggcaatttgacattttatatttgcaaaagcttatcagcaaatatcaggaacaaacatcagatgtgagctagcaaagacaagaaaacatcaaattcgaatgaggcagcttaataataaaacatatagcagggtacatatcacccatggggtcatagccaaacaatttgaagaggaagagttaatatattttaatagtcacctataacttattgtagtgtattcccatactgttatccaaaatttgtagttaacataaggacagaatggaaagaatgaaaggacagaatggaaagaatgaaataagtgaaaaaacccctgaaatattagaaatcttccaaatttaataaacataggtatcttgaagtaggtataccatgttctctggacctccacatagcaagaccctggagatagttggtcagggtgctcaatttcccaaaatatataaagtttgaggcaattttattttaaatttcacagggacagaatgccttcagtagatatgacttatatataattagcctgactgaaatgaaatgaaataaatactgtgttaattaagttaattttatttctatagtctgttgtaaaagtttcctttggtaactgttaaaaatgtgttgtgattttaacagtcctctgcatgaagtacagtttaaataattttgtaaaaatgtgatattaattggctaagacttccaaagcaattataatatctgtgggtggtttgaagctgatactgatcattgatgcttcatgaagtttaataaaatggtactttttttgcctgaatacattctaagccagtgagccatgtagtaccactttttcagcaacacttacagaattcatacaatgttagttctagaaagaattaagtatcctttcatccaactgcttctttttactgataaagaaattgcagtcgagagaatttgaataaattgttcaaacaattatataacaagccctggcttgtgagacaatcttgaatttatgtctccagcttcctagtttagtacatactcatttcaacacaaaacactgccaaggttttagtgaaaaagatatcagtaattcattaccaattatacaagttgcaaaattaaatcaaaatatctcagaaattcagtagaatattcaataattatttcaagttcattactaaatatgtagtcatattacagagtaattgcaggagaaaattaatataaaactatgttatattttttatttttgttaatttaatattcagctacattttcatgtatgatcaaaatttatttgttatagaaaaccattcaatttcagcaatattttataaagcatagtatctcttcggaaatatataacaaaattaagactatcaatctccaaaagttaattctgcagttttttttatctaaagaaaaccccactttccaattgacaaccattatgacattgtacacagagaatataaaaatttagttaactaatgcatggcacttaaaactgtgaatcagattcaggtttgctatgaagttagagtaggtagataggcagataatagtagggcaggatagtgccccaagtaatgtcaggtgactgtcttgtaattgtcaggtggccccttaattgtgggccacaactcccaataaaatcctaagaattgagcaaacatgtggcagatgacatgattgtatatttagaaaaccccatcgtctcagcccaaaatctccttaagcttatgagcaacttcagcaaagtgtcaaggtacaaaatcaatgtgcaaaaatcacaaacaatcttatacaccaataatagagagccaaatcatgagtgaactcccattcacaattgctacaaagagaataaaaatacctaggaatacaacttacaagggatgtgaaggaccgcttcagggagaactacaaaccactgctcaaggaaatgagagaggacacaaacaaatggaaaaacattgcgtgctcatagataggaataaccaatattgaaaaaatggccatactgcccaaagtaatttatagattcaatgttatccccattaagtaatcattgactttcttcaaagagttagaaaaaaactacattaaatttcatatggaaccaaaaaagagcccatatagccaagacaatcctaagcaaaaagaacaaagtgggaggcatcatgctccctgacttcaaactatcctacaagcctacagtaacgaaaatagcatggtaccggtaccaaaacagatatacagagcaatggaacagaacagaggcctcagaagtaatgccacacatctacagtcatctgatctttgacaaacctgacaaaaacaggcaatggggaaaggattccctatttaataaatggtgttgggaaaactggctagccatatgcagaaaactgaaactggaccccttccttacaccttatacaaaaattaactcaagatggattaaagcttttaacataagacctaaaaccataaaaaccctagaagaaaacctaggcattaccattcaggacatagggatgggcaaagacttcacgacttttaaaacaccaaaagcaatggcaacaaaagccaaaattgacaaatgggatctaattaaactaaagagcttctgcacagcaaaagaaacgatcatcacagtgaacaggcaacccacagaatgggagaaatttttctcaatctatccatctgacaaagggataatatccagaatctacaaggaacttaaacaaatttaaaagaaacaaacaaccccattaaaaagtgggtgaacggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggtgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaagtgggtgaaggatatgaacagacacttctcaaaagaagacatttatgtggccaacaaacatatgaaaaaaagctcaccatcactggtcattagataaatgcaaatcaaaaccacaatgagataccatcttacgccagttagaatggcgatcattaaaaagtcaggaaacaacagatgctggagaggatatggaggaataggaatgcttttacactgttggtgggagtataaattagtgcaaccattgtggaagacagtgtggcaattcctcaaggatctagaaccagaaataccatttgactcagcaatcccattactgggtatatacccaaaggattatatatcatgctactataaagacacatacacatgtatgtttattgtggcactgttcacaatagcaaagacttggaaccaacccaaatgcctatcagtgataggctggataaagaaaatgcggcacatatacaacatggaacactatgcagccataaaaaaggactagttcatgtcctttgtagggacatggatgaagctggaaaccatcattctcagcaaactaacacaggaacagaaaaccaaacaccacatgttctcactcataagtgggagttgaacaattagaacatacggacacagggaggggaacatcacacaccagggcctgttgtggggtggggggctagaggagtgatagcattcagagaaatacctaatgtagatgatgggttgatgggtacagcaaaccaccatggcatgtgtatacctatgtaacaaacctgtacattctgcacatgtatcccagaactgaaagtattaaaaaaaaaaagaattgagcaaacatattcaggcatggccagtaaagggcaaaatgttggaatttgactttccttggggacatgtataggtgtttacagtaagggtcaaaatggtggagtttgaccttccaccagatgcactagactggtaagggaaaatttccccaagagagcatgcctgtaacttcaaccaccaagtggcgcactcagctcctccagtatactggcaagtcactgagcatgcggtgattagccaacagctcacacaaggggaaggatgaggggacaagacctcgaaaaaaaaaagaacaggaaataacaattctttaagagccttgaaccaacaatcaggtagggcactcaatctgttgagttgcccacttggtttcttccaagtgtgtttttctttgcatcagtaaactctcatttctgccttaaatctacttttgtgtgttggctgaattctttctctgaacaagacaagaattgaggactgcagagtctacccagacttgccaccagtaacaaaagttaaaaaacaaaaacaaacaaacaaaaacctctatatttaatcatggtgtcatcagcctagctctatgaccttaagaagctaacttaacatgttagagcctaaatttcatcatctaaaaagtaagaaaattatacacaatgaattcagagtttccttcttctctaggtttatatgatttagtagtttaaaaaatcatatccaaagagttagctcagaaattaacagaaagtacaaaattacaatatgactgcatttttaaaaatcaaagaaaatttgtttaccacagaaacataggttaaattacttagcacatcatcatgattttaatatgtccccccagatttcatgtgttggaaacttactccccagttcaagtgttggtagatggggccaaataaaggtgcttagatcatgagggctctgccctcatgaatggattaatgctgttattgtgggaatggattgttataaaatctagctcagtcccttcttgctcttgccctctcttgtccttccaccttctgccatgagaaaacattgcaagaaggctgtcaccagatccaggcacttcaacctgggaatgcccactcttcagaactgtcagaaatatatatgtgtatgaataatatatatatatacatatatacacacacatatataatataaacatataaattaaatataagttacctgttctaacagatacattttctaaaatggtgaccaaaatgaaatgaaaaagtatttatatttgtatagtaataaaagagaagtaaaaattttaaattataaattgatgtttattaaatatatattattagtcaacattctatctaaactctgtagtctaaaaagagtaggtaataaaaatgatgcagctttttaaataaggccagatgatcgctgaatgtcttctaatattccactgaaggattgcttcaaaaattcaagtccagtaaggattatttaggtttctaggaaatgtatcattattttatttttcatatttgctattaatgaaagccttacacttggtgaagttatatgttaacctctagttttcagaccaattaaaataaattttggtagtaaaaaagataaaccctagcggatttatagttatgcagggttttaaccagtttcttttctaagctagttatattattcaaatactgtctttgaatattgctcccttaagtgggcctctctggacccttaactgaactcataattgcctaattagcttgctaatgttgtggctcagaaaacaataccccaaaatatgacattttgacatgctgaactgaagatgaagctcaggttctctgatttttccccacctctccatgtatctcccacagatgttgaagtttccgttttcccacctagaacaagaattattttttcttccccctccctattacctcattatctattgcagaaaagaagatcaagagtaacaactcctgaacaaacccttttacaattatgatgactgtctctgaggattatttaaatccccaactgaactatttacaagttaatctgtgttcctgatccatatccattcattcctccctagaaaccatttattgtccttcaatagaattcctcttctcccctctcccataacctgttttaccagaatctgagctcccactttctttttttcttttttttcttttttttttttgtaacctcaagatggtatataagcttcctcataactcgttggaaagttgggtcttcattttaaaggcttctgtgtatatacactaaatacatttgcatgccatttttcttatcagtctatctgcctcatgtcagggatttttcaatgactctttaagggaccaagagcccaaggccccctcactagctatttaaacaattaaataaactttttaacacatgtttatgttttacataagtgaaaattatactttaaattaaaaacagaaaataatagcaaaagagttgagcatgacttttcaatgacaaaattagactaggaaatttctatgtagtcatgtcctccaagctgcttttgtttcgaaagtggctcacttatttgattttctcaggagaagcagttgagaaacagtgctgtgtatgtcaggctgtcttttctaattgacaaaagttactcatgacttatctcaagaatacaaaattgaagaattagagacaaatgtacgtataaaaaacactgatgaaaccacatttgcaaaaatgatcacagtgagaatattatgacagtgaaagtgatctgacctgagtccatcttgcctctaacttccaaactgtccttgttcatccctgggcataggccaaactaactttgtgaggaacttagtttacaatttaactttgagacaacgatgataactgtcaggcctctgagcccaagataaaccatcatatccccagtgacctgcatgtatacatccagatggcctgaagtaactaaagaatgacaaaagaagtgaaaatgtattgttcctgccttaactgatgacattaccttgtgaaattccttctcctggctcatcccggctcaaaagctcccccactgagcaccttgtgacccccgcccctgcccagggagaactaccccctttgactgtaattttcctttacctacccaaatgctataaaacggccccacccttatttcccttcactgactctttttcggactcagcccgcctgcacccagatgaaataaactgccctgctgctcacacaaagcctgtttggtgatctcttcacacggacaccagtgaaaataacagtttttcgaaaacaaatcttcttcttgcctggggaccagactgccattgtaggactaacaaattagctacatgattacaaattatggcttaggagccatgcagctggtggccacaagattccgaacctcctcagttgttcccagggttaacaccactctcctaaaacctaagattggtgctcaagatattcttcagactctgcactcagtggatcagttgcccccacccaaatcaataaactggctcatctggttttgtggtctcaacccaggatctgactcaacacaaaggacagctttgattccctctgattttatctccaacccgaccaatcagcaatgctcactccctggccccctacctgccaaattatcctcaaaaagatccagtctctgaattgggggtgagactaatttgagtaataataaaactcaggtcttcctttcagactgctctgtgtgaattaagctctttctctattttaattcttttatcttgataaatcagctcaatctaggcagcaggcaaaatgaacctgttgagtggttacactgatgtggaaggacaagggagttggaatgagggaaagaggagtcagccatgaaagaaagattcaaatattctaagtatggactcttattccaacctcaatgcctggcaggttttcagctctaggtgtgtggggataggtggaaaataaaaaataaaataaaaaaaagttattttcctctagggaaaaagtaaaaggtattcaaggggatagatttcctcctccaattctgccagtatactcgagattactgaacaatttccctaccaactaaatgaagcttgcaaagaaagaagagcctagacctttcttaagaatagtaatgaattagcatcataaatagcctatgcagaaaacatgctgaattatgcttagcaaataggttctctatactcttcaatgatttactaggacgttttttgggaactcatcagcaagtcattttgaagttattatgctgtgattaactgctgtgccatttttcccctcaaaattcatgaaaaatgcagagttactatctacttcacccactgtatgagtttcacaactgacttttatcatgatctctcatgctgggtttatagattgcttgaactgggggtgagaactcctgctgatactgtcacagagcagtctagttaggttccactaagtgaatctgttaaaactgtcaacaaaaaatagccaataacttttaagataaacagagatggactctttcctacagtgtatctagaaatggaagctgaataaagtctcaataaaaagaaaggttttgtttattttcattcctttccttttgcattattgtttggactgcttctggaaacttcagccttagaaataaatagaagtgaataccttttaaaatgaatgtcttcagtagattaaaagtaactgaagatttttttcaatgtattttttacttgctcctttgtttatattctaaaagaaatgtacttggaggccatatgttttagaaactccattacacatgtacatttgtttctcgttattcacatcagttatgttctgtaaggttgccataaatactgaataattgctttggtggggcgggagaatatatattacacatattatactttagaaaaacaatagttttcattctatccttctaggctttcagctggggcatttgtaaaaaaagacagattaacaagagaaaaacaaacatgtatatctcatacatacatgggagaaaagacagggcaatcaactctcaaaggggtagctcagcatttaaacttaaataccatcttcagctaaaatatatatatataaaaagagaaggatatctgagaggtaagttatggcaaggtgaccatgaaaaccaaggtgaacaagaataaaagttgataggcagatttacgtcagtgccttctccatagataaaattaccttgtgatttagagtcatatactctttctggtacagagaaggatagacttttacaaatagaaatttcctttataaatatacttttcccttataaaagtgtaatttctactctggctttagagtttctattatatctgctgtttctcaaaataatcttctaggtcaaaaaaagtgtatattttattttgggatgacataatctggtctcctatagccatagtcccgggtaacatattctgatccactataatataaattccatgtactatgatcagttgcatttctaaacaacaatagttcgataatgaaatttttcaaatgcttttgataaaaatgtataatgcccaagttcagtctatatagaaagcttttataaaaaacattttttaaaaaaccttcgaaaaacagtaaagaagatccaaatcaatgaaaatatatgtttatggatatagggtttaatacattcaagatgtcaattatgcctaaatttatcaatagattttaagaaatttcaatcaaattttcagcagatcatttgtaaaacttgaaaagatgtaatgagatgcatatggaaaggcaaaagcccaaagttacaaacattaaataattttttttaaggaacattacctaaaatgagaaaggaaaatcttctctggtgaatatcaaaacatgaaaagctatgcttgtaagataccataattttactccattaattccttttaaatcaattcatgaaacagaatatggcgtttaattattgaataaatatgacagtgtagacaagctggaaaattatagactcttcaataaatcatgctggaataactgtatatccttacggagatacaaatttatatagcagtctttcatattcaaaaatcaatttcttgtaaattaaatacatgtatgtgaaacataatgttaaaaacttttaaaatacatgtcttggttctagatagagaaacagttctttaaaaaggcacagaagccaaaaataataataaacaatgttgttaagtctcagaaaatacaaatcataagtaaagaaaattaaatgataagccacaaattagaagaaatttttgtcacacatgaaaaatcgatgtggggaaggataaattatatttctttctactagttttatcatatgcaggggaaatgaaattaaaatatacagtcatgtgccacataagagtatttcagtcaataatgaaccgtatataagatggtgatcagagcaacaggcgataccatgtagtctaggtatgtagtagtcagtaccatctcgggctgtgtaagtatactcttggatgttcatacaataatagcaaaattgtccaacaatgcatttctcagaatgtgtaccttttgctaagcgaaacattaatatatttatatatgtactcccccattagttttatgttttatacaggaacatctattttaaaaattgcaaaaaaaccatgattaagcattttaaaaatctatttgcatgctttccattaaacaaaactacatttttctccaggcagcttatacctgctttttgatagatgttatcaagacaattgatgatttacttcaatgggctgaggagataattccatggaagctcttaaagatctaatatgtgtgcttctgaaacatctataatttagcctttatggttatgttaatataggcaatgagaatcaggaaattcaccttgggagtgatgtcacaaagattgcggagtgggcatagcagctctcatctccccctcagaaaaactatagacagctattcaaaatcaaaaataggccagagagggctcaagagctcattaatgaatctgccacaacatgttgaagcaaaaatggaaaacatgtatatagaaaggatcactgatgagatcagaatacgcaagatgtcagtacaagcaaagaagaaatgtaaaagctactggtatcagctacatggtcggaaccactgtggtctccacaagtctgctctgcaaaggagaccagcatcttttgccactgaaggaatcaatagctatcctggctgaggaacccagagagggagacgccactgtttactcttctcccacacaagaattggctgctgttcagtcacctcaggaaagaaacttcttcaggaaaagaactgccacagatacatgcatatgttcacgcaggtattctgtgcaaaacctgaccctgaagcccagcctccctgtaagtgcccatgtttcagctccaggctctgtggctgtactggtacagcctacctttcagatactggaaccacagctataagatgttagtttgcacacataggctccagggccaaattcttgcagtatatgcccatgctttgaacatcagcccagctgtgatgaatacctgtttctgaagctgctctaaacctgcacacacctgcattcccattctcatcttctcaactatttcatgagtatactgtttcatgatcaccttgcatactgttactaatgtggcagtgtaagcctctatgacccaggcactagctcagctgcctagagagttaagcagtatcctagtcctggggctgctctaacactgtgcatgcctattctgtcattcttggcactctggctagttcacaatcatccatgcctcacagacagtaaccaacatggcagtgggagtccctgcgccctaggcactagtgctattactgccccagttcccaaaactgtagtttctccacacattctcattctttagtcctcagctttgtgactgttccatgtgtgccacccagacatcggtgccactggcacctctagtgggaccctaaaccattccgagtgccaagagcaacccactagctacaacaaatatctaggtacaggaaagtcaaaggtctccaatcaaattcggtccaaacaagactacacaaagacacgatataatcaaactgtccaaaatcaaagacaaagagaaggtcctgcaagtagcaagagaaaaaaagcataacacataagaatgtatgtacactgagagtgaaagaatggaaaagatattctatgcaagtggataccaaaagagaacaggagtagctagctatgcgtgtatcaggtaaaataaactttaagtaaaaaactctaaaacaaaacaaagaagggcaatatataatgataaatgtattaattaatcaagatgtaatgattgtaaacatatataaccaacactggagaagctaagtaatagtaatatatctgaagagagaaatagactgtaatacaacaatagtaggagtcttcaatactccactttcaaagatgggcagatcatctggacagaaaatcagtaaggaaacatcggacttgaactatatgctttagagcaagtggcctaacagacatatacagaacattttaacccacagctacagaaaacaaatttctctcaagtgcacatggaacattctccagcatagattatactttagtccacaaaagaagtcttaacaaatttaagaagattgaaatcatattaaatatatttttgaccatagtgttatgaaactaaaaataaatggtaagagaaatttcaaaaaagaatagaactatttgaaaattaaacagcatggtcctaagcaacaaacaggtcaagaataaattatggctggacgtggtggctcacgcctataatcctagcactttgaaggccaaggtgcatggatcacttgaggtcaggagttcgagaccagcctggtcaacatagtggaacctcatctctgctaaaaatacaaaatttttttgtattgcaagtgtgtattgcacacttgtaaccccacctactccgaaggctgaagcaggtgaatcacttgaatctgggaggtggaaggtgcagtgagctgagatcatgccactgcactccagcctgggtgacagagtgggacttcctctctaaataaataaataaataaataaataaatattgattaaaagaaaaaagtttaaaaatatcttcagagaaacaaaaatggaaacacaacatattcaaaattaaaacatttagcaaaagtatttctaagaaggaagtttagtaataaatgtctacaaagaaaaaggaaaagatcccagataaacaacctaatgtgacagacatatcaaggaactagaaaaagaacaatataaacccaaagtttgtagcatgaatgatataataaagactacagtagaaataaataatatagacatgagaaaagcaacagaaaagaaatcaaccaaattaaaatttgtgttcttttaaactaaacaaaattgactaacttttagctagaccaacagggaaaaaaaagaaagactcaaatatatgaaaccagaaattaaagaggagatattacaattgataacacagaaatataaaggatcttgaaaccactttaaacaattatacaccaacaaattggataacctagataaaatggataaattcctagacacatacaaaataccaacactattttgtgaggaaaaagaaagtttgatcaaaacaacaacaagtaaagagattaaatcagtaatgaatattcttccatcaaagaaaagtccaagacttgatggtttcagtgctgaattctagcaaacaattaacaccaattcttctcaaactcctccaaaaattaaagaggagataatacttccaaatggattttatgaagtcagcattacccaaataccaaattcagagagcacactacaacaaaagaaaattacaggtcaataatcttaatgaacatacgtgcaaattcctcaacaaaataacagcaaaaagatttcaacagcacactaaaaggatcacttactataatcaagtggaggatttatccttggatgcaaggataatttaatatatgcaaaccagtaaatgtgattcactacattaacaaaatgaaggacaaaagtgatatgattatctcaatgcatgcatcaaataagtttgaaaaaaatcaacactcttctattataaaaactctcaataaattaaatatggaaagaatgtacctcaacacaacaaaggccatgtatgaaaagcccatagctaacattatactaaatggtaaaaagttggaagattttcctgtaagatgaggaataagacaagtatgcccactctccccattttattcaaaaatagagttggatgtcctaaccagagaaattagtcaagagaaagaaataaaatgcatcctctttagaaaacaagaagtgaaatcattttggttttcagattacataatcttatatatagaaaaccctaaaaactccatccaaaaactgttagaactaataaattcagtaaagcttcgggatacaaaatcaacatacaaaattgattagtgtttccatgcactaacaacaaactatttttaaaaagtcaaaaaataagattattcaccacagctataaaacaaatacttaggaataaatttaaacaaagaaatgaaagactttgtatactgaaaactctaaacactgatgaaagatattaaagaaaaaacataaataaataaaacatatctcctcttcatggattagaataattaatattgttaaaatatccatactacccaaagcaatctatgaattttatgcaatttacatcaaaatttcaatgacatttttcacaaaaatagacaaaataattttaaaatttaaatgaaaacacacacaagaaaacctaatagccaaagcaatcttgagtaaaaagaacaaagccagatatatcacactacctgatttctaaatctattacaaagctatagtaatcaaaacagcatggtactggcaaaacaagcaaacaaacaaaaacctgttgtccaatggaacagaatagaaactccaaaaataaaatccatgcatttatggtaaatttatttttgacaaaatttccaagaacacagaatgaggaaatgacagtctttaaaaaatggcactgagaaaactggatatccctatgcaaaaggatgaagttagactctcatctctatctaaaatcaactcaaaataaatcaaagcctttaacataagacatgaaactatacaactactaggaaaaaacacagaggaaaagctccatgacattagtcagggtaataatgtttttggatataaccccaaagacacagacaacaaatcaaaaatagacaaagttgattacattaaactaaaaagtttctgcactgcaaaggaaacaatcaacacagtgaagaggcagtctaccaaattgtagaatatattagtaaaccatacatctgataaggactttatatccaaactatataaagaacttaactcaataatattaataataataaaagcctgttttaaaaaaaaaaaaaatggacaaaatacctgaataaatatttctcaaaaggagacatacaaatggctagttggtatgtgaaaaaaatgctcaaattactaatcatcagagaaatgtaaatcaatccacaatgagatctcacctcatgcctgttagaatagttattataaaaagaggaaagataactgctggagaggatgttaagaaaagggaacaactgtacacctgttggaatataaattagtaaagaccttatgaaaaacagtgtggaggtttctcaaaaaattgaaaataggagcactaaatgatccaggaatctaaccaatagggatatatccaaagagtatgaaatcagtatgtcaaagagatatgtctacactgcactttttgcagcactagtcacaatagtcaaggtatggattaaacaggagtgtagatctacagatgaacagataatgaaaatatatatatatacacacaatagaatactacttagcctttaaaaagaaggaagtcctatcatttgtgacaacgtggatgaacctagagtacattatgttaaatgaaataagccaggcacagaaagacaaatactgcatgatcctacttacatgtgaaaactaaaaaagtcaaattcgtagaaaactagaaaagtcaaattcatagaaacagagtaaaattgttgttacgagaggctttggggtggaattcttgggaggatgttggtcaaaggacacaaaatttcagttagagaaataaatataatagatctattatacatcatggtgaccacagtaaataacaatatattgtatacttaaaaattgcaaagcaatagattttgaagtgttctcagtattaaaaaaaatgataagtgtgtgaggtaatgcataggtaaaatagcttggttcagttatttcacaatttatacacataccaatacatgttgtataccacaaatatatacataatttttacttaactaaaaattaaatttacaaaaacagaaaagaaattggactcatctttcacatatttaatttaatcttgcaacaaaataacctcataaaaaattgaggactataactaatttattaatccttttataaaatgttcttgcatattgactgaggcattaaagaagcacaaagattacaacgtaccccattctcttatggtcacacagtatttaattagataattaaaactgtttagtatgtttctagtttaaattattttccaaagctgtgtaagaataaatccagcacacaaaagaaaacacattttgtccagttacttttgctctgactggattaagttttcttcaaatatggcagtgacctaatggccaactcaactttgactaatgagaaacttttgacgattattcgtttgcctgtatacatgtgtttttttgttcctttcttagggaacttaagcatacttgaaaatagcaagtacttaaaaaacataagccagttacaagaatcaagaagatacaacatatattagatttagaaacttgaatatgaggcagctttatagacattgaaatacaaggatttccaaagtataattttagtgaagaaaagggggaatataaacagtatgctgatatttgtacagaaaatacatatatttacaatatatttctggaaatatatatcagagacggcaaaggtctttgtgtattagccagctcggctgccaaaagaaaatatcatagactgggtggtttaaacaacagaaatacattttctcacagttctggaagctgaaactttgagatcagggtgccagcacggtgaggttctggtgaggcctctctttcttccttgcagatgaccatcttctccatgaggccccacgtggccttacctatgtatgtgctatggaggcagagacacagaaatctgtctctttctttttataaggtcacccattctatcgagttagaaacccacagttataatctcacataaagttaattacctcctaaaagccctatctccaaatatagtcacactaagggtaaatgttgcaacatatgaattttgagagggcaaaattcagtctgtagaaccttgtctccagggagataatttgcattgccaggagacaaaaaagggaaggagacgtttctcactctactcttttgtaatttccatcttttaaatgtgaatgtgaaatttactcagaaaggtaagttacataaaatttaaataatagggttattgtatctacatggtcatgtaaatattaagtatctccattaccatggcattttactaaataatatatcagaatataattaattcaataattttgttttacagacctaagacacatgcatcagtactttgttaggttttgaaaaatgtcacagaaaaatatctgtatcctcaggaaggaacagcccattaaaatattattcaaaatcaacaagtatattccaagattaattcagcaaaagtggagtgtatttagtaaaattgcaaatgttctatttggagaaaagattgctttgaaataaaagttaattcaactcagagagaaaacaactataaatattaaggatacgatcaataaagttactaaaaatatggctgtgcttattcaagatttagaatccaaacagaactcattgggtctagtaactactagcctgaaattaggaagatttgtagacaacaaattacaaaagtaattgagagactaagaagatttaggacaataaatgtaagaattctcttttaattgaaaacctaattttgtagaatgcttaaaatataactaatcagtcatagataaaatagcatttgtaagtactctacacattgcattctttgaagcaattattaatgattaatactttactctgtgctgttatttgaatgtcatagatctgtataaaaattaaaatgaaatgagacagagtccattcaaaatggcataatgcataattggatacaattttaaccttgattccattgttctatataaagctactatttcaatttaatatagctaatgttctaaccagaaatttataatgttaaatacttcatcctaaaacttcaagtgtcatgtctcccccagacagggatattaaaggccattttttatctcaaggtaagcctgaaatatagataatatattaatattccagtatttcaaattgtaagcattaaaatgtcatctaatgaattttgtggttaaatataatttgacatattttaatctattcaattgcaatgagtaattttggcactttgtttcaacttttaaaaaagtgaatttctcataatggatctcttaaggaattatctattaacataattagaaattaatacatgttattaatggcttaatcaaagaaactgtaaattgatgtgggacttctttgcaactttgctgtgggtctaatcagtaatatttcatgtactcgtcttcacccaccccatcctttattaaatatagaggggaaaaaagtggctcatgtagactaggactggttcaagaattttacaaatatatgatttataaagtgatatggaggagagacatgaaagaaaaactgacttattgtacagcaaacgttttaaaagccacttaacaaaaattaatgctatatttgctctatttctatacaatcagaaactattaataaatatatatctttcatctataatggccagaattattcttagtaggcctcaggaatggtcaaagtaaaatttttgccagggaaacacaataattgccaatgttcaatacttggtgtgccagtcaatgagggaaacaaaaatgttgctttacaacaatccctcctaatgtttaatgttactgttaattgctttatgtaaactctatgatcttagttccttagtgatgctcttattaaccaaaatccttgtaatacttaaataagtacctatattcacctaaccaaaaatgtgtatatacatcatgcttttattagtcccattagtaaataatgaaaatcatttataaaaatgacaaataaatatctgtaaaaataaaaaaattagtagcaaggtaaatccattatatctctattatgtatacatccaagtctttagtgcactgtgattcctattggtgatttttttcaaaatgattttaaaatctaaaagcttggctgggcatggtggctcacacctgtcatcccagcactttgggaggctgaggccagcagatcatgaggtgaggagtttgagaccagcctggatagcatggtgaaaacctgtttctactaaaaatatatatatatataaattagccaagtatggtggtgcacacctgtaatcccagctactcgggaggctgaggcaggacaatcgcttgaacccaggaggcggaggttgcaatgaactgagatggcgccactgcactccagcctggtcgacagagtgagactccatctcaacaaataaataaataaataaataaataaataaataaaagctttctgagaacatttgatcttttaccagtgttttgttggaaaagcaggtgtgaagttatttcatttatagggaatactttatattacttcatgaatttctggagttatgtattaagacatcacccacagtcaggaccaggaaacttaataaatagaaattcagttttaagattgtctaacgaatttataaatttccccttagtcctgtttatagaggcttaggcagactagttttcaaagaacaaaggctagctctcatgtcaactgtattcatttctgcatgtcattctgaaccaaagaaatggatgaaactcatctgtacttttgactgagggaattacatgatattttgctatcattggaaaacaaataaaatgatctttctttactttcaacaaacccatacactcccccatcactatccacacaccatcatgattctacagaaataaataaactcatttagcctatcccaacagagggatttcacaaatttagaataccataaccaagtagtttggaatactcctgtacaaacatgacagattacatgtgtaataagtgacaaagaaatacacctaagaaatgttataattatccctattttatggacattttttgttttgttttttgaaagatgtaaccacattaaaatgtttatgcctagtatcttacttgcaaactctaggaatgactttataacaatagtagctaacactcatgttactaatatactgatagtggtatactactatttcatttcatcacagtaatggcaagcggattgtaatattgatccctataatgcaattttaaaagttatttttaaatttaatttaagttacataagtgacaaaaaaagaaatttgaattccatgtctataactcaaaggtactgttctaattgttagataatactgctgtaaaatctttttaattcccttctgctctggaataaaatctaggttataatactccagattttaaatgagggctcaagtatacttattttaatattgttttctcttaaactaatttgccgtaagaagaattttatagagaatattaaatataaaaatgcagaggatagtttaatggtatatttatgtcacattttcagtaagacaattactatgcttttcgttaagtaagaattactttatataagtggtagaagttttcttgtagtgttttatacaccttaaggatgccaaaagtaaaacaaaatggcaagtccgagccggtattccactacaaataatattttaattctatgactctcatttcatttggatagctttgaactccatctggtcactgacaggagggaaaaaaagtttgagtttccattttcattaatatcttcactttttaaagtggaaaatggaaagcttcaactgctaacaaatcagcaactaatacattcataaatgaacctgctcctataatggtctaaagtggctctctgtttaagaaagcaattgatgcaattggaccttcctattattttctttaaataatgaagttatttgtttttaaaatacaagtgcatttatattcacagtttacatgagtggacaatattatatttggttttatgttttacacaaaatagggatattgacagaatgttaatatgttcatattaacatactacctaacatatcttatgaacatattacttaatgtatcttatgacctaacatatcttatgaacatattacttaaaataaaaaaaaaaaatttcagactacagaaaattaaagcagaaacttttgttgactggatgaattctaagggtgaataggaaatatatttcagccagctatgacaaatagagaaaaacacaactgaaaaagaaccccagccatctatctttgatactatgtctctagttagctacattaatttaataactcatggactatttctgcatcatagtcttattacctggaaaataggtaggttgtattagatcaacagttctttgctggatgattttgcatccccatgggacatttggcaacagttgaagacattgtttatatcacaacagtgggaagggcgttagggctggcaatactggcatctactaggtaaaatggaacaggagaactccacacaacagaaaattatccaatccaaaagagtaatgtcaacattaggagaccctagaacaggcggtatttatggtttctatatctgggatttcaggatgagttttttagagttaattggggaacatgaggtagagtaaggggctgagatgcctttttaccaattaggtttttttcaaacaaaaatttgaagaattagtaacttttagttccaactgaattatccagaatgttctataaaataccttcaaacgaatcatttttctttgaaaatactacgctaaggctaatctttcacttttcaatgtggaggtccccatccaaagtttatggcatttatttatccagtcttacaataacatcttacgttgctatataattataatatgaatattatggatgatatacatatctttataatccatttaaatcacttctaaagcatgaataatatatatgtcttttacacatgcatgtatacacacaaatacaatttacttataaacctattaagaagttagcactatgggaatattatatatattatatatatatataacatttttcatctctctgtctccaaactttgtgattttataatttcaataaaagtacaattttgttcaaactgtatttgtatcttatgtttctgttcatgcttctgcaggatattttacaagataaaagtgtggtccattgttatttgctttactaaagttctaaattttaaatactactaagaccaccaggaaaatactttctaatttattagaaaatacttacaataaagcattaattcgataattcaagaatgccaatataaatacatgaaatggaacacagttaaaaataaatgtatgaacagtcacataaaccatttcatgtcatcattttctgtatttaccaaagttatagctctttcgaatgattattgctaatgtattcatctctgacaaagcacaattatttatttaaatgaatgaacaaaagaaataaacagactggctcattttcatgggtgactgactgaaggaatttaagacttgcttcaataatcctcaattcatgaatctagatggtataaacacatattgataattttaaaactaaaataatcaaaaatgtacattaaaatatttttaaaataaactgaattattattcatgtaaagaatttgaagtgatataaaaatgttaaataaataatacaatgcaattcagtatattatttcaataacagtttttagtgtactctttgaagcagaaatattataacattctttgtcataatgagaagacaattttaaacatcttttccaaatattaaggttgtctggcatatgagactacatttatgtgactgtatgttgtatttcaatgatgaatgagttttacctagaaaagattaatagaagattttaataaaagtaaactatatgagagtcttacagttattgttgtaagagctaaaataaaagcttcacttatagaaaaaaatactaaaaggtttagtaactactcaatatgaatttgcctgttactaaaatattttattattaggttgttgcaaaagtaattgtggcttttaccattacttttaaaggcaaaaagagcaattacttgtgcacctagctattcatagaaggaggaaaatcaatatttaatttaacattccatgttatgtggccactcacttatttggtggtttcaggctccattttggggaattctacagtttctttatggtttcaggaatgtctgcattaggagaggttgggagagagggtatcttgttggatgtaatttcttcattttactttaatcaaaatagtttctcttgtaactatacacatagagaatttcagaagaggcttttaactgaacagaaggatttatagaacaacaacaaaggtagataatttcaaattaatatggtaatatgcactgctcttacactgatctcttggtcaagtaatttaaaacaagaattaaaaactaaaattgaaatttaggtaattaaattctatgaataattttataaccaaaaggggcaactattgagatgctggagattaagggtatcctatcttaaggaatgtagccattgtggaattaggacagcacttttaaatgtagaacatacctgcatttgtttcttgtcaagttcaccattagagacaaaactgattgtcagaactgtggaacatttgagtagcaacatactttttatactgacaattaggttgaaacaaccgaagaatgaaacgcataaagaagtgtgttcatgcccaccacagaataagaattgcacttaaaaagttaaggaaatataattttgataggaaaatatttgttattagagagaataaagaaattttgtaaagtaaaaaataaacccattgacatattgagtagtagtgtgtacattccctgtccaattctattacaagcaagtctaaatctagagccactaaaatttctatgatagacagtttatctttaactagatgtattttttctgttcaactaaaatgccttagtaatttcagtacgattttttttcttagatgtcaaacatcttttaaaattcaagttatggatcacttaactctaaatacatgcttttattttatttccaaagcttagaagacaaagattattaaaatctgagtgttcaaatataaaatatcttgaagtatatgcattaaatgttccatattttaggctaccattgagaagatgtttctctaagcaacatttgataagactaatcatgaaactaaacagccagctgtttagattatagtacaatccttgctgccatgtataacactattatcatcattggttttataatcctttggctcaacttactacttactggagatagccgaagagaactaacaaagcttttaatgtgatggtgttaaaaggtgatatggttcagttgtgtccccacccaaatctcatcttaaattgtagttcccataatccccaggtatcgtgagagggaccccatgggaggtaattgaatcgtgggggccatgtccccagtgctattctcatgatagtgagaaagttctcatgagatctgatggtttttgtaaggggcttcccccttcccttagctctctccttcctgccgccatgtgaagaaagaggtgattgcttccccttctgccgtgactgcaaatttcctggggcctcttcagccctgcagatctgtgagtcaattaaactgccttcctttataaatactcagtctcaggtatgtcttcattggcagtgtgagaatggacttacacgaaaggcgaacataaatccctttctattgggacaacagtatttggagttaagagttaaaaagaaaacataaaaggatgaactgtaaaccttcattcaaaaataaaacagcatattatattacactttcatatgcaataatatttttaaaagttcaatgtaagtataaatttgtgtgagatataaccaacttattatagttgtagtttcataaattaaaagatgtggatgaagttccaagatttgaaattactacgcttttattatcaaagttaaagatggcagagtaataataattatcttaagtttgaacaataaatcattcagagggtggtgcccagctggttgtttacttttccccttagagaagattgaggaaatagtattaagatttactattagaaagatgtttagaagaataattttgtgacagtgattaaattctaaaatccttgatccaaaagggaattgagagtatgaaattagataatgaaatttcctgctgtgtatcacatgccatcactgaataaattctcttgccacatatttttgtattgtgtttcttttcctctgtgtcataaacctctatccacctcatttaacatttttactgatttttttctcccataaatcatattcttattgtgccaaatactattaatataaaatctaacaggctaacataaagaaagagatgtcactttatccttagaggtatctccagatgtgggcctgtcatgtggcggggggagtatctgctgagcctcttaagactgtggagatggcagaagcagttttatgcctctgaggtctcagcaaattggcatcagtcacacttacctgtctgtttccttcactgatctcttttaaactatttctaaaccttccccctgtccatatcgtgcctctgtattcgaaatataatattattagacacagaattttacttaaaaatacctactcacaggaaaataatgagactttctcaaagaaagatcattcctatatttttggcaaagggatgggctcctctgggaagcctttcagagagctacattgacacatttgtataaaaataaatgaaacagtattcatcataactacgtgtctcttgcaggattctataactcctaaactaacattctgcagatggcatgccaatgtgttcaagagggatcatatataatttggatagttttgatatattaataggatatatacatcaggctttctttttaaaaagtgaaatatatatgatcttagaggcaaatcaatgacttttatatttttgaaacccctaaattaactttttaagccaaatgaggctattatataatagtcatcattctttaaaagtttctacttccatttcttcccctcctgataagtttattttctcctgtatcacaccactcaaatttctagtaacctcttaacttccaaaaggaataatggtgtgttcctcatgccctgtgacttcctaccaggatttgcttacagtcactatccctgaatggaaactatttttctctgatcccaagatcctaagcagagcattgtgtgtatgttgtactctacttccaaccaaccctttaaagcaccaggcactctgcatgttgcattctggccagagtgcactgctttgaattcctctcatttgactctttgacgatccttactcagtgctcttcttcagcctgtttcgtcagtctgcaattatctttttcttctttacctccagttgaaattttacttctatttcaatatctattttaaatactttctccttctaatgattaccctcacacccacttaagtacacacacttgtacacacactcactacctctctaggtagaaatggttgattcttatcttgaattctgcttgtactctcacgtagcaaattttttcaaacagccaatatataaacttcaattggacttatcgctgtattgaaggcccagattattattttttagaaattggctacattctagaatgcctagaaaaccaaactagattgtatacttaaaaaaattaaattaaatcttaaaagtacatattaatatttctaataattcagctaagaaaaaacactttctctgaatgtagcattttaccattttcctgacatttctattttctaatgtattagaaataaatgttaaaggttttggggggtgataatggcctatgttttaacttcggcttaatgtttattaatgtgttacttctgaaatcaattatttctataattgttaaatatgtctttataatgtctacaattgttaaatatatctttataatttaaaaaatcatatgctgaaagcaaaaccattggcaaaatgaacgcgttggacatttttaaagcatataagaaagaaagaaaggattacagcacaatactagagaccttagtgcttaataaaattctatgtgttttcccacaattccactttaatattaagtgtaattgtaaaatgattctgaagatgtagcaagatgagtgtcaattataggcaaaagccaggaaagggtagcatggaaccttctagttctttcttccactaccacagtacccaatgaagcaatgtgcaacagatggtagaggctccatcaacctgaagcagaatatcctgctgcctacaatacacatagacatatcaacacaaaactttttctttttaaatttttaactgacacgtaatatttatacatatttatgggatacagtgtgatgtttcaatacatgtataaaatatgtaattattagggtaactagcatatctataacctcaaatatttatcatttctttgtggtgagaacattccaaattctcttttctacctatttaaaaatatacactatattattgttaactatagtcacttgactgtacaacagaacactaaacattattcttgctatctcactgtaactttgtacccactggacaacttcttattcccccactcccaaatccctctaggcctctgctagcaactattctactctttacttctagaagatcaacttttgaagattccgtttatgagatcacgtggtatttgtctttctatgcctggcttgtttcacttaacatattgtcctccaggcaatttcgtgttgcctcaaaaaacagaattttaatgttttttttttatggctgcataatattacattgggtaaatataccactttttttttttatccattcttcagttgatggacacttagattccataacttggctattgtgaatagtgctacaataaacataagagttcagatatttcttcatcatatttatttcatttcctgtgaatatatacccagtgctgggattgctatatcatactaaagttcaatttttaattatttgagggatctccatacttttttccaaaatggctgcactaatttacattcccaccaacagtgtgtgaaggttcccctttctcaccacatggcctctccaacatttgttattttttgtcttttgataatagccattgaaggtgaggtgagatggtattttacagtggtttgtttgcttgttttgagacagggtctcactctgtcacccaggctggaatacagtggtgccatcacagcttattgcagccctgactccatctcaatcaatcctcccccctcagcctcccaagtagctacttactatatacttaatctgtgtgtgtgtgtgtatgtgtatatatatgtgtgtgcctgtgtgtgtttctcataatgcctttccataatgtaaggaacatattgggaaggtccttggaattacagtaaacacaatacatttaaaagaaaacaacccatttcatagttctagatattatcttttctctttctctttctagttcttggtttattttcttgcctttttagactaaatctctgactcactttttgaagctcctaataatgcaaaaatttcttctgaatttactaatttaacctcttttgttatattcacccacacattatatgcatgtcaccattctctctgtctggaataatctttcccctgatttttgcctggttatgtactactgattcttcagctatcacttgacatgcctttgcgttggaaaacctctgggtcctggacttatatactctctcataatttgcattcttaactctttttattcttaacaaaattgaaaattaaattattttttatatttaataaggcatttctgtatccaccattaagccatatgctacctaaagacaagcaccatgtgtcattatctctgacatatcttgtcacaggcaagcacagtgctatgatgagaacataatagatacacaaaagcatgtgatggataactgcagtaacttataatcaactattttgaaaatggtatttctaggctaatcatacttagcatcattgtatcaatttgtatgttcatcttaatattcactaattttgatcattttttcaaaacacatttctattctatagctttcacttttcatagttaatttaaagttttctaaaaaatgaacattttcataactttaaaaaaagcctttatcaattattctaacagcattcagagtaaaaggcaacttaatttgattgattaattttggatttagttaagttagaagttgccaaattataatatagtatataactgaattttatatatgttagatatttacaaattatgcattgaattcaagttttaatatttaacatctggtaacttttatgaaacagatattttattactatatttcaaagtttcctgttttattgcattttatttacttgaaataaataaacaactgaaatacaggatgaagataacaacaaaactcacagctaacatttatcatgagcaggtataggataagtgattgacatatgctatcttatgtaaccctcacaaccacccagaggggtaaacgccactattctcatttagacatgaggaaactatagtcataactaggtatccagttctaaaaaaggagcttaactcaaatgcttgaggccctgccatgatgcaccactacttcattgcattaaacacagtttaaaattaaactacacatatccttaaaatttatctgtgggagcaggagaaataaaactaagaagaatggttggttttattaaaatccctttcctaatgtcattgagcagtacaacatgtttataattaaaatgaatgaaacttaacattggctttattcttttgtgattcctgcacgtagcatccttctctaccacatagcacaacattatggacaacagcatgagaaccatctttaattctgcctcctgtttccagtaactccagcaataggagtcaatgttgaagataatatgtaaataaatcactaataattcagcattacccctaggtgggctagggaagagcataaattatttcaatgtacagtccagtaaatcctttgtttttggtctctgatgcgtaaccattaaagatgcaccttattaagaaattcttatgtaacatttctagacataaatgtcatctgtctttccaaaactgtcttttaaaacaaactcctattcagctatctttacatagttgagtagtataggacatttgttaaacataaatggaaaaaaccatattcttcagaaacaaaatattattcatattagaagatcaaatggagactttttgcttctctataatattttattacttctctgtttttcttctgatacttcgggcgaaactggtgcaagctaagagttgaaaatcaatgccttagggcatgggcttttaataccactacatattagaatcaccttgaaatagtaaatacatgaaagctgacagcccacctcagaacatttaagttataattggatggggccagaatgtttagagtttgaaaagtttcaaggtgtctctcatatgcatacactattgaaaactactcttaagaggtaagaaacctaaacaaataaagtctattcttaaaattcaatttttctacttactctcccatagcaaattcatgtatttcccacgatattatttttttattctccccatataccttacaaagaggtcattagtactctaattatattttgtccttctctttaggaagtgtttctgtcaggtattatgattattttactttataattataatgcaataatattttgcattaaaaattaattaacacatagaatgtaccaggtattgttccaaaaaacttttccaatactgagtctacagcactattgctatcttcatttcacaaacaaggaacttggagcatagagaaggtcaaataacttgactaaaaatcagtcagctgttaggtagcatagacatgatacaaccccagagcagcatggtgcttcactaataataacaaaataatgagttgatagttatatagcaattagaacagctctggcaagtgttaggttattgcttactttactattatcattatgatcattattattattatttactgtgtgattaccatgtgctaggcataatgctaagaactttacatagttacatggttgtatatgctttatttcattttcacctcacaatatccctgtgagatgagaacacttattgctgtaagcaacttgtttcagtcacccaaccaataagcagatgagcctgaacaaaaacccatagttaaaaccatggcgtttttctttttcattttgtatcctgtacaggatttaataatagttttctcaaacagtagtaaactattatttactgaattgaattaaattgaatttgtatatctatgattcaaacttagttacattactttgcagtagagacattttcctttttttatatatatttgtgtctgtcttatttaatatctcttagcctgacgttcttaaaaaatatcagtttatcagatgagtagattgcaaaaattttctcccattctgtaggttgcctgttcattctgatggtagtttcttttgctgtgcagaagctctttggtttaattagattccctttgtcaactttggcttttgttgccattgcttttggtgttttagacatgaagtccttgcccatgcctatgtcctgaatggtattgcctaggttttcttctagggtttttatggttttaggtctaacatttaagtctttaatccatcttgaactaatttttgtataaggtgtaaggaagggatccagtttcagctttctacatatggctagccagttttcccagcaccatttattaaatagggaatcctttccccatttcttgttttggtcaggtttgccaaagatcaggtggttgtagatgtgtggtattatttctgagggctctgttctgttccattggtctgtatctctgttttggtaccagtaccatgctgttttggttagtgtagccttgtagtatagtttgataaactggattaagaaaatgtggcacatatacaccatggaatactattcagccataaaaaaacgatgagttcatgtcctttgtagggacatggatgaagctggaaaccatcattctcagcaaactatcgcaagaacaaaaaaccaaacaccacatgttctcactcataggtgggaactgaacaatgagaacacatggacacagcaaggggaatatcacacactgggtcctgttgtgtggtaggtggacaggggagggatagcattaggagatatacctaatgtaaatgacaagttaatgggtgcagcacaccaacatggaacatgtatacatatgtaacaaacctgcacgttgtgcacatgtaccctagaacttaaagtataattaaaaaaaaaaaaaatccatcattcacataaccttaagccaatgacctccacaagcttcactttccttatctgtaaattcagataatggtacttacttcacaggaccatttggaatctaaggagttaatgcatgtaaaatacctaggacataaagcgtcaataaaacagctcttttatctcaaaaaaaaaaaaatcagtttagttaaataacggtttatctctttgggaaatgtaagagagaaaacagtctagaattgcgacatcactgtcttttcaccaaatacagaatatgggtgtggtaggcagcttctaaggtgaccgccaatgatctctgactcttggtattcctactgttgagtctggattggatttaaagacttgtttttaatgaatggaaaatatcagaaataatgggatattacttttgagattaagttataaaaagaaagtatcttcagccttgagctctgagtgttgctatttctctcttcaaccccctatctcagtggaaaaacagcctattgcgagcacccctatgaggagagaggtccatctgaagatgaattgatatctctcatcaacagccggtaaaattctgaggcctgcctatagctacatgagtgagtgtgaaagagcgtcttttgaggcctactgtcagtccctttgacaagttttggggtggattatcttccaattcagctttaagatgactgtggctaaataacatcttggataagctgattcacttcggtgtccttagagaccttgagccagaggaacaaaactgaactacattcacaattgtgagataagttttttcttaagacacttcatttggggataaatttttatgcagcaatagataactaataattatattttggttatgtgatatatgtgaattcattttggaatcttcacataaacttcaaacagatagatatgtatgcagctagaaccaaataaaaacaaaggcctacattactgaatattgggaaagatgtgatttttatgtaaatgcaacatatgtgcagataacaaaaatgtgaccaatatgaatcctgaaatgaaagacaggagcaggcactatgaattactggttttcatgtacagtgaggcttctgtcacagaccaattctccacagcatattctaggttaaatgcaggaagaatttttttttttaagtaaaggtgcttgataattctccttattaatgccaaatatgtcagtaggctttccacaaaaaaataaggaatggtacatcattttcttactttttatttataaaactagaaatattcattacaattataaaaattgatttggataacaaagcatttaaaattgatatggatgaaaaagcattgttaatatcttattctaagtatttagtgggatgataagatttttgtttcagtagttctaacagaaccaagtcattaattagggaaatgatagtccttcaaggacatcattagaatgatgagcttctgctttcaacaaagagagaagccagagaaccgaagtaactcaaatttgatacagattcacaaaggatcagaagttcaaaacatactaatgcatatgaacattatattagagaccactgcatcccaaactggtattttacctaataatatataagcagttataatatttttaaaaatgattcctgctcaaataagtttgagaaaaaaatgctggttagacaggcttgttaattgtagggctctcctgtgctttaaattactaatacgcacgattaatctctaagagtgaaccaagaaacagcatttcctaccttcatttgagcattgagatttttgtgaaggctaaacaattagcctcgcccagagtaatgttccatggaacaataaatgaggaacactcttaagtatcataattcaaagagttcacagtaagctacaagaaagcaggaaccacctttagccactcccagtgtactcccagtactaagtacagtactgacagtgcaggcttttactaagaaattactgatgaatgaatggatagacacccccaaactgtaagttggaaagtattagctacatgcatatattattttcaattgtagccttgcatcaaataatgatttatttctcttcatctttctaccagcatctcaatgcaaggtcacttcagaagtctggaggcttctataacagcacacaggatcaaaggaaggaccctccactcaagaataatctgtcatgactgcggctaatatcaacattatccaagaccttatttaggttccttgaaagctggtatctgtgcagcttccattcaggtggaaggtactgaaataatcatagactggcaaaaatggccaagcgcagtggctcacacctgtaatcccaatactttgggaggtcaaggcgggcagatcactcgagctcagtagttcgaaaccagcatgggcaacatgggaaaaccctgtctcaactgaaataaaaaagttaactggacatggtggcatgcacctgtagtctcagctgctcaggaagctgaggtgggaggatcatttgagcctgggaagtcaaggctgcagtgagctgtgatccggccactgcactctaaacctggcaacagaacgaaaccttgtcaaaacaaaaacaaaacaaaacaaaacaaacaaacaaacaaacaaactctatttttaagtcctcactgctaaatgcaaaattttctaccacagggtggtagtaatagatttctgttattgagaagaccctcctccccacccaccccccccccaaaaaaaaaaacaaaaacttttctctcctggtatttagtacttccttcttttttttctcttttatcaggaaaactgatatactattttcaatgagttttggattttctaagggcacacacagagagaataactttaggctacttcttgaagatataattcaatgatttttaaccaatatttatgccatccagcatcacctggagtatagccaatcaaacaaagcatatgaaccaagtaatcacacaatatctgcattgatgtgttgcctacatgcagcagaatgatctggatagctcaccaaaaacataattcatatataccttttttactccatttgccaacatactttatttcagagaaattttaaattatatctcagctgtttctcagagctcctttgtggaaattacatcctggtttctgttccatacttgagtagactacaggctttccagtacattgtccattggaccaaaatctggagcaagagaaatagtgttatggtagtcaggacacagtagctggagccaaactatctcagttcaaattttcgctctgtcacttactaagtctttatccttgaacgtattatttaacctctttgcctcattttccacaactgtaatcaaagggagtagtaatagtatgagttagggtcatcacttaaattgagtgtattaatacatgcatcacttagaacaggtgtgtggtgtatatatctatatctatatttatatatctatatctatacaatcatccctcagtatcctcaggggattgggttcaggactgcccgcatataccaaaatccatgcatactcaagtcccgcagtcagccttgtggaaatcatggacaaaaaatgttggccttccatatatgcggatttagcttcctgcaaatactatgtttctatctgattttggcagatgaatgtgaatgaggaacccacctatagtgatggccaactgtaattattgaaaaaaatctgcatataaatggatctgcctagttcaaaccatgttgttcaacggtaaactgtatatctcttctggactctccatttggaaacacatggacccagaggatttcttcctttgcttgtttatttttatgtgagtttgggcccacatttatctctattggctgatccagaagattcacagaggttatgttcttcatcttgctatcccaaccgtcaggtccaagactttgtattatctttttctcttacttcattgacttgtagatgcccctggtccttgatccatctttgtgaacttaatgattcaaactctgttgtttatagcaggtttaaaagaacagctcttattactagatgttcagaaaaatataaattttatgtttctattaaatttagaagattctacccatttttagcattaaaaaatatgaaatgtttattcagataaaaatttagtccaatgtagatagatatacagtgtcttctaggtaaaaatgtttagtctcccagacacctttccttcttagtttttgtctccttaagatagtgcctattcatagggaaggggttggggggataaatggaacttattttataaggtttcatggtggtaggggaagcaaacaaacaaataccttgagtgctatgtcctcagatttctacggtttccaaagaattggttatgtgctgttggcacagaattggttatgtgctgttgacatctgctagtgatcactgctgattctgtatcgagtgtgagtctctcagcttagaaagcatgtaaaagtgatcatgtgatcaagtgatcttcatcaagtggaaggttcacctcagcttccactgcacctgtcacttatgagctctcactataatttcattttccttcatctggggatagcaggtagtgattcctaaccttttgtgcaaagacctctgacttcatacagttctcccagcagcctcttggtaaattctgagtcctattgtaactctggaacccagggtggttccaaaaggctacaacatagggccttttctccctgacctgttgcattgctaagtaattatagctgagcccctagtgattcaagtaaaccttcaagaagaacctcatcccagactcctggactatgggcaagagttttctcctcattgttattccttcaatatatgtaacatacctcatggataaggatggctcttatattcttatataatcctaaattaaatgtcaactattaagtattatctctgacatcatctttatattccctccatccttattctcaagcaaatgaaagctatacaacaacatagggaggtactcagaaatgcaaatgatgaaagcataatgtcccctcgtgaacacgaaaacaagttcctggtaatttacgtgcattttgtggtaccgccaaatcccaatcaggaaaataagtactgtgtattgaaattgtacctctgatttcaaaattaaaacataaaaatttttagtagttatataattatgttagttgcatgaaatttgtttctaaaatatgactttgacaaagatatatataggacacatagtaatcaaaacaaaagtggcaattttctcggtagtactatctaccctcatgggctattctatggaattcctttccctattgttttaggtaagccgtcagtatatctgttttgcaaagaaaacaatgatactgggattttagtacaactcatgtcacttagtttccatgtctatttctttatatgagttattatttccttttaaaactatcatttatgtatcatgatagattcaaaatatatctaaatacacgttgcttattatgaatactaaagttaagtaatgcagaatttatagattcatactccagtttaaaattaggtagcttacataggggcatttatattgtttcatggaagcaagtttattagtgctttcctttcaagcatagcctaaatacattaagattaaatacattaaggttaatttgagagtagttttaattccataggaacatacattagccatatcttttcatctggaaaaaattataacaatagcaaaacaataagtctaataatgtctacaaagaaaccatatgagattagaaatatgaaaccttgtataaatccctcttatcagtccccatacaattgtctgaatccccatggctacagtcaattatgcttttttttcccccacagagataccagcaccaataagagaacagtttattctgcctcttgcagtgatttttgtgaatatctcaaaatatcgataataagaaatgggtcctgtcaatcaatgcatctgatggatgctaattctatccagaaaacaatattaaccttttccactgtaagcctatcaaatactagagatctaagatggaataatagctcaaaatgaatttctccatgaaataaaaatagaactgcttgttaatttttctcgaaacacagattagtaaaactgcagctgtttcaagaagtgaatttgtgggaaaatgtcaagtgtgagacatttttctttcttgaccaattaaaagtaataacatgccaactttgagaataatagtgtgggaaatagtggcagtttttaaactttgtaaatagaaatatcaaaacatataattagtttcaaatttttggttaattaaacacaaatacctatttatctgttgtattttgctttcatagtgggcttataatgttggtatgaagaaaataaaaatagctttattgttacagcctatgtaacaaagcatgacaaaaacatccagatatctaatttctcattggtctgggtctttcgcagtgtggatgcataattttgttatcaaattgaatggatatttttaaggatataattacatgtttcttggggaagttcaacaatttaaagtatcttgtcaatgttttatattttccattcctccaaaacttaaaattaagtagtgagtcactgattcaacaagatgtacacaaaagtatgtctactagtataaattataaatgtgaaactatagtttagaactctcatcattaaagttattgggttataatagaaacacatgtaatacatgtaaaaatgtataacacaagctcaagttgagttataaaaacatgttttgctcatgaaatttaattttttactaaatttgattagttgaggcttttaaataaacataaacattaatgaattaaataatgtataattccacaaatgttttctccacatgcatcttatgctatggaaaaatatttatccattctttccacaaatatttattgagctttgaaatatgccagacactgttcttggaagcaagaacacatgaataaacaaaaacattctaaatgctggcctttgtggtacttgtgctcatgttttgtatattaaataaaaaagacaaaaactatttttgtgacatttgcagtttgtggttaagcaggcagtaaactcttcttcacacaagtcaacaggggaagcacaggttgtaaatatctgaatgaaagagtgatgtgatacagaataatgtgtgaaggcccattgtagggaagagacagggaagcctttttgaagtgataactccatggcgtgacacacttttaagtttgcctaagacagttttaatttacatttgttgtcctaacagtctgtcagagtagcctttgctccactcaaatatttaggagaatgactaaggtaaagtagtagactgattgtaagcattgaagcaggttcggtaagggatggttttgattgggtttagggtgatagtaactgagattcagaaatgtggatacacttgatacaaatactctaaataatcttcttttccattcctgtatttaagtcccttatctattcaaagaataagtagcattcaagactctaaagttcaaataacagaatgatacaccacttcctgctttagaggctcacagcccatctgaaagagacagacaaataaacacatgcatataacttagagctacaggaatcctagtgtaattggcaatgggtaagtggatcaccaatgaaagagaggtgaattctaactatattcaaaaacaaaaaagattcacagagtaatggaccatggacttgagatttagaagtgaatgatggtcatttgtcaattgggataatatctctgtaaggtgtatgaggtcctaactttggtgaatgaaaactacaatttgccttcataaattgcttacattttttctgaagaaagatagttttataattccatctattaatatttctttgaaccccctgttacctgagaaggcaatctattttgaaatgaaaataatagaagcttaatacattaacctggaaacactttataatacatatcacactgaagaggtcctacataagtactcttctgttcattttaaacttgagctttattatctgttttttgtaaaccccagagctttcttaatgagcattatgaaaaatcttttaaataagacaaaaacattttaggtttctattcctttttttccctcagtgctttcaaagaaatttctgagcataacctgttgtataaattatactagcaggttatgattgtttggggtacttccttgatttttcacatttaaaaataaaactgctcatgttttttttgtttgtttcaaacagcaagtagaaaaattgtcatacagaatgttacctgtaaactttatctttgttcatgttttagatttttttccttgatttgaatgacttcttttttcttttcaggtacttatatgtgaattattttcaaactgtactttttaagcaatagatgcggaaaaaataggaatactgacttattatgtcctcaaagtctcctctcaacaaataccaggagatttccagttttctcttacatagtttggttggaattagctctgttttgattaatactcatgaacaatgtgtttgttctgccctcttttttaaatatgggagggagttgatgttggtaattatttattatttctctcaactttgctataaaacaggaggaatttcattcaacttccgatcacatttgaattagataccagaagactaataataagtaattttacaatgttgatgtgcgggcaattctagggaagactcaaaacccagaatacataaaagggaaaattcacacgattaattacgtttaaaaattcacatggaaacacattaaagagttcaaaagagaaaagggaaaagtaaagccatgaaatacaaactatccacatgagtactaaaataccaaggtgtaggttatacatgtttatatatttgtcaaaatttggaatgtacacttaaggtttgtgcattttattatatgtaaattttacattaaaataaataaatttgaactctagttaatgatagtaataataaggtatttaagcgaaagtacgctgattcctgcaaagtattttaaattgcatccaaaaataaggtagaataatgtatggataggatgaaggaaatatggattgtttgtgccacgagtttaaataaatattagtgttagaatctaggtggtagatcaatgatgttcattgtaaaagacctttaaattcactgccccctttttttttttttttttttgagacagggtcttgctctgtcacataggctggagtgcagtggcacaatcatgactcactgcagcctcaatttcccaggcttaagctagtctcccaccttagtttcctgaatagttgggactaaacatatggccgaccatgcccagctatttttttttttttttgtagagacgggggtctcactatttttcccaggctggtcttgaactcctggactcaagcaatcctcctgccttggcctcccaaattgctgagattacaggcatgagtcaccatactggctttcactgcacatttgaaattttcataataaaatgttgaaaaatttctacaggatgatttctaataaataatataatgcaattgaataccaattaaaaattgcattgacatgaatggtatcaacaaaaaatttaaaataaacacacaagtgaaaaaaatgaaaataatgcataacttcattgtcgatcacatttataaattaaaattaaattgatatttattctattatgtcttgaaagaagaaaataaattataatacacaaggtttttgagtgtgagggtgttgagaattatatacaatgtccacgtgcatataaatttgtacagccttttagaaatactccttttgaatatatgtctaataaatttaatgacattacctttgattcagcaattcaaattttagaaatgtattttcataaaacattgaaagactggatgcaaagatatatatccataagtttatagttatcaaattgaaagtatataacatacatatttagcaaaattatttgattaaatacatttggtataaataatatgattaaaattttttattgtattgtaagcactgatatagatttatatttatggacataaaaagatagccacacttttttgagtgaaaaaggcaagctatgaaaaattatgttgaataaatatgtgtgtgtatgtgtgtatatatttatatatgattgtatgcataaaagaataaacgtctgaaaatgtagaataaaataaaatttgctatctctggaaatgctatattgtggtcaatgtttactttccttttatacatttccttttacacatttcagtagtttgaaaagtaaaaataaacatttacagataaaaacttgaggaaatatttcacatcagatataatgaataattaatattcttaaagtactgagttcttacagttaaaaactaccaatagtcgcaaatttttaaaaacaatatttatttacatgacaaaatggtagtctctaggaaacacagagaataagaaatatagagaataagtattccttaccttccacatatttacaaccagtattcaaaaatagttttaaaaatatgtttaaccactctaaatgtacattaatattctatacacacaaatgtgaaatgatcacatcaaagtaaaactatttattgctttatatttacttactacatattccaagccatactaaaatgtatttaaaatgtaattctaattgcctaaagaaagcatacgagtttgtataaataaaataccattttcgtaaaatgaaattctaagataaatttgaattttgtttttttgaaaaggattataaataacatttagattatatcatcattcatgagttcaaagaagaaatgaaatctcctttgaatgtcgcaccattctgccctgattagatcaattttggacaatgacaatcgtaattaattactcttagccttcaggatgatgcacaactcaaaatacggaaaactgaaattctataacaaatacaactggctttacaacatctgaacaatttaatacatttaaaattacttaaatgaaaagtaaaagttaaagttattgactcaaaattttaatcagcttgactatccttctgcatctaaacatgaattaaacaatcttaaagctagaaatctaaccacagacagatataagtaaaaaagagaagtttaccagtttacttttttctaatatctgagttgaattagtctcttccaaagtattttttttttgcaattttgaatttactagttattttaatgaatgaagaaataataatgggatataatgtcttaagcaggagtgagtagaatatacaaaaatctaatctaagaatgggaatgagatattggatatttatttatgaaaactgaataactaataaaaatgatctcagcaaatatgcttaatttagatattgtgataatttcttgtgaaacttttgaagttaatgttttgagggaactttaaattctctctcaaccacttgcaatttaattaattagctatcaggcatcagtgatattcaaacttgcctccagaatctcatttatgagatttcaccctggatcacatttttagtttgtcataaaggttggcactctgcacaaaattggcaaggcaaaatatttattttcctctgtattcacttaaaaaaaaatactgtcacatctgacagaaaccatagtaacttctctctaaagttattctttctcaagttttttaccctttgtgctcttgacaacttttctgcaaatttcattgtaacagaaccaatacaattaataagattcctgctgtaactttcctcacgccttctatttatttttgtctgtttattaaaatagtactttttataagagtcgccctatgatattactgcttcttttaattactttttgaaaaataaatacttttatttttaagaagtatgtttaatcaaactcatcttaaatttattttgcgtaccttcaaatatgcagttatctgagataattaatgttttaatatggccaaacaaaatttgtgctttaaagtccattatctcagcgaacagaatggagtgaaaataaattatatttaaaaccacacacatacattatgcagaattttctcctttcagaattgatattcacagaaataaaatgccactcttattgtttagttggaaaatacaattgttagaaaattacatttcatcttatgtgtcaatctctgcagagaaaagcaaattagctttccctggaatgtgagaaagcagcaaaagcaaaacactctaaaattataatttcatattcttatatttttatctttatcttgctaaagaataagaatatattccactcttaaaaattcttgattttgtggaggaaacacattcagcaatctttagaatgatatagataagtgtcacttaattatgaggatacattctgagaaatgtatcattaggcaattttgttattgtgtgaacatcacagagtgtacttacagaaacctaaatgggatagcctcctacacacctagactatatgctatagcctattgctcctaggctacaaacctgtatgaggtactactgtacagaatactggagacaactgtatcacatggtaagtatttcaatatatttaaacaggaaaaggtatggtaaaaatacagtttaaaagacttaaaatggtacactgtatagggcacttgccacaaatagaatttgcaggactgaaagttgctctgggtgagtcagtgagtgagtgctgagtgaatgtggaggcctaggatgttacactattgtatacttcacaaacactgtacactttataaacagtgtacactttataaacactgtacacttaggctacactacatttactaaaaatatatttcattttttcaatgataaattaactcaccataacattttaggtttatttactttttatttactctttgacttttctgtaataacacttaggttaaaacacaaaaacattccacaaccgtaaaaaatatgttcttgctttatatccctattatagaagctttttcctttatatccttactatataagctttttataaaaattttaaaagatttattttcgtttgtagtttctaaactttcttgttaaaaactaagatacaaacacacatattagtctatgcctacaaagtgtcaagatcatcaatatcactgcccttcacctccacattttgtcccacagaaaggtcttcagaggaaataacacacatggagctgttatctcctatgataataatgccttcttctggaatacctcctgaaaggcctacctgaggctgtttcacagttaaatcttttttaataagtagaaagaatacaatctaaaataatgattaaaaacatagtatagtaaatacacaaatcaataacataatcttttattataaagtagcacataattatatttgcttatattttttgtatgactggcagagcagtaggtttgttttcaccatcatcaccacaagcatgtgactaatgcattgcactactacattaccatgactaccaccactaagagataggaattttccagctctattattatcttataggaccaccttagtatatgtggtccatccttgactgaaacaactttacctggtgtacaactgtacgtatccaagatagccaaaaaaaaaaaaaatctaatactaacattgtaagaactgtataaaatttaattttaaaattacatgaatcttttaaaatagagaatgtacccttgttactcctaatacttagctgactctcctttttctagatgagaaaaatatcatcacaattgcaaatcatcttaaaaggagattctcattcagtataatataatttcacttacactgaatatcactttttatttcctttattgcattatctcacatttgaaaggtttgaattgccacctggcagtgtattataatatcatattttacattcactctttatcagatatctaacatggaaattcaagttcatatttctttgcagacaaaaccaatgacaaaaagttctttaaacaatcagtttctccaaagctattctaaatacatttaatcctctgaatcaaatgcataatatgaatatgtatcatgttcataagcaagttacataaaactaaattgttatgccactaaaaatatataggccacatatcatgtgtctacacttatctttttgaatgcattgtgtttcaccttttgagatatagttcacacactggttataaaaatatccagcccaggctggaatgcaatggtgcaattttaggtcattgcagccttgaactcctgggctcaagtatcctttcgaatcagcctccctagcagttgggactacaggtgcatgccaccacgcctggctagttttttcattttttttattttttgtagagacagtatcttactaagttgtccagacttgaagcaaactcaggccacaagtgaacctttccccttagactcccaaaacactgggattacaaatatgagctgccatgcccggcctattaaactattccttatttgttggtggtttttcttttttggtttctttgtattgtgttgttctttttttcccccttttttaactattcttaacatatcagagtttgtctactcagatttgcatgacctcaaactcatagggattatttatcttcattagtcattaattgctaacaatgaaatctaaattggtgagggcagaaaaggatacgcagataaattttgttccatcatttagatacatttttatgtttatattttcctattatgatacttttaggtttctggagctgcagaacctttgtcaaaaggtgcattttttcattgcaaatattctaacctatgtgccataactacaggggaacatcctatatataaagcaaattattctattcaaatttgacacatgtcctctgtctctgacaatatttcaaagtcttcctaactgtactttatttaaaacttctataacttttctagttttattaacggattaattttcacaggatgatatgatgcttgcaatattcagcttccttatgatcaaagccaattctaattctgctatttactcacaagcatactaattactttttaaaatatcgtgtttataatgatcaaaatatctctctgtgtaactgattctttttcctagcaaaaagctcattagtagtcataggactcaataatgttaatattcccaggatgaatgatacaaaagattcattatctttatgccacactggaatcattgaactgaatcattttatacgattacaattatctttcaggcaatgtactcatataaatttaactaaatgcttaaatggcctgttgacccaaagggcactattagttttggcttgataatttaataaattaatgcccaggaaataatacatactttttattccacacttttctcttttattttttgaatcaaataaccgtgtgggtataattagaatattgaaaaaaaaaaagcttcctttcttcttggctacccttccttggtatatgcatgtcttcttcactgattatgatgaagaactgagagaattcaacctacataagttcattttctgtataattgcaatttaaaactttaagcagcatgcttccaaccagttttggtgaaactctaagaacataaataaattatttgaaaagtcagtataaagtataccttcagtatgaatataatatgggtatataagaaagactatttcttgttttctcatgaaatcctaattttcttagttttatgtttagttttctttttatagataaattccttaaagccctaagtcatgacaagcagaaaaagactgaaaagatttcgaattaaaattattttattgtaaaaattatattgattgatcagagacagttaaatattatatttacaaattccaatctgtttaaatgtcctattagtacacataaagttgtaatagtatggcatttgcgatttatcgcaagatttctatacctttacagtacagttctctgacattggctgcacacagcaatttcccatagagctttaaaaaatactaataaaagggcctcaaacccactacttctggcttaattggcctaggatgttgcctcatcatcaggatcgttaaaagatccccaagaagttctattcttgagccaagcttaggaaacattgctcaaaaggtatatcaacagaagaataaagtctaaagtgcaaagtagacatttgctttaaacttgtcacatttctcaaaatttatctagtaatatagaaaacattatttgcatatataagccatttaaaatggccctaacaatacttattatcttaacaatttcactagcaaagtccaaaagaacactcataatggtataaaaatatattaaattatttagacatagccagcattttagacagctaacaggatgttaaaacaattaatataacggtgcttggattggcatgtgtctttgaatgtaaaccctgtatatatatgtatatatatgatatatatgtgtatatgtatatatcatatatatttattatgtatgacatataatcctgggtattactattttaatcaaaagataattcagagctcatgaaatatgatgaattgaacttccttgatactgattcggattgttgtttggtccatctatctgattactgcttaaagaaaaacacaggtactaaatttaccatgaactgattaaattaggtgatactaaatttattatgcactgactaaactaattcttgcaagctataaactaaattgtatttattaactgcattatggaatagaaatattctcatgaacaaattcctaaccctctggaaaaataatactttattttaaatatttctattgctgagttaactaagcaacaactaaacattctacaatatgaaatgttaatatcatttaattaaaatacattgtggatattggtattacataatcactcattctacagtattaatcatagaagttttcttttcatatattttatagaatgttattaatctttattctggtatgttatttattataacttaaaaaagcaagtgattaaatttaaattaagatagtttatattagttgattgggaaaaaatagaattgctcatcatattttccctccttttaagtattttgttttttttacttattttactttttctggttagaatttcatcaattttatcaaaaatatgaaggctgtttaggtatgaatttttcttgagcattactgtgtaaacaagataaatatataaagaaaataacaatcttaaaacttaaattaacttttttctaaccaccccagaagtctctgtaaatgaaacagctacagaggcatctcagtttatagatggtttttgcttcaactatttccattgcacagatatacacgtctgtcttataactttaattttcttgtctttcttatgaatataacagtacatgcaaaatcacattatttagtgttggagaaatcaatatattaaattagaggtgtctggaatacaatagatgttcagaatattggtatatttgttgactaaattaattttattatttaatacggtggtgacttctccatggataaggtgagagacctagttgaatcctttctatgaatattcttcaagcaatcttgtcaataattcactgttcatcatagtaattatgaacataaaaaggaaaaacatctgcagtgtgggaaatctgaatttgaagtataattttcagtctggtacactgggtaagatcatttttaagtggaaaagaaagaaagaaatggaccctgaaatattctgtgtgtgagcattagcagcaattcaaatacatgatctgattgccagccaaacagaatttatttaaatatgtacacaagtaaatgggtttacatgatttagggtagtttttacaggtactaaaagttagcagataactttgtcttgaatgtaagccatgtgtacaacagaatgtaaggatccaggcaattcgtttaactgagtattgacttttttcaattatgatgaattatgataaagtgattaaaaacacactacctcggtcttcacataatatatgttttcatttgtaatatgatttcctactttgataacttcaaacctaatttttttatgtttttcatatggatggtttatggttattaggtaaaaatatttatttagattatgaaataaaagagcctaaattaataaagttggaaacttttgcatacttttcttaaacaactgaaaaagaagcaatttagttactacaggcaacatggtgtccatgattagtacaaaatttaattattcacaaagtgccaggcacatgggatatacaatacgacgtgtctttaaatttcacttatttcattttccattatctttaggtttatattatttcacagataataactacacatttcataactaaatctgaaatctatacaaatgcacattatgagtgtttttggagatatggacccccaaacagatggtgagatgctgaaaatttagactaccatataaaaattactcttgctacactgtacttcaccaaaatacacaggactagttaacaattacaccctaattaaagaatcttgttgtctggggtcaaagctttaattcatttaatgtccgtatatttggtaaaaatggtaatatgtatggatatctccagaaaagttcaccacctagcaatatctatgcctgtgaaaggatccagaatatgttgcattaaaaaattatatatatgttggatgtagtccaatgaatgtcatgactcagaagaaagtacaataaaccatgttccccatagatgaccagttgtctccacaaaatgtacatttgttataaaatgcataagaatgaactaggtgtacttaaaatggatctacataggtttaatctacttggcaagaaaaacatttatattattagatagagaaagtggttgcatcaattacagcaaataaatgacagtatttgttttttatttgtcattattcttaaatcctctagaggcaaaatggttaatgaaatacttctcagcctgcatttatatgccagccttttaaataaaatctgtaaatattcaaatacaatctatgcatattctgtagtaatctttaaagattatcaataaagttatagacataaacacatacatgcatgtttgtgtgtgcatgtatacacactacaaaggctagtccttgcaaaagatgagaggtatgttctcattgttcattatctattcaaaaccactagcttactgctacactgtgcagaatcaaacaaaactttctagaacataccaaaaggcgaaattcaatcatcgtgtttgctatttcaaaaatctgaaaaatgttgcttagtaacttgtctgcaagtaggttaattgaattcgaataattattttaaaatactttgcaaattactttgtcctttcatttttaattttacatctacattactattgatcaataccttgcttgagacaaagtttagggtactttgcagttttcatcttttgaacaagactggcaagtagtgggtattaaatgagcattggccaatttaaatgaatactctgaggaaaataattcatcccagttatccgaatattcaaaaccgagttcattttatttatttatatatatatatatgtgtgtgtatatataaatatatatatttagtacatatatatgtactctatatattatctatgtagacacaaagctaaatgatgtttactgtgccacatttttactgtcttttggataatatgatttttaattttttaaatattatgttttcttgagaccagatatatatatttgatttttaaagtatgttttcccccagggcatctacacgaatacttctcagatatggttacttagcaaaaaaagttctcagccaggtgcggtggctcacgcctgtaatcccagcactttgggaggccaaggcgggcagatcatgaggtcaggagatcaaagtcaacctggctaacacggtgaaaccctgtctctactaaaaatacaaaaaattagccggtcgtggtggcgggcgcctgcagtcccagctacttgggaggctgaggcgagagaatggcgtgaggccaggaggcggagcatgcagtgagctgagatcgcaccactgcactccagcctgggcgagagagcgagactccatctcaaaaaagaaaaaaaaaagaaagaaaaaaaaattatcaaatagtatgaacacaaattaatttgatgtgaacttcttgacacaaaattgtatcaagagttagaagaacatgttaatgcattagcatcaagcattaaacatttactcttacagtttttcagttttaagtaattaattttattaaattatatattttagtataatggaaggctgatatccaatttttaaagccagcttttattccacatgttttactcatttattctgatgtaatgacatttttctagtgttaatagtcatataaaatgtttctgctctgtgagtttcttcactaattcttgtgtttaagttttctgagtttgttttaattcactcaaaattatttgttcactctctagaaattcattactcttgcaaataatcaaatcactgtttaagacaattaatgtgttaatcaaccttgtttgcttcaaacaacaaacccacaagttagaccaattttaagactaattttattgaaccagagaatttaatatggcattattttcctatatgttttaagaagtaaatctttaggccgggcgcagtggatcacacctgtaatcctagcactttgggaggccgaggtgggtggatcacgaggtcaagagattgagaccatcctggccaaaatggtgaaaccccgtgtctactaaaaatacaaaaatttgctgggtgtggtggcacgtgcctgtactcctagctactcggaaggctgaggcaggagaatagcttgaacccgggaggtcaaggttgcagtgagccgagataacgccactgcactccagcctggtgacagagtgacactctgtctaaaaaaacaaaaaaaaaaagtaagcctttattttctaataaaacgaagaaaaaataaatacgtatatatcttagttcaatatttttaattcaattggtgactgatcactatgactaactaatacattgaagcttttaaaaatgttattatttccctggcttatttatacgaattaagtattgaatatgtgtataaacattaaaacaaataaaaattaaacatcatatgcagttacaacaaatgatttctaacattaggacatggatttttatggaaagggagaaatattttttatactttctttgatcttcagttcaggtgattttaaataatttaatgtgcttgtttctgcacatattcattaaacatcaagagtgttagaaacctatgtataactaagaaatgttgacctggagaaaaaaaatattgtttcacctcttatctatatttgatattaattcagcaggttgacaatataacaagagcctgtgaacgaagctattgatttacttatgagggacttaaaatatctagtttactagtgacagtcagaatgcaaattaatagagaaaaagaaactcacttgttacgacttcaaaaactattctatcattctatcacatatctattggtaaatgtttaatgatacctgaattaaaattacataaaattagcaaggtatattgataaatgtttaatgagacctgaattaaaattatataaaattagcaaaataagttcatatggtattatttataatatattttttaaatttattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccaccacaatccccagagtgtgatgttccccttcctgtgtccatgtgttctcattgttcaatttccaccaatgagtgagaatatgtggtgtttggttttttgcacttgcaatagtttgctgagaatgatgatttccagcttcatccatgtccctacaaaggacatgaactcatcatttttgatggctgcatagtattccatggtgtatatgtgccacattttcttaatccagtctatcattgttggacatttgggttggttccaagtctttgctattgtgaataatgctgcaataaacatacatgtgcatgtgtgtttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccatatcctctccagcacctgttgtttcctgaatttttaatgatcgccattctaactggtgtgagatggtatcacattgtggttttggtttgcatttctctgacggccagtgatggtgagcattttttcatgtgtttttcggctgcatgaatgtcttcttttgagaagtgtctgttcatgtccttcgcccacttttcgatggggctgtttgtttttttcttgtatatttgtttgagttcattgtagattctggatattagccctttgtcagatgagtaggttgcaaaaattttttcctattttgtaggttgcttgttcactctgatggtagtttcttttgctgtgcagaagctctttagtttaattagatcccatttgtcaattttggcttttgttgccattgcttttggtgttttacatatgaagtccttgcccatgcctatgtcctgaatggtaatgcctaggttttcttctagggtttttacggttttaggtctaatgtataagtctttaatccatcttgaattgatttttatataaggtgtaaggaagggatccagtttcagctttctacatatggctagccagtttcccagcaccatttattaaatagggaatcctttccccattgcttgtttttctcaggtttgtcaaagatcagacagttgtagatatgcggcattatttctgagggctctgttctgttccattgatctatatctctgttttggtaccagtaccatgctgttttggttactgtagtcttgtagtatagtttgaagtcaggtagtgtgatgcctccagcttttttcttttggcttcagattgacttggcgatgcgggctcttttttggttccatatgaactttaaagtagttttttccaatgctgtgaagaaaggcattggtagattgattgggatggcattgaatctgcaaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattatgaatgggagttcactcatgatttgcctctctgtttgtctgttattggtgtataagaatgcttgtgatttttgtacattgatcttgtatcctgagactttgctgaagttgtttatcagctttaggagattttgggctgagacaatggggttttccagatatacaatcatgtcatctgcaaacagggacaatttgacttcctcttttcctaattgaataccctttatttccttccactgcctaattgccctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgcggtttttgtctttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcaatgttcatcaaggatattggtctaaaattctctttttatgttgtgtctctgccaggctttggtatcaggatgatgctggcctcataaaatgagttagagaggattccctctttttctattgattggaatagtttcagaaggaatggtaccagctcctccttgtacctctggtagaattcggctgtgaatccatctggccctggactctttttggttggtaagctattgatcattgccgcaatttcagatcctgttattggtctattcagagattcagcttcttcctggtttagtcttgggagggtgtatgtgtcgaggaattcatccatttcttctagattttctagtttatttgcgtagaggtgtttgtagtattctctgatggtagtttgtatttgtgtgggatcggtggtgatatcccgtttatcattttttattgtgtctatttgattcttctctttttttctttattagtcttgctagcagtctctcaattttgttgatcgtttcaaaaaaccagctcctggattcgttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggcatgttgtgtctttgttctcattggtttcaaagaacatctttatttctgccttcattttgttatgtacccagtagtcattcaggatcaggttgttcagtttccatgtagttgagcagttttgagtgagtttcttaatccggagttctagtttgatagcactgtggtctgagagacagtttgttatcatttctgttcttttacatttgctgaggacagctttacttccaactatgtggtcaattttggaataggtgtggtgtggtgctgaaaaaaatgtatattctgttgatttgaggtggagagttttgtagatatctattaggtctgcttggtgcagagctgagttcaattcctgggtatccatgttgactttctgtctcgttgatctgtctaatgttgacagtggggtgttaaagtctcccactattaatgtgtgggagtctaagtctctttgtaggtcgctcaggacttgctttatgaaacttggtgctcctgtattgggtccatatatatttaggacagttagctcttcttgttgaattgatccctttaccattatgtaatggccttctttgtctcttttgatctttgttggtttaaagtctgttttagcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggaccatttagtccatttacatttaaagttaatattgttatgtgtgaatttgatcctgtcattatgatgttagctggttattttgcttgttagttaatgcagtttcttcctagtctcgatggtctttacattttggcatgattttgcagcggctggtattggttgttcctttccatgtttagcacttccttcaggagctcttttagggcaggcctggtggtaacaaaatctctcagcatttgcttgtctgtaaagtataatttttatttttaaatgtttccttgatgtgtctcttttactgagttctaatatgatgaatcaccaaatacagataatcatagcattcaatgaagagaagttaagtgagttaattaacaggtgtttataaagctgtggtgttatgctttcactaatctttccttgtggcaaatattgtggcacattatagaaaaaataataaaactaaacaaaactaaaaataagcagttcccaagtctccaagcacaagacagagatgtctataaatttaactgaacaacttttccagtttatgtcagcaataaagggatatctaaatggagaccagaatgagacagaatcgtttgtccttctcagctgattctctctggggctcactcttctccccagttggttaatccattgttttcttcacacaggttagacacagaggagaacctttggagatgagaaatttgaactttatatttttcttctttatttctacaggctacactgaaaacagttgctctgtatcaggttagccataagttagagcaccaacttaaattaccttgaaatacatcaactttttataaattttctgatttagagatttcaaaattacttctgctattaatcaaattttccttagacatgttttccattattattgtaatattatcattattaaaataatagtagtagctacattcttttacacattattcaattatggtaagtaatttgcatattttttcttatttaagatctatacaacagttttatgggatggtggtgttaaaattatttttccttggaataataagaataaatatttgggatacctggtttggattactgcattggagaaaaacgtacttcaaagcagactatcattgttaagattgttgcatttcttgagttaatcaagagtaagaccacatttttaatgaatatctcttactatataggaataatctttcttttttttttttttctggttttgaaacagtatctctctgtcacccaggcaggagtacagtggggcagctacagctcattgcagcttcaacctctcgggtccggtggtcctcccaacatcaccctcccaagtagctggaactataagcatgcacaacaccacccgactaattttcaaattattcgtacagctgagatctgtctatgttgcccaggctggtctcaaaatcctgggctcatgtgattctcccacttcagactcccaaagtactgagattgtaggcctgggcctccaagcttggtgattctcctttttaataccttaatttgagatatggccaggcaaacagtagaccttacttctaattacagaattgggaggaaagaaagagtctgagctctgggcacacaagctgatgcagttgatggacaatgtcctgctggataacctccaaagacttggttgtaattttctcaatctccatttttcataggaacctagtagaaagcaggggacagcgaagtcatcatccaggaggaactaacatgaaaaacattttgcatatatattattattttaaaatcatttgccttaatttttaaactgcttatataaaatgaatgtttatcccttgaaatgaactacattaaaatttaatgcagatatttcaggtggcttcagctcaaaataatttgggtaatttttaacagttgtttataataagtaaatttatctttaaaggacagctgagataaataatttttatgaatttacacttacaaatttttagtatagtgttgtgcctaggggaaagtttaatacataataggtattcagtaaaaactttttgaaaaaaaaattgaagcgataaaaggttagcctggatttgccatttaatcagttcagttcagagtcttgagtatgtacatatgaatcattgttaaataaacatggaattattttgtgaattaaaactaatgtatgtacatttcttagatgatgtctaacatgcagtagacgtccagtgagtcacaaatggtgcatagtgtttacttttggaataaagtgagacagaagacaattggtattttctctgtctctcttgtataacctagcataactcacctttcttgaacataggctcatgttgagtgggaagcaagggagtaatcacatggaagaatgttctgctttcaggaattaatgcatcctattcctaaataattaactacaggtaagtatatgatagatggatggatagatagataggcagacaggcagatattctcaaacagcaattaaagtaaacattacaacttaattcaatatctcatattacagttcaagaatctgagaaaatattttctaaaataatgatattaggcatagaagagacacacttagtggctatatagaaatctcaaacttatacaaaagcaataaaagttcccctgatagatatcagtatgggaatgttatgtttacattaaaccctgtattttaaaatgacttagtattggggttggcagttttgcccccttaatcttcaatcccttgatattgcacctatgaatatgtcagcttacatgctaaaagaaactttgcagaggtgatgaagggtatgatgaggagactatcctggattagacagtttcagtctaatcactctagtccttaaaggaggagagccttttttcagctgaattcagaaagatgctgtgatggttaatattgagtgtcagcttgattggatcgaaggatgcaaagtattgttcctgggtgtgtttgtgagggtgttgccaaaggagattaacatttgagttagtgtgcatagggagaggcagacccaccctcaatctgggtgggcatcatctatcagctgccagagcagctagaataaagcaggcaggagaaggtggaagagcagacccgctgagtcttcctgccttcatttttcttctgtgctggatggttcctgctcttgaacaccgaactgcaagttcttcagctttggaccttttggacttacactactgtatgtcaggggctcttgggcctttggccagagactaaagattgcactgttggcttccctacttttcagattttgggacttggactggcttccttgctcctcagctttcagacggcctactgtgggacgtcaccttgtgatcgtgtgagtcaattctccttaataaactcccctttatatacacatctatcctattaatgttgttcctctagtgagccctgaataatacagatgctctggaaaagggagggaggggagaaattcaaagcctgagaaaatttcaacctagaggaagggggctgttatacagggaaagtgggctgcctctagaggctgagaagacctcaagccaattgtcagaaggaaaacagggacctcaatctcaaaatcaaaatgcactgaattctgccagcaatctgagcgagcaaggaaacagattatcttatattccccgaaaagccatggtactctgtcaacatttcgacttcttcctggggagacttggagcagagaaactagctgaaatcaccaaattctgacctcttgaaactgtgagataatctatttgtgttgttttatttcactaaggttgtggcaatttgttatagcaacagaaaactaatgcaggcataatggaggattcagataattacaaatttatccagctttcatttgcttacttttaaatctttccaatatgaacaacaaaaacatgttaattttgtgacttgcctcagttaacaaaaggaaagttctggtgtgaaaatgtcaatataataccgcatattttaggcaaagagaggttgtgaaatagtctcatataattataacatacatgttttctatttttatgtttactgaataaatgaaatttaacgagtttgagttaagtttctgaaaattaaacacaattgcttatatgcaaattgaaaacttgcatcaaactattttgttttgttttatatttgaaattacagtgacaatgatttccatttagctctaaagccattaagcaaggcaaatttctcaagaaaaggttcttaatgtagtccctgaagttaaatgtaacaattgtctatctaaaattgctcttggaattctacatcgcaataatcatttgcaaatgtaatatttttcagttaccaaaactattttatctttactgaactttcctgtggatgttctgaaattattccttcccttcctttaattgcagatttttcaaatgtagcttccagatagcagcttccaggtagcaatcatgatctaaatcactgaagcctgtgtagtgatgtgtatagtctcttagtccctaagaggttccacaaatatcatctcctatacacgttttgaacctcctagacgatgatacaaagcacttatagtcagactattcagtcctgggagatttttgaggtctaaaatctcacagtgattatttggttcttgtatttgtagttcatcaagtcacacagttcatcaaattcatttctggctcagaccttgccatatttaggggctaaaacagagccactacctagagtttgcttgaattctaaggccaagatcatagtctttgttttcttgttgttgttgttatcttctatatgcatttagtaatctcatatcactgggaagtctggaatgtccaaaagcctagatgatgtactgtggaactcacatgatccctctgataagggtgagagtctatacagggatagatacaatgaataaactaaaccttaatccactccctgtataattgaatctgttttaaacaaaccctaattttttaattaaagctcctctgatcattgaaatcaattgtatttgtttacctaaaacaagccatggacccgaataaggagtagattagaatacagaccaggaatggagtaaagaggtcaaaagtgaggaatgactaatttgcaaaataacaaattcaaagatagtaacaaatatcccagcctcaaagttgtaattaataatgataataatagtaataatagatatatattgactatgtgtgtgctcggcagtgttttatgtattgtatggactcataagaacagagagcccctggctcaatggaaatgggcatattatgtaaaaaaaacacacacacacacacacaaaaaactgtcttgttaaaaaccaatatatttcaggttttcttttctttctttctttccttctttcagcctgcctttctttctctctctgccctttctttctttctctttctttctctctttctttcatctctttcctttcccagtttatcttcatataaatattgattacctgaaattggtgctactgtaacaatgacaataaaatgcacagtatttactttaagtctgggcagtaaacagcaagggaactcttactggaggctgtaagaaaggcaatttgtattacgcaagagtgaaacataaaactgtcacttgtgataccatgaaagagagaaaatatcccagtgaacttgtagctttaggtcaaaagttgaacaagtttaacaaagagaatttgtgatggttgcatttgtaatggtactgagaggtgacagcgtgctggcagtcctcacatccctcgctcgctctcggtgcctcctctgcctgggctcccactttggcgacacttgaggagcccttcggccgccgctgcactgtgggagcccctttctgggctggccaaggctggagcccactccctcagcttgcagggaggtgtggagggagaggtgcgagcaggaaccggggctgcctgccgcgcttgcgggccagctggagttccgggtcagctggagttccgggtgggcgtggtcttggcggccccacactcggaacagctggccagccctgctggcaccaggcaatgagggacttagcacccgggccagtggctgcggagagtgaactgggtcccccagcagtgccagcccaccgatgctgcgctcgatttctcaccgagccttagctgccttcccgcggggtagggctcgggacctgcagcccgccatgcctgagcctcccacccactccatgggctcctgtgcgcccgagcctccccagcgagcaccaccccctgctctacggcgcccagtcccatcgaccacccaagggctgaggaatgcgagcgcacggcgcaggactggcaggcagctccacctgcagccccggtgcgggatccactaggtgaagccagctgggctcctgagtctggtggggaggtggagagtctttatatctagctcagggattgtaaacacaccaatcagcaccgtgtgtctagctcaaggtttgtgagtgcaccagtggacactctgtatctagctgctctggtggggccttggagaacctttatgtctagctcagggattgtaaatacaccaatcagcaccctgtgtttagctcaaggtttgtgagtgcaccaatcgacactccgtatctagctgctctggtggggccttggagaacctgtgtgtggaaactctgtatctaactaatctaatggggatgtgaagaacctttgtatctagctcagggattgtaaacgcaccaatcagcaccctgacaaaagaggccactcggctccaccaatcagcaggatgtgggtggggccagataagagaataaaagcaggctgcccaagccagcaatggcaaccccctggggtccccttccacagtgtggaagctttgttctttcgctctttgcaataaatcttgctactgcacactctttgggtccacgctgcttttatgagctgtcacactcaccgcgaagatctgcagcttcactcctgatcccagcaagaccaggagcccaccgggaggaacgaacaactccagacgcgctaccttaagagctgtaacactcaccgcgaaggtctgcagcttcactcctgagccagcaagaccacgaacccaccagaaggaagaaactccgaacacatctgaacatcagaagggacagactccagacgcgccaccttaagagctgtaacactcaccgcgagggtccgcggcttcattcttgaagtcagtgagaccaagaacccaccaattccagacacagtactataggaaagagatgagcttggaaaataattcaatggttttcatgcaaaaatatgatggcattgtttagaattttaggggtgtgtagggttgaaacacatttttaaccacaaccattaaaaagcaaaattgagaaatgatttgatcagcaaaggtcaatcaaaactcagattcacagtaaagtcaagtgtatgactatcacactcactgttaaaactatacagtagtttaagatgatgctcagtcaatcctttcagttcaacaaatagtgcaaggaaatgagactgaaggtaagcctgttctacagattcctggcaggatcaaggtacccaaaattaaatctaaagggagagtcatatcattaaaagaatagtatgttttataaccagaagttatgacacacacacaaaagacttgaatctttaagggggttattctgaagctgtcatcacagggttaacaagaattctggacagaaatatagttacaagtatgcattagtcaggctgcaatttgattcacttccttgtaaccaaaatcaaagtcactagatatcgaccatttgcatgtccattgttcttctaggtaggatatctgaagttagaatcataagacttttaagaatcctgaattccagcagaacagctgatgccaacccgaaaaccccacatgagaactaaatcagcatgagaatgcagtttcttcttctccctgtctcatgactgcaccctgcactcttcaactaatcaacaatctccacacatcagtccactccaaaacctttaaaaaccctaccctcaaactcctcgagaagacggccttcaggtttcctcctgtctctttgtttggcggccctacaattaaacctccttctctgctgcaacctgatgtcttggtgtattgatttgtcttgtgcatagggcaatgggcaatgaaccttttgaggctataattccactaagtcatccacctctctggaataaaaaataaaatgacctcaatattctaaagatgtaaaacaagcctataaaaaaatcctgcacagcctccagagaagacaaattctcaaattccctctttaagtgaagacaagaaggataatagaaagttaaagaactcccaaaggtcaatcccatggatgatggagaacaaggtacagaactggattgctaatcctaggaagtgaaattagggtctaatcaaggaatacacttccagtgtaaaagcacctcataaattccacacagctggatttcagaattgctgttgaccaatgaccattatatctcctgttcttcccatgtcaaaatggtcactgtggttgtcttgtgtctgcttcactatgtaatatttggtaggggaaaggggatcattgacacttaggtcaataggaatcacatccagacttcatttagagactatcacattacctagattcacggattttagttagatactaagattgcttgggactttgtgttccccccgcctggggaaacaggagaaacaggagaagtaaacagttacaccttatggaacatcttctccattaatattttcttaatagagcatttttctgctttttctatccaaacttagtagaacttacatatttctcaatgtaaatattttgaccaatatttatctaaaaaaatttcaaaaactcaacagcaatattttagcaaaaccggtatatgtgaaagtctcaggttgcataacaaatacatttgacagaacttctaaatcatatgcagatatcttgaaaacttgcagagtatcaacaaaagaaataccattcttatatgaagcacatcacagtgtcattgtcagttaaaatattctctgtgactttgtacttgtgttgaacatcttgccacattactttttatatttctatagtacttgtctaaaatagtaaaacaagtcctccaaacaataaagaaatttgtataaaaattattgagaaaagctgtatcaatggaagaaaacttactgaatgcaaaagaactgcttgttaacaaccgtattgtttggtagttaagaaccaaagatgtaagcaatttatatacttaggcaatagttcataatgtgtattctttaatgcattttaaaaagtaatatattggttgtaaatatttgactgatgtgtaactcattaggaatatttttcatttaaattattaagaaataggctacttgttagtattttcacacataaacctctaattcgcaggaataaattactgtgattaatgggagacccctgtaaaaaagaggatcaaccaagtttttggtgacaatgaagacagatgtgaccattatttgtgctgttgaaaaatatcctcattctccagcccaccttctggacacaaggtagttgcacttcctgaattctgtctggaggatggggctgggtggtgagtttcagtccgtgaggtggggtggaagaatgcatatcatttctggaccaaagtacttaatccactatgatatcctccagtgtgttatttcctccagctactgtgaaaagtaatattagctttggtccttgaatgaggatggcatatacaccagatgggctataatggacacctaacatgaatggaaaaaaaaaaaaaaatcctgtgttgttttccctctgtggggcaagtgggaggtgagttttacttgaaaaatctagtctgatctctgtttctctacaacttcattatgactgaacaagcacaaatactgtcatctctactctgatttactataaaagacttgtaattgatttttctctttcatgttcataatctgcaagtcttctttccatagagggagaataaatttttttaacatgcaaataagattgtgtcagcagttctaatgtgcctatggataattcgagtagagtataagtaaaatttactagtaggtgttccaggaactgtgaggccaaattttagaaagtccattattatggatgttagagttcccaagcataaaagagaataatgaatggaaagaaaggttataattcagttagtggctaaagtcactgaatatgtacaatgtggcagacactctttagttctcacatcactctaattctcttacaacttctcctactttatatatgaggaaatttaatgacagaaagattatggtaaacaatatgtcttaggtaacacaattgttaacgtaatagaagtgggattcaaacttgccacagagcctaacacttaactgccaaaaaccaaaaaaaaatcctgaaagttctatggacagaaccaataaaaagtaggcaaaatgagctcatgaggagtttatgaaagtgcctgttacaatgctgaatgcaaagcaactgcatgctttgtacttatattcttatctggatgctttataggtaccagattttctctgctcgttcatcagtagacagatgaatgttcctgatttccacttgacaagttaatgcattttggaagtgtaaatactcaaataaaattcaaaatcaatgtctaataaaatttttctgagcctggactccaccactagacaacgtatgcatgtaagaaatccgcacttatactcactaactctataaagacaaaaatacaaattttcttctttttcctatagtataaagagctcccttggtgcgggtgagcatgttattattcatgctctatcatattccaaatttcattttatgctacaggttagcatatcaattactatcctcattttccattgaaaggtcagcgttgctgtttgtgtggtttttgagcagaagaaatatgcattctgaacagtgttataaatgtattagttattccttaataacttattatgctacttggatgactataagaatgtaatatataccactaggtaagttatattttctcaagtagaaacaaagaattgaaaaactagaagattatcttatgatacctagtttaacttccatgttccataggtgaagaaattgagtcccaagtaagttaaataactttccctgaatttcagaggatactagtaaatagggataaattgaggaccataactgagggcccttgaatctgtgttccatgtagcttatgtaattaataaaataaaagcctcaatgttacacagcaaatatgtctatctacagaaatttattaaatagtatttttaatagtaaatgagaagtcaaaaaggttggctcatataaagatactatataaagtatttttcttgctaccacaacgtaatcattgcattgttagggttgtgttttctctgaactatccatcataagatttattttttgacttttgtatatctaatgctttctcacttagatcttctagtaattcacatctgagttcactttgctctcaccacttttctaagcagggttaggctacaatggtaacactttaccttcttgcagtgtgctatatttcattttgtaattatatgaaaagacattgtaaaaaagaggaaagaaaagctcaatgtattttacagaatgcattttgtgccaagtctgaagtaccacatacttgtgaataccagagagttttcaaagcattttcattttatttcacattatttcatttaattctcccactaatctgtagaggtaggcgaagtaggttttaatgtctctgttttatagatgagaaaacttgtcattggaaggataagtgacttgcccaagttcacactggtattaagtggtgaagctgtccattattcagtgcttctccctctacagtttactgagataatcagtgttgcttaatagtagctgcctagaatacatctactataattatgaaatacctaccctcaaagccacaaactggcccttttccaatttctcacacttttatagagcagaggtcagcaaactaaagcccacagatcaaattggagtccttcctacttttgtaaataaagtttattaaaacacaaccacagtcattcatttacatattgtctatggctgttttcccgctgcaatggcaaaggtaagtagttgggagaaaggtcacatggtcccaaagtcttcagtgctcttcggcctttgccttgaatgtgtgctgacccctgctagagaatatgaaaagctaaagtatacttccagactcttgcagctattctttcagaaactacagaaatctctaagtaatctttccaggaaatgtttttaaaataaacagacttgactggcttggctcttcttttctttgtccctttcctatatttgcttcttccaacctgtattgtgaacaacacctgggattgcagtcattacttagtatacatgaagagacaaacatatggacaaatgaggacggatagaaagaaaacagagttagggtgcctaactacatttctgagcaacttcttcagccctggacttcgtggatctataaaggattctctacatatgaaatacactgttagtagtgttacttgattataatttaaaaaaattataatggatgcattcaaatgtcctgtcatttactgagtcataacaatagtgttagcttccatgttaaggccactaaatattgaatcactttaggattcagcattttactcctttatctacacccactcccttagcgatcttatataacctcatgaatatacagtgtttatgtgatgattaatcttaattctatcacaaggccagtcatctattcagctagctactcggcaactctacatggaagtttatccatatttcaaacttgacttctgcaaaacctgatcctcttgaagatttccccattccagttaatagcaatttaatgtttcaatgcttgtgccaacaactgtggagtcatccttgatttctctctgtcatctacattccatatttttagcaaatctagtcgtaaccccatcaaaatatttcctgaggccctgcaagctgaagcttagtccttgttatacaggtgagaagaatatgtcagattgccagtgccttcctcttctataactaaaagttctttgagtctaacatctggataaattgtgcccaacattaaacttcatttttcttctgtctctatagaaatgcctcttattaaaaatcaatttgccttcatcacagacagaagcctagaccacctgagatgccatctcctcatattggaaacagctgtttaactgaactgatctagtttcaggactagtctgcagttcatttaagtgctgtgctaaaactgttggtaaggttatcaacatctttgtcacataagcctaggaacactaactgggaaccccatgagtagatgcagataactgcaaagtggttttatttttatttcccttgtgcataacccacctcaaccccacaactatgcctcttgtcaacaggaagaagctagagtgaccatcagccttttcccatctctatagccaacaccttaagagtaaggtgctatggagcccaaagcagggtttaaaactacctttgcaaattatatcagggagaaaattatgacagtaaaagagatctgatttaaccaccccgccccatcttgcctttcccttcaacattcctgagcttaggctaagctaactttgagagacatttagtttatatgacttttatcttattttgttatttttatagagatgaggtctccctatattgcccaggcttgtatcaaactcctggattcaagcaatcctcccaccttggcctcccaaagtacaaggattacaggcacgagccacagcacccattcaatataaaatttagttttaaatgataataggcctcccccaaaactcaaccacctttgtaaatctaatgaaacattatcaggctagggggaagagctaaggtgtggtctgatcacaagatatgcaacatcactatagtatattgcccttttgagatatttgttcaggttttttgcctgtctgacacctggacctgattgctcctatggctccacatggaagcaactccgcttaagaggatagctgtgccctcctacaatttcatctctgcctgaaccaatcagcagcaagtacccattacctggccaccccatcccttccctcaaactgtctttgaaaaactgctaacctaaaagcctgagatgagattgatttgagtaacaaccccatcttctgtgtagtgtggcaggccttgtgtcaattaaacttttcttcagtgcaatgccatggtctttatttatgcagcgggcaggaagaactgatcaagcaattatccttctactcttgtcttatttggcctattctctatacctcagtcagaatgacccagtaaaactgaaaagaagacaaggtcatttctctgcgcaaaatttttcaatgatttgctgtctttcttaaacagaagcgaaaatctttgacaacaacctacaaaatgttttgcagtcagtcccacttcctccccaaccctaccttgttatttccatgacctcaattcatattatagcctctttcattcattgtcctctggctacacttttttgcttgcttgtcttcctgaacatgccaagcattctcctgcctggaagtctactctggttattctttgtttgcattgctcttcaaccaactagctacatggatatctcttctcttgcaaatttctgctcaaatttgattacctcagtgagctcttccttgactattctgtataaaacagccaacaattaaccacttcccttaagatgacagcaagaatgaggaaaataaaaataaaaataaataaaagcataaaagattatccacttctctttcccattagtacttcctatattctctaatcttccattctttatttctatcattaatgttttattatgatatataatttatgtactataatatacactactcttaagtatttgctttttctccttaactcatgtcttctatgacactatatactttacttttatttatttagttatttattttttgaggcaggatctcaattctgtcacccaggctgcagtgcagtggtgtcatcacagctcatcaatgcagcctcaacctcccagcctcaagcaatcctcccacctcagcctcctgaatagctgggactaccagtttacaccaccacagttggatatgttgtttttttaaaaaattttgtagcgatggcatccccctatgttgtgcaggctggtctttaagtcctgggcttaagcgatcctccacctctgcgtctaagattaaaggctaagcttaaaggcatgagccaacacacttggtcacatttatttattatttactatatgtcttcctgaatttaatttaaaaacgataaaggcagaaattttgtttgttttatttgtagagaacccacagattttttagtaagtttctggtgaataatttaatatgcattttctcatttaatcctcacattaatgagttatttcctccacagaaaaaaggaaaaaactcaaatttattatatttaaaataattggcattggtcacattgctagtaactagtgatggaagtgacgaccagtgtggagcagctgctgcaaggatgctggttgcacagcatgagacatggacagggttgcatgttctgcagagctggtgggagccaggagcaggcgagagcccagacccctacttagttgatgaggcagaagcccgtgctccctggcacagctgcagccacccagctgtggcgctggactctagcatcactgcactcttgggggcccaggaagctacttgccatagcaggcttgaaagtacctgctcctgctccctggcctctccccacttccagcacccactctggcatggagcaaagttgtaaccaagcctgggcactgttgcaactctaacaagtgtgcgggcactcgggacagggctgacacaccagctccctgctgcctcagcctcctccagacttcgggcaccaacaagcacaggagggaggctggcgggcgtggtgagtggtgagagcagctcagcatgggcctgcagcacccctcaacacaaacagcctgggcactgtggacagcatgttgatggtggcaagaagcagacaggccctcgggtggaaaggggtgcatcccaggtgaaaccccaccttcaaggcagggatggcctgaagcctgggggccgggttgtcagttccagctggagtccactacccagagtgagaacttacggtgcttttttcgggcctgccaatgacagcccatggacaaataagcgcatatttcctcccttctgagcccactgaaaccctggactcagccagactcagacatatgtcaggactaccagctgtgggaaggaactacccacttcaggtctcctggagtgataaggatgacctgtctgcagaaaggagcgatccactaggggtctcctctgagctgttctgttgctcagtaaagctcctctccaccttgctcaccctccagttgtccgcatacctcatttttttaagaggcaggacaagaagtcaagaccaactgaatggtgggaatgaaagagctgtaacacaaacagggctgaaactccccccgatcgccatgctgtgggcgatgaaaaggagagaagagctgaagaggccctttggggacgccagacctaggggctccccgagccagggccgtgacaccctctttggggctctgtggttcctggcgtctcgaagcttctgggtgccaccgcagtcccctcatccagacacaggtgcccacagtggaagctgcttgtggtacatctgatccagccacagccttacacagagcccgcacctgtgccggtgcctggagctgcccaccgcgctgcagcagccagcatgcctggctgtgcgcagtgggtggaccccacgctcactttctcacatatcccttgccactccatgcctggcttacccttggccggcgtgggatcctagccggtggtgcaagccaagcacagcctggcaggctgactgggcagaacgagccagtgggcccaagcaaaactcaggcaaacgtgccactggccacagaggtttccagctggaaaagcaacaccctaaggaactcaagacagcagtgttgccaagattttaatttagaaattgtgaagtcacacaataccctcttaattaccatgctctatattctcctagctgctctgtagaaaaaagttcagacaaaacaaatagtaacatgattgaaatggagattggcaggatactagaacaagcagatatcaagctacttcagaacaatatcctcttagttgccaaatctaagagaaaaagtaaataagctcataataaaatacagagaacaaaaaacctgagaatgtatgattaagataatatcaatatgagaaaatactacatttaaaactagttgtcagtggaaggaggagtagagaaaggaagagaatagaactctattaagtcaagtttcaggaagaattttccagtctgaataaataagataagttattagggaagtaataaagggtcacttctagaagaataaaaacctgtatatgtttatccattaactcaaaaaaaaattattcaatcctttcatcttgaaagagaaagagatgcatttaataatggattatttaaatgcatctctttctctttccaaggcccaaataatgttatcacaaagtaacaccaacaatgtgaaaacccatagaattgtgactacaaaaattgagatatttcagcacacttttagcggatctaaagtgaatttaagaggtaggaaccatttagtagagccaaaaacgataaaacctgaaattctctagagtaggatgttaatgaatggtgaaagattctgaataaggaagcaaaaattgccatggaaagcagggaatgaggcaagattataaaaacacagaacctgttttttcctcaggactcttatccttacctcaagtacacaggttccgttgctgtttgagatcagtgttttatttgctaaataaatatggagcagaggatccagacttgactccccaggtgtaagagaagagtgaggcacaaagctggaaaaaaagaaataagaaaaattattttatctttcagtttcttctcatcatccctaagctctcccacatcttatggagggatataatcccctcctttcagattagccagtatcctgcctttagctatagtcctacatttattgtctgtgtaattactgagagaaataagatggtaattaactttcaaaatgggcagtatacctgtaacaaagtctttgaaagcaactgacatacaaaaattctacaaataaaagtaagtgtaagctcaaataatacaatagtacattatttatagaataatgcttttcccattccattgtattttaaacctatgaacccaaatgccatactggaaagaaatgttagggaaatgtcagcagtaattcagtgggtccatgaaagggcttcaacttggcaggaaacctctaaaattatatgcaggatcatatttgtattttcatagtgatggttttcatgagagtatctctaaatgaatttcaaaaataattctttcattaaaaagagttttttttttcctttaggaaactttttaatacataggctatccgtgaaatatgtatatgtcttcagttgctgttgaaagcaaaatcagctactcctctgtctgaaaagtattttacttcatcttcattcttgaagggtattttcaaggcatatagaattcaaggttgggagttttgctgttattgttctttctgtgttgttctgggtttttatttggcatgttgagaatatcattttactgttttctgacttttattgctgctattgacaagtcacctttcaacttaatattttctcttgggccattttttaagatttttttatggtgtatttgatgaggtacagtttcattataatgtttctagttgtggatttatttttatttcttttttcctgaaattacttaggatccttgactctatggatttctgtcattgaccatttctgaaaaattatcagccacaattttttttttacccttggccagtaaaatttattatctgtgccctatttctttttttctcctcttaggacttctgttgaaataatgttacattttctcactctgtcctgtatatactttattctcttcctgtattttccttttatttctttgtctcccatgcttgtggtgttttttacagtgtaaacttagcttagctagaaatatgttttccatatgtgcttccctatatgcttccaggttatagtgggccaaaatagaagttggtacatgatttggaaagtggagaggaagcaacagccataacctctgttggttgttttggtgttaggctgtaagaaccagaagcatcaacgctcagagaagcaaattcaaaattaaccatactcttcccaactctgcatttgtaatattcacctgctagccctattgaccaagagtgacctcaggcctactccatctcagatgcaaaggcaataccctgacacagatgtctccactagttctccttaatggtcccattctgcaagtcagccatgcctggtttctgagatctctggcaagttctaatttgtccacccatactggttcttcagagaggaggagagcaaatttttctgatcctctaactcacccattctgacccttacttacccagtgtcttgtgtagttgtctaaagttttagtgctataataaatgtcctattctgtattacttacagtggtagtgctcacatggttgaactttgtctgtactgcgtactgttttactgcactctttttaagaacactaacttcacatccttgtatataattagctatgaggtctatgcaatgaatttttaatttattaaattttggagatctttatgttctttatatccttttttacatctgtagcatcacattttatttccctgtttctgttgatgtccttaacttttgtctttgacttctttaagttaaaaagcttaagagtttcttctgccttgacctcctgggctctagtggtctttctggcctggaattagtcatctcacagagtaatccacgaaaagatttagaaacaactgagctcgaaccaaagcttggaccagttcctaagtaataaataagttctccttgtttaacatcacactagattgtaaagtccttataaaaaatagatttgcttattttatccataactgaatatatagggcctcgaggagttctgagtatctgagaggtactcaatacatatttgttgaataaaagcatggccaaaaaaggataaattattttgtgctctccctgatgatttcaataggatgtacttctgggtctatttattttgttgtttgtgtttcggtgggtacatgcttttggtgtgtttttactttatgtacctggctacctttgatcgagctaagcattacacataattaactgtataattaagcataattaagcactgcataattatttgtaggaataattagaggactgagatgaaggaaagccttcatccagagaggatttctgtttgtttcagtcaacgggggcattacttgtcctcagtcacattcaacaatttgaatacgttagattactgaagcctccagacttttaaaattgggctacaattcttcaagaaagccaatcattttatttttttttattcacctttgtcccaaaggtgtatttattaggtagcaacttattgtgggacacttacctgttagactcttcattttgttctatattttttaactatagataggtcaatacaaatattcacatttatgtaactaacaaatacttctattagttctagttttccctgtgatttcagtctaataagtatttcttttcttacaagacctgcagtgattttaagaagatattttaaaatatatcttacgcagatttttagaagtttttaatagaattgtttgtacaaacaatcctcccattatgggaaacacctagcctccagaaaataactttaagaataatttagagagctttgattaaaaatgtagataggaggcaggactagcttgcagttcctgcttggacagacagagcagtgtgtgaagacttacatcataaaattttgctccaagaactaccacaggaaaataccaggaaagctgagagaattatctgaccctttgaaggaactggattgctactgcaggctccctgagatgccaaaacattgtgagtgtacttgctttctcagcagggatgctggtggtctgaggcaagttctcagccctggtcaccagctgcctaaaaatagactcagtgttgttggggggacacagtgggagtaagactggcctttaggactgtgggctgtgtgggagcagggtgagtcctgcgactgctgactttcccccacttctttggtgacctgtacgactcagcagaggcaacctaatacacctgggaatataactccattggcctgggaaccacattcccattccacacagcagctgcagcaagccccacccaaggagagcctgaactaagacatgcctatccctgctaccacccggtggtctttctctaaccagtgtagttgccaaagaaaaaggacataatctcttgggagctctatggccttgtccactggctgagaaacctgaatacttaaccagacattcctagggcaagtttgcatcctccctatagtaccacagctgatgcactcttgaaagtgccacctcctgcctggagggcaaccaacacaaaaccagtgcactgaacaaaaacacaaccaaagaccctcacagagtccacctcactcccctactatctccaccagagcaggttactggtatccacagctgaaagacctgaagatgaatcacatcagaggactctccagtaccagcccagagctcagtacctctgcttggtggctagatccaaaaaagcgaaaacaatcactgaagttcacctctcaagaagccctatccctagggggagggggtacaagaataccacatcaagggagcacgcggtgggacaaaaaaatctgaacagcagctcttgagtcccagatcttccctctgacatagtctacccaatgagaagaaaacataaaaacaattctggtaacatgacaaaacaaggttttttaacacccttaaaagatcataccagctcactagcaatggatccaaaccaagatgaaatctctgaattgccagaaaaaaattcagaaggttgattattaagctcatcaatgaggcatcagagtaaagtgaaatccaacttgaaatcaaaaacatgatacaggttattaaagaaaaaaccttcagtgaaatagatagcataaataaaaacaatcacaacttatagaaagaaggatacacttagagaaatccaaagtgtactggaaagtctcagcaatagaatagaacaagcaaaagaaagaacttcagagcttgaagacaaggctttcaaattaacccaatccatcaaagacaaaaaagtaataaataaatgaacaaagcctacaaaaagtttgggactatgttaagcattcaaacctaagaataattggtgtttccgtggaagaagagaaatcaaaaagtttggaaaacatacctgagagaacaatcaaagacaacatccccagccttgctagagatctagacatccaaatacaaaacactcaaagaacacctgggaaattcatcgcaaaaagatcattgcctaggcacatagtcattaggttatctgaagtcaagacaaaggaaagaatcttaacagcagtgaggcaaaagcatcacgtaacctataaagaaaaacctatcagattaacagcagatttctcagcagaaatcctgcaagccagaagagattgggggtcctatttttagcctccttaaacaaaacaattatcagccgagaattttgtatccactgaaataagctttataaatgaaggaaagatacagtcttttccagtcaaacaaaagctgtgagaattcgccactaccaagccagcactacaagaaccgctaaaaggagtgataagacttcaaaataaaccaaaatagaacctccttaaagcataaatctcacaggacttatataacaataacacaatgaaacaaacaaggtattcaggcaacaaatagcatgatgaataggataataatacctcacatctcagtactaatgttgaaaatgaactaatatagggactttagcactccactgacagcactagacaggtcattaagatacaaagtcaacaaagaaacaatggacttagactataccctacagcaaatggatttaatagatatttacagaacattctacccaacaactgcaggatatacattctgttcatcagcatatggaacattctacaagataaaccatatgataggccacaaataagtctcagtaaatttaagaaaatcaaaattatataaagtactctctcagaccacagtggaataaaactagaaatcaactccaaaaggaaccttcaaaaccatgcaaatacatggaaattaaataaactgttcctgattgatcagcagtcaacaataaagtgaagatggatattaaaaacgttttgaactgaataatagtgacacaacctatctaaccctctgggatacggcaaaagtggtgctaagaggaatgttcataggattcaatgcctatatcaaaaagtctaaaagggcacaaatagacaatctaaggtcacacctcatggaaccagagaaacaagaaccatacaaactcaaacagagcagaagaaaataaataatgaatataagatcagaactaaatgaaactgaaacaaaaaaactacaaaagataatgaaacaaaaagctagttatttgaaaagagaaataaaattgataggctgttagtgagattaaccaagaaaagaagagagaagtttgaagtatgctcaattagagatgaaatgggagatattactattgataccacagaaatacaaaagattattcaagtctactacgaacacctttatgcacataaactagaaaacctagaggagatggttaaattcctggaaagaaacaactctcctagaatataccaggaagataaagaaactctgaacaaaccaataacaagcagcgagattgaaatggtaataaaaaaaattcccagctaaaaaaagtgcggaatcagatggattcacagctgaattccttcagacattcaaagaagaattcaaacgaattctactgatactattccacaaagtaaagaaagacggaatcctccctaaatcattctataaagccagtatcaccctaataccaaaaccagagaaggacatcacaactacaacaagaacaaaaaaactgcagaccaatatccctgttgagcacaaggacaaaatactagctaatgaaatgcaacatcatattaaaaagataatccactatgatcaagtgggtttataccagggatgcagggatggtttaatatctgcaagtcaataaatgtgatacccaacataaacagaattaaaaacgaaagtcacatgattatatcaatagatgcagacaaagcatttgataaaatacagcatcctttatgaataaaaccttcaacaaaagtggaatagaagggacataccttaaggtaataaaaaccatctatgacatacccacagccaacattatactgcatgggaagaagctgaatgcattccttctgagaaccagaacacgactagcatgcccactttcaccacttctattcaacacagtacttgaagttctagctagagcaatcagaccagaaagagataaaagacatccaatttggtaaagaggaagtcaaactgtcactgtctgctgatatgatcgtatacctagaaaaccctaaagacttatctaaaaagctcctagaactgatgaatgactcagcaaagtttcaggatacaaaattaatgtacacaaatcagtagctttgctatacaccagcagcgaccaagctaagaatcaaattaagaaccacttttacaataacagcataaaaaataaaatacttcaaaaaatacctaaccaagaagatgaaagacctctgcaaggaaaactacaaaacactactgaaagaaatcacagacgatacaaacaaatggaaacacattccatgctcatctcatgggtagaatcgaaatcatgaaaatgaccatactgccaaaagcaacctacaaattaaatgcaatgctcattaaaataccaccatcattcttcacagaactagaaaaaacaatctgaaaaatttatacggaactaaaacagaggccatatagctaaagccagactaagcaaaaagaataaatctgcaggtatcacattacctgacttcacactatactataaagccatagtcaccaaaacagcatggtacaggtataaaaataggcacatagaccaatggaacagaatatataaccctgaaataaagccaaatatttacagccaactgatctttgacaaagcaaacaaaaacataaagtggggaaaggacaaactattctacaaatgatgctgggataattggcaagccacatgtagaagaatgaagctggatcctcatctctcaccttatataaaaatcaactcaagatgcatcaaagtcttaaatgtaagacctgaaaccataaagattctagaatataacatcagaaaaaccattgcagacattggctttgccaaagagttcatgactaagaactcaaaagcaaatgccacaaaaacaaagatattgtaaatagatgggagttaattaaccaaaaagcttttgctcaacaagataaataattagcagagttaacagacaacccagtaattgggggtaaattttcacaatttatatatccaacaaaggactaatatgcagaatctacaaagaactcaaacaaatcagtgagaaacaaacaaaaaaacaaacaaaatcttagcaaaatgtgggctaaggacatgaaaagacaatcctcaaaaaaagatatacaaatggccagcaaacatatagaacaatgcgtaacatcactaattatcaggaaaatacaaatcaaaaccacgatgtgctaccatcttactgctgcaagaatggccaaaataaaataaaaaataatagatcttggcgtggatgtggtgaaaaggaaacacttttacactgttggtgggaatgtaaactaatacgaccactatggaaaacaatgtggagattccttaaagaattaaaagtagatctaccatttgatcacgcaattccattactaggtatctacccagaggaaaataagtcattataacaaaaagatacttgcacgcacatgtttatagcagcagaatctgcaattgcaaaaaatggaatgaacccaaatgtccatcaatcaatgagtggataaagaaaatatatgtgtgtgtgtgtgtgtgtgtgtgtgtgtgtgtgtgtataccatagaatactacacagccataaaaaggaatgaaataatggtatttgcagcaacctggatggtattggagactattattctaagtgaagtaactcaggaatggaaagccaaacatcgtatgttctcattcatatgtgggaacagagctatgaggacacaaaggcataagaatgatacaatagactttggggacttgggagaaatggtgggagggtcgtgaggagtaaaagagtacacattgggtacattgtacactgcttgggtgatgggtgcaccaaaatctcagaaatcaccattagagtacttattcatataaccaaacaccacctgttccccaaacacctattgaaataaaaaaaaaatcaatttataaaacaaacagagaaaagggaagaaaaaagaaaacaaccttcattcacatttaactgaaattggtggctgaacaacgcactattccacctaggcttttacacatgtaagaaagggaacaaaagatttttaaaaagtgtccaggcctggtggctcatgcctgtaatcccagcactttgggaggctgaggagaaggtagatcacggggtcaggagatagagaccatcctggctaacatgctgataccccatctctactaaaaatacaaaaaattagctgggcatggtggcacacacctgtagtctcagctactcgggaggctgaggcaggagaatcacttgaacctgggaggccagtgagctgagatcgcgccactgcactccagcctgtgcgacagagcgagactctgtctcaaaaaaaaaaaaaaaaaaaaaggaaaaaagaaaaacttaaacaataaaaattgacattacttgcaagacccaactattttctatgatttcctttattctagcaagagttttgtatgtgttttgttttgtttgttttgttttcaagattggacgccttttcaaagaccttaacctatgtgtttgtgcataatgtgtatagcataggttcttttctgaaagtgtgtccaatcttaaaacacacacacacacacatacacacatccatgtgcatttgtaataactgaaactaaaagaagctgattactaagaatataatgaaccttattgtttactcttcatcaaacatataatcatcaaatatccatttaaattataaataaaaataagtgatttcataagataagtttgatgccagaaacgaggattgaactggtttgatccatgaaatgctgatacatgcaaaatagaactccatttgtaatttctttaaagtaatactccattcttttttattagaccattgatgagttcgctcctttctctagatcagaactatttagattgtttttttacaaattcagtatgaaggaatttgttttttaataggtgtgaatagcatcgatgtaatgatgtgtcattgagccccacatttctgtcactagagtggtaaaatgacacagaggatgaaccaaaagtcacctgtagatgacaatgggtgaaagaaaacacatttaatttacatagaaacatacagaatgtcaaaagagttaaaattcatgaataaaatttcattaaaaatgcattctaaaatattagttaaatatacactacttaagaatgatttaaaactagcattaaatgtattaaaatggatatattttgcaggaaaaggatgcctgtgttttcagtgttttatctgaattatttaatggtttacaaaactttctgtgaatgaagggaaagcagttttttatctgagtattctcagtgttatctgagcattctcattgcctacataacttattctgaatgaaggcaggcaaaatagagagaaaagactgagtatctataccatataatactttaaatagaaaacattagccctttgttacatatctataggctgaataagaactcaaacacagctcttccaactcaacacacaatgctctctttgaggtctgaaggttataaggctatactcataacagattctcagtctcacaattaaactaaaatctaggcttgaagagattaacactatttagcatgccaggctgggttgtaacacagtagccatatatttattttatttcattttgattttagacctgcagtgtattgccagaccccaggtgagtttgaaatattgcaatggttatttcagaatactttgtgtggctttactgtcatttatgttaaaggtaaacaggattctctgctcgatcattgacatcaaaggcaaaaacgaatgataaattattttccctctattcttgcattttgagacaatttttgttgaagttcaaatttacaagcgtttcgggaggatgttttcttctggggaaacaacattcacagcagtccagactgagggtacacagagagcaaaaacagctctagctgctgagtgtcctgcttatactctcacatttgcccatctactaatctctattactgttttatcttatttttacagatcctacatatctaggaggttccttttaaaatgcaaataaaatatctaaatgggagtgtcactgacttcattatcattcatcaacaccataacagggattattttatcacattagtttgcttcagagagttgagctgcaagaaaatgggactgaattcacttatgttttgaaaatgaaagtgctggataacaaggtagcagttttcaacaaatttaaatataaaaacctttattaatataataaaatgtctaatgtctattaaattatatagtggcaaaagtcttagagaattcagggacatgttaatattatcaattataaattgtactagagaaagctactccaaatgggtggaaatcaaagaagctgatcattttccaaggaatgaccttgcatgcttttacctaaaggaactgtttaaatttttagatcagaaaaataagtgaaaaaaaacagaagaatggtctaaaatatatatacttatttaatgttactgtcagaaaatataggcttgtaagagagcttggatttcaattttagaaagaaacttcggtttctttggagacaatgtttatattaattcaatagtgtttctgtacatatatatctgatattgactgccattgtctcttctataactttctttgagtcctaggtttatatttaatcttatgatatcttcatgtatatctcctataaatatttcaaacttaaatttttaaaagcataagacatcatttcccctctccagttgcaaaactcttccttctttgtaaatgaatgaataatacagcaaccactagaggatgcaggctagaatcttggaagtcttactttatttcttctcttatctcattatgtccttactttcatgtttacttttgaaactatccagttctctctttttctgtaaaaaatccagagtctcctatcatccagtcaaaatttctgctgtagttgtgtaaccagtctctttaatccaaggtatattttcagtgctatattagcagtcatactgaaaaaataaactaaccattgttatttgggataatttattatgcagtaataaataactaatacgctaaattgagaactcctggaaagagagaaaaacatataaaagattctttttttttacactaaatccctaggctccatctcactttgatggtattagacacaatagaagctccatttttttctgatgtatgtagaattaaaataaataaaagcaaaacatcaataattaaaacaactataaaaatgtgtagctcaaactagagggaagctggaatggcttgaggaaggaaaatgataaatgaaatcaaagaattgattcatgtgaaataaaagaaaaatgctttttgcaaacaatactgctgactaaagggtatacatcttatgaaatgaaataatttatttttttgctcactgaacactatgatggagttatagatgcagaagtaattttgtagttgactttgaaaattgttttgaaaagtagaagaaacgagttagatgtttattgaggcaattggaggaaaaattgtgctgaagttaaggaggatagggaggaggagacaggaagagaaagaaaatatcccagagaagtgtaatggtggtggcattggatggcttgttggtgtcacttttttcatattttgaaattttttaatgtatgttcaaatcacagaaaggactgattccacttctgtgtagttagtgtaaatatagagagcacctactcagtgaaaagaaaattaataagcttgaataatttagaagaagatggaactcttagctagaggtcactaaaaaaagagaacatcaggaatgtaaagacatactagggagaatattgaactttcccctaaaatacagtaaaattttgagctgatattgtctagatctttaaggcaggaagggtgcagatgaaatatcagttatctaatatcaacatgagcttagtttaatgaatcatgagattgtacttatgttaaataactacattttgaatcagtgataactatccaggatataagaaatcatttattttccataacaggactgtaatgcagaggtttggctacacagatgatggagaagccaaatatctcccagtaggaagtcactaccaatactaattaggagggataaacgaagaggaggttcaacctaagccagaagatagtgttaacaggcagaagctacaatcatgtggacatgtcctgaaaaagtgggagccacaaaggatacacagattctggatactacctaattcagagagaaagggcgagggagagagaaataccctgtgttttctatttcttcacttaatttttatctgtgcctacctttgtccaaaaccacccagaagcagatgacagggttgcccagaaaatacaagattatcagtcctgttacacagagcacagcaagaaaagaacaaatcattggtcaaacacacccaggatgggcatagtttatatgtaagggggaccaaattatcaaataacttgataaaaagagtgaatctagagatataaagtaacaatgaagataaaattgccaccaaacaagtttgcctagcacaagctttgatatacactgatttcagagccccattaggatactggtgccactgagacaattaaatttcagaacccatttaattttatacaggaacccacttcagctcagatatcatatcattgccgtattcacaacatttaaattgatttgcgggcaatccaacttttaattctgactcatgtaagtcttctagatttacagcaacaccatgttgaactgcactggtttgtcatctctcccattccaggatctgtttatattcagcactgtatctcaaggacaggcaaatagagtcagatttttgacatagccgaagagtggtgactttagagaaccctatttcctcttataagagctttttaggaaataaccagttactagcaggtttaatgcattggcaaagtccaagtgtcctctacatctcacatcctttgtgtcatctataaggacataggaaggcaacttccagaagcaaaaatatgtctgtatcttctgccctcactttttaggtcaacacagccaccacaacccgagctgccattttcatttcctgccatggatatctgacagtccttcatactgaagaaaagtaagtttcattgatataaaaagttataggattattagaagtatttatacttatttttgtttttagcatgcccactaaatacttcagagttagtcataaattgacaagacaacccctcggctttactcatttcattatttattagttctcaaaacaattttctcaaagtgtgaaagtttcttttaaaaaaggtagcatgaaactatttcagccagaaatagcctatgaattcatagtatatgtgtcactttcctttgcctttctgtaatagttactcacagacctgagcttctgtaattggcttattttattacttggaataaataagattgtatacaagaaatcctgtaggagaggaaaacacaactcttgggcgtggatattattctttgacaacccaaagatttttccaaatggttaataaatggaccattatcttatttactcttgaggaaacttcttttccagcatctgaggtaatgacttcccagtttttgacctgccactgtaaggtttaaatttggttttcctcaaaactgatagatatcagaaattacatctaaagtgttaaagattctgagctacatagtactgggtgtcaaaaggttacagagacatccctataccagctgagagtccattaaaaaggtcactcacttctgttctcacaagtattgttcactgaattgagtcaagaaacgctcaataaaagggaaaaagaactaaaattgttcctgagaattacctgacaaaagtgagatcaccgaaagaaatgatttaggaccataccacggagagacacaaagtggtaccagagaccagctcattaagtttaccatatacaactatggtaatttgtttttaaaagatattctaaaacaggtaagtcaaagtttcacatatggaaatatgtccaaattaaaatgtgcttgtcttcctgaagagtctgggtcattcattaaaaaaaaaaaaaaaaaaaaaaatgtttgtccaagattttagagcaggaataaaatatcttcatgagaattacttttctattcataacaggaatttgtagtaactcaatgcatttttataattaaaatgtattattaattttgtgtaatacaaatgaaattggatttagagataagtttctggatgacattgaaaactcagtattagaaaaattccaaataatttatagagaattctcaataatttatttaaatactctgccatcaagtagatacagcataactgctcaccacttaagtgtgagatgcatatagtgacttccttctaaagaatatagtatgaaaatgaggggaaaaataacatctgtacaatcaagatacctggaaaatactgctttagtgagttaatcaaggttaacatcattaataagttgttgtttatagtatatatagtatatataccaattataaatatatgttgatagtgtatccccttgaaatggtacaatgaaaatggcactttacctctttattttccttgaaatagataaaccatatctagccatgagaaaaacccagacttaaggatttttcataaaatatctcatcatgttcctcaacacttttaaaataggcctactttgttttattgtgctttgctgatgctgtgtgtttttttatttgtttgtttgttttttaacaaattgaagggttgtgttaactgtgtccagcaagatgtgactgaattgctgcaatcttatgatcaaatttggagagatgagagttgctttttatggatgagcaaataacatggtttcttgagatgtaatctattcctggcgaagatgctgtgaacaatgttgaaataacagggatttagcatattacataaagttagttgagaaagcagtggcagggtttgagaggattgactctaattttgaaagaagtacattggtgtcatttttccaacaccatgtgctcacttcgtgtctctgcgtcacattttcgtaattctcaccatatttcagacgttttcattattatatctgttaaggtgattagtgacctttggtgttaccattgtaattgttttggggcaccacaaaccatgcccatataagatcacaaacctaatcaacaaatgtatgtattctgactgctccacccactggcgattccctctttcctccccgtctcctcagtctctctattctttgagaaacaacaatattgaaattatgccaattagaaactctacaatagcctttaaatcttcaagtgaaaggaagagtagcacatctctcatttaaaatcaaaagctagaaatgattatgcttagtgaggaaggcaggctgaaagctgagataggttgaaagccaggcctcttgcaccaaacagttaaccaagttatgaatgcaaagcggaagttcgtgagggaaagtgctatttcagtgaacgtatgaatgataaaaacaggcttatggctgtgtgatctggataaaagataaaaccagctaaaacatttgcccaagccaaagtttaatctgtagcaaggttctaactctcttcaattacgtgaagacagagagatgaggaagttacagaagaaaagtttgaaagtaactgggaagtcattacctcagatgctggaaaagaagtttgaaactagcagatgtttgttcatgaggtttacagaaaggagtcattcctataatataaaactgcaaagtagagcagcaagtgctaatgtagaagctgcagcaagttattcagaagatctagctaagataattgatgaagatgattaagatgaacaatggattttcaatggaaacaaaacagtttaatatgagaagaatatccaaataggaatttcatagctagagaacagaagtcaatgcctggtttcacagcttcaaaggacaggctgactttcttgttagaggctaatgtagctggtgattttaaagttgaaactgaatctcatttactattttgaacattttaggccccttaagaattatgttcaatctactctgcctgtcctctagaaatggaggaacaaagcctcaatgatagcacatctgtttacagcatgatttactgactatgttaagcccactcttgagacatactgctcaggaaaagatttgtttcaaaatattactatttatagataatgcacctggtcactcaagggttctaacagaggtatacaatggagaagcatgttgctttcatgcctgctaacaaaatatccttctgtagcccatggattgaggagtgatttttactttcaaattttattgtttaagaaataaatttcataaggctacagatgccgtagatcgtgatttctctgagggatcttccggaaaagattcaccattctaaattccattaagaacattagtgtttcatggtaggaagtcaacatatcaacaatactagaagtttggaaaaagttgattccaaatctcatagatgacattgaggacccaagatttgaatggagggagtaactgcagatgtggtagaaatagcaagagaactagaagtgggagaggagctgaaagatgtgactgaattgctgtaatctcatgatcaaacttgaagagatgagaattgctttttatggatgagcaaataacgtggtttcttgagatgtaatctattcctggtgaagatgctgtgaacagcgttgaaataacagggatttagcatattacataaagttagttgagaaagcagtggcagggtttgagaggattgactctaattttgaaagaagttctactgtgggtaaaatgttatcaaatagcattgcgtgctacagaaaaatctttcatgaaaggaagttaattgatgtatcaaactttattgttgtcttattttaagaaattgtcaaagatatcccaaccttccttcatcagtcagcaaaagccaatattgaggcaagatcctccaccagcacaaacatcataacttgctggagagtcagatgatcactggaattttttagcaagaaagtatttttaatttaagatatgcacattgttttttaggcataatgttattgcacacttaatagattacagtatagtgtaagcataagctttatatgtgctggtaaccaaatagcttgtgggatttactttattgaggttgcctggaactgaactcacaatatctatgaggtatgcctgtattatcaaaagcaaggaaagtctgagaaactgtcacagtctatatgagctcaaggagataagaccaccaaatgtaaaataatgtcctatataggaccctataacagaaaaatgaaatgacataaaaactataaaaatctgaaaactgtatggacttttgttaatcataatgtatcaatatcagttcattagttgcaacagatgtatcatggggaaactaggtgtgaaatttaagagaagactaatattcctgcaactcttccataaacttaaaactattataaaatgaaaagtttatttctttaaaaacttagattagtaaaatatagttaaaatattaataaactccctgaaaactatgaataatgataactatgactaacatgattgtattttgagtgatcaatctactcagatattcagtatatttcaaatttaatgtttgcttaatggaaacatacttaaaagtaaaacattgcccagaagtaaatgaggaaagttaaattttaaattatgatacacatgtaacatatatggaattgaactgcagcctttcctaactttatatggagcatctccacctccctacttgccaattccaacactaacccaactctaagcacactggcaaatcatattgtgtttacagatattgtcttgggatggggataaaggaaagaatacattgtatctcatatagcaagcattataaaaatgatctttaaaccttttttttcttttttttaatgaaaggtctagaaggtttgtttagctttattctcacactctccagaatctttttctttttctctttttgaagaccacatgggtgcagctttattccactcttagtttatctagatcctattgtttttgtagttaatttaaatctctcttgatttatttaatttatagccttacatatcaatatcctggaagaacttgaaaatgttcctttagatttttatttttaagaaggaaagataaaagtattgcagataacttttttaacttcctttattatttgctctgccacaaacaacctatataatattcagtatttttttccaggattaacaaaaggaaactttgttttcaacaatttttatggtgcaggagtactatctggcaatacaagtttatttgaaacagaactgcatgacactcacatattaagcactttatgaaggaaaaccgtaagaaaatatcctagaaagtaaaatgttggaatataaaataaggaatcctatgctaaatctctgcctttggtgatttcaatgattgagaccaaactcagatttccatcaagattcgtaaaacttatcctgccattgttgaattcactactggagtatatatactgttcctggtcaatttttagaaacacctgagctgataaaagttaaaagaatcacgaggagaactggaaatactgacttataggagataataaatatccttagattcatatactatgaaaaaatgttttgctgtcttcttagctgctatgctttctatttcttttttttgacacacaaacattagaattttcaaacaaatttactaattttatgaacttactattttatttatttattattctatgtacagtattccattactatacaatgaagagtatattttctttcatttttaggtggttaataaaataattcacacaaggttatggctaatcaaattattgtagtcaagaagtcagaattgcagataacagctcttggaagtccacccctaagtatggagggtgttcatgagtttaagagaaattttcgtgaactgactagtcacataaactggtttctactatagttggggacaggactggctgtataaatgacagggtatagtgcaaaatgaagataaggggctgcttattaaaaatttattcagaattttaaaatggtgtcaaaagatcatgaaaccaacagcaagaaccttttgagcattgagtcctgtgcaaatgtaaaaaatcatgaagctggtcctgcataggggtagtgagaattagggaataaatactattttccttttggtaacttagtgatcccctgttttaagtatgaatccataatcttaaactattttctcttctttggtataccattgcatgtactatctctccttttaagcttttctgcttttctcttgtatttatttaatttataaaccttcaaataaatgaaatatgatgaggggacagttcctcatgtagcacttagtcataggtaaggagtggaaaagcgcttcatggcactttattttaatgtttaatttatataactatacgcctttttgaaacctgtaaggacaaacaattgaacatctaaagacagatatccatatgtactgtaatttcctgaattctacatttttgggaaaaaagatgttcttctatggtaagggaaatatatgtatactcacacaaacacactcacacgcaattatatatttttagtaccctattacgtttgaatataacatgaaataacagacatatgcaatgcttacggaaaattgatatattaactttctgatactgtgatcaccttaatttcttgataattcattttatttgcatgtgaagctttgtaaacttatattttgaaattgaaagagtcaattagaaagcacctcaggactcatagtgtccttcttttattgctttgtaacacactgcttttatgtaattgctttaatactctactatgtagcactagtgtgacaatgattattatgataatgatgataataaaagcgatatttaataatataaattgtaccttgaaataagctgtaagtacagtctacagagcttaaatgctaaattctcaaaataactcggtctataagtggtagtcttttatttgtttttctgcagctcctaaacactttccaaaatgtattcagaaagtgattataatggaaagatggtcttccttaccaaaggaatgtttagatcctttctgagacctagggactatatctcacctccagagaaccataggtttatataaccaccatatatgagacggtaaaatattaattacaacaataagcatcttttgagaactttttccaggctatatcagaagcaaaaaaggttttgtttggtgtttgttcttgctttgttctatgccccttccatgtagtgaccattattatacatatcttgagggaactgaggcttaaaaagattatataaatttaaacagagtaaatttgcacaaggctatgctacaatgttaaaatactttcacagaactttataacttacaaagtattttcctatttagctcaataataaacacataaggtcacttaggctccaataataatacaattttgaatgaatgagatattcttgccttatacttccatggaagagaaaggaattgcattatacactatttccatgatttagttacagacatattgctatgtgaacagaaaggaggataaggcaaattctacctggaactttcggatgatttcatgagtggtcatttgtaccacttctcccaagcagttttagaattatatgagcaaatgtatgaagatggtaaaaatctgtgcctgcacaaggaacaatacacagtctggtttggttagagaatagaatacaaaatggcagctattcttggaaaatgcatattaggctgatctataaaactttgaattcctacttatatgtacaggatctttctgtgtcagttttgaatggaggcataatgaaaggatggagaggcaagaaggaggttacttaaaaggctacagctaaggcaaagttaataatcaccagagattagacagtagggaagaaactggatgcaaattcaccacactcattttactttttttctggtcacaccatatttctagacttcctttaagtaaaggttaaggataaattaaggttaaggataaaaaaaaaggcaaaagtaaataaattatttgcaacctatcatacatatctaacaacagaataaaaagataaaaggtactgattctgaacattcccaaaatttaccacttaatttctggaagaggtttatcttctactcaaatttagtgaagagagaaggtcactgtggcttaatgaaatggctcatctccaagctaatgtccaatctcatatcagccaaagtatgatcaccaggttacattaaggatgagcttgatatatattttttcactcaaacacccatcagctttgcaatgcaatattctctctcaaaggcaagggagacatcgatgttaaataaaaaacaaaagaatttagaacaatctattttgcattgttacatacttatacaattgcaattaatatttgctttattttaatctaccataaaattgtctgtaaatggaatttctcctcaataaatgagtgctccacatcttttgccccatctttcagctcaataatccatgctcagggtggatgtggaaaccccgtattgaagaaggcagcatgtcaagaaccacagtgttgaaatgactacatgctctgttataaacactaaaattttaaggtttatctttaatatctgctagcattatctggaatgctaaacagtactatagagaaaaaataaaagggaaggtggaagaaaaataacaagttagtcaaggttgttataaaatgtgacgatttagataaacttaacaaaattttacctctggtaaactaggatgttggcactataatacccaaaatgggatacataagaaaaaatgaatctactctgaaatgtaatgatgatcaggctaagcgtatgttagggtttagagggagcgcccctaaaatataagaaaaatatttgaaaataatactttgaaactatttttgacagctcaaagaagcagcagcttctttcttgaagcagcaaagtaatcatacgggggtaatcacaatgtttcttatgctcttatatgcactctacagtttggcattgtttatcaatttcattctttccagcgattagagcctctaaaaattcatgctagtttagaagtatgtctgtgtttaggtatctagagaacaggaagagagttcgatatgttgctcagcagagaaaccaattctaagagtatatggcacaggagtcaaacccttagaaagattgttagagccatgaattggtataggaccacaggagacaccatagaaaaataagagtagagtgtcatcaggctatagtcccatttacaaaaaggaaggctaattagcaaaactaaatatagtcaagagataggagaagaaacttaaagaaaggaattatcactagcaaatataatgagaatataccaacttggacttatccttactggaggcatcagggaaaccaaatgggttcattggccaaagtgggcagaaagatagctttgaaatgcatctgtcatggtttggatcatggtacaaaagcaagttaaacttatgtagatacatcattagtagataaaatctttatttatttatttatttattttttgagacggagtctcgctctcttgcccaggctggagtgcagtggcacgatctcagctcactgcaagctccgcctcccgggttcaggccatttcctgcctcagcctccctagtagctgggactacgggcgcccgccaccacgcccagctaattttttgttttttcttttcttttttttttttttttttttttgagaccggagtcttgctctgtcatccaggctggagtgtagtggcgcaatctcggatcactgcaagctccgcctcacgggttcaggccattctcctgcctcagtccccagaatagctgggactacaggtgcggccaccacgcccggctaattttttgtatttttagtggagacggggtttcaccgtgttagccgtgatggtctccatctcctgacctcgtgatccgcctgcctcggcctcccaaagtgccgggattacaggcatgagccaccgcgcccggcccataaatttttatatatttcaaccaaaattagaaaaacagaataataatagtgaaagaaccagaaagtgacaatcttcaccaaacgttcagtctcaaatggtatgggcaaaagcacaccatgcacacagaagaaagggcagactgagatgaatgtgggtcattagggttcaagaagtgttatggaaatgaagggagtaaagaaaagaagaacatcaatccaggatacaaaacccatggataacttcagacaatgcatttttacagctgtgaatattttaatatgatagctaagtaaagcaaacatattaaagaaagttgaagagaggagttacaaaagaagtattgtctagaggagtcagagggaaatataatttgatagagaaaagaagacaatggcattaataagcacttagtatatatgagaaagttgctagagaggatggtgggcagaggagaaggattctctgggttcaatatgaaatttctccacttataaattatttcaccttagggaagttattcatttttaatatgctcacaaataaacaggataataatttgttttcatattatttctttcagagggagtaaacagagatccttttaataattatgatgtgacaacaggtgcaaaacttagacaaactaaggtatctgatcaccatatttactaggcaaaatattgaggttaaaagaatttgtgctttgttttttcttttcagttttcaacgttctcatcccagtagataacaaaaggtctgtgacaagatgggacatagcaattctgtctctgtgatctgcccatcaggaaaagagctcttaataatccaggctaaccttttctgcagttaaatgtacccagtttcctccttcagtggtatgatcttagacatcagctttctttgagggaaatcttcatagagacattgagagaaatctttacaatctaaaattacataatggaataggtctgtggttatagttcagttttaactagggacatacaagtcataatgtcttaacttcaaatatcgaaaatccataagaatttaaggtatgagaactgaaggacagaaaaggcagtcttatttgtgctatgagatgttcttaaatccctcacataattgcaccaggaagtatactttctttcttcatttatctcttaaagctcggtcttaagacgaaggggctaaaggcctgagtttcaatttatatttgtttcataatagcagtgacccctcaagaaatggccactaaactgtgggaaacgatgaattcctacacagtaaaatagattattttcttaaaaatggcacaaggttttatgagaattacagcagaaacattgcttagcatcatgcatggcatgtactaaatattcagtctatgctacttaggtatccttgatgttataatatgaaattgtggatatttgtaaatatgcagtctcctaatacatagttgtaaaaatgtgtgaaggtgtccagtgagcaattaatagattcttaaataatattccattcttacccttcatgatttgtatggaagatttagagaatgaaacaaaactctgggatctgtaccttttaactgaaacaaccaccagaactaaatttacataaccatgataaataaatctctaaataagataagtatggataaactttgtaaactttctctttttaagatacaaacaacaataatagtgtgggttatttcttcataaatcatatacactcccagttatttgtgtcaaacttctctcttgtgcctgatggtttccaattcaaaacatggtaatatttttccagtattcaaaggaagttctgatttgtcagtacatagaacttaccatctccaggcatacgtattgatggaatgtaagttaacaattcaaatctttttttttttttacattgggtggtaatttggatttatgtttctttaaaactaagtcattggtgtcatgttcatttccctatagctaagattccatcatactgaaccagaaagaaatagtatgtgtgtacaaaaatgtaagaaatcagtactccaagctatataataggttgtcaaacattattctcataaaatatctatagacacattggccaatatttacttattttttatagtaatgtagaagcaatagtagttaaaaacagggactttggagccagaataatctgtattggctcccatctccatttcttatttgctttgttctctaacaagtctcaaaatttcttgtctcagttttctcagttttaaaatggggataattatacatatgctttacatagcatatttaaattactaattactgtagtaattaaatgttagcataactaaagtttatacctgtcgggtagtaaatattatgtggttgtactaaatagtaagctgtggttgtcaattctaatattcttaatagtacacacttcattgtgttctacagatattgattaaatataatttttgagaaatttaaattttgacttttctctaacatattaaaatattctaaaatatagaattgctgggttcatgagactatagaaaccatatgtgaaaataaagtaatatcagcatcctatagacatcttctagaatcatagaataaaaaaggttctttatctgttatttgtatttcattttattaagctaagaaagattaaggataaatactcttgaaaaatacataaaaataataaaaattaaaaataaataaaaaatacataaaaaatataaaaaatagaaacgtaaatctacattgccacccaatgtaaaaaaaaaaaagatttgaattgttaacttaaattccatcaatacatatgcctggagatggtaagttctaggtactaacaaatcagaacttcctttgaagagatttattaagagatttgatgaaagtgattttaaaaatgcaaacacagaattaatctcttgctctgactactgccctatctcctaatttgttgttctacttctgttcttgctcttacttattctatttttcccacagtagccagagcaatttttgtaaaacatgaaactgattatgtgactgttctgctaaaactcttcaaattcttccactgtgcttaaaatacaactaaattcctcacctttgtttacaaaactcatgtaatctgttccttgcctaatgctctcacttaaattcataccattctctttctcacttatttggcttcacccataactttctatttctggaacacatttatgttcatttccagcaaagacactttgtaattgccatttcctctgactggtaagcattggatctagattttagcaccattaccatattcttatgattcagatcttaactcagtgacgcctcttttcagaggactttcccaactaccaaatcaattgttgtttaaattccattcttatcacgaatacccttattaattgtcagtcacattactcttgtagcatattaacatgattgttctcagaaattatctgttcattcatctacctcttgattgcaagattgcaagctccttgagaccaaagattttgctggcattttccactggtacatttttcccacccagaacaatatttcctaaattacagtatcacaatacatatttgtgtaagcaatgaataaaaggacataaatcaaaagagaagcttgttgatatgctaatatgaagatgctgatgttcaaacagaattttatcagtaaatttggaataaaaagtgttggaaaagatattcaatggtaatggggtgagtggttgatatgtattgtacaacagcaactgagaaacattaagtgtgaatagaaatatcagcaaatgcaccattgaagtagtatcagtagtacacaaagccaattcatcatgaaatagtttacactctaactcttccataagtttcatatttggctctttctttagatcccctttgcccactttattttgggctatcatatttcttcctgttttctaattaggtgttgtctttatactgtgaatcttagtcttacttgaatcaatgattagtagaaatcactgttgtgactaacatgcttcttcacatatgtgtttaaaagtaccctaaaatcaattcatttaaagtgaaagcctgactgttttttaaaatatctttcaatactacttcattatcacattaaataggcaataaccttgcacctcattattttatattgggtcttggctaactgtggctcttggactaaatccagctggccagctgtttttgtaaacatgattttattgaatcacagccacacctatttatttattgtctatgactgctttcactctacaatgacaggatcattgcaacagagactgtacagccaacaaaacaaaaaaatatgtattatctgccctttatcagaaagcttccttgtccctactttaaaccactgttttacagagattaaaaactatataaaattcaaatcattttcttccatcagctttactgagtcatatctgtctctctccctttccatacaatataaagattacctttcaagatctcttattagcctttaaacattgaagacattggcaaacagacactactttgttttcactagtttcttaataaaactgttaattgacaagttaccttatttagcaggaagccaataaaccacagtgtaaatcagtagattacgctgctttaagcttttgaaaaaatgattagtctcactaaagggttgggcaattactgccactgctaactaattttgtacctggaaataaagatctgcaatttgttgcccatagctatagcacacagcctgttgacttagtacctatacagttataaactatggattctaagaaaatttaaatgtatgatgtttatttaagtatatatggttatgatgttatctaaagtacatttattatgaatttcttggtatataatcattcatgcagataggaggatctctcattttgcaataaaacttttaattttgacccacacaaggtaaagagatgctcttgaggtacctgcttctaaactacaggcgatgaatgtgtgtgtggactcattggtgaatcctcatatataaacaaagtagatgatatattcatgctaaaaggaatctgacttggagcgaaggcccttttctagaggcataagatttagtcatacaaaaacacttaaataattttaaaggcatcagactctctgtacagtagggattataaaagactgaaatttcccttttgtaatagggtttctggcctctctggccctccagaaatattaggtatagcttaaaatcagagaaaaataataccaattgccagagaatgctttgtccttcatgatgtcaatagctgtccctcactggttgctctgatctcttctttctgtcagcttctcttcacctatacacagacaactatgatttgcaggccagaaatgtaagagctatgcatattggtgccacattaaatccatggtcatcaccattaaatgagtccttaatatagcaagaccaccttgtttcattttttctgtaaactcctgtttccctcattactatcattgtgtaaaaactgtgtgtcaaatagagttattaacacccgcacagttggacatatgcgagttaactatggctttgtcacacaggaatggcatgatctggaaaaaatgggttaaactctccatctcttagttttttctcctgtaaaatgatgacaataatgtttataacatatacttgtgatagcattaatggtacatagcatatagttagtcctaataaaaatgatttattgtctccatcatgcctctctgactcctcctcctcctcattgtttttgaacatgtaacccatatgctactctttcacctgagaaattagaacaaatacaacaagattaaccctgcacctttctgtttctccttttatcatctttcaatggaggacttggcttctttctaagggccatttctctctgtcctctagtttagatgccttctaattgaatgctatttactgttcaactacttgttattttcttaacatttccttgtaatataaacactctctcattaaaagtcaattatggaaccaaagaacttctgttgcatatctccttttgcatggatggaccttttggtttcccttatctctttgggtttaggggtggtaagggattcccattgttgctaggcatgaggtatttcaacattctgttaaggtttcctcactctgttcacacttctgtaaatagttatttcattgaaatatcatattaaactctgtgtgtgctactgttctgtgccaggaccatgactgatacagatgcctatgatctttatggagtcagtagaagtgttagtctaagtttctgggttaatcatccaaactctattaatagcttattacatgccagatactgagaaatttgaacaattgataatgaatgctaacttaagactaataagatcaaacaatcagaccttatttcaagaaaaaagccctgctacttaccttaggaactaatttctcttcttttccaaaatatatgccatttcaaatgatcagtttaccctcgacactagaatattttctcttcatcattccatatttaaaaacatttatttaacataaaaagagcaagttaattacaatccttgtttccttggccacagttatagctatctcacagaggagaaaacacattttatatgaatggcacctatatttcttttcaccgagacacatttaacaacccatcttttaaagcacaaagaaaggagaaaaccttcagaaatatgtcttttcaaatgttgttaaacattgatttgtctgattattataacttgagatagtccttattgtagtaattgaatacttaaaatttaagaatttatgccatgttatatgttaattttatgcatccactttctatttctcctgttccagcctcccacatcctaggacatctgtgaagataacaaaattgcaaatgccagatggtagtatgatcattaaattaaaatcagttccactcttgtttcaatcatgaaacagaacgatcaaatttgtaaatgtttctattttggatattattttattttacatgaaaacaaagagatgtactttaaaaacattacattggtaaattacagtatttttttctctactaatcttattttgtaaggttctaaaatttggttgactaacacttgtgttctgcaaattagtttacctaaaaagaggaataaataataataaactttgaacaaaaaaaactaatataaaatactgttatatttcacataactaatggaaaaaaaattctgacaggctttcttgacacaaaaatattaggaataaattttgttccttgttgcagggtgaagtaaggaagatggttgaataagtaccaaaccctcctctgaaagggacaccaactcaacaatatgcaaaacattctcctttgtgagaaacccagagaccagccaagagactcctatagcccaagtgagtatcatgccagccacactgaagttgatgggaaaatttgtggcacccacttgccaaagccctgcccttagctcagaaatgtgcaatcagaaggaagatcctaactcctcacttctccctggggaggaaatagaagactggaacatatgtctaatgttcagatttggagggaactagctaagagactgatttcttccctatttgaatctaagtgctgacaggaaagggtgtcagataagaaaccagtggaaacagaggcagccctttgaactagcacacactcagttaccatcatctttctccccagctcagcataacagtttcacctgacttggcatactgacaggaatttgaatgctctagatgcttgaggatactgaaaacaaacataagagctccagaggacctacagtatagcagacagaagctgattcaacttgacagtttgtccctcagggggaaaagagaagaataaaaggtgtgtcaaatattctgactttcgggaggagctgcctgaaaaactggttgtttacttgctagtctcagagcactaaagggagctggcatactctaaatgcctgaggccaatgaggagaaaaagaaatgagtgacttacagtaacatcaaaggatcttcattagtggagacagacaccataagaaggaggaaatttcagcttctaaaaaaggaaaccagtaaaatctccctaattaggaatttacaaattcacagaaaacatttgagagacccgcaaaatatgtagctgggtcatttcaagaaaaactttccctgtttggagctggtccacaaatactgggagagggggctacttttcaaatgcatagatcccaacaaaaagtaacaaggcacatgaagaaactgttgtaaccaacagttgggcacatgagccaagcaaagtatcaaaaaactatctccagaaataagtcctaaagaaatggagatatatgaattactcaacaaaaaattcaaaattaaccattgtaaagatgctcaatgaatacagaaaataaatacataaaatgacaacatcaacaaagacagaaaattttcatgcgagtccatgtgaagagaccaccaaacaggctttgtgtggcaataaagctttttaatcacctgggtgcaggcgggctgagtccaaaaagagagtcagtgaagggagatggggtgtggccattttataggatttgggtgggtagtggaaaattacagtcaaagggggttgctctctggcagcaggggcaggggtcacaaggtgctcagtggggagcttctgagccaggagaaggaatttcacaaggtaatgtcatcagttaaggcaggaaccagccactttcacttcttttgtgattcttcagttgcttcaggctgtctggatgtatacgtgcaggtcacaggggatatgatggcttagctcggatcagaggcctgacattcctgtcttttatattaataagaaaaataaaacaaaatagtgttgaagtgttggagtggcgaaaattttgggaggtggtatggagagataatgggcgatgtttctcagggctgctgtcagtgggattggggcagcgtgggaacgtagagtgggagagattaagccgaaggaagattttgtggtaagaggcaatattgtggggttgttaaaagaagcatttgtcatatacaatgattggtgatggcctagatgtggttttgtatgaactgagaaactaaacagaagatacaagatctgaataagagaaagagaaaaacaggtatttaaggactaagaattgggaggacccaggacatacacttagagagtggccaagggggttcagcgtaagtttttgggctctatccttgtcagagttctcctttttaagttggaggctgagcttgatgaggcgtgtttttaaaagaccattagtccattctacgtttcctgaagattgaggacagtaaggtgcatgaaagttccactgaataccaagagcctgagaaactgcttgggtgatttgattaataaaggccggtctgttactggactgtatagaggtgggaagaccaaactgaggtattatgtcttacagaagggaagatataaccgcggtggccttttcagaccctgtgggaaaggcctctacccatacagtgaaagtgtctaactagaccaagaggcattttagtttcctgatatgagtaaagtcaatttgccagtcctgggcaggggcaaatccccaagcttgatgtgtagggaagggagggggtgcaaaactaataaaaataaacacacagaaattttgaaactaaagaataaaattatataattaaataattctctagaagaactcaaaagcaggcttaattgtgcagaagaaaaacagtgaacttttgaaatgacaagcaaaaagaaaaagaatgaagagtgaagaaagcctaaaagactgatgtgactccatcaagggaacaaatacacattatgagagttttagaaggggaagagttaaagaggtaaaactcttgttggaagaaataatggcagaaaacttcccaaattggggcaaggaaatgaacaaccacgttgaagaagtccagtggcataaactcaaagaagacaacaataagacacaatgtaatcacattgtcagaaataaaagacaaagagaggattttaaaagccagcacaatattgcagtgaggcgagatcacaccactgtattccagcctgagtgacagagcaagactccgtctcaaaaaaaaaaaaaaaaaaaaaaaaaaagcagcacaataaaagtgattcattatatacaagaaatcctccataaaactaacacaggattcctcagcagaaatattgaaggccagaaggactagaatgacatattcaaagtgctgaaataaataaaattgccaaccaagattactatatggaacaaatctgtccttcaaaaatgaaaaagaaataaagacatttccagattaacaaaagttgaggtagtttataattatacttgccttacaaaaaatactaaagggagtccttcaattgtaaacaaaagaatgctagatagcaacaaaaaaaacatattaaagtatacagcttggtagcaaaggtaaatatttaatgaatacagaatccttcaatactataatggtagcatatgaatcacttttagttctggtgtataatgaaagtattagtataaaaatacaactaaaataaatttatacacaatataagaaagtataattgtgacagtaacagaaagtgtatgtgtggaggaggaagtaaatatgtaaagttttttgtatgcaattgaaattatgtgttatcagcttaaaatagattgttataattataagacgttttatggaagccccatggtaactgcaaagaaaatatctataagagatatgcaaaagaaaataagaaagcaattaaacactgacagtataaaagtcaatgggaagaaaagactgcaagagaggaaaagaggaacaagaaaagctacaagatagacagaaaacaatgaataatatggcaataataagtctttatcaataaatattttaaatataaacaaattaaaatccccaataaaaagatacagagtagctaaacagattaagataaaaaccaaaaccatgatttaactataagcaccctacaagagactcactttagctttaaggatgcacataggttgaaaatgaaaggatgaaaaaaagatattatgtgtaagtggttagcaaaagaaggcagaggtagccatatttgtatcagacaaaatataatttaagtcaaaatctgtcataaaacaaaaataacatcttagaattataaaagggtgaagtcactaggaatgtataccaaatatatatgcacatagcacccaaatatgtaaagtaaaataggcagaactggagtgagatagagagtaacatgatgatagcaggaaatcccacactccccttttaattatggatagaaaaccagatagttgaccaataaggaataagagagcttgaacaacactatagtctgattgaacccaactgatacatagaatcagtctacacaaaaccagtagaataaacattcttctcaagtgtacatattcttctccaggtaagaatacattgtaggttgcaacacaatcttaagaaatttaaaacgattgaaatcacaccaagtatctttcttgcacacaactgaataaaaatagaaatcaatacaagaaggagaagtggaaaatttacaattatatgaaaactaacacactaccaatggatcaaagacaaaatcgagggaaattagaatatgtactgacacaaacaaaaatgaaaacctaacataccaaaatttatgagctgtagcaaaagcagcactaggaaagaacttcatcgtgataaacacctacattataaagaaaaggtatctcaaataaacaacctaactttataccataagaaactagaaaaagaagaacaaaataagcccaaagttagcagaaggaaggaattttaatgattagagcagaaacaaatagaaaatagaaaaacaattttaaaaatcaacaaaaataagaattggtttattgaaatatcaacaaaattgacaaaacctcagctagactaagacaaaaagagagagtattgaaataaaattataaattgagacattacaactgatgccacagaaattaagattataaaagagtattacaaaaattatacgtctacaaattgaataacgtcaaagaaatggatcaattcccagacacatacaacctactaagactaaatcatgaagaaatagaaagtgttaacaggcatatatctagtaagaaaattgaatcaataagcaaaaacctctcaacagaaataaagtctaggactagatggcttaactggtgaattctaccaaatatgtagagaggaattaatgtcaatctttttccacttgctaaaatattgaagaggagacaatacttccaacatcattttatgaggccagccttattctgagattaaagctagattaaaaacactagaaaaaaattgcataccaatattccagatgaatacagatgtaaaaatcctctgaaatttcctagcaaaccaaattcagtagtatcttaatagaatcatataccatgaccaagtgggatttctctcagggatgaagggactgttcaacataggaaaatctatccatatgatacaccacatttacagaattaagagtgaaaaccacctgatcaccttcatagatgtagaaaaaatttgacaaaactcagcactgattatgattaaaaaaattaaaaaaactagaaattgaaaaaaaaatctcaacacgatgaaggtaaaatatgtaaagcccatagctttatcacagtcattggtgaaaaaaaaaaaaaaaaaaaaaagaaagaaagcttttctggtaagatcagggataaggcaagaatgtgcactcttatcacttctattcaacatagtaccagaagtcctagctagagaaattaggcaagagaaagaaataaaaggcaaccaaatcagaaaggaagaaataaaatcaattatattcacataggatatgaccttacatgtagaaaacacaatagatctcatataaaaactgttagaactagtaaatgaattcggaaaatttccgggataaaaaatcaacatatagaatcagttgtgtttctacacgttaacaaagaacaattttgaaaaataagttaaaaacaataccatttacaatgacatcaaaaagaagaaaaaaatacttgggaattatcttaaccaagggaataaatgactataaaacattgatgaaagaaattaaaggagacacaaataaatggaaagatatcctgtataaatattggaagccttaatattattaaaatgtcattaccacccaaagtgatctatagggttgaggcaatcccatcaaaattccaatgccatttcatttttcagaaatagacaaaataatcctaaaattcataaagaaccacaaaggacccccaatagccagacagtctcatgcaataacaaagctagagggctaacttcaaaacatactacaaagctacagtaagcaaaataacatgatacaggcataaaggcagacatataaaccaatgaaacaagtttgagggtgcagaaataagcccatgcacatatagtcaactgatcttcaacaatacacaatgttgaaaggatagtatctgtgttagtccattgttgtgttgctgtaaaggaatagtggaggctgggtaatttataaagaaaagagttagttgccaaatggttctgcaggctgtacaagcatgtctccagcatttgcttctggtgagggattcaggaagcttataatcattgtgaagggaacgggagccagcatgtcacatgatgagagcgtgagcaaggggatgtggggtaccacgctcttttaaacaactagatctcgtgtgaactcagagtgagaactcactcattattgcaataatggccattaatgagggatctgcccccatgagccaaacattccccacgaagccctatctccaacactggggattacatttcaacatgagatctggaggggacaaacattaaaattatatcagtatcttcaataaaaggtgttgggaaaaattgaatttttttcacatgccaaagatattcagatgcaatagaataaaattgtattcttatctaacagcataaacataaattaactcaaaatagattaaagacttaactataagacatgaaactataaaattcccagaggaaaacatagtggaaagctttataatgttggtgcaggtcacgattttatgaatatgacacaaaaagcacaggaaacaaaagcaaaaacagacaagtgagactgtgtcaaactaaaatacttcaacacagcaaagtaaaaaatcaacagagtaaaaaggcaacctgtagaatagaaaacaatatttgcaaaccatatgtctaataaacaaacagcaatatccaaatatatgaggaacttgtaaaactcaatagaaaaaaagaaattatccaattataaatgggcaaaggacatgaaaatatacatctccaaaaaaaaaaaagacatacaaatgacccacatcttcatgaaaagatgctaaatctttttaaacaggaaaaaacagatcaaaaccacaatgaaatatcaagtcatccctcttatagatggccgacatcaaaacaaaacaaaacagaaaataatcagtaaggatgtgataataataatcctcagtaatcctcaataatcagagaggatgtgaatacattgaaacccatatcccctcttggtgttactgtaaaatcgtgctggggctataagaaatagtgtgaagatatctcaaaaattaaaaatagaactactatatgatctagaaattctactcctacatacttatctaaagtaactgaaagcaggatcttggagagatacttgcactttcatgctcactgcacctttattcacaaaaaccaagacatgaaaacataaatgtccactgacagatgaatgtttaaaaagttgcatatatgtgtatgtgtatgtgtgtgcatgtgtgtatgtaagtgtatgtataaaatagaatattattcagctttaaaaaagaaggaagtcctgtcatctgtaacaacataaatgacacttgaggacatcatgctaagtggaaaaagccaatcaccaggacagatactgcatgattccacttttatgagtcaccaaaaaatagtcaaactcatagaagcagaaagtagaatgttggttgccagagtccgaagaaatggggaaatgaggagttattgtctaataagtatagagtttcagtcatacaagatgaaaatgttttagaaaccttttctacaataaagtatatatagttaacaacactgtactgtataactaaaaaactgttaataagatatatttcatgttgtgtgagattttttcaccacaataaaaagtattccttgttatgacaaattaaaaacaagaaaatcactacagtatagtaaaggaaactgcatcctgaaatatttatgaattatttgagatcatgttgtaatctgttattaatctcaagtcgtacaatagcaatttgtttcttctaccaatttctcacaaagtgtggtctgcaatagccttcagtcagaataaaaactctggtatctaagaacatctccagacctactgaatcagaattatggtggatggtacacaggaatctgtattttaagtattctttccaggtgaaaattatgtacataaaacttgtgacgttgctttatatgaaagcttatattcatatatattatgcgctcctaaattttcacacacacacacacacacacacacacacaaagcaaatgttctcaatcaatataagttacattgaagttaaattcattgtttgactttgactctaagatgtgggtcacgtatcttcactaaactcttctaatcttactgatcacacttgataatccatactaatttcagatctagaaaattaagtaaaactattcaaagttccttaacaatatgaactagatttgaaagttccaaccactttcaacattacataagatcctgataatcatactatttgttttcaacctcagaaatagcaaaaaaatttaattttgaaaagcaaagaattgatggttttgaactttattaaaagcatcatcagcattttattcattctatagtaaagaaaataatataagaacttgaaagtctattaatgacagtaaagtaaactagtttattttgttttctaagattcaagaaaaatggatcacttctatggctaaactaatatcttgaaattcctttattatagacctaaaaatgtaaatatggtttaaagactgcaatttgtttaggttagccctgtgattgactctgatttatatgctgagttcaatttcagctttctattataaatgacctaataacaaatattctcacaattctcttccgacagaggagatgtggggattcctcaccatcagcaaagaagtgatcaattctgcagaaacaccagctgggctaactcaattcaattcaattcaattctcacactctacctcgatgtagcaactgagctacatctaactctattcaattctcacactctaccttgatgtagcaactgagccacaggttgaaggttcagtttcacgagattgcctcccactggccaccggtgatcattttaaccttcagccccaactcatccctagagccttggtctatctggcaaccaaatgtcatcatctatgggggccaacagctgtcagccaacttattagcatattagaagactttggagattctaaggattcaattcaattctctaactcaattcagttctcacactctacctcgtagcaaatgagccacaggttgaaggctcagtttcatgagattgcctcccattggccaccagtgatcattttaaccttcagccccaactcatccctagagccttggtctatctggcaaccaactgtcatcatctgtgggggctaacagctatcagccaactcattagcatatgaaaagactttggagattctaaggattttaggagttgtattccaggaaatggggtcaaagaccaaatgtatatttcataataccacactttgaagaaaaatttaagtgaaattaaatcaatatcaatatttcagtggaaagcttcagtgaggaagataatttaacaaaggaattaactttttgctttacgttaatgatcttcacgatatagcagagctgaattacaatggtaggctacaagcctttatttaaattttccccttagacatgaacaatgtgttttatgctagcagaagacatgagactcctgggccagagacaaaagaccttattacttatggcttaacaggcagcataaatatcattctcctgtcctctgaccaagacaattttaatgttcccctcagcttgagtaaatgctaaacagatttcttcttgattttaggcccctgacttccttcgccctttgagatgtaaagaatctttgagcctcttgctagttttatagctcacgtatatttgtcttaagaacttgagagccatccttctaaaaatctaatcattaagaaatatagtgcctctacctgtcaagctctgtgagagagtaggactctgactttggtaagtgccaatcagcaaacacagcctaatcacgttgacccctacctaacaaatagtcttcaatacttttccactaggctactccagcaattaaaaactctcctgccttttgtttcagtggtgttgagttcaatctctcccctactgcaatagtcttaaccacaattgcaatattgttgaataaagtttgcctccctgtttagctgtcaggtgcaatttttctttgaaattctgaagtctcttgggagcaatgaagagtggtccaggtagaagctgcagtaatagtttgtttatgtcactgctgagaaatacaagcataggaaactccagtttcatcagagggttgctagcaagtctgtccaatcttagctacggagtgggaagaaaacatggtatttattatcctgattaggagacaaatcttgtctctgacccaaaaggaaaccttatctgtatcttccaaggcttttagctatcctaacatatgtcataaataattttatatataagagttaatacttacataataaatgtttgttcatttggtatattataatttgaaaatattaaaatatagttatttcttgaaatacaaatatttttattattcaatcacatattagtttatttaatacagtgttcaacaaacatttttatagattgcctaatatatatcacatgctatgatcaagagctataagacacagtaaattcatgctctccgggagctccaatatagcagctaaataattttctagttgtgtaccacattcaaagaagtcagagccagagcacagagacaaatacagagtttcaagaggtgatgctaaatttatcagacaaggagaaggaaaggccatgtatatagtaaaaagaaagaaaagaaggtaaaatggctttaatatggagtatctgagggaacagtaaataccatatgagagtggctagaattacctggaaatataaacgcggtcatggcagaaaggaaagtttaggccactatcaataagttgggctttatttgtaaatgatgtggtgtcatttaagcattttatgcagaacagtactatgttcagatatggatcaaagagaggcaatgctctacactgagactgttattagaaactgtcatagtcttgaattaactacagggaatataaattcccaaaccttctttacccatggtgtattcatttcaaaaatatatttgatgtgtttttatcactcacgataaaaattgccaaattgtttctcaaaaatattttacagcagtattatatcttcattagaatttagttttaatgtcagcacatctgatgaaaaatagtctaaagtcaaaattatccttgtcagtttctgataaaggtgccattttgaagatccacaatctgtctttcaaagtactaggttactccagcaatgaaaaactatcctgccttttgtttcagtggtgttgagttcaatctttcccctattgcaatagtcttaactactattgcaataatgttgaatacagtttgcttgcctgtttaactgtcaggtgcaaattatccttgtcagtttctgataaaggtgccattttgaagatccacaatctgtctttcaaaataacaacactacttttttctccatggtaaaacagtttacaattcctccatggaaatatcagatgaagtagtggcttgtatttagggtccatgttttattaagataagtactctgtttttaaaaactagcagcacattcagtgcttactgaagctcacagtatcagggacatgagttggaactgacaaggattgagagagcagcagattcatattttcttccacaacccactgggtctaggacatatactcagcagaatggcaggcaacatttccaacagtatctgaatgtatccactccctctctcaaccatgtataattaaagccaagtaatttaaatagaaccagtgcaaatggactatactgtgtttttatttcattttctttgcaataatgctaattttggaccaaagttttaggcaaagggtatcatcactgttaaaaggggaaaaagctggttttccttttggtttctgtttattctttagtggattgtagattaatattcattgccttagaatttattaaagtcatgatacttgccaatcaatttttgtataagcaatttgtttggtggagatgtaacatgataacaataaggactgatttattgtcttcaaattctgataaaaccaggattgaaaacaataggagacaaacattctgctatgttacagaagggtgcgagacacagtcatgcaggatttagttaaaaatagcaaatcctcttatctccccaagctctacaagaaaataataacattttaatggattatttgaagggaattaataggctataaagaaagctgtggcacttcctctgtcagatggtgggagggggtccttttcctaaagccaaacgtgggagcacgttcaaaagaatgtagagaggacacccgccagcaccttctttctcaaacaatgtttgctgagctgcagaaatgtatagacgctatatggtacagaaatgaagtgttgtgtgagagtttttgatacacgtttgtgtgtgttctagagaatttggtaatatacatgaacctaggggctgttttccactggagaagtttaaaagcagcagcagtctgttttgagatacttcccatggtaaggtgaggagagaagggtcagcagttaaacatgtgtccttttttttccaccttttattttaggtttaaggggtacatggttaggtttattacatgggtacatcgtgtgtcacggggttttggtgttcagattatttcatcacccaagtaataagcatagatatgataagtagtttttcgttgttgttgttttctcttcttttgtttttcttttgtcttcaacctcctcccacctcccatcctccaccctcaagtgggccccggtgtctgttgttcccctctttgtgtccataggtactcaatgtttaactccaacttatgaatgaaaacaggcagcctaaagatgtatagggcttctatggcctgaggagatgatgcggataatgggctggctcctgttatttttatgtagtccaacctataatagggttagagtgagggtaataagatatggaaggaatgttttcacatgggtcactctataagggcatagcctatactagacaggtgagtagggacaaagtccctgtagcacttccaaaaaacagcaagcctgatatatgaagaagaacctcaatttgaatgatggacacatagagacgtcaatggccatatttcagcagcattttttctctaattcctttgctcacttcctctattgtttcttaaacctagaatcaagaatcaagtctgtgctgggaagaaagaagctacgactacgacatcaaattgaagttttgtttatataaactagacattttaatgtctgaatgtgtcagaattaccataataaaatttttcttttaattgaaattgattggaaagccaatagatagacttaaggttcagcaaaaagaatttactagagtataattgaaggcaaggtctggagaaaagtaaagtattttcctatttatatcacatagagttcaaccttcattccctgttcaatataccagctgcaagagtattaatcatttggcatatttgccttaatattctctttttgttgttttaacctctttttatttccattacagcgaaatgtgtgtttccatgcatatgtgagagaagacagttaatatgtccaaatttcatattttcctttgtaatctatatcttttatgtactgaatgagtcattcacattctagaaggtacaacaatgttgcaatatattctcattaaaattctaatgccttcaatcctcaaattaatattctaaacattaaattcatataaaatatatttgatcactgttctaaggtaagtacagaagaccatatggtgtgcttcccagatctccgttcaagactgaaaaacttattcccccatctactggaagtgcattgcgagattatttcgagctcttcctcaacttcaggaattgttctacctgaagaatgttgccttgattaagatcatgttcttcccagtgtcaccctacatctaatgatagccagatgcaggtataaaacaaacaaacagactgaaaacctaatcctttcttttctacttaagataacctgaagggacatctctagaggtctttatttagactgtatcagagcccattttctctggcgttcttcccggctcttccccagaagacaatgctaagagcccttaattgatactgatgtctacctctgcatcttgaaaaatctaatatgggacagaaaagactgaaatcagtcctcctccaaggtcagaagccatttattacaatgccattttttagtaattattattttctttctggtgctccaatggctccttgatcatacagtaaggaggcctatgtagtggagtcgacgcgattatgtggttatgcacgtgtatgcttctgtgcttgtgctagcacacacacaaacacatacgaatacataaacacacatatataacatatgctcacacataaatggggagaacaggaggattcatatgtttgttaaacaaactacaaaatgaaagataaatacaaatgaacttttaaaatatcactttaaggaattcttatttatcccttgggtaatgggttgtttttaaagcaagaaagtattattatctgaattttttcctaaaaggcaaatagtagccatgtgttgtatacataaacaggaccaatgcaaaggtcattataacacatgaggtgagagatgatgaatacctgaagctgggtattgacactggtaaaagttaagaggtactcattggaagctagaattgatggggcttggtgacaacatgaaaaattgaaagggagctttttttttaatgttataggctatttaaatcgattttattagaacacaaaaatgttatttttaatttaaagtattagaagtataattattctatagaaataaaaggcataatatattctttagtcacacatttatacctagactagtttcac

SEQ ID NO: 1075 - DNA, 3090 bp, Homo sapiens
ttataaaatgacagagtcaattctccgttactctccattactcgcatttcaatttggtggctcacttttcagtgtgaatcctgtctttaatacacactgttcaagagtggatgccaacttcaagtggttcctggctgtcaagggccttcccattccactccataaaatggaagggcccactgacatattttaatggaagggtataaaaaccttctttgttttaacatacattaaacacttgttaccaaacatgttggaggaatacaaagtgacagtctgtgatacatttaagtaattgtaattcagattggtttctccctattaccactttcagggcaagtgaggcaaaaatctaactaccctcaccatcccgactcctatcccagcactcctgcgtaaacatttacatcatttctaattctcacaccgaagtccttcctatcacctacatcttgctactgcgagggacataaggaggttagggaggtgagtgggtggaggtatgggcagggacaggggtaggggtttgagctgacatagtacatacaacaggaattaaaggaatcagaatcacattgcaggttgtgaagtagatagagtctgtgtattgaagttacacagctctaagtctaaatcctcagctctgaaactttttagttgggtgacagttgacaagttactaaacttctcagagcctcagctttcttacctatataagtggttaataatatgtacatcctagggctgtagtgagaattcaattacatgtataagttgtaaatactcagtatacactcaaatatagtgctgtatttgtattgggtgaatatgtggaaattagggagttctatgcttttgatagagacaggccaatttacttgctcatccttgaatgcaggtttcttgacattccttttcactgttgaatctatttcctgagccattacagccactgaaccaaaatcgggcacaagagttgacctgtttgtcataataccatcgaaccacatattcaccacagtttccaggcttcaaggcttccaaacatctaggatctagagtgagaaaaggaaaatgtgtcacggatttttcttatactgaagacatgaaaaataaaaactgtataaagttatataaataaactttattcttcatgcacactaacaaaccaagaaaatatggttctaagtaagtgaaagaaggattccctaaaacccaaaatatttccctcaccacctgaaactctgctactagatattaattcttttgaaaacatgaaagtttttgatcctcatgaaaccacattaaaaatgtttatttccctgaaagcctaagtgagacttcattggctaatacttttgtggggattagaaagacaggacttctttcatttacactggatttgatttacaatcaaattaatatttggaataaaaaatatttccactttctgtacacatttcctcccattctgttcacagaaggcaccactatgatcacatgcaattgcccactatcaaaggaaaactctttaagttacaaaaaaaaaaaaagtaaaatgaaggactgtctttatattacaattatagttttaaaagagcagctcttgcaggacactaaaaacgtgatacaactttctaacgtcatattgtcttatcgtagaaatacacctactataagaaagcataggacagctgtaacaataaagccacattgtcctaataaggttcctttaattatggaactcctcatttgctaaatccctttttattgtttggtactctggagtgccttgattagtatttcctacttcaggaagtgatgccaaggtgggagaagccaaaaaacacacaaaaaatccccaaatagataattgctatctgggacttatatgtgataaactttattttgcaatagctaaaccagcactttctcttccttaaacattttcccagatttggggtatggctcggttcatttattttctcaaacttacctctaaatctacctctactatgaagactccctagaccaaatggaaatgagccatagatttctactacctctgcccttaaaaacaaaaccaaataatatatattgtgtaattcattttaaagataatctaaacttttgagcacaaaaattgtctctcatgttctgcagaaaatatgtacataataatacattttctatagatattaactccatagaaaatatgttaatgaatcagaatctagattttcgcttgtttctctttcctgtgcaataaaaggatcacaaattcaaatgcctacatgtgtgaagggcacatgtaagacaatagggagcagtacggactacggtaaacaggagaatgcaatcccctctaaaggcattcaaattaaaataataaataagaactttgaaattcttcatagaccaaatttactccacagttttcaaattctacatatagtccagtgaaaactatattttgtcctgcttgtttagaatcataacattttctctctgggtaaccctgtgccttcctcacattgtagatacagtagcagattggcagatctctctttcctttgtgcaccaaatctgtgcacaagactgtagaatcaaaatgggacttggagttctggtttacctaccctctgccccatccacaggggtgctgagcagtggcctgggggtggtggtggcctcagatgaggtagtggcaggcagatcatcagcccacgttggctctggagccttatcatcttcatcctggtctctggtgacactcaactacacaaaaatattcacattttgtgtttctgataatatcaagtaaaaaaaatactagtttgcttttgggaacatataaagactagttcagccatgctgtgtttccctagctctctgatactaactatttcaaataaaactcaggaaataatgcccctcctctgtgtcatgcatccctcaatacccaagttgtggattttcccaccacttggtgtgggtgtatttctgtgtacacacacatatacacacatacacacacacacgcagcccacctccaggcacagatttttgggtgctgggacatccaaagca

SEQ ID NO: 1076 - DNA, 4990 bp, Homo sapiens
ttataaaatgacagagtcaattctccgttactctccattactcgcatttcaatttggtggctcacttttcagtgtgaatcctgtctttaatacacactgttcaagagtggatgccaacttcaagtggttcctggctgtcaagggccttcccattccactccataaaatggaagggcccactgacatattttaatggaagggtataaaaaccttctttgttttaacatacattaaacacttgttaccaaacatgttggaggaatacaaagtgacagtctgtgatacatttaagtaattgtaattcagattggtttctccctattaccactttcagggcaagtgaggcaaaaatctaactaccctcaccatcccgactcctatcccagcactcctgcgtaaacatttacatcatttctaattctcacaccgaagtccttcctatcacctacatcttgctactgcgagggacataaggaggttagggaggtgagtgggtggaggtatgggcagggacaggggtaggggtttgagctgacatagtacatacaacaggaattaaaggaatcagaatcacattgcaggttgtgaagtagatagagtctgtgtattgaagttacacagctctaagtctaaatcctcagctctgaaactttttagttgggtgacagttgacaagttactaaacttctcagagcctcagctttcttacctatataagtggttaataatatgtacatcctagggctgtagtgagaattcaattacatgtataagttgtaaatactcagtatacactcaaatatagtgctgtatttgtattgggtgaatatgtggaaattagggagttctatgcttttgatagagacaggccaatttacttgctcatccttgaatgcaggtttcttgacattccttttcactgttgaatctatttcctgagccattacagccactgaaccaaaatcgggcacaagagttgacctgtttgtcataataccatcgaaccacatattcaccacagtttccaggcttcaaggcttccaaacatctaggatctagagtgagaaaaggaaaatgtgtcacggatttttcttatactgaagacatgaaaaataaaaactgtataaagttatataaataaactttattcttcatgcacactaacaaaccaagaaaatatggttctaagtaagtgaaagaaggattccctaaaacccaaaatatttccctcaccacctgaaactctgctactagatattaattcttttgaaaacatgaaagtttttgatcctcatgaaaccacattaaaaatgtttatttccctgaaagcctaagtgagacttcattggctaatacttttgtggggattagaaagacaggacttctttcatttacactggatttgatttacaatcaaattaatatttggaataaaaaatatttccactttctgtacacatttcctcccattctgttcacagaaggcaccactatgatcacatgcaattgcccactatcaaaggaaaactctttaagttacaaaaaaaaaaaaagtaaaatgaaggactgtctttatattacaattatagttttaaaagagcagctcttgcaggacactaaaaacgtgatacaactttctaacgtcatattgtcttatcgtagaaatacacctactataagaaagcataggacagctgtaacaataaagccacattgtcctaataaggttcctttaattatggaactcctcatttgctaaatccctttttattgtttggtactctggagtgccttgattagtatttcctacttcaggaagtgatgccaaggtgggagaagccaaaaaacacacaaaaaatccccaaatagataattgctatctgggacttatatgtgataaactttattttgcaatagctaaaccagcactttctcttccttaaacattttcccagatttggggtatggctcggttcatttattttctcaaacttacctctaaatctacctctactatgaagactccctagaccaaatggaaatgagccatagatttctactacctctgcccttaaaaacaaaaccaaataatatatattgtgtaattcattttaaagataatctaaacttttgagcacaaaaattgtctctcatgttctgcagaaaatatgtacataataatacattttctatagatattaactccatagaaaatatgttaatgaatcagaatctagattttcgcttgtttctctttcctgtgcaataaaaggatcacaaattcaaatgcctacatgtgtgaagggcacatgtaagacaatagggagcagtacggactacggtaaacaggagaatgcaatcccctctaaaggcattcaaattaaaataataaataagaactttgaaattcttcatagaccaaatttactccacagttttcaaattctacatatagtccagtgaaaactatattttgtcctgcttgtttagaatcataacattttctctctgggtaaccctgtgccttcctcacattgtagatacagtagcagattggcagatctctctttcctttgtgcaccaaatctgtgcacaagactgtagaatcaaaatgggacttggagttctggtttacctaccctctgccccatccacaggggtgctgagcagtggcctgggggtggtggtggcctcagatgaggtagtggcaggcagatcatcagcccacgttggctctggagccttatcatcttcatcctggtctctggtgacactcaactacacaaaaatattcacattttgtgtttctgataatatcaagtaaaaaaaatactagtttgcttttgggaacatataaagactagttcagccatgctgtgtttccctagctctctgatactaactatttcaaataaaactcaggaaataatgcccctcctctgtgtcatgcatccctcaatacccaagttgtggattttcccaccacttggtgtgggtgtatttctgtgtacacacacatatacacacatacacacacacacgcagcccacctccaggcacagatttttgggtgctgggacatccaaagcagatgtgaaagatgcaaagttgagaggagtttattttcattcttagccactgctatgagaaaataaccactcatttctttaacatttttatggcctttctccatttcctaacactagacgtcttaacaatatattccaaaatatttaccatgaactcagtcaattttgagattgggaattagggtagcagaagacaataatacagctgaaataaaaacaatagtggccactttttgattgcttacccaaatctcagctgcagacacctttgcctgctctattatcagaccccagctaataccaaatgctgtaggatgcttaacatataagatgctctaagaaatgtttgatatctaaagaacaaaggatttttgtttcaaaagcaaattttctggactaaaatttccaagtttcatccaaatttatgatatataacgaaacaagaaaggcattttactttttttttaaaaatagtgcctttatagtagaatgatttataatccttgggtatagacccagtaatgggactgctgggtcaaatggtatttctggttctagatccttgaggaattgccacactgtcttccacaatggttgaactaatttacactcccaccaactgtttaaaagtgttcctatttctccacatcctctccagcatctattgtttcctgactttttaatgatcgccattctaactggcatgaaatggtatctcattgtggttttgatctacatttctctaatgaccagtgatgataagcgttttttcatgtttgttggctgcataaatgtcttcttttgagaagtatctgttcatatccttcgcccattttttgatagagttttttcttgtaaatttgtttaagttctagtataaagacacacgcacacatatgtttattgcagcactactcacaatagcaaagacttgaaccaacccaaatgctcatcaatgatagactggataaagaaaatgtggcacatatacaccatggaatactatgcagccataaaaacatgagttcatgtcctttgcagggacatgggtgaagctagaaaccatcattcttagcaaactaacacaggaacagaaaaccaaacaccacatgttctcattcgtaagtgggagttgaacaatgaaaacacatggacacagggaggggaacatcacacaatggggcctgtctgtgggtgggggcctagggcaaggaaagcattaggagaaatacctaaagtagattacaggttgatgggtgcagcaaaccaccatggcacgtgtatacctatgtaacaaacctgcacattctgcacatgtatcccagaacttaaagtataataataaaaaatcatgtcagtcattcttgacaattaccaggagctagacaaatcttttatgggaataattatattcttttgcaaatttttccttggattccagctgtatgcaattgaatcagtcattcacctgagtcctgacacttggttatttatccttgcaagagtttctcttatttgtttgtttgcatttttatttatttaaatagtcaaatctgtgactgagatagttttttatgcttttttacccagggatcctggtatgctgtcatcattaactgccgtctgccagctaagctgttctattgcttttgattttttttgtgtgtgcatgcatacatacacacacaagagggaaaaagtaattagtactattactcatgtatgcgtattttttacagtgattaaattactatcaggtgacttagagcaaagatttttccatttggattggtcattagccctatataaagggcacacaattcaaatacaataggaaattttcactgtcccctaaacacaacttttggtacaagtggagacaaaactgtggattacttgag

SEQ ID NO: 1077 - DNA, 1193797 bp, Homo sapiens
tattctgttggcagaaatatcagaccagtgaatggagtaaccaatcttagtggatttagagcccagagacactgtgtcagtcagaggtcacctttactgtgagggtacatctttctcctgcagttaaaattgtccttgacttccgtttcctcctgagatcacttgtgaaggagcttcaaaaaatctggttttttggtttgtttgtttgtttgtttttttgagacaggttctcactctatcgcccaggctggggtgcggtggtgcgatcttggctcactgcaacctctgcctcccaagctcaagtgatcctcctgcctcagcctcctgagtggctaagatcacaggtgtgcatcaccatgcccagctcattctttgcatttttggtagagatagggtttctccatgttggccaggctggtctcaaacttgtaagaaaaagccatcatgcaagtaataccacgatttgataaagtgtggtggcaggtgcacaggtattattttgctcagtattctcctaatgtttgaaatactttatgatttaaaaataatttaagggacaggtgcagtgacttacacccgtaatcttagcactttgggaggctaaggcaggcaagtcgcttgagcccgggggttggaaaccagcctgggcgacatagtgagaccccatctctacaaaaaaaagaaaaaagaagaaagaaatgaaaaaaacttagctgggcttggtggcacgcacctgtagtccaagctactcaggaggctgaggtgggaggatcacctgagcctggggaggtggaggctgcagtgagccatgattgctcccctgtatgccagcctgggcaacacaccgagaccctgtctcaaaaacataacaatttaaggtgaatagatttacagtcattgtagagcccctaggaaaacaatgtcaaaatctataccccccgccaaaaacaagttgactttttcaaacccgtgaaaacgtatgcaaatgaagtctttccagtgaataaattaacaggccatgtggaaaccgtcctggtgattccaatttcatctctcttcttaagtgtttgcaaagtaacctcataccttaacatgagcagaagagatagaagataggtttttgcttgcaattggattcctgagtacccattccataaacttaaactgcagtcatgacagagaattaactacatagcttggaaacctatacaaataggcaagtatttcctatcatcactgttttgctatcctttgcttatgagctagaaagaattactttgtaaatactgctactaagtctttactaagtactgctacttagtaaataactacttagaaaatactaaagcatttactgagtatcagtacttagcaaatgactacctacagaatactaaaacatttacttaatagccatacttagcaaatggctacttacataaaatgaaagtatttactgtgtagcagtacttagcaaatgactacttacaaaatgctaacatatttactgagtagcagtacttagcaaataactattataaaatactaattaattacagattttgtgcaattatgtagtagtgctaaatattaaaatacttagtatttttaaaatactaaagtatttacaaattactaaagtatttactaattagtagcatttacaaaaaagtattttcagattggagtgtatggcatgatcatggctcactgtggcctcaacttccaggatcaagggatcctcccacctcagcctcccaagtagctgggaccacaggtacatcctaacacacccagctaatttttaagttttttttgtagagacacggtctccctaggttgtccagactggtcttttgaaaattttaattttaatttttttccttcattttctctagttaccatgctgcattttattttatttctcacagttggtgtacacactgtgacattattcataatagtccagtgggatgttactcctcaggtcacagggggttaataccctgggacagtaatcctcatattccagggcggtgatactcctaaagtcacagggtgtgtaccccgtgatattattcgtcctattctagggggacattactcctaatgtcacagagatgtacaccctgtgatattattcatagtatgccagagggatattagtactaatgtcacaatgcatgtacaccttgtgatattattcataatatcctaatgtcacagggggtgtgttccctgtgatattattcctaacatcctagacggatattgctcctaacatcacagggtgtgtacaccttgtcatatcactcataatatcctaaaactatgttattcctcacttcacagggggtgttcgccccgtgatattactcgtaatagttttgtgggatgttactcctaatgtcacacggggtgtacacagagtcacacagtgctatgacctgtaatattctatagaaatgttactcataaatcacaggggctgtacctcctgcgatattatttgtcatgttctaggggaatgttactactattgtcacagggggtgtacagcctgtgatattactcatcatatcctagtgggatgttactaccaatgtcacaatgcgtgtacaacctgtgatatgatttgtcatatcctaaagagatgttactactaaggtcacaatgcttctacaccctctgatattattcgctatatcctcgggggatgtcactcctaatgtcacacggggtgtactccctgtgatattattcatcatatcctagggggatgttacttttaatgtcaccgggggtgtgtatcgtgcctattcaatgcctgtgatactattcctaatatcctaggggcatgttcctcctaatgtcacatggggtgtacaacatgtgtgtacacctgctgtgatactattcataatatcttaggggaattttattcctgatggcacaggtggtgtacaccatgtgtgtataccgcctgtctcattattcataatatcctagggggatgtttcttttaatgtcacaaagggtgcacaaaatgtcacagaaggtgttcaccttgtgatgttatctgtaataccctagaaggatgttactcccaatatgtcacagggttgtacaccctttgatattacttgtaatcacatagagagatattacttcaactatcaccatggatgtacacacatggtgcataccccgtgatatgactcgtaatatcctagggagatacgactcctgatatcacagtgcgtgtaccccgggtgtgtacacccttgatattagtcgtaatatccagggtaaagattactcctcatatcacacagtgtgcacaccctgtgatatttttcatcctactttagggagatattgcttctagtgtcacagcgggtgtaccccttgtgtgtgtactctgtgacggtattttttatatcctagggaggtattactcgtaatgtcacagtgggtgttcaccctgtgatatcattcttatttgaccttgctgcctttttgaacccacactacaaaaggaatggaacagataagaagatattgagattagactgtgctgccgtgtggccgccgcaggacacctttaacatccctgtttctcaggctgtagacgaaggggttcagcatgggggtgacaaccgcgtacatcactgaggccactgcaccctttctgggggaaaatgacacatccgaactgaggtaccctccaacgcctgttccataaactcagcaaacaactgacaggtgagacccacaggtggagagggctttatacctcccacctgacgatgaaaccctcagaatggaggaaacaattttagagtaagagaaaagggtccccgagatgggaagaaaaccaaatatggcggcagggaaatacatgattatgttaatggtgaaggtgtcacaacatgcaagatgggggagttgagaagggtcacagaagaaattaggaatttccacatccttgaagcaggtcacttgtaaggcaatcaagttgtgcagctgggcatctaaaagactgagaaaaaaaaagacaacaaaactaggaagccacagaaacacgggttcatgatggctgaatgatatagagggtgacagatggctacaaaccagtcataggccatcacactcaggagcatgcctctcttccatgcctccaaaaatgacaaagagagacatctgagtcaggcagcctgcataggagatgactctgctgtgagattggatgtccacaatcatcttggggactgtggtggaggtgaaactgatgtcaggcaaggacaggttggagaggaagaagtacacgggggtgtggaggtgggagtcagggctgatggccaggatgatgagcaggttccccagcaccatgaccaggcagatggacaggaacagcccagcgaggaccagctgcagttctggatcccctgagagttctaggagaaggaatagagagacatctgttagattctgtggctctgcatagtttggataccttttgcctagaaaagagggttgcaaaatgggaaacaagtaaaccaacacccggcattgattgtgtctgcattttgaatagaagcaattcacaagtcatgttttcagatttcagagcaatccacactcagcaatattttgcagttctgataaactcaattgtcttctagtgctttcatcattgatttctgtgttattcacttcttgctgtacacacctgccttagagacaatagattcaagaatgttccaagaaccagatcatcatatataacaaattcataattgctagaaaatacagcctatcttgtctgaaggaaaatatgtaataaaaccattctcttcactttaagaaaaaagttatcctaattaaaggaaactaagaactcaaatattttatttcatactactagatggatacaaattcccttgatttagaacatttataaacactgtagaacagctgagaccgggccaggcgcagtggctcatgcctgtaatcccagcactctgggaggctgaggcgggtggctcacctgaggtcaggagttcgagaccagcctcaacatggggaaaccctgtctctactaaaaacacaaaattagccaggcgtagtggtgcatgcctataatctcagctactcgggaggctgaggcaggagaattgcttgaacctgggaggcggaggttgcggtgagccgagatcaagccattgcactccagcctgggctacaagagcgaaactccgtctcaaaaaaaaaaaaataaaaaaataaaaaaaacagctgagaccatgtcatctggaaatgaaatgaaagttgatagttcataagcagaaaatagttccacatgccggttaggtcctagtgatttcatcattatgtgttctgacttttctccttcaagagagtaattgcttcctcaaatcggtgggtcttctttgaaaattcacgtaagctctaactcctgtccttagcttaggtggacttagaattttcatcagaaagtttggccggacgcagtggctcactcctgtaatcccagcactttgggaggccgaggagggtggatcacggggtcaggagatcaagaccatcctggccaacatggtgaaaccccgcctctactaaaaatacaaaaacttcgcccggtatggcggcgcgggcctgtagtcccagctactcgggaggctgaggcgggagaatggcttgaacctgggaggcagaggctacggtgagccgaggtcacaccactgcctccagcctgggcaacaggagcaaaactccgtctcaaaaaacaaaaaaccaaaagaatcaagtaagtcgaagtcacactgatgacagccaatttttgtgaaccaaggaagtatcaattcaataattcacatagatgttgacttttgctgtctcctatgtgccaagcaagatatcggctctggggcatcagaaacaaaagatactcacttgttcctctcacaatactcagtacttactgagataaggacaaaagtaaatgtcctgtctggaatgcagagaaaccagaacttcaggtcaggggatatttccgttgaattgtatggagttgaagctgaaaatattcacggatgtacctaaaattcactttgccttgactttacgcatccatcacatagagatcacgcagcgggcacccacgatcggtttcatcatcgctcacttccattggatcaactagaaatcagctcagatgagagtgctgagtctcagaggatgggcctctcaccccttgccatacagaggagtagaaaaggtggtattccaaattcatggccagactctaagtcccgggtactatacttcatggtcttccaactttcaaaaagttgtggttttggttttggttttgtttttgcttttttgagacggagtctcattccgttgtccaggctggagtgcagtggagtgatctcggctcactgcaacctccgcatcccaggttcaagctattctcctgcctcagcctgctgagtagctgagatgacaggcgcccaccactacaccaggctcattgttttctatttttagtagagacggggtttcaccatgttgtccaggctggtctccaacacctgaccttgtgattcacctgcctcagcctcccagagtgctgggattacaggcgtgagccacagcgcccagcttccaaaagttttcaacagagctcagaggtcttaaccacaggcacatctgaggagcattcacaagcaattcacaaggaacatcttcacacttgctgaccatacaccgccagcagtgtttctcagttgtgtcaattccaaaaatctcagaattattacgtgatttacttttttgctatacaaggctttctgtacatactactttagagaaaatccactgaagaatattagaagaccaaaacgtcatatataagaaatccatgatctcagtaaaatacggcctgctcttttcagaaaaaatagaatgcaatgaaaatgttcttctctcttgaagagaaagatctcagtctaattgaaagaaattaagaagccgtgaaatacactctattttattctgacaccgtgctacaaattcctttgatgtagaatacgtaaaaggacgatacaagagctaggaccgcattatctaaaaatgaaatcgaaacttagagttcttcatcggaagaccttttcacatgccacttacttttcgtatttattatcatccttaggttttctgacatcatttcttcataaaagtacatgcacactcaaatatgggagctgtgtttccaaatgaattgaatctataactctcggccgagcgccatggtgcacccctgtaatcccagcactttgggcggccgaggctgatggatcacctgaggtcaggagttccagaccagcctggccaacgtggtgaaaccccgtctccagtgaaaatataaaaatattagccgggcgtggtggcggctaaccctagctactcgggaggctgaagcaggagaatcccttagaacctggaaggcagggattggacaccctgtgataggatttttgatatcctagggagatactgctcctgacagcagagtgggcgtacaccctgtgatattatttgtaatatcctagaaagatattgcccctaatatcacagtggctgtacaccctgtgatcttaattgtaatatcctacagagatattactcctaataatacagtgggtgtacacgctgtgatattattcataatatattatggagatacgactcctgatatcacagtgagtgtacaccatgtttgtacaccctgtgatcttatttgtaacaacttagaaaaatattaccgctaatatcgaagtgggtgaacaccctgtgatgttatttgttatctactaggtagatattactcctaatatcacagtgtgtgtacaccatgtgtgtacagacagtgaaattattcgtaataccttaggaagatattactcctaatatcacaatgggtgtacacgctgtgatattattggtgatcccctagggtgatacgattcctaatattacagtgggtgtacactctgtgaggttatttgtaatgtcctaggaagatatgactcctaatatcaaagtggatgtacaccatgtgtgtacactctgtgatctaattcatattatcccagagagagatttctcctgatatcacagtgggtgtacactctgtgatattatttgtactatcctagagagatattgctcccagtatcacagtgggtgtacaccctgtgatatgattcataatatcctagagagatattacctctaatatcacagtttctgtacaccctgtggtattattcatcatatcccagggagatattatccctaacatcacagtgcgtgtacagcatgggtggacaccctgtgatgttattggtaatatccaatggggatattacccttaatgtcacagtgggtgtacagcatgtgtgtacgcactgagatgttactcgtaacatcctagggagaaattacacctagtgttacagtgggtgtaaaccgtgtgtttctattctgtgatgctattggtaatatctgagaaagttattagtcctagtgccacagtgggtgtataccatgtgtgtccactctgtgatgttaatcgtattatcctagggagatagttcttataacatcactgtgggtgtacatcatgtatgtactccctgtggtcttattggttatgtcctgggttgatatgacacctaatatcaccatgggcgcacaccataggtgtacattctgtgatgttattcgtaatatcctagggagatatcacttcttatgtcatagtgggtgtacagccttgtgatattcctggtagtatccttgggatgtattactcctgttatcacagtgggtgtacaccctgtgatagtatttgtaatatcctagcgacgtatcactgtataccctgtggtattctttgtgacatttgagggagctatttctcctaaagtcagagtgggtgtacaccctgtaatattcttcctgatatcacagtgggtgtacaccgtgagtgatttttttttctaatatccagcgggggagaggatgatattgcttctaatatcatggaaggtatacacccccttgtgatattgttcctagtatccagggaaggagaggatgacattattcccaatagcactgggggtgtaccacctcccgccgggatattgttcttaatatccggaggtggagagaatgatgttactcccaatatcccagggggtgtacaacacacctgtttgtagacaccccctttgatattgttccaaatggcctgtgaaagagtcaatattactcccattatcgcagggggtgttcagccctgatgatattgttttctaacatccagggaaggagagtatgatattactcccaatatcgcagggcttgtatacctttttgtgttattgggcccaatatcctggaaaatagaggatgatagtactcccaatatggaaataattgtgcagcacccctgtgatattcttcctaatatccagaaaggaaaagaatgatattattaccaacagcgtaggaaatgtacacccgcgctgtgatatctttccccatatccaggtgcggagaggatcatattacttccaatatcgcagggtgtgtacaccccctctgtgatctcgttggtaacatccaggtttggggaggatgacatgactcccaatatcgcagggggagtcccccccatgaccttgttagtcatttcctgggtggagaggatgatcttactcccaatatcgcagggggtgtacacacccctgtgaaaatcttcctcatatccagagggagagaggatgatattactcccagtaccgcagggggtttccacagcccagtgatactcttcctaatatccacagggagagaggatgatatgactcccaatatcgcagggggtgtacacaaccctgtgatattgttcctcatatccagagcgaaagaggatgatatgactctcaatttcgcagggtgtgtacacccctcccgtgctattgttctgaataccctgggagggagaggataaggtgacattgaatatcgcagggaatgtacaccctccccctctgatacccttcctagtatccaggggaagagaggataattgtactcccaatatcgcagaggcagtacaccccgcctgtgatattgttcccaatatacaaggggggataggatgatactactcccaatatcgcaggggtgttcacatccccggtgacatttttcctaatatctaggggagagacaattacatgacagcaaatgtcgcagggtctgtacatcccttcctgatattgttcctaatatccaggggggaagaggatgatatcgaatatgaaagggtgtatacaacccccacccctaagatattgttcttaatattcttgaggggagacgatgatatgactccaaatatcgcaagggttgttcacaccccactgtgatatcctttctaatatccagtgggggagaaaataacataacttccaatattgcaggtggtgcataccccacctgaaatattgcattaaatatccaaagagggagaggatagtattcataccaatatctaagtgtgtgtacacgccccttgtgacatggtttttaatatccagggggcgggaggatgatattagtcccaacgtcacagaaggagtacactacccctgtgatattgtccctaacttccagaggggagaggatgagatcactcccaatatctcagaagttgtacatcccccgtgatattgttcatcatatccagggaggcacaggatgacattccattgaatttcatgacaggcatacacgcacagtgtgatattgttcctaatacccaagaaggcagaggatgacattaatcccaataaagcagtgtgtgtacattacccctgtgttattgcctctaatatccgggaccgggggatgggggagaggataacattccctcaaatgtagcaggtggtttgatgcccctcgtggtgttgttttacatatccagtggggaagacaataatattatttttgatagtccgattcatcctctccacctttctggaactctgaggccgggaggcggcatgcactttccgtgtgatccccaatacctttgccgtcttctgtagcaagtcagccacaaccgcaggcccgttatctgagccaatccggaagggctgtcccaatctacgaatcagatctcgaagaagcacatgggttacttcacgagctttctcagttcgtgttagataagcctccacccacccagagtaggtacgcccaagaactagtgaatacttgttacctccacactttggcatctctgtgaagtctacctggagatcttcaaagggggctgctccataagcttgtatgccgggtggaacagctggacctggcctcgcatcatgctgtcggcagctgacacatcgctgcctcaccgttttggcaagggctgacaaaggcgagatggagaaataccagcctaacaactttttgcagtgactcctgacctagatgggtggtttcttgcacagccagtacaactgcagctcctggcagctgtggcacagctactctcccatccggtaaccaaatccatccttcctccatcacttgtccttccctctacctggacaaagtccttttctcctttagaataagcaggtccaagatcaggtgcttgagggagcagaggagctgtgactgatgcctggaaaggggcagatgctgcttttcgagcctctgagtcagcgcgggaattccccaagcccaccaaggtggaagctcgctggtgccccctgcaatgcataactgccaccttgtggggtttccatactgcttctaatacatggaagatttctggttgatattttctgccttttcccccagagttcaataggcccttttctttctagcatgctccatgcacttaaagggttaaaaaggcataccgagaatcagtgtaaatgttgacagtctcaccctcactgagctctaaggcccgaatgaaagcaatgagttcagctttctgggctgaagtggcctggggcaatgatctggcttcaacaacagtgtccagggttaccactgcataccctgcacctctctttccttgggtgttgaccaagctgctcccatgcacgtatagttcccagtctactgatgcccaaggctggtcccggatgtcaggtctgctagggtcaactgagtccaacacttctacacagtcatgctcgacagggctctctgatagcgggagcaaggtggcggggtgtagggtgttacaaacttcaatggttatacggggattttcacagagcaaactttggtacttggtgagtctggcattcgttagccagtgatgtcctttagtattcattaaagtcaccacagcatggggggcctttctgttcaggttctgcccaagagtcagcttctttgcttcttgtactagcagagcagttgctgccaaggccctcaaacacaggggccatcctttagaatccccgtctagttgtttggagaggtaggccaccggcctcggccagggccccacagtttgggttcaaagtccggctgccatcttttccctctctctgacacataggatgtaaaaggctttgtcagatcgggtagccccagggctggggctgacataagtttctcctttaactcatgaaagacttgctgttgttgggatccccattcaaaatgttcccagtcccccccccctgccccttggtgacctcatacaaaagcttggctaatactgcaaagtttgggatccgcagtctacaaaaccccacagctcctaagaattctctcacctgccttctgctcttaggctgggctagattgcaaatgacctgctttctttctgatcccgggctgcattccccctgtcggatagtaaatcccaaggaacgtacctgctgtcggcagatctgagctttcttcttggacagcttacacccacagtcctccaggtgtcggcatagggcaatccattcccttggcgcatccgactgccgtggggtgtcccagcaaaagctcatcaacctagcggagcaacgcgcagcctaggtctctggtgggaaacttctggaggtctcgagcccacgcctccccgaagatggtgggggagttcttgaacccttggggaagcccggtccaagtgtactgagtagtgacacctgactccggatcttcccactgaaaggcaaacagcttctggctctcaggggctaatctgataggaaagaaagcgtctctcgggtccaagcaggtgaaccagctgtcctcagctggcagcaaccccaacaatgtggacgggctaggtactgttgaatggaaagtcagggtagcttgactaagcaagcgcgaatcctatcccggcctgtagtcctaggcccatggcttgggaacaggcaggaggggagtattccatggagactgacagggaactatcattccgaaagttcttaggtgcttaagatggacctggataccttgaagagcttctctggggaccgggtcctgtttttgcttaagcggctgggccccagtcttaactggccaaccctggagggttgtcttctgcctgtactcttggccaccgcttagccagagctggtcttctcttggcccggctcagttcagaaaagtctccattcctcctctcgggggaccgtaagggtcataatgactcccgtggcgggtcactttagcagcaaagagctgtgttctgtcaaagagagagcagctctcagcttgctaagctagtcccttcccaaaaagggcaagggacagtcaggcatgtacaaaaactgatgaatcacttgatgtcctcctacagtgcacatcccaggcaagtagaaagcttgctttgctgaaacccccatggctccagtgaggtcaagagtctttctggataagggggcgaccggggtggttactagcgaatgttcagcaccgctatctacaagaaaatcaatgtctctaccctcgactgtcattctgaccagaggctctttggggacactggagcccggtctccctcagtccaataacccttctgccaggttgagccgggccccttcctccttgtccagggcctcctgctctgagtcaccttcttttcttttgagctgagggcatttgttcttccactgtcctatttctttacaataagcacactggtcacgctgcaaactctgacacccaagctgagtttctttcccaaggccccccttcccttgcttctttggggggacagctctgattgctgcagctaacaaacaggtcggcgtttcgccgggcctgaccttcattctctttgggctttccctcgcggcttactgcatccctgtttacaaacacctgcttagctatttctcatcaatgtgatgtattcatccctgcaagcccagcctgcttctgcagttttcttctaacgtcttccgcgctttgatggactaaagccatgtgaatcatgcgctgattttcagggttatcgtgatcaaggggagtatacataccataggcctcacacagtctctggtagaattgcgctggactttctacttttccctgaatgacctcagagaccttgttaacgtttgtggccctctgagctcccctcttgaatccttccaagagagcttccctgtctcggtttagcctttgcatctcctctctttcatgtgggtccaactgggggtgggttcctggtaactgggtgcttccatactcttgggggttttgataatcagctggtgcatgttcctctagccacttagttgctgcgtgaagccctctccgccttttgcctttcatctctcttaaagaggaacatgagcaaccggtggcgatcggcccaggtggggttgtgggtctggataaccgtttggaggaaatcaattagggcttgtggcttttcgctctaggacggggtattgttttcccagttgagaaggtcggcagaggtgaagggctggtacacaaaaacacgcctctccaccacgtgaccatcctcctctctcccagtatgccgctgctctctcaggggcatttggatccccgttttgggtcgtaaaagagctgccgagggaggggtggaatggcgcaatgttacttaccgcaattaataatcttaattattaattgatactgataattatcaatattaataactgatcatataattctgaaaatcaataccgataatgataattcgtattaaagagttatactcacgataacaataaatgaatattaatgattaatgatgcatggtcttaaagagtgatattgatcttattcattagaaaactgtcatattagctcctaataattaacattaatattaataatctgaacactatttttaacaatgatttcttaatattaatattaatattggtaatacatattcatgttaataaaagaggaagaattaatatgaatattatccctaatacctcagtgggtgtacacccacctgtgatgttgttcctaatgtccagggagggagagagcatgatatgacgttcaatatcgcagtaggtgtacacccacccggtgatattgatccgaatatcatctccagggggtggcgtatgacgttactcccaagatagcagtgggtgtgcatccacccggtgatattcctcctaatattcccggaagaagagaatgctattactcccagtatctcaggaagtgtacaccccttctgtgacattgttcctaatatccggagggggagagggtgatattactcgcaatatcgcaggctgtgtgcacccaccctctgatattgttcctagcagccaggaagtgagaggacgatatgactccccatacagcaggaggtgtacacccatcctgggatattattcctaatatccacggaaaggagaggctgatatgactcccaatatcgcagggggtgtacatccagtctgtgatattgttcttaatattcaaaggtggagaggttgatattactcccaatatcacagaaagtgtacaagcccgtgtactattgttgctattatacagaagaagagaagatgatatcaccccctcatcgcaggaggtgtacacccactctgtgatattttttccaatgtgcagggcaggggaggataatactcttcttcatagcacagggtgtgtacagccccaccgtgatatgatccttaatattccaaggcggagaggatgatcttactcccaataccgcagaaagtgtacacaaccccagtgatatggttcccatgatccaggagagaagaggatgatgttactttcaatatcgcacggggtggacacgctccggtgatattgttcctaatttcaacgtgggagaggatgatactacacggaatgcccctagggataaaaacactcctgtgatattgttcttaatatcaaggggaaagaggatgctattactccaaagagcgcagaggatgtgcacccgtctgtgatatagttggtaatttccagaggtggagaagatattactgacaataacgtgaacacgctgtgtgaccaccgtggatcgtcatatccagggggggagagggggtgctgatatgactccccgcatcgcggggggcgcccgcccccctgcgacgtgaatcatcatatctagaggggggtgatatgactgcccgcatcgcgggggcctcatccccttgcgatgggggtcctaagagccagggggtgataggggctggctcttactccccgtaccccagggtggggccttacccccctgcaaaggggctcctaagagccagggggagagaggggctggctcttactccccgtatcgcaggaggtgggtacaacccctgcgatattgggagtaatgtcatcctctccgcatgaatataagaaacagtatcacaggaggatgtacaccccctgcgatattggaagtaacaacattttctccccctccggatattcggaacaatatcacagtgggtgtgtacagcccctgcgacattgccgctagtatcttcctctccctcccaggatagaaggaacaatgtcacaagggggtgtacactccctgcgatattggctgtaatatcttcctctcccccgctgccctttaggagcaatgttacacaaggggtgtacacccccggctatattgggagtgatatcatcctctccgtccctttatattaggaacaatatccctagggagtgtacacattctgcaatattcagactaatagcatcctctcgccgcctggatattaggatcaatatcacaaggatggtgtgcacccccggtgaaattggaagaaatatcatcatctccacctttggatgttagggacagtatctcggtggaggtctccaccccctgcgatattgggagtcatatccgctcccacccaggatattaggaacaagatgaccgaagggatgtacacccactgcgctattttcaataatgtcatcctctaccccccggctattaggagtaacatcatagaggggtgtacactttctgcgatatagggagtcatatcctctcccccacggatatcgggaacagttctattaattattaatattaataaatataataacaattaatagtaatcatcaatattaataattacagtagagacagtaaaacagtacagatgaaaaatattaacggttactattaataattaatagcaatatcactattaataataaaataatgatatcactaattaatgttacttcaatcaatcataagtgatgttggtaataaaacaataattaatattaagattaataactaatattaaaagtgacattaatcttaataattaattttaatcatgcataatcatatcttgaaaataatcattaatgattaataacgttatactgttaattaatattaccattgataattattaataagactgatgtttaataattcagaatattattactgctaataccacagggggtgtacacctacctgtgatattgttcctaatatccagggatggagagcatgatattagttttcatatcgcagtaggtgtacactcaccctgtgacaccgatcctaatacccagagggtagagtatgacatgactgccaacacagtaatcaatgtacagccacccggtgatatcgctcctaatattcacggaagaagcgtatgatattactcccaatatcgcagggagtgtacacctcttctgtgatgttcttcctagtatcccgagggggagagggtgataataattccagcatcgcaggctgtgttcacccagcctgtgaaattgttattaatatcctgaaagggagaggatgatattactccccataatagatagatatgactccccataatagagcaggaggtgtacacccaccctgtgatattcttcctaatattcggagaccgagaggttgatattactcccaatatcgcaggaagtatacacccccatgtgagatggtccttcataatattctaaggcggagggggtgatatgactacatatatggcagaaagtggacaccccccagggatattgttcccatgatcctggagggaagaggatgatattactttcaatatcacagaaggtggacacgcccccactgatattgtttctaattgcaacgtgggagaggaggatatgacacgcgatatccgagggagtggaaacacccctgtgatactcttcttaatattcagggaggaagaggatgatattactcccaatacagatgggtgtacaccctctgcacaccgagggtgtacacccgtctctgaaacagttcataatctccagagggggagatgatattgctcacaatatggtaaacaggctgtgagtccaccgcggatcctaaaaaccaggaggggggaagaggggctggcccttactccccgcatcgcggtgggcacctcacccccctgcgatgggggtcctaagagccgagggggagaggggctgttccctacattggggcactgaggtccctgttttcttgcaagctgccatcggggaccactctcggcttccaggggcctccttgtaggtggcaccatggccacttgccctactccaagcctgcagaagagcacctctctgccatgtccctttcttttaaaagacttgcctgactggttcaggtccattaggtagcgtcccacttgattagctcaaaagtactgtagcccatcacattcactcacaggagggcattagcggggtgtggacaccagggagtgagaatctctcaggccagtttagcattcagttggttagcgaggttcagtggctcacgcctgtactcccagcactttgggaggctgaggcgggcagatcacctgaggccaggagttcgagaccagcctggccaatatggtgaaacccagtctctactaaaaatacaaaaattagccaggcttggtggtgggcgcctgtaatctcagctacttggaagcctgaggcaggagaatcgcttgaacccgggaggtggaggttgcagtgagccgagatcgtgccattgcactccagcctgggcgatacagcgagtctcaaaaataaataaatgcgaaggctgccgagcgcagtggctcatgcttataatcctggcactttgggaggccgaggcaggaagactgcttaaggccaggagtttcagcctagcatggacaacacagtgcaactctatctctaagtaaaataaaataaaataaaataaaataaaataaaataaaataaaataaaataaaataagtaaaataagaattcagttggttaaaagaaactcactaggtccagcccacaatcaagggatggaaattacacaaagttgtgaagagtcaagggtgggagatcgctggcagcccttatagaagctgcctatctcacatacctgttggacagcttctctctcctagctgggggtatttggagcgggtgtcgaatcctgctcttttgtatgtctgttgccttttctcgcggtgatgtgtttcctttgcgttctgtaattttggatcatgagctgagcttcagaggggctttatgtggggaatcctgggtggccaggtttgagggagccacctagagaggttttctatttggcttttccaggggccccagggtaccagtaagcgaaggcacctgttttttttttgagacagagtttcactcttgttgcccaggctggagtgcagtggcgcaatctcaactcactgcaacttctgcctcccaggttcaagctattctcctgcctcagcctcccgagtagctgggattacaagcacacgaggcgtggctaattttttgtatttttagtggagatggggtttcaccatgttggccaggctggtctcgaactcctgacatcaggtgattcacctgcctcagcctcccgaagtgctgggattacaggcgtgagccaccacgcctggcccaaagcaactttttagtgttaatttctcaactctggcattcctagaccacacaggtagcatgacttcattgtaggagttccacatttatataagagaggcctgaaaacgcaacgatctcatgggaaacttgttcaccacctaaagctcaaattttctcacctctctctgttcccctgggtggaaatgtttctgtccctttctctaaaggtgttgcatttctgtggccccaacttcatcatgcttgactgtaaccctgaccccctgccttgtaagggcttccaacactcaacccagccctgccctcaggcagttgcagcaccagctcctctgtccccaccttggttctcactcccctcttcacttctggccttaggggacttaacttgttttctgaagaactcagctagatatttattttattttattttattttatttatatattttttgagatgcagtttcactcttttgcccaggctggagtgtaatggcgtgatcttggctcactgcaacttctgccttccgggttcaagcgattctcctgcttcagcctcctaagtagctgagattacaagcacctgccaccactcctggctgagttttgtatttttagtagagatggggtttcaccattggccaggctggtctcgaactcctggcctcaggtgatccgcccacctcagcctcccaatgttgtggaattacaggcgtgagccaccatgcccggcctcagctctatagttaaaaggacatttgtttcttacccagcattcctaggtgttttgaagagggagacttctcaggttatctaacctgctactgagaacttaaagatagggaaaatcttggactggagattcttggaatcacataattgaaaaatcccagccgggcgtgatggctcacgtctgtaatcccagcactttgggatgccgaggcaggtggatcacctgaggtcaggagtttgagaccagcttggccaacatggtgaaacttcgtctctactaaaaatacaaaaaaattagcctggcttggtggtgggcgcctgtaatccccgctactcgggaggctgaggtaggagaatcacttgaacccaggagacggaagctgcagtgagctgagatcacgccattgcactccagcttgggcaacaagagtgaaactccgttgcaaaaaaaaaaaataaataaagaaaagaaaaagaaaaatccccacagtgcagatcgacaaaatcacagagttgctttgggagcgagggtggcaatcagacacggaggccatgacacagcctactcgtccactcaggggtccagaacctccacccagtcaccttatccgggggtgatggagacaggggaggtgccacctacgccagtgtcatctcttacaatgagctcttctcctgctcgaaacgagccagcctgctgagcttgctgccagggcccgtcgcactgcctgcactgtgtttcccgtcgcacagcctgtgatgtgtgtttcccgtcacacggcctgtgatatgtgtttcctatcatgtgtgcacgtgcattgtcatgtagtgtctgtcacaggtgttacccgtcacgtgtgtttgcatgttgcatgtgcgtggcctatcaggtgtacatatgtgttgtttggcacatgtcagcatctgggcattctccgtgtgccaggagcagccaggtggcctgtgaaaccttctcatgggaaatgcccagatagaaagagcacagccaggagccaagaccctgagtggccactccatgtgcctggatcaccttcaagtctgctcaacatcagagcctctgttccttggcaccatggacattggaattgactcggaactgggaagagctgtaggcccactatccaggtacccgctccccgtttgcccagcatcccaggggcccacaaccttccaaatatcaccttgccctccattcagaggtgaatcatccgagcgtcaggttgcccaactccgactggtttgctggaggctgcctgtaggatgtcgccagccacctccagagaacactcagtccacagatgccgagggggaactggaagcacacagtgctggccttcacccagtttacggtggcacctcgggaccgcttctgagtctgcttgtcgctgaaggtcggcatgaggaaggcagcgttccctcccagatttagaaaatgtcaagtctcccgccgcacccttttgtgtttcttacagggtctggggcgcttgcagctgccacactaagggctccaacatgttccgtcacacactcaacagagaaggaacctatggctcagatgggagactccctatccaaggccacagagtctggccccagggaccactagaggcttcaagaaccaaactcacatgagggcagagaggagagatggggccagtttagggctgggagaatccatagagcgatgctgaagcgggcatggagcctggaggtacggacgagggtctcaccaaagtcaggggtagagaggctgtggggagtgaggaatggtgtgggccggccccgggcctgctggggtgcagctgggggctccatggccctcccacggccccgacttgtcctcacccaaccgttcagagctcttcatggcgggggtgtccctctcctctggccacaagaggagcgggtggaggaacggcaccttcaggccttgtagggggtctgcccctccaccagcctgtttctcttgggcatcgcagctgaggctgtagccaggaaagggtagtaaccgagcgtacctggcctccaaccactacttccaaggcccctactgggcacagggtgaccccaccgtggctcggaagtggaccctgtccgacgcgggggtggtcgctggagggccgaggatgcctacacaggcccctggagggtgtgccttcggagtctgtctcgccctctggacccatgggggaccagcaacgccgtcacaccctcctctgtctctgccagccgctcccccgctcccttctcctggctgaggctggcaaaggcaggcaggcatgggggggcggggcctcaggagggaggaggggctggtgggcggggcctacggacacctcgccccgcccccagtggggctccgcactccccacaccccgcggtccccctaggtcagggcctctcaccaccgcgcccagaggccgggccagccgggcgtgcatcccaggggcgctccgtcccccgcggcctgggactctccagtcaggacagtacaaaatctctttatcgctcattttctgtaaaaaatcgtggctctcggcggaccctggagataggaggtgcaaagggcgctcacacgcggcccgggtccgcggccgagagctggggggatctggagcggggccgggtcgcaagaagaccctgaccctgctccggcgctggggcgcgtgctaagggcccgcggggtatcagctgtattttcgaacccctgtgcttggccggggagttcccaaggctccactccgccttggagggggctgcggaagcccggaggtgacccgggctctgggaggggcgtccccaacgtgggggaagggagacaggggccttcgaagacagcgcgagactcggagggggtccccccgacctaagacgtggtaaactgaggccggcgaggagcgaggctgagtccggggaccaggcggcccctcactgctcctccggcccgtcgcccccctgcgcctgttcgtacgggcagggccggcggccgagtccagcgggctcggggccaggcctgggccccgggggcggcgcctcctcctccgcgccgtccccatgctcgccctccgcgtcgctctcgtccgagttgtcctcctccaagtagccgtcaccgcgcaccttgtgctggggccgcgggatgcggggctggcgcggggccacgccccgccgcagcttctgctccatccgcaggtaggagaccgcggccaccaccagcgtcaccagcagcaccgccagcttagcctgggcgtaaggagagggatgccagggacccgcggccgcctcgccccgcaccttctccgcctatacccctcgctgagataggcccttccctcctccgggagcctcccgggccacgcggccctcaatttctccagcccctccacccacgtttcctggaccgcctcctgcaggcgaggctcacatccagcactgtcccttacagtcgccatgcccctggcgacctcagtgtcccacgctgtaaggggacaatgcaaatccctttgcctcttagggtgcatgcgccagtgttgataaagtgctggccacaggccctgccttcccagggctcacaacactgtgtccctgacacacccgtgggctgtagtgatgcttttcatggggttttgactataacccgcagtcaggaatgatttcacaccatagctcagtacacacacacatatctgtatgcatacttcctgctcttttcttttttccagacacggttgctccgtttccccaccgcgccccctccctcccttcccccacccactgctggagcgcagtgccatgctcacttcagcctcaatcttccaggctcaagccatcctcccacctcagtctcacaagcagctggaactacaggcacgcgccaccacgcccagctaatttttaaatttcttgtagagacagggtctcctatgttgcccaggctggtcttgaacttctggcctcaagcaatcctcctgcctcagcctcccaaagtgttgggattacaggggtgagccaccatgcccagcccactcactgcttttcttttttctttttttttcttttttctttgggagacagagtctcgctctgtcctccaggctgaagtgcggtggcgcgatcttggctcactgcaatctccatcttccaggttcaagccattcttgtgcctcagcctccagagtagctgggatcacagggatgcgccaccatgcccagctaatttttgtttttagtagagacagggttttacagcctgttacccaggctggtctcgaactccagacctcaggtgatacccccacctcagcgtctcaaaatgctgggattacaggcatgagccactgctcccggcccactccctagtatttttagttctatttttatttttatttttttttttgagacgcagtttcgctcttgttgtttaggctggatggagtgccaaggccccgtctcggctaactgcaacatccgcctcccagttcaagcgattctcctgcctcagcctcccgagtagctgtggttagaggcacctgccatcatgcccggctaatttttgtatttttagtagagacgaggtttcaccatgtcggtcaggctggtctcaaactccctacctcaggcaatccactcgcctcggcctcgcaaagtgctgggattacaggcgtgagccactgcacccggcctttagttctatttttaaaaaatgtttagcaactgggacttcctagaccgagccaccatcttttgggagcagaacatgaggagcctgctccccttcaggccatgaagggagacagacccaacatctggagaacagggtaccaaacaacccacaggatggctgtgatgcacccacaaatcccctcagagatgggcaaactgagactggctggaggtgggccagtaagtggggtgctgagttgggggccacccagtgggctgcaggaatggggccttggcccagagactggctagggaaggggtggcgtttaggaagctgtgaagccagggcaggggctaaggaagtacctgtcattgggcatggggcccccaaccctgcccagtctcaccttcatgtgcaggctggagcccaggtacacggtgaagatggccacagcctgccaccagtggtagatggtgaagatgaagtcctgtctctccttgtcttcgtacaagattcccaggagtgctgcaagcaggcagtacagggcaggcaggggagaggtgtcacctggggcctggggctgccgagctaccatctatgaactttactaagccctgtatgtgtcccagcccgggaccagaaagcgcctagaaagtgctgtgagccggtcctggcctgccccctggtggagaccctggtcaccacactgctcacacgctaagcagaagtaggagcaggttcgccaggctgtgtggatgcaggtggtcccgctccacaccacatgcgtggcctcaaaagaagaaagctctgtgcttagtcatgttctgtccccaaccccaggtgtgcagtgccaagcttgcaggcgctgtttctcctcctcagccgggactagagagatccaactgtttgcagctgccaactctgcaaatcaaacctgaagctaagcatggagaggggggcttcctttccggtgagtcctcccagggtgggcaacaagagtaatggattgggagtcagaagatgcacactcgttctcaggactgtaacgttggttctgtgggtgatttgggtacttaactccccagagctgcttttcccaatggtgagatgagcctatgcctatagtgtgctgtgttctgaagttctaaagtgagaaagtgggcatggcacctgccaaatcataggggccactattaacaccttcaccaggcactcaggacatgaacactcctgtcttggggccctgcagggtgactttacccccacagtgctgctatgaagagacaaggatcccccagggttcacctgtggagatgggatatggagctgggcagaggggatgccatgaccagacagggcacaacatgggtccaagatacccaggttggactcggcccagaattggctatccttgggcaaaacggccaagagactgtggtgcagtatgaggctccagcccctgctacagacagagacaccgagccagcctctgccctgccagcagcaggcatgacctctgccactccacacccccaaggatgacgttcaaaactgttcacagcttccgcccatcagaacagacactgacatggatgccccgcaggactgtgcccgtgtgtgctagttgtgtgtcactgcgtgtgcccatctgtgggcagggagcatcctggagctgaacatgggcccacccactgccttctgcaaacagggccctgttccccaccagcccagacctggggcctggactgtggtactgagcagactgggttggggctgcaggcctgctcctctctatacaaaggcccatgtctgtatctatgccgtggatgtacaacaggccacttgctcctaccacatgctccgtgaggcagagaccaaaacatctgctccaagtgtcacgaaaacaatgtcagggtaagccctgtcccctggtatgaaaagggagaatccctgatgtgtttttcacactgtccgtaaggggtgtccacagagccccacacctgccccgtgtagccacgagatttcacactgaccctccagtgttgatggggccctgtgcccgccctggggtgttaacggaatgtccatggcgtggaaccccaacacctgtctccagagtgtccacgccctacccatctgtcccagtgtgtccatgagacttcccttccagccccggagtgtccacaggaagccccacctgcctctgccatgtccacaggaccctatgtgaccatgggaccccatatctgtccctgcgatgtctatgtctagccaaccacccacagatagccataaagccacctgccctgcccccccccagtgcccacagctatactcactgctgagtccagtcttgttcagggcgctgcccacaccccaaagggcggctgccacacagaggatccagctgtgttgcaggacctgaggcacaggggcccagaaaaagaggatgaaggtgagcagcaggtgcaccccttctccagccacgaggggcaccgggtgtggcagccacaggcccagcagaaccaggagtgaggcggctgaggcgcccaggctgtaagccacgaggaggtaagccagccactccagccccaccgagcacacaccataaccctgcggggggacaaggggtgagtgttgaagtctggaacagcccagaccccagtctcagccctccctgcatcgcggggggtgcctcacccccctgcgatgggggtcctaagagccagggggggaagaggggctggctcttactattcctgatggaatagtttagagggactcattccctgctatcgtgggtgagatgtctatgaaaaggacaaccagtgggggagggtagcaaaattttgaataagatttctgagacccccagcacaaccaggaacagaaactccacactctgctgagcggatagtttgcacattggtctcctcccatctgcccatctcactctcctgtttgtcctgaggaggaggaaacaaaacaaggctcccgaccgtccctcaacactcacttgaaagggtggcccgtccctccacacctgtgggtatttctagtcgggtgggatgagacactgagaaaagaaataagacacagagacaaagtatggagaaacaacagtgggcctagcggaccggcgctcagcataccaaggacctgcactggcacaggcctctgagttccctctgtttttattgattattatttttattattttagcaaaaaggaatgtagtaggagggcagggtgataataaggagaaggtcagcaacgaacatgtgagcaatagaatctatgtcataatgaagttcaagggaaggtactatgactggacgtgtacgtaagccagattgatgtttctctccacccaaacatctcagtgcagtaaagagtaacaaggcagcattgctgcaaatatgtctcacctcccaccatagggcggtttttccccatctcagaattgaacaaatgtacaatcgggttttataccgagacattcagttcccagggtcaggcaggagacagcggccttcctctccctcaactgcaagaggcttccctctttgactaatccacctcagcacagaccctttactggtgttggactcggggatggtcaggtctttctcctcccacgaggccacttttcagactatcacatggggagaaaccttggacaatatgccgctttcaagggcagggctccctgcggctttccacagtgtattgtgcccctggtttattgagactagagaatggcggtgacttttaccaagtatactgcttggaaacatcttgttaacaagacacgtcctgcacagccctagatcctttaaaccttgatttcatacaacacatgtttttgtgagcttcaggttgggtcaaagttgctggggcaaagctacacattaacaacatttcagcaaagcaattgttgaaagtacaggtctttctcaaaatggagtctcttatgtctttcctttctacatagacacagtaagagtctgatctctctttcttttccctacactcactgaactgcccttcccctctgctgggccatgaccacggagaacaggtccactgtcctccctgtgtggtgcaccatggaggctcagactccgtcctcaaggctggcaagaagacagggtgagacgtgagcctcctgatacaggtgacgggagtggagcccacaggactggaacctcacactgcagggctggagtcacagactatttactattctgtggcctcgggggctcaaggcacagagctccttattagccaaagccaccgaagttccccaagctctaaggattcctcatcatcatgcaagaagaagaagagaaaagtgagtgtccatagaagttttggggctcttcctctaatcaggagaaagctggtgtgtattcttcgcttctttcttttctttttagacatccaactgctttaattttcatcttttattatgggaaaatataccaagtataaatattaaaaattataaatatatattagttcatatagaatggccagtataaacatttacagtttccacgctttttcagtttacagtttcatgacattaagtacgttcagattgtttagcaagcatcaccgtcatcgtctccagaacagttttatctttcttttttattttttattatttatttattttttaattatactttaagttttaggatacatgtgcccattgtgcaggttagttacatatgtgtacatgtgccatgctggtgcactgcacccactaactcgtcatctagcattaggtatatctcccagtgctatccctcccccctccccccaccccacaacagtccccagagtgtgatattccgcttcctgtgtccgtattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaacatcattctcagtaaactatcgcaagaacaaaaaaccaaacaccgcatattctcactcataggtgggaactgaacaatgagttttatctttcaaaatggaaattgcacccattcaccaagctctccactcctctctcttgcccgcccctgggggccacctttctagtttgcaactttatgagtttaactactctagacacttgatagataagtggaatcataccgtgtttaatttttttgttttggaaacagcgtctttctctgtcaccccggctggagtgcagtggcgtgatgtcgcctcactgcaaccgccacatcgtgggttcaagcgattcttctgtctcagtctcccgagtagctgggattacaggcatgcgccaccacgcccagctaatttttgtatttttaatagagaccatattggccaggctggtctcgaactcctgacctgaagtgatccgcctggctcagcctcccaaagtgctggggttacaggtgtgagccactgagcctgggcgtgtttatccttttgggatttatttatttcactgacgataatgttttcaaggttcatccatgttgcggccagcgtcagaagttcctctctgtttttttttttttgtttgttcgtttgactttgttttgttttgtgtttccatggagtctcactctgtcgcacaggctggagtgcagtggcacaatctgggctcactgcaacctccgcctcccgggttccagccattcttgtgcctcagcctcccgagtagttgggactataggcacacgccaccacgcttgtctcattttttgcattttcagtagagacagggtttcaccaacatgaccaggctggtcttgaattcctgacctcaggtgatccacccacctcggtcttccaagacgctgcgattacaggcatgagccaccgcaccggccagaagtgcctgcctttttaaggctgaatagtcttccattgtatgaaggaactgcagtgtgctttttcattcatttgtccacgaacccttgggttgcttccacattttggctgttgtgaataatgctgctatggatatgggtgtacacaaatctgtcttccactcctggcttctaattctttctggtaggtacccacaaatgcaactgcgggaacatctgatcattctgtttctaatttttccagtaaaagccatactattttccccattccttcacggttttacattccctccgatcatattcaagcattcctacttccctctagtctcaccaatgcttgtttgtttctcatatccatcctaatgtgtgatatcacattcttggtttgatttctgcttccctatgatgagtgattttgaacatcattttagatgcttattggccattgctgtatcttctttaggaacacgtctactcgagtcttctgatgggacgctttgggtttcttgttgtttagttctagctgttctttatatatgatggatatcagcctcttttcagatatatgctttgcaaatctttttcctaatccatgagttatcttttcactcaggtcacagtgttttttgctgcacaaaagtgtctgtcatttagatgcaattcaaggaatcaaattttcttttgttgcctatgcttttggtgtcatatcccagagaacattgcccagtctgatgtcatgaaagcatggccaatggtttcttttaggcgtatgatgcttttagcgcttggggtgaggtctttgatccagtttgtgttaatttttgcacctggtgtgacatagggtccaccttcattcttctgcatgtggaaatcaagtttctccaacaccatttcttgaaaaggctgcttttccaccaatgagctttcttagcactcatgtgaaaaatcatttgaacatataggtgagaagttatttctgggctccaaaacaaacaaacaacaacagacaacagataaggatacagcatgggccgggcgcggttgctcacgcctgtaatcccagccttctgggaggccgaggcgggcggatcacctgaggtcaggagttgaagaccagcctgaccgacagggagaaacccccgtctctactagaaatacaacattagctgggcatgctggggcatgcctgtaatcccagctactcgggaggtggaggcaggagaatcgcatgaaccaaggaggcagaggttgcggtgagccaagattgcaccatgacactccagcctgggcaacaagagtgaaactccatctcaaaacaaaaaacaaaaaacaaaaaaacagcatgatttcaagagcagaaagagaagagcttaaaaaccagcctaatgagaaagttaggaagcttcttaccaaagcatctggaaatatgcaaacgattcttgtgaactaaaattttcatattgtactatcaaacagtagaactcacttattccatctttctgtattttgggacccaattatccacttgtcttcattccctatcccaccccttttcttcctagcatctgctaaccacctttatactttccactttcctgagattccttttgtgtgtaggtgtgtgatggagtctctttctgttgcccaggttggagtacacaggcacaatccgggctcactgcaagctccgcctcccgagttcaagcgcttcttgggcttcagccctccgagtagctgagactacaggcacacgtcaccacacccaactcattgtttgtgttttcagtagagacggggtttcaccatgctggccaggcgggtctcgaactcctggactcaagtgatctgtgcaactcggcctcccagtgtgctgggattacaggcctgagccaccacacctggccaaggtttccttttttcttcctacatagaagtgaggacatgaaatatttgtcattctgtgcctggcttatttcatttaatatacagacctgcaatctcatccattttgtctgcagtggagaggagtttcttcctttttaggctgaataatacttcactgggtgtgtataccacagtttcttcattgaaacaaatttctgaagagcaaatattttaaagatgtcttggaatgtgaaacttcacggatactgtgcccattttattcttttctatttcccatcttatgtatatgcaagtgtataacaaagcagccatcaatgtgtgtataaatctgtaacttcaacaaatgtaaaatgtaaatgctaagtggtggctgggcgcggtcgctcatgcctgtaatcccagcactttgggaggcggaagcaggcggatcacctgaggtcaggagttcaagaccagcctgaacaaaatggagaaacactgtctctattaacaatacaaaaaaaaaaaaaaaaattagccaggcatggtagcgcatgcctgtaatcccagctacttggaaggctgagacaggagaattgcttgaatacgggaggcagaggttgcagtgagccgagaccgtgtctttgaactccagcctgggcaacaagagtgaaattctgactcaaaaaataaggaaaagaaagaaatagaaaatgcgaaatggtaagaaacaacagcataataaatatttgtatggtgttgctggacaatgcatttgaagataatatttgaagaaatcatattacaattaatttcttttcttactcattggagcttgatgcctctaaaaactttgtcattggaaccacctcttgtgctttaaaagaaaaaaaagaaatccacatactcacacaggtgcaaggaaatcagaatctcaggtattgagacccaggcctcatcatttgtaagctccccaggtgagttgactcaaagccaagactgaggaacggcgacatggatctctacacacaactttcctaaatagattctctagaagcagtttataaagaaattccacatgaactgtggaagaggatatgaatttgatgtacagtatgtcctcacgtaacatctttgaaagtctcttggaaacttcaccttgaagcaaaatgatgtacagtgaaaccacttattcctaatccacaatataactagacaactttgaacacaccagtggtgttggaggacctcctgtacattgtttccataaagtcagttttcagggaattccaaaacgaagtgaggacttcgtgtatataaaaagatggttgtgattccacctggatgacagggttattgctcagaaactaaaagaggccgcctaggtatagaggattctgtcgtgaggtttctgctaaacaaaggatcccagaatcctcacccattccagtgaaaggcataacgaagaaagcaatattcacaaaggaaatgcggaaaggaataaaagccatcaagccacaaaaagaatgtgactaaggggcaggatttgcagatgttgagatttaatgtggttgccctttctaacccacacaagaaaaaggatggaacagatcatgagattcgactgttctgctgagcagcctccgcagggcgctttgaatgtccctgtttctcaggctgtagatgaaagggttcagcatggggtgaccacagcgtacatcgctgacgccaccacaccattcctggggggtggtgccacagctgaagtcaggtacacgccaatgcctgttccatcaaatcagcaaacaactgctaggtgagagccgcaggtggcgaaggctttatacttcccatctgacgatgacatccttagaatggaggggacgattttatagtaagacaaaaggatccctgaaatgggaagaaaaccaaacatagtactatcgaaatatatgaatatgctattgatgacgctgtcagaacaggcaagtttgagaaattgagaggggtcacagacaaaattagagatttccacattcttgatgatggtgaattgtaacacaatccaactgtgcagctgggaatccaacaggctaaggaaaaaggacaccaaaatgaagaagacacagaggtgaagattcacgatgactgggtagtgcagagggcgacagatggctacaaagcagtcataggccatcgcactcagcagcatgccttctatacatgcaaaaaggaccaagaaagacatctgtgtcaggcagcccgcatgagagatgactctgctatgcgactgcatgtccacaatcatcttgggaaccgtggccgaggtgaaaccgatgtcagcccagcacagcttggagacgaagaagtacatgggggtgtggaggggggagtcagagctgaagccaggatgctgagcaggttcctcagcactgtgaccagatacatggacagggacagggacagcaaagcgaggaccggctgcagttctggatcctctgagagtcccaggaggaggaattctcagacacctgtgagattccgtggctctgtgtgtcttggacaccttgagaaggaaaaaggattggaaaagtaaaagataaaatccagcccttaatgctggatgcaagcaattcacaaggaacatcttcacacttgcggaccatacaccgccagcaatgtttctcagttgtgtcaattccaaaaatctcagaattattacgtgatttacttttttgctatacaaggctttctgtacatacgactttagagaaaatccactgaagaatattagaagaccaaaacgtcatatataacaaatccgtgatatccgtaaaatacggcctactcttttcagaaaaaatacaatgcaatgacaatgtccttctctctttaacaaaaacgtctcagtctaattgaaagaaattaagaagccatgaaatacaatcgactttattctgacaccgtgctacaacttccattgatgtagaatatgtaaaagaacgacacaagagctaggaccccattatctgaaaacgacgtcgaaccttatagttctcaatcggaagaccttttcacatgcctgttacttttcatattatcatccttcggttttctgacatcatttcttcataaaagtacatgcacactcaaagataggagctgtgtttccaaatgaattgaatctataactcttggcccagcaccatggctcacacctgtaatcccagcattttgggcggccgaggctgatggatcacctgaggtcaggatttccagaccagcctggccaacgtggtgagaccccgtctccagtgaaaataaaaaaaaatcagccgggcgtggtggcaggtaaccctaaatactcgggaggctgaagcaggagaatcccttagaacctggaaggcagacattggacaccctgtgataggatttttgatatcctagggagatattgctcctgacagcagagtgggcgtataccctgtgatattatttgtaatatcctagaaagatattgctcctaatatcacggtggctcaacaccctgtgatcttaattgtaatatcctacagagatattactcctaataatacagtggatgtacacccggtgatattattcataatatattacacagatatgactcctgatatcacagtgagtatacaccatatttgtacaccctgtgatcttatttgtaacaacttagaaaaatattacagctaatatcaaagtaggtgtacaccctgcgatgttatttgttatctactaggtagatattactcctaatatcacagtgagtgtacatcatgtgtgtacagactgtgaaattattcgtagtaccctaggaagatattactcctcatatcacagtgggtgtacactgtgatatttttttgtaatatccagcgggggagaggatgatattgcttccaatatcacagaaggtgtacacccccctgtgatattgttcctaatatccagggaaggagaggatgacattattcgcaatatcactgggggtgtaccacctcccgccgggatattgttcttaatatccggagttggagagaatgatattactcccaatatcacagggggtgtacaccacccctgtttgtaaacaccccctgtgatattgttccaaatggcctgtgaaagagcaaacatgactcccattatcgcggggggtgttcagcccttatgatattgttttctaacatccagggaaggagagtatgctattactcccaacatcgcaggggttgtacacccttttgtgtttttgtgcccaatatccaggaaaatagaggatgatattacgtccaatatcgaagtaattgtacagcacccctgtgatattcttcctaatatccaaaaaggaaaagaatgatattactcccaacagcgtaggaaacgtgtccccgcgctgtggtatctttcccagtatccaggtggggagaggatcatattacttccaatgtcgcagggtgtgtacaccccctctgtgatctcgttgctagcatccaggtttggggaggacgacattactcccaatatcgcagggggagtacacccccctgtgaccttgttagtcatttcctgggtggagaggatgatcttactcccaatatcgcaggaggtgtacacagccctgtgaaaatcttcctattttcagagggagagaggatggtattactcccagtaccgccgggggtttccacagccctgtgatcctcttcctaatatccacagggagagaggatgatattactcccaatatcgcaggggttgtacacccttttgtgtttttgtgtgcaatgtccaggaaaatagaggatgatattactcccaatgtcaaagtaattgtacagcacccctgtgatattcttcctaatatcccaaaaggaaaagaatgatattactcccaaaagggtagcaaatgtatacccgcgctgtggtatctttgccagtatccaggtggggagaggattatacgactcccaatatcacagggggggtacacaaccgtgtgatattgttcctaatatccagagcgaaagaggatgatacgactctcaatatcgcagagggtaaacacccctcctgtaatattgttctgaatacccagggagggagagaataaggttatgttgaatatcgcagggaatgtacaccatccgcctctgatacccttcctaatgtccaggggaaaagaggaaaatttcactcccaatatcacagaggcagtacaccccactggtgatgttgtttccaatatgcaacgggggagaggatgatactactctcaatatcgcagggctgttcacatccccagtgacattttttcctaatatctaagggagagacaattctatgacagcaagggtcacagggtctgtgcatcccttcctgatattgctcctaatacccagggggaaagaggatgatatcaaatatgaaagggggtgtacatcccccacccctacgatattgttcttaataatcgtgaggggagacgatgatattactccaaatatcgcaggggttgttcacaaccccctgtgatattgtttctgatatccaggggtggagaaactcatattacttccaatattgcaggtggtgtatgccccacctgatatatggcacagaatatccaaagagggagaggatggtattcataccaatatcgaagtgtgtgtacatgcctcttgtgatatggtttttaatatccagtgggcgggaggatgatattagtcccaacatcccagagggtgtacactacccttgtgatattgtccctaacttccagagggaagaggatgatgtcactcccaaaatctcagaagtggtacatcccctgtgatattgttcgtcatatccagggaggcgcaggatgacattccattgaatttcgcgacaggcgtacacgcacagtgtgatattgttcctaatatccaggaagggagaggatgatattactcccaataaagcagtgggcatacatcaccgctttgttattgtctctaatatccggggccgggggagggggggagaggataacattccctcaaatttagcaggtggtttgacgccccttgcggtgttgttttaaatatacagcggggaagacaatagtactatttttgatagtccaattcatccgctccacctttccggaatgctgaggccgggaggcggcatgcagttttcgtgtgatccccaatacctttgctgtcttctgtacgaaggcagccaaatacgcaggccccttgtctgagccaatccgtaagggcggccgaaatctaggaatcagatctcgaagaagcacaggggttacttcacgagctttctcagttagtgttggataagcctacacccacccagagtaggtgcgcccaagaactagtgaatacttgttacctccacactttggcatctctgtgaagtccagctggagaccttcaaagggggctgctccataagctcgtatgccgggcggaacggctggacgttgcctcgcgtcatgctgttggcaggtaacacaccactgcctcaccgttttggcaagggctgacaaaggcgagatggagaaataccagcctaacaacttttccagtgactcctgacctcgatggctggtttcttgcacagccagtacaactgcagctcctcgcagctgtggcacagctactctcccatctggtaaccgaattcatccttcctccatcacttgtccttccctctacctggacaaagtccttttcttctttagaataagtaggtccaagatcaggtgcttgagggagtactgatgcctggaagggggcagatgctgctttttgagcctctgagtcagcgcaggaattccccaaacccagcaaggtggaagctcgctggtgtcctctgcaatgcataactgccaccttgtggggtttccacactgcttctaatcattgcaagatttcttgttgatattttctgtcttttcccccagagttcaataggcccttttctttctatcacgctccatgcacttgaagggttcaaaaggcatacggagaatcagtgtaaatgttgacagtctcaccctcactgagttctaaggcccgaattaaagcaatgagttcagctttctgggctgaagtggcctggggcaaagatctggcttcaacaacagtgtccagggttatcactgcataccctgcacctctctctccttgggggttgaagaagctgctcccatccacgtatagttcccagtctactgatgcccaaggctggtcccagaggtcaggtctgctagaggcaactgagtccaacatttctacataatcaggctcgacagggctctgataccgggagcaacgtggcggggtgtagggtgttacaaacttcaatggttatatggggattttcacagagcaaagtctggtacttggtgagtgtggcattcgttagccaatgatgtcctttagtattcattaaagtcaccacagcacgggaggcctttctgttcaggttttgcccaagagtcagcttatttgcttcttgtactcgcagggcagttgctgccaaggccctccaacaggggggccatcctttagaatccccgtctagttgttgagagaggtaggcccccagccttggcctgggccccacagtttgggttcaaagtccagctgccatcttttctctctctgatgcatacaatggaaaaggctttgtcagatcgggtagccccagggctggggctgacataagtttttcctttaactcatgaaagccttgctgttgttgggatcctcattccaaaggttcccggtccccacccccttggtgacctcatacaaaggcttggctaatactgcaaagtttgggatccaccgtctacaaaaccccacagctcctaagaatcctctcacctgccttctgctcttaggttcccctagcttgcaaataacctgctttcattctgatcccaggctgcgttccgacccctgtaagatagtcaatcccaaggaacgtacctgctgtcggcagatctgagctttcttcttggacaccttctacccacagtcctccaggtgccggtgtagggcatcagttcccttggcacacccgactgccgtggggtgtcccagcagaagatcatcaacctactggagcaacacgcagcctaggtctctgctgggaaacttctggaggtctcgagcccacgcctccccgaagatggtgggggagttcttgaacccttggggaagcccggtccaagtgtactgagtagtgacacctgactccggatcttcccactgaaaggcaaacagcttctggctctcaggggctaatctgataggaaagaaagcgtctttcaggtccaagaaagtgaaccagctgtcctcagctggcagcaaccccaacaatgtggacgggttaggtactgttggatggaaagtcagtgtagcttgatgaagcaagcacaaatcctgtacctgccggtagtccttggtcggtggcttgggaacaggcaggaagggagtgttccatggagactgacaaggaacaataattccaaaagttcttaggtgcttgagacggacctggataccttgaagggcttctctggggactgggtcctgtttttgcctcaccggctgggccccagtcttaactggccaatcccggagggttgtcttctgcccgtgctcttggccaccttttagccagagctggtcttctctcttggcccggctcagttaagaaaagtctccattcctcctctggggggaccataagggtcataatgactccctttagcagcaaagagctgtgctctgtcaaagagatagtggctctcagcttgctgagcaagttccttcccaaaaaggtcaagggacagtcaggcatgtaccaaaactgatgaatgactctatgtcctcctacagtacaagcccgagacaagcagaaagcttgctttgctgaaaccctagtgggtccgatgacgtcaatagtctttttggataagggggcgaccggggcggttactagcaaatgttcagcaccgctatctataaaaaagtcaatgtatccacccccaactgtcattttgaccagaggctctttggggccgcttaagcccggtctccctcagtccaagaacccttctgccaggttgagcagggccccttcctccttgtccggggcctcctgctctgagtcaccttgttttcttttgagctcagggcatttgttcttccactgtcctatttctttacaataagcacactggttacgctgcaaactctgacagccaagctgagtttctttcccagggccccccttcccttgcctctttgagggggcccctctgattgctgcagctgacaaacaggtcggcgtgtcaccgggcctgacctccattctctttgccgttttccttagggcttactgcattcctgtttacaaacacctggctagctatttctagtaattgtggtggattcatccctgcaagcccagcctgcttctgcagttttcttctcatgtcttctgcgctttgacggactaaagccatgtgaatcacgcagtgattttcagggctatcgggatcaaagggagtatacatacgataggcctcacacagtctctcgtagaattgtgccggactttcttcttttccctgaatgacctcagagacgttgttaacgtttgtggccttctgagctcccctcaataatccttccaagaaagcttccctgtctcggtttagcctttgcatatcctctctttcacgtgggtccaactgggggtcggttcctggcaactgggtgcttccatactcttggtggttttgataatcagctggtgcatgttcctctagccacttagttgctgcttggaggactctccgcctttcttcgctgttaaagaggaacatgagcaactggtgccaatcagcccaggtgtggttgtgggtctggataacagcttggagcaaatcaattagggcttgcggcttttcggtataggtctgtgtattgtttttccagttgagaaggtcgacacaggtgaagggctggtacccaaaagcacgcctctccaccacgtgaccatcctcatctgtcccagtataccgctgctctctcaggggcatgtgtgtccccgttttgcgtcgcaaacgagctgccgagggaggggtggaatggcgcaatgcgacttaccacaattaataatctcaattattaattgacactaattttcaatattaataaccgataatataattttaaaaatcaataccgataataatgataattaatattaaatagatatactaatgataacaataaatgattaatattaatgattaatgatgcctgatattaataattgatattgaccttattaatgagaaaacagtcatattagcccctaataattaatattaatattaaaaatgggaagtttttattagcaattatttcttaatatgaatattaatatcggtcattcatattcatgttaataataaaagaggaataattcatactaatattacgccctaatacctcagtgggtgtacacccacatgtgatattgctcctaatgtccagggagggagagagcatgatattacgttgaatatcgcagtaggtgtacaaccagccggtgatattgatccgaatataatctccagggggtggagaatgacgttactcccaatatagcactgggtgtacatccacccggtgattttgctcctaatattcacggaagaagagaatgctattactcccaacatcgcaggaagtgtacacaccagtgtgagacggtccttaaaaatattccaaggcggaggaggtgatatgactacatatatggcagaaagtggacacccgcaaggatatcattcccatgatcctggaaagaagaggataatattactttcaataccacagaaggtggacacgcccccagtgatattgtttctaattgcaacctgggagaggaggacatgacacccgatatcccagggagaagaaacacccatgtgatactgttcctaatattaagggaggaagaggatgatatgactcaaaacacagaccggtgtacaacctctgcacacaaagggtgtacaccagtctgtgaaaaggctcagaatctccagagggggagatgatattacgcacaatatgataaaaagactgtgagtccaccgcggatcctaagagccaggggggcaagaggggctggctctttctttactccccgcatcgcggggggcgcctcgcccccctgcgatgggggtcctaagagccaggggggcaagaggcggttgctattactccccgcatcgcggggggcgccctcacccccctgcgatgtggctcgtaatattcagtggggagagcggttgatattactccctttctcctattatgttttctctactgccacgcttagttaacatcctgggacattattttccatcttctaggatggtgtcactgtttaagtcccaggggttatacaccctgtgatattattcgtggtattgtcgcgaaacatgaatccgtatttcacaagtctctacacactctgatatgattcgcaacaccctaacgatacgttaataataatgccacaatgtgtgttcagcgtgtgctattattcttaatctcctaaggggaggttgattttattgtcacacggagtattttccctgtggtatgattcggaatatcctggaagcatgtcactctttatgtcacagggtttgtgcaccttttcaaattactcgtattacccttataagatgtcactcctcatatcaacgagggtgtacactctgtgatattatcgtcatattctagggaaatgttacttttaatgtcacagatgttgcacaccttgtgaaattattcgttatagttttgtttgatatgactgctaacgtcacacggggtgtacatccagtgatattacgtgtaatcttctatagaaatgttactcgtaaatcacaggtcctgtacaccctttaatattcttcgtcttattctaggaaaacgtgactactaatgtcccagggcgtgtagaccctgtcataaaattcgtaatatcccagcgggagttcactactaatttcacaatgcgtgtacaccctttgatattgttcgtattatcctaaagagatgtgactactgatgtcccaatgcatgtacattctgtgatattattccttatatcctcgagggatgtgacttctaatgtcacacggcgtgtagtccctgtgttctatttcataatatcctagggcaattgtactgttaatgacacagggggtgtacacattgtgatattattcatgatattgtagaaggatgttactcctaacgtcacagggtgtacaccctgtgatagtattcaaaatttcccaggggtctatactcctaatgtcacagaagataacacactgtgacattatttgtaatattctggtgagatgattctcctaatatcacaggaagtgtataccctgtgatagtattcttactattccagggggatgtcacttgtaatgtcacaggtgtcttccttcctgatattattgaaaatatgctagctggatattactactaatgtcagaatgcgtgtaccccttgtgatattattagtaatattctggggggatgttacccctaacgttacaggggtgtacaccgtgtgatattgctcccaatattgtagggggatgttactcctaatgtcacagggggtgtacagcctttgatattatttgcaatcttatagagacatattactttaatgatcacagtgggtgtacacacatgggctacacccactgggatattatttgtaatatcttagggagatataactcctaatatcacagtgggtgtagcccatgtgtgtacatcctgtgatattatttgtaatatccatggtaaacattacttctagtatcccacagagggtacaccctgtgatatttttcatatcattgggagatatttcttctaataacacagtgggtgtacaccatgtgtgtacactctgtgatgtgatagcttatatcctagggagatattccttccaatatcagagtgagtgtacaccttgtgatatcattcgtaatctcctagaaagatgttgctgctaatatcacagagggtgtgcccccagtgacatcattcgaaatatcctaaggagatgttactcgtaatgtcacgggggttgtacaccctgttatattattgtaatattctagggtggtgttacttttaaagtcaaaggggtgtacaccctgtgatgttattcgtaatatcctaggaagaggttactcctaatatcacagcctgtgatagcattcagaatatccaaaagggatgttacttttaatgtcacatggggtatacaccctttgataatattcgtaagatcctacggacatatgacttcaaatatcacattggatgtacacacatggtgtacacattgtgtgtgaacacctcctgtgatattattcataatatcctaggaaaatgggactcctaatatcacggtcagtggacaccctgtgatatgattggtaatatcctaaagagatgttaccactaaggtcacaatgtctgtacgctccctgatattattcgttatatcctcgggggatgttactcctaatgtcacacggggtgtactccctgtgatgttattcgtaatatcctagggtgatgttactttcaatgtcaccgggggcatatatcatgtgtattcaacacctgtgatactattcctaataccctaggggcatgttcctcctaatgttcacatggggtgaacaccatatgtgtacacctgctgtgatattattcgtaatatcctaggggaatgttactgctgatggcacaggagatgtacaccatgtgtgtcaaccgcctgtgtcattattcgtaatatcctagggggatgtttccttgaatggcacaaagtgtgagcaaaaggtcacagaaggtgtacaccttgtgatgttatctgtaataccctagaaggatgttactcctaatatgtcacaggggtgtacacactttgatattatttgtaatctcatagagatatatgtcttcaaatatcacagtggatgttcacacatagtgtataccctctgatattattcgtaatatcccagggatatgcaactcctgatatcacagtgcgtgtacccggtgtgtgtacacccttgatatgagtcgtgatatccagggtaaatatgcctcctcatatcacacagtgtgcacaccctgtgatatttttaatcatactttagggagatattgcttctaatgtcacagtgggtgtaccccatgtgtgtgtactctgtgacagtatattctatatcctagggaggtattactcgtaatgtcacagtgggtgttcaccctgtgatatcattcttatttgaccttgctgccttttttaacccacactacaaaaggaatggaacagataagaagatattgagattagactgtgctgccgtgcggccgccgcaggacacttttcatatccctgtttctcaggctgtacatgaaggggttcagcatgggggtgaccaccgtgtacatcactgaggccactgcactctttctcggggaagatgacacatctgaaccgaggtaccctccaacgcctgttccataaaatcagcaaacaactgacaggtgagacccacaggtggagaaggtttatacttcccacctgatgatgaaaccctcagaatggaggaaagaattttacagtaagagaaaaggtccctgagatgggaagaaaaccaaatatggcagcagggaaatacatgttgatgttcctggtgaaggtgtcacaacatgcaagatgggggagttgagaaggttcccagaagaaattaggaatttccacatccttggagcaggtcatttgtaaggcaatcaagttgtgcaggtgggagtctagaagactgagaaaaacaaacaaacaaacaaacaaaaacaaagacaacaaatctaggaagccacagaatcacgggttcaagatggctgaacgatatagagggtgacagatggctacaaaccggtcatatgccatcacactcaggagcatgcctctcttccatgcttccaaaaatggcaaagagagacatctgagtcaggcagcccgcataggagaggactctgctgtgagactggatgtccacaatcatcttggggaccgtggtggaggtgaaaccgatgtcaggcaagggcaggttggagaggaagaagtacatggggatgtggaggtgggagtcagggctgatggccaggatgatgagcaggttccccagcactgtgaccaggcacatggacaggaacagcccagcaacgaccggctgcagttctggatcctctgagagtttgaggaggaggaatatagagacatctgttagactctgtgggtctgtatagtttggacaccttttgcctggaaaagatggttgaaaaatcagaaacaagtaaaccaatacccagccttgtgtctgcattttggatataagcaattcacaagtaatgttttcagatttcagagcaatccacactcagcaatattttgtagttctgacaagctcaattgccttataatgctttcaacatcgattgctgtgttattcacgtcttgctgtacacacctgccttagagacactagcttcaagaacgttccaagaaccagatcatcatatataacaaattcgtaattgctagaaaatacagcctatcttttccgaagaacaagatgtaataaaaccattgtcttcactttaagaaaaaggttatcctaattaaaggaaattaagaactcaaatactttatttattctactagattgttacaaattcccttgatttagaacatttgtaaacactgtataacagctgagaccatgccatctggaaatggaatgaaagttgatagttcataagcagaaaatagttccacatgccagttgggtcctagtgatttcatcattctgttttcggacttttctccttcaagagagtaattgcttactcaaatcagtgggtcttgttttaaaattcatggaagctctaactcctgtccttagcttaggtggacttagagttttcatcagaaagtttggctggatgcggtggctcacgcctgtaatcccagcactttgggaggccgaggagggcggatcacggggtcaggagatcaagaccatcctggccaacatggtgaaaacccacctctactaaaaatacaaaaacttcgcccggtatggcggagcgcgcctgtagtcccagctactcggggggctgaggcaggagaatggcttgaacctgggaggcagagactacagtgacccgaaatcacaccactgcacgccagcctgggccaacaagagcaaaactccgtctcaaaaaacaaaaaacaagaatcaagtaagtcaaagtcaccctgatgacagccaattttgatgaagcaaggaagggtcaattcaaccattaacatagattttgacttttgctgtctcctatgtgccaagaaagatataggatctggggaatcagaaacaaaagagactctcttgttcctctcacagtactcagtacttactgagagaaggacaaaacaaaacgtcctgtgtggaatgcagggaaagcagaacttcaggtcaggggatatttccgttgaattgtgtggagttgaagctgaaaatcttaaggaatgtatctaaaattcactttgcctttactttatgtatccgtcacctagagatcacgcagcaggcgcccacgatcagcttaatcgtcactcacttccatcggatcaactggaaatcaagtcagatgagagtgctgagtctcagaggatggacatctcaccccttgccatacagagaagtagaaagggtggtattccaaattcatggccagactcgaagtcccgggtactatacttcttggtcttccaactctcaaaaagttgtggggtttttttggtttttgtttttgtttttgttgttttgagacggagtctcgttcccttgcccaggctggagtgcaatggaatgatctcggctcaccgcaacctctgcatcccaggttcaagctattgtcctgcctcagcctgccaattagctgagatgacaggcgcccgccactacgcctggctcatttttttctattttgagtagagacgtggttttaccatgttggccaggctggtctcgaattcctgaccttgtgattcacctgcctcagcctcccaatgggctgggattacaggcgtgagccaccgctcccagcttccaaaagttttaagcagagctcagaggtcttaaccacaggcacatcggaggagcatttttgaaacactttccagcttcctcattaggaatggaagccaaactccgaattgatgactccttggaggaagtcgagagctgtaaggaaagccaggaacaggggcaagggagagatgtgtcccaaatgatcctgtgccaattctttctggaatcctcgatgtgatctcagctgctgtttccatacttgacacagtgattgtggcactcactggtctagctgtggtctacaaggaacccccaaagggaagggcacagtgagcaggggcatccgcctgagtgacgagaatttgagaggacaggttggttgcagggagaggactggccaaatgccatatgtctggacttagactgcctggttgaaaatggacttcaccctttttgacttcatgatcaagtacgagtgatttgaaaaggcattgctccttttctagtctgtaaaatcatcctgaaatgtgcactaataacgtggagactacgcagatgaaatgaaacaagctgcatagagcacagagctcagagcctggcctttaggaaaccctcagtaagggttcatgatgccatggtgtctgtcatcatcctctttatcctcatcatcaccttcataatctttttgttgttgttagggaatagtttagagggaccgattccctgctatcatgggtgagatgtctatgaaaaggacaaccagtgggggaggaaagcaaaattttgaataagatttctgagacccccagcacatccaagaacagaaactgcacactgctgagcggacagtttgcactttgttctcctcccatctgcccaccgcactctcctgtttatcctgaggaggaggaaaccaaacaaggctcccgaccgtccctcaacactcacttgaaggggtggcctggccctccacacctgtgggtatttctagtcgggtgggatgagagactgaggaaagaaataagacccagagacaaagtatagagaaacgacagtgagcccaggggaccggcgctcagcataccaaggacctgcactggcacaggcctctgagttccctcagtttttattgattattatttttattattttagcaaaaaggaatgtagtaggagggcagggtgataataaggagaaggtcagcaacgaacatgtgaacaatagaatctatgtcataatgaagttcaagggaaggtactatgactggacgtgcacgtaagccagattgatgtttctctccacccaaacatctcagtgcagtaaagagtaacaaggcagcattgctgtaaacatgtctcacctcccaccatagggcggttttcccccatctcagaattgaacaaatgtacaatcgggttttataccgagacattctgttcccagggtcaggcaggagacagcggccttcctctccctcaactgcaagaggctttcctctttgactaatccacctcagcacagaccctttacgggtgtcgggctcgtggacggtcaggtctttctcatcccatgaggccacttttcagactatcacatggggagaaaccttggacaatacgccgctttcaagggcagggctacctgaggctttccacagtgtactgtgcccctggtttattgagactaaagaatggcaatgacttttactaagtatactgcttggaaacatcttgttaacaaggcacatcctgcacagccctagatcccttaaaccttgatttcatacaacacatgtttttgtgagcttcaggttgggtcaaagttgctggggcaaagctacacattaacaatatctcagcaaagcaattgttgaaagtacaggtctttctcaaaatggagtctcttatgtctttcctttctacatagacacagtaagagtctgatctctctttcttttgcctacactcactgaactgcccttcccctctgctgggccatgaccacggagaacaggtccactgtcctctctgcatggtgcacgacggatgctcagactccatcctcaaggctggcaagaagacagggtgagacatgagcctcctgatacaggtgatgggagtggagcccacaggactggaacctcacactgcagggctggaggcacagactgagtatttactgttctgtggcctggggggctcaaggcacagagctcctcattagccaaagtcgcccaagttccccaacctctaaggattcctcatcatcatgcaagaagaagaagagaaaatgattgtccatagaagctttggggctcttcctctaatcaggagaaagctggtgtgtattcttcgcttctttcttttctttttaaaaatccaactgctttaattttcatcttttattatgggaaaatataccacatataaatatgaaaaattataaatatatattagttcatatagaatggccagtataaacatttacagtttccacgctttttcagtttacagtttcatgacattaagtacgttcacattgtttagcaaccatcaccgccatcatctccggaacagttttatttttcaaaatggaaattgcaaccatttaccaagctctccactcctctctctcgcccagccctggggccacctttctagtttgcaactctaggagtctaactactctagacacttgatagataagtggaatcataccgtgtttaattttttttttagatacagagtctttctctgtcgcccaggctggagtgcagtggcatgatttcggctcactgcaacctccacatcgggggttcaggcaattcttatgtctcagtctcctgagtagctgggattacaggcgtgcgctatcacgcccagctaatttttgtatttttaatagagatgagctttcaccatattggccaggctggtctcgaactcctgagcttaagggatccgcctgcctcagcctccccaaatactggggttacaggtgcgagccactgagcctggacatgtttatccttttgggatttatttatttcactgacgataatgtcttcaaggttcatccatgttgcggcatgtgtcagaagtgcctgtttttttttttttttttttttttttttttttttttttgatttggttttattttgttttgttttgtgttttcatggagtctcactctgtcgcacaggctggagtgcagtggcacaatctgggctcactgcaacctccgcctcccgggttcgagtgattcttgcgcctaagcctccttagtagctgagattacaggtgcgtgccaccacaccagctaatttctgtatttttagtagagatggggtttgccatgttggccaagctggtcttgaactcctgagctcaggtgatccacccgcctcaacttcccaaagtgttaggattacagacgtgagccactgtgcccagcccaagggtgtggatattttctatagacttttgatgataatactttgacagcaaatatattgtgtctatctatatatacatttatatatatatatatatatatatatatatatatatatagagagagagagagagagagagagagagagagagagagagagagagagaacgtgtgagagagacagcgagaaagagagagtctccctttttcacccagactggagtgcagtggcacaatcatagcgtgctgcggccttgaatttctgggctcaaacaatcctgtcacctcagcctcctgagtagctgggactacaggcatatactaccatgcccggctaactttttattatatttttttgtagagatgaggtcttttttcccgggttggtcttaaactcctggctgaaagtgatcctcctgccttggcctccccaggtgctggggttacaggtgtgagccattgcatctggtgtgaagctgggattgcaggtgtgagacacggcatccggtgtgaatatctcctggtaaataccttgtactttcactttcattaagatgtctttcgtcctcatgaaattatctgaaaaacggatgaaacactgttctgctccatcttccccgcaggcacttgggccccatcctgctctcctgcccccctcttctagtgaatggccagataggaactattgcaggtttatgggccacgtggtctctgttgcaaatataacagctctgctgttgtagtgctaaagcaaccacagaccatatggaaaccatctttcctgcatggcctctgtaatcttttagaaatacccgttgggtcacaccactgcctgacttaaaacatatagatgacctcttccgtctcctaagctattaggttggtgcaaaagtaattgctgtttccattcaaagtaatggcagaaattggctgggcgtggtggctcacacctgtaattccagcagtttgggagaccgaggcacgtggatcacttgaggtcagcagtttgagatcagcctgggcaacatggtgaaaccccatctctagtaaaaatacaaaaattaaaattagctgggggtggtggcgtgtgcctgtagtcccagctacttgggaggatgaggcagaaaattggcttgaaactgggacttggaggttgcagtgatgcaagatcacaccactgcactccaacccgggtgaccgagacagactctgataaaaaaaaaaaaagtaatggcggaaatcacaattacttttgcaccaacctaataaaagtcaagtcctgaccacagcctaggaagccggctatgacgtggcccttgtcaccctctccaagttcaactcccgagactttccgtttcctctctgctccccgctccggcctcccattcctcactcgtgttgcatcagatgcctgcgcaccctggtgtttccgcatgtgctcttctgttagcctggaaagttctttactccctcttcatccagcactactagatacctccccctgccttagcctagccaggtcccctgtcatttagtctcagagtatcttgaatgtcttcttcacagcccaactgacaaccctcactcactcgctgagtgggtgccatcctttctctccacctagaatgcaagctccctgagggcaggggctggaaccgtcttgttctttgccaaatccccagtgccatctctggcacacagtgggcattatgaaaatatttgctgagtgcataaaaggagggaatcatgcatttgagccctcggcttggtgccctggggatgtggctccataaaatcagttcccattttttctctctcttctcctgggaggtgggtatctgggttctcctgccaggagagcttctctctcataagactccaggtgcctcttggcctaggcctgcctcctgctaagtgagactctttagggctagtctgcatcgactctgctgagatgcagccgccagagatgggtaacgtgggcaacccttggcaggtccctgggaacgaggcttccgagtcatctggatcaactagtttgaagttacaaactcaccagatgttggtcagctggcatcttagtgatgagctggtccaaccccccttgttgtagtcaagtcacttgtgcaaagccaccacttggctgggaccccaagctcaggcccgtgctctctccatggtcccaggctttacactaagggaatgtcaactgttctctagaatcacttggactactttatacttttgtgtctccttttcctattctgtattctggaaaaacaaagttttccttgtgattgaacagactcttcacactgtgttattgctggcattgttctaaatttagccttggttcatccccagctggagtgaatgactttaatttgatcagctgctgtctgtgcttgggagcctccgaaggggtcctatggcctttaaggctcctttccatacttagatcctgacctggggcaaacacacactccagctcgttcatgtccagataagacacctagaggccatggcgagggttccccctgtcggggcactattgctgttgagaggatcaaggcagcagtcagggcctgagtgttgtccagaagaaagcacaaagtgtaccgagcgctggtctgacagcacttaggggtgtgacagaaaccttctgtcatgaaaccagagattggagactgtgggaacacatccgaatccacatctccatgacaaggtggtgctgatttccagtggtcctccctggtgggggaatcacgtagctctgacggtggagcgtgttgttgtgtttctctttcagtatgagcttgtctgtggccctagggttcctcccttatgaaataatgatgcctcccaacacaggacatcccaggctgcaagcctgtcccttcagcccagcttccttacccctgtgccccaaaagcccacagcagggcctgccagaggctgatgacatatctgtcactgtcccaagggggcaggggcagcgacggaaatattaggccacaaaaggcatgcctgcaggcacatatgagggaaacacccaaagccagatgtcaatgaaacagtaattcggtggaataggagaggtcatattctcatgcaagactgtctaaatacataagtctccttgggcacaatctcccaggggacaatggttcatgccgagacagctattacactgtcttgctaagaacttccaacacacacttacacacacacatacacacgcacatatgcatgcacacacacgcatgcatacactcatgcacccacacacacacatgcaagcacacatacagatacacacacatgcacaaacacacatacagatacacatacatataggcacacacatgcacacacacagatacacacatgcacacaaacacacgaaggcacacacacatgcaacaaatgcacatgcatacagacacatgcacacacaggcaacacacatgcatacacatacatacacacaggcacacacagatgtacatatgcacacgaagacacacatgcatgcacacacatgcacacagacacacacatgcacacacagagatacacatgcatgcacatacaggcacacacatgcaaacacatgcacacgcagaaatgcatgtacacccctgtacacaccgtacacacacatgcacacaaaaacacgtgcacacacatgcacacacatacacacatacagatgcacacacagacacatgcacacagatacacacacatgcacacatccacatgcacacacgtgcacacacgtgcacacacatgcacatgcacacttgcacacacgcacacacacacacatgcacacatacacacaaaccactccttttccatttctctaatttccaattttttttctatgagcttcctcagactcatgatcttgattctagaatgaattcagggagtaagtgtgtattattgaaataacagtaaattcaaacatgcctaagaagctttttgaatgttggggaaaccatctcacagatcattcaaatgacccgaggagacacttcaccagggacccttggacatgtccctgtcccttctgccgacctctgtgctgtaatatcaggggacaaacctctcgattttggtttctcatctctttgtccccaggtacactggactgcactactgtgtcaaagctacttgtagcctgacctgggaaatgcacttttggattcactcgatttgccacctatttgggtggtttgggctggaaactgccctgctcacactcttggctcccagctgctcctgctttgggggcgcctagagaccccagctcatcccgtgggtcatatccccacagtggggccgggggtgcgactgagagttgtctgggcacctgtccccagcagcattgaggatggcgctcagcactgtgtgatgttggctggtggccactgcctgtttaggtcgaaatggcccagcctgatgtccacaagcacctctgcggcacactggcctgcagacccccgagcatgcgctgcatgcttctcacctctagagtggccacccagacagcgatacagacacaccaagaaaatccacaggcaagcccagaggagcccgttctactagggccttgtgagcctctgtgatttgagtcacgagcttcttgtggtgatttcatttggctaacatccaacacagtgcatttagagactctttctcttggacattatatggaggagtggccatggtttgctgagagaaatgtcccaaaacacccctcaataaaaccaaataacagctcatcaactccttacatttaaaaaaaaattgacatcttataaatagcaaatattggatgacaataaggcacaggaaaaagctcataagcccagatcagcagtcatccttcaattgttccttaactactgactgtgcacctgttctgtaccagcaccgcaacctagatgcagggacaccacacgaaataagatgacaaagcacctgcccctgtggagctgagccactagcaggagagacagtcactaaacgaatatctctatcctgtggtttctgggaatgacagtcacataaaagtatagaaagggatggaggaaagctaatttagccaactcaggatcagaatggggaggtggttgcatccctcaaaattcagagtagctggagtgcaagctttgtattagctgagcctgaatccgggccctgccattgtccatggtgtcctcaggcaaatggctgaactcctctggccaccggcttcaagtgcagaacaggggaccagagtcccatctctcagggttgttgctgtggactgaattgtgttccctccaattcactcattaggagctaattaacgttaaaggaggtcataagggtggaatcctaatctgataggattggtggatttataaaaagaagagatgtctctgtctctgtctctgtctctccccctctctgccatgtgaggacaagcaagaaggctgctgtctgccagccaggaagacagcccttaccagaaagggatggtggatactttgatcatgaacttctggcctccagaacagtgagaaaatcaatgtctgttatttaggccatccggtctcgggtactttgttatggcagctgggctggctgaggcagttgttgagaggaaccgacaaggtagttggggtaaagcacacagcacggccacagctcactgagcacaatgtcagtctcattccccttcaattgttattctctgtctggaggattttcatgatggcttttctccaagaagctccctggggtctttgtaaatatggggatatatctgacaagaaaaatccttacggttcttaacattgacaatgatcaggaacagcaagacatgaaaatgagaaggtggctagaaaagagaggacccacagaagaaaccaacaaccacataacacacacacacaggaggaatcctaatgcaggagaatagaacatcaggggaccctgagactgaactctgcatctcatgtattgagatcattccctgatatggtttggctgtgtccccacccaaatctcatcttgaattgtagctcccctaatctgcatgtgtcatgggagggacgtggtgggaggtaattgaatcattgggtgggtctttcccatgctgttctcatgatagtgaatacgtctcacgaaatctgatggttttataaaggggagttcccctgcacaagctctcttgcctgctaccaagtaagacgtgactttgctcctcattcaccttccaccgagattgtgaggcctccttaaccatgtggaactgtgagtccattcaacctcttgcctttataaattacccaacctcaggtatgtctttattagtagcatgagaacagacaaatacattccctaagcctctcttttcctctgagacaggcttaaactgaatagccccatctttgcaggccttgaatagtaatactgttatgtgttatattaacatgtactttactgaaagtctctggtttttgtctctctgaacataggcaggcattgctgaaacttgcagatgacactccaaaatgcattctatcttaagataagaagagagggtggtgaggaaaaattgtacataccttccccttgatgaagaggtccccgtggtgtggccggccttggtataagccttttggctctgttaattcatgagggctgagtctgattgatcctcatggggaagactaacaagggaatccttggcaaccattaggaataacactaatgacccagaaagtggttctgtcttcatggggcatcatctgtcttgtttactgagtgatcttctggctcatttttcttccaaccagggttggaattcaataattctagttccttcccaaattttagagctgggaaatgcattcctcaggtatctgcttttcaaaagtgaacaatatctgtggagctcaactcctaaatagtgtgactttgtctgtttatgtggttctcttgctgactgcctggttgcgactgtgcctgaactcaggcctctgtgtttctgaatcttagaagcggtggttggcatgtcaaacttgaagtcattgtcctttagttatctgagtgttataattgaacagcacatttattaacaagactttagtaaatccatcagcattctagggagctttgattcattgacctatctctaatgtacgcaaaggctgccatagagtcgctaacaagaattccatctttcctcagaaccttcgattcgctagggtcggagttcatacctgtttcatgaaaaatgcaaaaccatttaatcacagctgttcatagtatgcctattctaagagacctctgctgttcctaccccagggaccgccagaataattaaaagtcacagaaatcaaacaaatgggcctctggctaaattatagaagattaacccaggaagagcacttattaaatagtaagcagtccccgaaaatattaaagtacaaaaaggattagaaattgttttaagtgttgattccaacttcaggtgctgttcttccactccactgcggaagggaacaaatggattttcccgtcctaaagacagtaacattcatcacgccccttggaggcttaataacatctcgctttattttattttaattgtttatttatttatttatttttgagatggagtttcactcttgttgcccaggctggagtgcaacggcgcgatctcggctcacttcaacctctatctcctgggttcaagcgattctcctgcctcagcctcctgagtagctggaattacaggcacatgccaccatgaccagcaaatttttgtatttttattagagatagggcttccccacgttggccaggttggtctcgaactcctgacctcaggcgatctgcctgcctcggcctcccaaagtgctaggataacaggcgtgagccaccgcccccggccaataatatctcacgttaagcaaggagttgctgtctgctgtgtggccagagagaaaacaagccgccattacagagggaggtggtattgggctacttttttttggaaacaacagcaaaatgtgaggcaaatccgcttttagatcctggttacactgctggatggagcttagcaagcctgtgatagggtagcctggtggtggcttgggggactcctagccatgtcagacaggacagatgcctttgaggagagatggcatagcgttggctctcaggcccccattgcagggggaccaggctgtttatggatcaggtgggaaccctgttagaaaaataagaggaggctgggtgtggtggcctacacctgtaatcccagcacctttggaggatgaagtgggtggattgcttgagcctaggagtttgagaccagccagggcaacttggcaaagccctgtctttagaaaaataataatattagttaattaattagttgatttttttttttaaagaaagagaagtggagctaaggagcacagagcctgccagaaagccaaggtgaccagctagaaggacacagaagaacattaccatagttctctctgagcttttggactagggatgctttcatgtggttttcatatcaaacatactttaattttatacttagccgggaaagacctaatacatacaataaaggtaacacgagacaaaactctcacctaagcctaacatcttagatgctctactgggtctctgcaatttctattagggaccccatgggtttgaattgcattctagatttgttaagaagatccaaatgctcaaccccttcaaccaccccgcatccgtccaccccatttacaaaagccaagtgaaaactaaggagggaccgggtgcagtggttcacacctgttatcctagcactttgggaggctgaggcgaggggaacacctgagatcaggagttcgagaccagcctgactaacctggtaaaaccccgtctctactaaaaacacaaaaattagcaaggtgtggtggtggacacctataatcccagctacttgggaggctgaggcaggagaatcacttgaacccggaggcagaggttgcagtgagtggagattgcaccactgcactccagcctgggtgagaaaaagcgaaactccaaagaaaaagaagaaaggaaggaagaaagaaagaaagaaagagagaaagagagagagagagggagagagggagggagggagggaaagaaagaaagagaaaaagagagaaagaaagaaagaagaggaagaaggaaaagaaggaaggaaggaaagagagagagggagagagggagggagagagggagggaggaaggaagctaaggaggaaggtggcttgtacagaggtacagaggccctcaggtcctagccggcactggtgcctacgcaggttccaatgggctgagctttgcaaaaagctcattgtgtaacccaggaagcccaaatttatttctgagcagatgtcttttcaaagtgattttccttttaggaagtgagaggagaatgaaggggaggtttatctacttctgatgttaaaaaagtcaaaacaaaataaattggtgttcattgcaactattggccaaagcactataatcaccaggactggtacctcaaacacacctcctgacagccccttccattctaatcaagatgtgcccaacagtggtcacccaggggctgtttacctttacttaaagagaaccgctggtagtaagccataaaaattaccatattcaccatctttctgcttcaaagaaggttttagattagcaatggctggatcaatcactgtgagtatgttcttgggaactaaaagccaaaaagaaatattttaaatacgtggtatatttttaaaatgtggactcttaatatatttttaaatgcaatgtaggtaagattttaaaatcactttccaaatcggtgcaagagtcactccctctccctgttacatacacacacatacacacaacccaatggtatccacgtgatcatcaaatgctccagagaggtggttttaggcccattttgcaatatttaaaaaatggagactaaaaacaagatatgatatatccatccagaagaatacacctcagtaataaaaaggaatgaaaagctcggcatggtggcttacacctgtaatcccagcactttgggaggtcgaggtggacagattacttgaggtcaggagttcgagaccagcctggccaacatatttgaaaccccatctgtactaaaaatacaaagttagctgggcttggtggcacaaggctgtaatcccagctacttgggaggctgaggcagggagaattgcttgaacccgggaggcagaggttgcagtgagcaaagatcgcaccactgcatcccagcctgggtgacagcgtgagacttcaactccaaaaaaaaaagtgaagtactgatacgatacatgctacaacatggatgaacctctgaaacattacattcagttaaagacgtcagccgtgcacacacacacaaaaccatccattgcataattccatttgtatgaaatattcagaaaaagcaaatctagagagaaagtagatgcgtggtgacctgggaccggggggctgggaatgggacagtgacggcaaatgggcacaagggagcttcggggcattgtgaaaatgttttaaaactggagggtagtgatggttgcacaactctaaatttactacaaatcattgaattttattcacgtgtaatagaattttaagaaaaataaacaacacgtcaatagagtggttaactctgggccgggcacggtggctcatgcctgtaatcctagcactttgggaggctgaggcaggtggatcacttgagtcaggaattcaagaccagcctggccaacttggtgaaaccccgtctctactaaaaaatacaaaaattagccagacgtgctcacttgaacccaggaagtggaggttgcagtgagctgagagtgtgccactgcacttcagcctgggtgacagaggaagactctatctcaaaaaaaaaaaaaaaaaaaaaaaacatatatatatatatatatatatggtggttaactctgaagatgagcttccctggactcaataaagcaaaatgactgtgaccaactcaaaatccaccatcaaactctcccagcacctgctcttctgctttctaccccaagctctttgcctctgtgtttccatcgtaaatctggaaagaattcgaagactctgtgctaaagtgatttgctaaatattatcagaaaggactacagaaagatgcagagaggatggcagcgtgaccgacccctttgaaggtggttgaagactctgctgaactgaacctaagaataagccctgggatgtcagaatccccaggcaaagctgctggcagatgacagcacccgctgaaacagaggacagagcaagaattctgcaggccaagcacactgccgcaggctgggagaagggagtggaaaccgaatattcctcctgcataaaactgcttatttttatttgttcctcagcccagctgagatcttggagaagtagcaacaggaaatggaaagaaagcgaaaacaaactgcaaattcagttgcactgctttttaaaaaaagaacaagtgagacatcttcagcagcaagaaaaccttgtttcctttcttggagggcttaactaaattcttctggggatgtcccaggatcaacaaccacaggacattcctagattgtgagttttccatgtacaagaggccctggtaccttggtgcccctcagcagcaagggagacttcccagggaggcccggtgaagttgctggaggtggctgatgatttccagggcctcgagaaatgtcccttggctgtcctcagggcccaccactgatcctgggaccatggcagcttcggagagctgagcggagctgctgcaaaatgctttctgctttaattacctcgcattcatttctgggcccagagaaggatacagtggcctgggaagtgtcagctctccctgccaggggtaggacttctttctcatgtctgcctcttggcttgttctcaaactgtggcttcaggagggccttggctcttggcaaatgccagaggctttacagtttgagaaagaatcagaattttgaagaggagctcagagaggaaggtcattctaggatgcactttgcagaatcaccaggcagtgaaaaggtgaaattggctgtggatgacacaggccactgcagggaatgtgcccctctaccatgtgaaattggttctgaaatccagagaatctcttaggacctttaaaatcaccgttgtcaacacacttgtcagatttttgcatctccttgtttcaaactggttcagaatgaggtcggggacttgggtgtgattgatcaccgtcctgctccacttcagatatgttggtgaaaacactagggaccactcttcatggagctcctactgtgtgcaggaccctgttctcagcagtttaaaccagggccatcttcctcctcatcaacacctttcctctcccactcagcagcctcagcgtctcagcccctagtgtgcagctagtgcgcataccctagtgttcaccctacaggatggttctctttggaacacttaaaccaccacccccaagctaaattaggccccctccactgctatagtcttcttcccttttctaaaatagcatttgtcacaatagggcatgatgatgtgtctgtctatttggttaatgcttgcctttctccctcaactgttcaccccatgaaaacaggaccgtgtctggttttttttttttttttttttttttttttgagacagagtttcacccttctcacccaagctgagtgcagtggtgagatctcagctcactgccaactccacctaccaggttcaagtgattctccttgtcacagcctcccgagtagctgggattacaggcatgcgccaccatgcccagataattttgtatttttagtagagacggggtttcaccatgttagccaggatggtctcgatctcctgatctcgtgatccgcccacctcggcctcccatagtgctgggattacaggtatgagccaccacgccctgcattagtttagttttttagagacagggtttcactctgttacccaggctagagtgcagtggtccaatcatagctcactgcagccttgaactcttgggctcaaacctaggctcaagggatcctctcgcctcagcttctcaagtacctgggaatatatgaatgcacaccatgcccagcttacatttatttgtttaaaagacaagaaagaggccaggcacagtggctcacaagtgtaatcccagcattttgggagggaggctgaggtaggaggatcacttgagcccagaagttggagaccagcctgggaaacatagcaaggcctcatctctaagttaaaaaaaaaaaagcaataaagatgacatgataccaaatcaaatcatttcctttcctaggaaaagggcaaaaacaaggcacggtgtcagttaagaatccctctttagagaagcatgaaaagtctgccccaaatctggtaaaaccaggaacaactgacggtcaaactgatggtgcattctaggttaggatgatttggaccaggttgtactttgttcccaaagaattcaaggaaaagttagtttgtttaatccgcttatcatggtaaaatctttctttgcaatgtcatacaaagttggcattgtgtgtgcactgttgaagaaaacatagttaattgtttttttaaaagactgtattccaaaaccatttaattagtaaaaatgtttaataatgatttgtttttttttgtttttgttttttttttttgagacggagtctcactctgtcgcccaggctggagtgcagtggcgcgatctctgctcactgcaagctccgcctcccgggttcatgctattctcctgcctcagcctctggagtagctcggactacaggcgcccaccaccacacctggctaattttttgtatttttagtagagacagggtttcaccgtgttagccaggatggtctcaatctcctgaccttgtgatccacctgccttggcctcccaaagtgctgggattacagtcaggagccaccgtgcctggccctttgagtacattttctaagaacttggtcatgagttcagatgtctgcctcagagatacatgtggcttcctttaaagaacccaccttccctttctataggagtatttatgggagatatgagcctggaggttggaatctatcctggttgtactttgctatactgaagtaaggagtaaacctacaactaaattcatactgaagtatacaaagggggctctacaatagataggaattctgtttagttttgttgggtaacaatttctttgagaagcaaataatagctcacctacaaaactggtgatctgtataagttgggatttttcatggatcagttttgcttggaatgaactacctaatcacaaatatatttatacccagagagagagaaggagtgtctgttgaaaccgtatcatcttaacgtgtctataaaaggcaatacctggaaggtggtgggtgccacacaggttaagctgtcttccctctgggaggcaggcttctgggaactacacatttggtaatcttgcccataaaatgccgattggacacttatcgtagaatgccgagggcactgtagattgaaatagtccccatcacaggcatatgtggtgtggttttgcaggagtttggttaggtaacctggtaaatattcagtcgggttacaagagttccagaaacccaccactcctccttgggtttggggacaggaggacgttggttcccctggggaagggctgttgagttaacaacatgtggggtggggcctccctagcagctctggtgcagaggtcaccaaaccaggcccagaggtggggcacaggagccaatgtcagctttcatgttgatatggaaggggggcaggggagtgctgggtagagaagggtggggtcactgtcgagggctctgccctcgggcttgtgcccttggaccttagtgagaacaggcactcctgttttcttgtccaaatgttgcattttccaagactactctggcctgctatgacccccatcctgtgcccataaaaaacccaagatcctagtgggcacagacacaagtggctggacatcgagaggagcagagaagcaggagagcacactgaaagacatcagcagatgctggcaggcttttgacagtggggagatgtggaattcagtagggggtggtcggaggagagtgtggctactaggcagcccgactctagcagaagatcaccttcccactccatcccccttctggctccccatccatctgagagccacctcctccactcaataaaatcttgcattcattctccaagtccacgggcaatctgatttttcaagtacactagggcaagaacccgggatacagaaagccctctgtctttgtgataaggcagagggcctaactgagctgattaacacaagccacctgcagatggcaaaactgaaggagaccactgtaacacatgcccactggggcttcgggagctgtaaacacccaattccacacgcttctgtggggccagatcccagaaatgctccccacgacatgcccctctacacgctccctctaggggtttgagcagcagggtactgagaagcgagccatgcccctgtagcatgccctgcaagggggataagggtactcctcctgtttcaatgtctgggtcagaaaccttggtctaggcccactgaatggtttggagggctctttccccttcaggaagcactaaggtattggccaggagccaagaagtcctgaagcacctctgtaaaccaggaaaaaacaattgggatgagtatcccctggacgtgtggatgcccatcctgagggaggctttcattttctcatctcccactagtgaggccatgccttattgggatgagaggatgcagtttcatttcaagaaatcactcttggctctgtcttggtgctggagaggaaagacaggcagggtgccctgtgcagagaagcgatggtggggctctgctgtgggttgaatggtgtcctctcaaattcacgttcatcaatgtggggaaaagaaagagagatcagattgttactgtgtctgtgtagaaagtagaaatacgagactccattttgttctgtactaagaaaaattcttctgccttgagatgctgttaatctgtaaccctacccccaaccctgtgctccctgagacatgtgctgtgtcaactcagggttaaatggattaagggctccgcagggtgtgctttgttaaacaaatgcttgaaggcagcatgctcgttaagagtcatcaccactccctaatctcaagtacccagagacacaaaacactgctgaagcccacagggacctctgcctgggaaagccaggtattgtccaaggtttctccccatgtgatagcctgagatatggcctcctgggaagggaaagacctgaccacccccccagcccaacacctgtaaagcgtctgtgctgaggaggattagtgaaagaggaaggcctctttgcaggtgagctaagaggaagtcatctgtctcctgcttgtccctgggcaatggaacgtcttggtgtcaagcccgattgtatattcctactactgagataagggaaaaccaccttagggctggaggtgggacatgctggcagcaatactgctctttaatggattaagatgtttatgtgtatgcacatcaaaagcacagcacttaattctttatctggtttaagatgtagagagctttgttcacgtgttttcctactgaccttctctccgctcttaccctattgtcctgccaaatccccctctctggaaacgcctgaaaattatcaataaatactaagggaactcagaggctgctgccggcatgggtcctccgtattctgaacgcccgtcccctgggcactattttctttctctatactttgtctctgtgtctctttcttttccaggtctctcattccacctaatgagaaacgcccacaggtgtggaggggcaacccaccccttcaatcaggaacctcagaatgtgacatttggaaattgggtggttgcaggtgtaacgaattaacctggtgacatactggagtaaggtgggcccttcacaccatgtgactggtatccttaaaagaagaagagactcagagggaagacagccatgtgcagctggaatgatgcatctgaagccaaggaatgccacgcattgccagccaccacccaaaactggaaaaagtcaggaaggattcttccctagaaccttcaaaggcagcacagccctgccaacatctgcattcagactctggcctccagaactgtgagaggatgaatttgttgttttcagccacccaagcttaggaaatgggttgcagcagactgggaataagacaggcagccagtcagactccgtggaattcccaggcagcttgcagaagccacagtgggccctgggctctgagaagtctgaggcctagcaggcacgtggcctaaactatttctcggcaaggaggaaggaaggctcatccagaacgtagatccccttcctccttctcacacctcacgaggtcacagcgaggtggctgggaggagagccaggggcttttcactgaggtgtgtgggagacagcttggccgcccttggcctctgaagggaggaggtggtgtgaaggagggcagcttcagaacttcccagttcctgcttgaccacctgtgtgtaaagtattcctgtttaggtttcaaaatcctctcagaaacataattctcagaaaatccaggcacccaatccagctccctggccttccctgaaatctgaagtcaaaggggctgagccagcctgccctgggtgtcaggcctctgagcccaagctaagccatcatagcccctgtgacctgcatgtacacatccagatggccggttcctgccttaactgatgacattccaccacaaaagaagtgaaaatggcctgttcctgccttaactgatgacgttgtcttatgaaattccttctcctggctcatcctggctcaaaacctcccccactgagtaccttgtgacaccgactctgcctgccagagaacaacctccctttgactgtaattttcctttgcctacccaaatcctataaaacggccccacccctatctccctttgctgactctctttcagactcagcccacctgcacccaggtgaaataaacagccatgttgctcacacaaagcctctttggtggtctcttcacatggacgcacatgaaatttggtgccgtgactcagatcgggggacctgccttgggagatcaatcccatgtcctcctgttctttgctccatgaaaaagatccacatacaacctcaggtcctcagacccaccagcccaaggaacatctcaccaattttaaatcgagtaagcggcctcttcttactctcttctccaacctctctctgtccatcaaccactttctcctttccagtcttcaatctctcccttctcttaatttcaattcctttcattttctagtagagaaaaaggagacacgttttatccatggacccaaaactctggcaccggtcatggactgagaaggcacatttcccttggtgtttaatcattgcagggatgcctgattattcaaccacgtttcaaaggtgtcagaccacccagggacgcctgccttggtccttcacccttagcggcaagtcccgcttttctgggggaggcacaagtaccccaaccccttctctccgtgtctctaccccttctctgcttttctgggggaggggcaagtaccgctcaaccccttctccttcacccttagtggcaagtcccacttttctgggggaggtacaagtaccccaacctcgtacctctgcaccccaatcccttatttccgcaccccgaccccttttctctgtgccccaatcccttatttccacaccctgacctcttatatctctgcaccccaatcccttatttccatgcctggacctcatatctctgcgcccccacccctttcccacttttctggagagtaagaacccccgaaccccttccctccgtgtctctactctctcttttctctgggcttgcttccttcactatgggcaactttccaccctccattcctccttcttctcccttagcctgtatttttaagaacttaaaacctcttcaactctcacctgacctaaaatctaagcatcttatttcttctgcaatgctgcttgaccccaatacaaactcaacagtagttccaaatagccagaaaacggcactttcaatttttccatcctgtaacatctaaataattcttgccgtaaaataggcaaacggtctgaggtgcctgacttccaggcattctttcacacatcagtcccttcctagtctgtgcccaaagcaactcatcccaaatcttcctcctttccctcccacctgtcccctccgtcccaaacccaagcattgctgagtctttctaatcttccttttctacagacccatctgacctctcccctcctccccaggctgctcctcgccaggatgagctaggtcccaattcttcctcagcctctactcctccaccctataatccttttatcacctcccctcctcacaccgggtcccgcttacagtttcattccatgactagccctccccaacctgcccagcaatttactcttaaacaggtgcctggagttaaagacatagtcaaggttaatgctcctttttctttatcccaaatcagatagcatttagcctctttttcatcaaatataaaaatccagcccagttcccggcttgttcggcagcaaccctgagacgctttgcggccctagaccctaaaaagtcaaaaggccgtctaattctcaatatacattttatttcccaatctgcccccgacattaaataaaactccaaaaattaaattctggccctcaaaccccacagcaggatttaattaacctcaccttcaaggtgtacaataatagaaaaaagttgtaattccttacctccactgtgagacaaatcccagccacatctccagcacacaagaacttccaaatgcctgaaccgcagtggccaggcgttcctccgcaacatcctcccccaagagcttgctacaagtgtcagaaatctggccaccaggacaaggaatgcccgcagcccgggattcctcctaagccacgtcccatctgtgcgggaccccactggaaatcggactgttcaactcactggcagctgctcccagagcccttggaactctggcccaagcttctctgactgaccccttctcagcttagcggctgaagactgacgctgcctgagtgcctcggaagccccgtagaccatcatggatgccgagctttaggtaactctcacagtggaggataagtccgtccccttcttaatcaatacggaggctacccactccacactaccttcttttcaagggcctgtttcccttgcctccataactgttgtgggtattgacagccaggcttctaaacctcttaaaactccccaactctggtgccaacttagacaacactcttttaagcactcctttttagttatccccacctgcccagttcccttatttggccgagacactttaactaaattatctgcttccctgactattcctgggtacagccacacctcattgccacattttaccccagttcaaagcctccttcacatcctcctcttgtattaccccatcttaacccacaagtatatgatacctccactccctccttggtgaccaatcatgcacctcttaccatctcgttaaaacctaatcacccttaccccactcaacgccaatatcccatcccgcagcatgctttaaaacatttaaagcctgttatcactctcctgctacagcatggccttttaaagcctataaactctccttacaattcccccattttacctgtcctaaaaccagacaagccttacaagttagttcaggatctgcgccttatcaaccaaattgttttccctatccaccctgtggtgccaaacccatatactctcctatcctcaatacctccctccacaacccattattctgttctgggtctcaaacatgctttctttactattcctttgcacccgtcatcccagcctctctttgctttcacttggactgaccctgacacccatcaggctcagcaaattacctgggctgtactgccacaaggcttcacaaacagaccccattacttcagtcaagcccaaatttcatcctcatctgttacctatcctagcataattctcataaaaacacacgtgttctccctgctgattgtgtctgattaatctccctaacctcaatcccttacaaaacaacaactcctttccttcctaggcatggttagtgcagtcagaattcttacacaagagccaggaccgcaccctgtagcctttctgtccaaacaacttgaccttactgttttaggctggccatcatgtctctgtgcagtggctgctgccgccctaatacttttagaggccctaaaaatcacaaactgtgctcaactcactctctacagttctcataacttccaaaatctattttcttcctcatacctgatgcatatactttctggcgccccggctccttcagctgtactcactctttgttaagtcccacaattaccattgttcctggcccggacttcagtccagcctcccacattattcctgataccatacatgacccccatgactgcatctctctgatccacctgatgttcaccccatttccccacatttccttctttcctgttcctcatcctgatcatgcttgatttattgatggcagttccaccaggcctaatcaccacacaccagcaaatgcaggctatgttaaacacacctcaccaagctcagccgacttaaaaaggactggacaatacttttaccactttcccttctcagaagtcagacctgtcctcagaatgctacaaaatacagcccatttgagctcctgtacagacgctcctttttattaggcctcagtctcattccagacaccagaccaagttagactatgccccaaaaaaacttgtcatccctactgtcttctgtctagtcatactcctattcaccattctcaactactcatacatgccctgctcttgtttacactgccggtttacactgtttctccaagccatcacagctgatatctcctggtgctatccccaagcctccactcttaactcttgaggtaaataaataatctttgctgacaaggctatgctgaacctccttaggcactctctaattagatgtcctaggtcctcccaattcttagacctttaatacctgtttttctccttctcttattccatttagtttttcagttcacacagaactgtatccaggccatcaacaataattctacacgacaaatgtttcttctaacaaccccacgatatcaccccttaccacaaaatcttccttcagcttaatctctcccactctaggttcccacgctgcccctaatcccgctcaaagcagccctgagaaacattgtccattatctctccataccgtcccccaaaattttcgctgtcccaacactttaccactatttcattttatttttctcagtaatataagaagacaggaacgtcaggcctctgagcccaagctaagccatcatagcccctgtgacctgcatgtacacatccagatggccggttcctgccttaactgatgacattccaccacaaaagaagtggaaatggcctgttcctgccttaactgatgacattatcttgtgaaattccttctcctggctcatcctggctcaaaacctcccccactgagtaccttgtggcccccactctgcccgccagagaacaacccccctttgactgtaattttcctttacctacccaaatcctataaaatggccccaccccatctcccttcaatgactctcttttcagactcagcccgcctgcacccaggtgaaataaacagccatgttgctcacacaaaacctgtttggtggtctcttcacatggatgcgcatgaaactggggtcctcacgcccaccagcccagagtactctctagaggaaggctacagatacttcctggctcgctcatccaaacgttagctgtcttgctgaaactccttttgtcacccttgaaaaccactggaagaatggccaagaacccagctatcctgagtaagttcacttaaagaagcaaaatctgacatgagtggcaaaacggacattggcaccaagagtgtgggtcagagtcctgccccttggaactacatcatcgcttgtacagtgtaccccccaggcaccaagagaccaggcggagacccttcagtggccctgggcctctggtcactgtcttcctgcctggcacagaggcaggccctcataaatcaatgagtactgaaagttccagccttcttggtgggttctctgcaccccgtcgtgagccacaccctgccccagggaaatcagggtcaacttgatgctacccctaggccagtgccccttctgcagtgccccaggctggcaccccatacttagatctcttcagcctcttcatgaaaaccttcttgtccatcaccccagcattccccagactgtgctaaatgagcagctgaccacacgtcaaatcaattttcagagtttgcctttggtttaatattcatggcttatccaaaagatcttgtcaccatagctagatgaaaaaaatgacaaggctctggagaagcagagccacaagatggaagatacctgggtcctaggttcatgaggagaggagcttcttgctccacagactgtcacatgagtgggaatgaaacttttgctgcgtttagacgattacctttcttcactctgtcacatagtctatccccgctaaacagaacttgacctccaccagaccgtttacatcaagacctatatgtgtagtgcagcggcctgagcctccaatccatgccccacctatccaaccagccttgccatattctaactctgagagtggtattctgggggcagacgctcagagcatagaattgactaatgccagatacttcaggcgctttgcactttgaagtctctctgtcctagcacattccaagtacaaagaagacacttcagcagtacaacctggcctacactcagttcaattacttcttcaaaaacctaggcccggccaggtgtggtgacttacatctgtcatcccaacactttgggaggcggaggtgggtggatcacctgaggtcaggagttcgataccagcctggccaacatggtgaaattccatctctactaaaaatgcaaaaaattagctgggtgtggtggcaaccccctgtaatcccagctacgctggaggctgaggtggggaaattgcttgaaccctggaggcggaggctgcagtgagccgagactgtgccactgcactccagccggggaaacagagcaaaaccccatctcaaaaaaacccaaaaaaacaaaaacaaataaaaacaagcctaggcccacatccagacaatggaatgttatttagcactacaatgaaatgagctatcaaaccacaaaaagccatggagaaaccttaaatgcatattcctaagtgaacgaagcccatccgaaaaggctgcacactgtatgattccaacgatatgacattctggataaagcaaaactatggagacagcgaaaatatccatggtttccagaggtcaggagaaaggaggaatgaattgatgaaacacagaggatttttaaggcagtgaaactactctgtgtgatactacaatggtggatccacgtcattgtccatatgtccaaacccatgcaatgtacaacaccaagagtgagccctcatgttaactatggactctgggtgatagtgcccacctcggcctctcaaagtgctgggattacaggtgtgagccacagcgcctggcctctgcttcatttctctaacacattaagtctatttaaaaggaaaaaaaaattccctatccccaggatagcattacctttgggaggagaggagctagcgttagggaggggagaatgaggtgctcaggcaagctggccatgcccagttccttgatctgcatgacgtgcatgtgctttactgtgtgaaagctcacccggttatccacttgggatatgtaaacaaaaatgtttaaggaaacttcgaggatgggctgctgggtgacagcaggacaggctcatgaggaccagccatcacccaaatgctctggtcctccaggctgcctgcccatgcctcaagctgtttggtctacagtgccaaaaggtcaggaagaaggacagttaggacaacctcatagtttcagcaacatggaggccatcaagaaccattttgaaaccatatggaatggggggtggggacagaagcttgtttggaaaaggtagaaaagtgagtggaggggccaggtgcggtggctcatgcttgtaatcccagcactttgagaggctgaggcaggtggatcacctgagattgagagttcaagaccagcctgactaacatggaaaaaccccatctctgctaaaaatacaaaattagccatgtgtggtggcaggtgcttgtaatcccagttacttgggaggctgaggcaggtgaatcacttgaatctgggagacagaggttgcagtgagttgagattgcaccattacacgccagcctgggcagcaagagcaaaactccatctcaaaaaaaccaaaaaaaaagaaaagtgagtggaggttcagaaagtcaaagatggtccatgtggtaggcagaataatggcccacaaagatgtccacaggccttaatccccaggaccagtgattatgttaccagacattgatggaaaaagggacttggcagatgtgattaagttcaggattttgagtgggggagattatcctggattatctggaaggggtttatataatcacaagagtccttaaaatgaggaaggtggctgagtgcagtggctcacacctgtaatcccagcactttgggagaccgaggtgggtgtatcacctgagatcaggagtttaaggccagcctggccaacatggtgaaactctgtctctactaaaaatacaaaaaattagccgggcatggtggctgatgcctgtaatcccagctactcaggaagctgaggcaggagaatagcttgaacctgtgagacggaggttgcagtgagccaagattgcaccattgcactccagcctgggcaacaagagcaagactctatctcagaaaaagaaagaaagaaagaaagagagaaagaaagaaagaaagaaagaaagaaagaaaggaaggaaggaaggaaaagaaaataagacagaaatggtttatactggatcaatctacctgggaggagatattcccaagcaagcagcgtcttttctcctatgactgactctggaacagtgaggagctgctggattctatcaacagttcgagagtgccctatataaccagctctcatctcactcacccccagctgtttggtctatggatgacaatttcgaggtgaacaaacaacatcctgtttggagggctgctactctggctaaagacggtaaaaatcagtcagctcagtgagctgaattgcatgctgttttcctagccactgatttatactagaatgatgccagtaactgattttcaaagaatcatggtatgtgtcccaaagtgttccacaggagtgtgatattgtgaaatatatatttgatcagttgaacagtggtagaagtcccctgtttgggtttttactgactcctgggcagtgaccagtgtcttggctgtacactcaggcaagagggcaatcgccacctggcttattaacggatgtccatatggggcacagccctgtggagaggtgaaagatgccttgaagtagaacaggttcacgtccatcagaaaaactcccttccaggctcaggaggtggctggagtcaccaagtggattttttttgtgtgctcctgtgaggtggtcacctgggcccatgaaatgagtgagcaaggccgttctgcagcagtacagagatgggctgaatctagccatgccccttgggctcaaaatgccaataagaactgttctgtcgctgggtgcggtggctcaagcttgtagttccagcactttgggaggccgaggcgggtggatcccctgaggttgggagtttgagaccagcctgaccaacatggagaaaccccatctctactaaaaatacaaaattaccggggcgtggtggtgcttgcctttaatcccagctgaagcagaagacttgcttgtacccaggaggcggatgttgcggtgagccgagatgatgccattggactccggcctgggcaacaagagtggaacaacgtctcaaaaaaaaaaaaaaaaagaactgttctgtctgccagcaagagaaacagagactgcccacaactgccaggcacattccctagtgagaaagctcttaacgtcactggcaagtgagatggatgctggcagccctgggggagctgcatctaggtctttacaggaatagacgctgtctctggactgggctttgtttgtgtggtagaagatgcaaactctcggagtgccattaaaaacaagaaaaaaggccagacacggtggctcatgcctgtaatcccagcactttgggaggctgaggtgggcggatcacctgaggtcaggagttcaagaccagcctggcaaacatggtgacaccccgtcactacaaaaatataaaaaaaattaagcaatcccagctactcgggaggctgaggtggaagaatcacctgaacccaggtggcgtaggttgcagtgagctgagatcgtgccattgcactccagcctgggagacagagggagactctgtctcaaaaaaaaaaaaaaaaagaaaaagaaaaaagagaagaaaagaaaagaaaaaaacagaaaaggagatactgcatgaatcttgatagccaacgtcattgcttcagaaaaaggagcactctgtacagcccataatgtccaacaataggcagagaggcatcctcttcagagtcataatgtggcacagaaatggaacaggcaaatcaaacgctggttgtctaaaacgggggaggtgaaagcagaagggctggtgatagagtgtggatctgtatctccaccaaattgtgtgttgaattgtaatccccagtgttggagctggggcctggtgggaggcaactggatcatgggggcaggtttcccatggatggtttagcactattctctttggtattgtactcacgatagtgagtgagtcctcgtgagatctggtcatttaaaagtgtgtggggccgggcatggtggctcacccctgtaatcccagcattttgaaaggctgaggtggatggatcacctgaggtcaggagttcaagaccagcctggccaacatggcaaaaccccgtctctagtaaaaatacaaaaagtagccagcgtggttgtgggcgcctgtaatcccagctacttgggaggctgaggctggagaatcacttgagctcaggaggcagaggttgcagtgagccaaggtcacaccatggcactccagcttggatgacagagcaagactctaaaaaaaaaaacaaaaaaagtgcgcggcacctcccccagtcattctctctggctcctgctcctgccatgtaagagaactgctcctccttcatcttctgccatgattggaagcttcctgaggcctcaccagaagcagaagctgctatgcttcctgtatagtcttcagaacagtgagccaattcaaccactttccttgtaaattacccaatcccattgcttctcagccttttggctaagatcaagtataaattacccagtctcaggtatttctttatagcaatgcaagaatgaactaatatagctggcttgcacgctttgtgagtgtgcactcatacttagcatgagtggtctaaaggagtggccttccagatttttctccatttttttggttgatctggggaagggggggtggggaggatgctgacatgaccatgcaattttttttttctttctgagacagagtcttgctctgtcacccaggctggagtgcagtggtgcaatcttggctcactgcaaactctgcctcccaggttcaagcaattctcctgtctcagcctcccgagtagctggaattacaggcgcatgccaccaggcccagctaatttttgtatttttagtagagatggggtttcaccatgttggccaggttggtctcaaactcctgacctcatgatctacccgcctcagcctcccgaagtgctgggattacaggtgtgaaccaccgcacccagcccaatgaacagttcttgaatgaatgagacagtgaagaagactaccagaagaatagcagatcaaaggtgaataagtgagtagtagcttctgattaatccctcatcagcaaccaacgtaacccagggcttatagatttctctgtgtaacatgttacacacatgtctacggaaagagagagagagagaagcacatcagtcaagcatttttcaaaagttaccctaaatgtgctgtgttggtcttgtattacaatctttagattacactactgttttatttcaaacaggactggtagaaacttcttcatgccttttcaaccaaaggccttcagtcctataaaaatgatcaccttgttctttgaccaagtaccaaccttagaaagttaagcagcgaactccatctgacttagattagttgaaaagtaactggatcaatccccctttaccccaaacatctaaatggaacaattttcttttcttcgggatgcagcataatcctcaaactacagagccacttggcgatgaagccagaattgcagtgcatttgataacttcatgcaactttttactagcatttaaaactcagatatgaaatctgtacttgatcttttctgcttggaattggccagattagtggttctgcccccacatacaacaaaaggctctcagaaacactcagggttgctaaccagtcagaaggaccaacagagctcgacaaacagacaagagggagaagggcaccaccttccaacctacccgcttagacagcctttcaactctgcccactttgaggatgtgtaggatgatccaggtaatcatgatacctaccttaacttcaaggtagaaattaaggcttgagggcacttatttggtgccttattcagtgaattggaagactatatggtaatttcactgctcataataattaaaccttttttttaactttagggatgataatgacatttggagagtagcactataaacctcagacatctattttgaagatgactggatttaggagcaagacaggtttgctgtacacttgactgaacatgctttgttccccaaagcagcaaaaaagccagagcctggaagtttctaaaacttgaagcagatgtaagtggcaaatccaaaaagccatgcctagagaacaggtcgggtgaccggctgtgtctattccagcctccctgttggctcggtggaggacttcggacaggtctgtcagtatccccttctttggtttcaccttagaatgaggggaagtcacagcatttcttcgtttgtatttcacagaaacacagtcagcaaatgtaaagaagtacgggcgcctaaatggtggttatgctgccctggtctcaagcttcatattcatccttaattgattcccaggcacactcactagtgacctggctctgcttcactgaatgaccccaagggcccacactttcttaattctcctgtggaccctttattcactccccctcatccttcctttgctgacggtgtttgcttctgattgtcccaatcttttttttctttttctttttcttttttttttctttttgagatgtagtcttgctctgttgcccaggctggagtgctgtgtcgagatctcagctcactgcaacctccgcctccccagttcaagtgattctcctgccttggcctcccaagtagctgggattacaggcgtgcgccaccacacccggctaactttttttgtatttttactacagatggagtttcaccatgttggccaggctgctctctaactcccaacctcaaatgatccatctgccttggcctcccaaagtgctgggattataggcatgagctactgagcctggcctcaatcttatgcttacaattcttaatctgttgcctcattttatagccacagctcaggtgacagctgagggattaccttcgtctgtctctgagcctctaagatttctattttcttcaccaccttccaggaatccttttttctagctcttggttgctggccatgtcctggacagttcagtttaaaatctgacctccagttcatcggtgcatctaccatcaatcctcattacctgcagattctgcagctgtaaattcacgtacttgataatgtttatttatagcccctaaatcaatcccagcagggctttcctggatgtgcgccaagtgctgaagaggttgaatggctgatatgcacggtcccagcagagctccatcgaggagctccttttggtttccgctcttataccataaatgaatgcccttttcttggttgctttggggtttttttttgagacagagtctcactctgccacccaagctggagtgcagtggtgtgattgcaacctctgcctcttaggttcaagcgattctcctgcctcagcatcccgagtagctgggactacaggcatgtgccaccacacccagccaatttttgttttttagtagagacggggttttgccatattggccaggttggtctcaaactcctgacctcagatgatccacctaccttggcctcccaaagtgttgggattgcaggtgtgagccaccatgcccagccagggttctcttaaatgtaatggaaagaggagaattggaaaggcagagagagagaactaggatcctgcatgaatgaatcaagttgagttggagagaaactgtatttataggaaagttaaggctctgagtttggaggccaagcagggtggggatgagcaaagccatgagaaggaaagaagggcttcaaaaaacagctgctccttcttgatagatgcagagaggaatcaggaaagaccgggggccatgcagtgttatttgtagcacttgaatagcttggctcttagagttccaagacctccagctagtgatccagagatgccattagagggcaaaagcgctcgctgctccctcatttgtcaccaggaagacatggtatggccctggtcttaaggacaaattagtcaattgcttattgtatatcacgagatgaacgctgggagagaggaaacgcagggtgtgtaggaagagggcaaaaccggctacatctgacccaccccagagatgaggaaggcttccaggtgggaggtgacgccaggaggtaaccaggtggaaatcaccgtcaagtagcagggacaggagtgcaaaggctcagagggaacttctccaggatcagcagagctcaattgtagggtgtgaggctgtcacagaggctggagaaataagcagtgccttgctaagaagtctgaattttaacctgaagggacatgagagctactgcaggctggtaagcaggggggtgatgctggttggattgcaatgcagagaaaccctgggttggcctgcgtctgatggactggagacacccttgaagaaatcagggtacaggcagtcctccggagtagaaatgaggaaggtgccagctgagaccacagcagtggggaagagtgtgagagggatggaaattgagatgaattcatgggtgtttggcctgtgcagtcacacagtgccccatgctgagagggaccccgagcgtggcttaatgctctgctcttactgtcttaaaattcctcctcattttatgtttgaatctatgttttgttttgttttgagaaagagtctcgctctgacatccaggctggagtgcactggcgccatctcagctcactgcaacctccacctcccaggctcaattgattctcctgcctcagcctcccaagtagctgggactacagccacctgccaccacacctggctaatttttgtatttttagtagagagtgggtttcaccatattggccaggctggtcttgaactcctgacctcaagtgatccgcccacctcagcctcccaaagtgctgggattacaggcatgagccaccgtgtctggccttttttcttgtttttaatggcactccgagagtttgcatcttctaccacacaaacaaagcccagtccagagacagcgtctattcctgtaaagacctagatgcagctcccccagggctgccagcatccatctcacttgccagtgacgttaagagctttcccaccagggaatgtgcctggcagttgtgggcagtctctgtttctcttgctggcagacagaacagttcttctttttttgagacattgttccactcttgttgcccaggccggagtccaatggcatcatctcggctcaccgcaacatccgcctcctgggtacaagcaagtcttctgcttcagctgggattataggcaagcaccaccacgccccggtaattttgtatttttagtagagatggggtttctccatgttggtcaggctggtctcaaactcccaacctcaggtgatccacccacctctgccacttagaaaacaataaacaaatggggtaaaatggtagcactggggaatgtcagcgaagggtataaaggatgtctttgtactattcttgcagcgcttctgtgtctggaaaaataataataaatattacatatttaataactaaatgaatgaaaaagtgtgcaatgtttttgcagatgtcaaccttggcaatgcaataggatcatctcagaagctctgcatgaatatcagtgcccaggctccaacccagagattcatagtcagttagctgggggtgaaactccagacatcggcatgtgtgaaacacaccccaaggtcattctagtgtgaatccagaataataagcagccagcttagcctttagtgtcattgggtgacaggaaagttctaggctggggactttctgagccccccatgtctgcttgttttgagatctgatcttgggggcagcatggtgactcaaaacaggagcacagttgtgggtccagtcttggtccttccactaataagatgggagacgttgggtcagatcccttgcctgtgccaagcctgggttttctcagctgtagaatgaggttaaccaggaagtgcctcagaggccaatgtgcattcaaggaagaagatgcccagctcagtaactgatatggtgtggctgtgtccccacccaaatctctaattatagttcccataatcaccacatgttgtgcgagggacctagtgggaggtaactaaatcatggtgtgggtctttcccctgctgttctcatgacattgaataagtctcacaagatctaattctttttttctttttttgagaccgagtctcactctgttgcccaggctggagtgcagtggcgtcatctcagctcactgcaacctccgcctcctggatttaagcaattttcttgcctcagcctcccgagaatctgggacaacaggcatgagccatcactcctggctaatttttgtatttttatgagagatggggtttcatcatgttggccaggctggtctcaaactcctgatctcgggtgatccacccaccttggcttcccaaagtgctgtgattagagatttgagtcactgtgccctgcctgatctaatggttttataaaggggagctcgcctgcacaactctcttgcctgctgccatgtaagatgtgactttgctcctcctccaccttctgccataatcatgaggcctccccagtcatgtggatctgagtccattaaacctctttttctttataaattacccagtctcaggtatgtctttattagcagagtgagaatggactaatacagtaatccttacacccccggaccccaaaatggagttgccacaagatggcagtctgaaatccttgtgatgtccagctggcagaaaggaatttggatgagtagggctggccaacttctggtattgctggtgggtcctgtcattgtgtgggtgactccttgcacccctggcccttcataggactgaaatctgggagggttcttgggaaaggggctagagaaagcaagaggacaccaattttcttccaggcagtaggaaggcaagctggagaggccaagctcccaagtaaactgaggcacctccactggcccctttgtgaggcacgcttgacctgggttttatggaaagaaagtgccctcaccaaagggtgctaaacaaggccccaggctccacacttgatcccatgtgcccccctctgccctgccctagactcacctaaagctgtactgcccagagtcatggcctcaggccacacgtggctactgggcacttgagatgtggccatctcaattgagatatgctgttagtgtaaaatatacactagatttccaagccgtcatgagcaaaaaaaaaaaaaaagaacataaaatatctcattaagaatttttaagtattcattaatgttgaaataaaaacattttgaatatattggttaaataaagtttactaggagaattcatttcaccccttttactttttctaatgtggtgactaaattatttaatattacacatgtggattacattatatttctattggacagctctgttctaaagtctgcacgttgtccttttgtggcttatttccttgataattttattaaaattaaattgacgggcaaggtgcagtgactcacacctgtaatctcagcattttgggaggccaaggcaggtggatcacctgaggtcaggagttcgagaccagcctggccaacatggtgaaatcctgtctctacttaaaaatacaaaaattagtggggcgtaggggggcatgactataatcccagctacgcggaggctgaggtaggagaatcgcctgaatcctggaggcagaagtagcagtaagccgagatcacgccactgcactccagcctgggggacaagagcgaaaatccatctctaaataaataaataaataaatagaaaaacaaaattgagggccaggcacggtggctcatgcctgtaatcccagcactttgggaagccaaggcaggagggtgacttgaggtcagaagttcgagaccagcctggccaacgtggtgaaatcccatctctactaaaaatacaaaaattagctgggctttgtggtgggtgcctgaaattccagctattccggaggctgaggcaggagaatcacttgaacccaggaggcgaggttgcagtgagctgagattgcacaaaggcgctccagcctgggcgacagagtgagaccctgtctcaaaaaataaagaaagaaataaaaataaattgaggaaggattgagcatgcaaaatagaatcagcctttgaccctgaataccctgcagtgagaattcccctgtggttctcaggcttctgtcattccagcaaatacactcttccctcagcttcactaaaatgcagatattgtgagataatgctcatttctcacagcttgcttgaataataacaatgatcattatagtaatttataacttaatagtcaacattgcctttttaacccagtctgtgagactgaatcgtaaacgtgacattctttaaagctgtcaattaatataccagactgcataaactctaataacttacctttccatggaaagagaatatgtgggtattctctttgaagacaaatggtggagagtagactctcatccaagaccctctggcagtaatgagttgcattccagaaggttccagaaggttctgtggaaggctgcagtttgggattggttctcaggtgtctgtctaactgctttctaaggatgaagacggccgggcacggtggctcacgcctataatcccagcactttgggaggccaagacgggcggatcacgaggtcaggagatcgagaccatccttgttaacactgtgaaacctcgtctctactaaaaatacaaaaaattagccggcgtggtggtgagcacctgtagtcccagctactccagaggctgaggaaggagaatggcatgaacccgggaggcggggcttgcagtgagccgagatcgcgccactgcactccagcctgggtgacagagcgagactccgtctcaaaagaaaaaaaaaaaaggatgaaaactcctggttcgtgctttagcaacatccacaggagcaacagactaagacattcctccacacactaacagaccccggcagtgcagagccacgtgggtcttatctgtcctgttgtccacagtctggttttatcttagacctggcctggtgcaatccatgctgcgtataggcacgccacttaagtttcctgtttgtaaaaagcccctttcattcagtgattcctcagggctttaggggaactttctggaaaccaggaagaaggaaataaaggttgttttactgaggatgggtgacattgggtgcgggacccaaatgagtggtttgagcagaaagtagcctccacgctggactaatgcttggcaacattatgggaaaatttgaggaagccgggagaggagggggcagagtttctttcccagccagccacgggggccaggcagttttggtcctaggatgtctctatgcattcccaagtgattgcaaggcttcttcttgtcatcgtctgagacttggattccccaagcgtccttcttttcctggagtctctgagtcctctattcctgaggcctttcttcagccctcccaatagccctgccatgatttcattgcagggctgtgaccgtctatgacaagccggcatctttctttaaagggacacctctggacctgcagcacaggctcttcatgaagctgggcggcatgcactctccgttcagggcccggtaggcctcccatcctcagctgctttctctcctgctcaccactgccctggcctctccccttctcactgcagacctgggaacacactcatccaggggttggcatactaaggcaaccggccagtctcctgctttggtaagtcaagtttcattgggacacaacacactcattgccttctgagttgtctacagccgcctttgagctacaatagcagaatcgtgttttgcaacagagaacccgtggcctgcaaagcctgaagtatttactctctggccctttaagaaacgtttgtggacccctgtgctgtcttactctcctgccagtgggttcccaggcctgtggcaggatctgtggacctgtgggtcccctggggtgtctcacggggctaaggagggacctttgtgcagatccacacaccctaaggtgtgcccctgggtaagctgcggtggtgtgggagggcgtccctgcaccctcatattgagtccaggggatgataagacagtaagtcccacggagaaaaggaatgagtcagtcttgtttgctgttgtaaccttagcacccagcaacaatattagagaaaggaagcccaggcctcgatggcaggggtggcctggtgctgctgatgtggccgggcaccccaacctttgggagcctgcaggccttgccatggcaggagaagcctgtcctgggtcctgggcctgctctgtggcctctcacaggcttttttcctgctctttcagtttagaacctgaggaaccagccacggagccgtcggccttcatggagcgggatgctgggagcgggctggtgatgtgtctctgcgagtggccagccctgctggtcagcagcacaggctggacaggtctgcacgacccctggaacacttgggcttggtgtgacgggcacctggccaatctgtattctcctcacccctgccagtcctgcatgcccccaccctgccacagtctcaatgagaaggggagggcgtgtgagctggaagaggggtgtctagaaacaggcccctgacattcaattctcttctcatagaggacgaagacttctccatcctgctggcagctttagaaagtaggggtgtagctgtggtgaggagctctgggcttgtcgggggccactgagctgtgagctgcttgcctggcctgcagcatgttcctgtcccgggccactgggtggggcagcctggggacagcggaggtggtggaggtgggctgccctgaatccccagttgggtcattgagtgaccaggccctcaggctgaaatgcctcctccaggagagtatctcacagaggctggtggcctccccacaagagcagtgctctttctccaactgaccaggtgactctggctattgtttatttaaaactttttttctgaatgggcatggtggctcacacctgtaatcctagaactctgggaggctgaggcaggcagatcacctgagttcaggagtttgaggccaacatggcaaaacctgtctctactaaaaatacaaaaattagctgggtatggtggtgggcgcctgtaatcccagctacttgggaggctgatgcatgagaattacttgaacccaggaggcagaggttgcagtgagctgagatcatgccactgcattccagcctgggtgacagagcaagagtctgtcagaaaaacaaacaaaaaaagaaattctatcagaaattccatgtagaattgtttctttttttaaacacagagtttgagcaactgactcttgatggacacaaccttccttctctcgtctgtataacaggtaccgcctgggaccctgggtgtctgtttgattgggggatggtggagggggaggggcacgcagcctttaccctgtgcttcccacgatcttgtctccttaatcttcactgcagctctctgcatagggtcttatactgcttgacgtgggggaaactgtggctcagaggatttcacagcagggcagggagcccagattagaatctgtagataccaagctttctactttttcagtagtttccaagcatctttttgttgttgttgttacatcattagtgtctttttttctttttttttttttttttgagacagagtctctgtcgcccaggctggggtgcagtggtgtgatcttggctcactgcaacctccgcctctcacattcaagcaattctcatgccttagcctcccgagtagctgggactacaggggcccaccacacccagctaacttttgtatttttagtagaaacaggtttcaccatgttggccaggctggtcttgaactcctgacctcaggtgatccacccaccttggcctcccaatatgctcgaattataggcacgaaccactgtgcctggccatgtcattggtgccttaaccaagcctcttttaatttttcaaacggaagagcccctgtgccacagttactgctgctgagccctttcaaggtgactcagtgaggagggagaaaagcggaagtggtgtgggaagaggcggggtctgggccagctgctggtcctgctctcctccctcctctggcctctaggctcccaggagtggtttggagcccgcgccatgtgctctggaggctgtggcagggcagggggagtcctcgtgtcccctgtgcacaacacagacaaaaggctgggtccacccagtggggggtcgggtgccaggccggtgcttaccccgccatgtttgcagcccgaggccagctggctgcaagtgcagggctgtgcgtcaggggtcagggtgcacacacccctgcgggtctcggggctcctgggatgcttcccgaagggcccggatggggcctgactggagctgccgaggggtggagcttctgggaaagggatccctcctagcggggagtgtcttgggcctggggccacttggtagggtcagagacgggtccatagcagtatctgctcttctctgtgaaggcaaagggcctctgacggagtattacagctgcctcatccaccagaagcatttccagcacatccaggtcagcaccccttggctggaggccgaggactagcccctgcttctaggtgagaggccagcaggaggctcagggaggaggcggggccttaagcagcgggaacagaggtgggcgggatgtactttttctgaaaaggtggctctggaggccacttggggacaggacctgggctctggctgaactcccgggaggaggctacttcctggtgtgccagcccctccctgccaggtggccccagaggccctttaccaaggggtttgaggaggccatgtcctttcagcctgccacgccctccattcagtcctcttccttcctgcaggagggctgggcctggggttggggcactgttgcccaggtgtgggagggcagtggctttgggaggtacagggacgatgtgtcaaacagcgtcgcttctcccagtgagatggttctcctttgcctccgtctctttccccgattgatttttccaaatggggagtcgtggcttggtcctgatgcgtctctagagctgcatcttccagcttcaagtgagcagagcagttggaggctgagggccttttcctggcaggactctccagctagtctttgttttagacagtctcgctccgttgcctaggctggagtgcacgatctcagttcatgcaacctctgcatcctgggttcaagcgattctcccacctcagcctcctgagtagattacgggattacaggagcccgccacaacacctggcttatttttgtatttttagtagaaacagggtttcaccatgttggccaggctggtcttgaactcctgacctcaagtgatcctcccgccttggcccccctaaatgctgggattccaggcgtgacccatcacgcctggccccagctagtcttcagaaatattaagctgtttcgctttgttttcacactgacagctggtttgtggtgggtgtgctgtggtttattattattactgttattattattattattattttgagacagagtttcgctcttgtagcccaggctggagtgcaatggcacgatcttggctcactgcaacctctgccttccagggttcaagcgattatcctgcctcagcctcctgagtagctgggattacagacagctgccacgatgcttcgctaattttgtattttttttagtagagatggggtttcaccatgttggccagcctggtcttgaactcctgacctcaggtgatctgcccgccttgggctcccaaaatgctgggattacatgcgggaggtgaacctgggaggtggaggttgcagtgagctgagattgtgccactgcactccagcctgggtgacagagtgagactgtctcaaaacaaaacaaaacaaaatgacaacaaaaaaaaaacaaattgtggttaagtagaaaaagtgtcaacttacattttcagatgtcccagccaggccgtgtggctgcttggccggcttaagccacttgtgcttggtgctgtcgggtgccttatccgattttcactcccctcaggggatgttgcctcactgtgctgggaggatttgtgttcccagggcagagaccagtgctctgaccgcacccctcttgcctagcagggtcggtggacctgggtgtctgtctgcacacgttctccagtggcctggacctgcccatgaaggtggtggacatgttcgggtgctatttgcctgcgtgtgccgtgaacttcaagtggtaggagcagaacccgaatctttctagggatagcttcacagatccaccgctgagggggaagcagtgcagagggagctgcccacagtgaggccctgcccctcggtcagtccagcacacactggaggccacgaggaggagccctgcggttactgtggctgggctgagcctcactgaagtagttgcttccatttagagctcatgttatatttaggctggtacaaaagtaatcacggtttttgccattaaagatggcaattacttttgcaccaacctaatatgaaaaaaaagcatcttaaatactagaactccactcggggcttttgctcctggagtagaattggcgggaattgcctgcaggcttacatggtcttctttgtttctttctctcccaccatgtcccttttggccaagctcacgtggtgggtttgaatcagttgaatgagtgtcatgctgtggcctcactccacccagcatagacgggtgtttggaagggcactgttagaggagattctagaagcagtagccccagcacaagctgagcccttggcccctgctcaggagccggctcatggatgggattcagcgatgtgagcccctcctgtgagctgagctcagggaatgtcgggatcaaatctggtgccctagaaaagtcatcttttatgtgctgagccagtccccagggtgttccctttacttgttccatggccatggaattaagaaaaacatgcaaaaataattcttcagtccttgaagagcatccagcacagaaggtacaaaccccccttaaggctccctcctcaaatcggtttggccacttagatgtgcacccccccaggcctttatacccttcagatgccaaatctaagaacgagctcccggaaaccacaccccctgttccaacccccagcctggcttgagcatggggttgggggggtggagcccaggtgggcaccccaggggtctggtgtcttctccaggcagctctcaggctcccttggttctctctgcagtttaaatgagctggtgaaacatgaagaaaatggcctggtctttgaggactcagaggaactggcagctcagctgcaggtagccacatctgccaccacgccagggtggggagggttctggagactggctccgagccacgctccctgatcccttcttcccacagccagggtgggaccatgtagggtctggcggaaaagctagggagagagcagaggtcacaggccggcccactctgctgtcccgttttggtacagtaggctcaggaaagttaggacacacccccacctgccctctggatttatggagctgacactccacaaatgatgctggagccgggtgggccaggctgcagtttaggaagtgatcaggatcacgtaggtgggcgggcaaagggagcttctgggaccagccttgaaagatgggtggaattctgcaaaggttacttgtttcttattgctaaaagtaatacaccattcttgccaacagaatgattggcaggattttcagtaaaggtccaggtcggaagtcatttagactgggtcccccagtctctgtcagaaccatggtactgacatgtggtgtgaaagtagccacagatcatctgtcgattaaggggtgtggctctgttcaaataaaactttatttacaaacacaggctgtgggctggatttggcctgcaggctgtagtttgtgatccttgattcagacagtttagcaaggctgcaaagaacacagacacccccttgttacccacagatgggtgggacatggccagaggccaaaaggagggtgcttgcaggggaacatacagcatgtagaggccgggaggtactccagggcaccaagtgtgggaaagtgggacacacggggaagtttccagaaagcgtgatgtcaagttggaggcagagcgctgctggggtgtgaagagtctcgagtccaagtgagggagttaagaacttgggaggggttgttgttgggttggggacatggggtcagccaggtggtgacctgggatggggtggggacaggaaatgagttaagctctgctctttatttttttgcagatgcttttctcaaactttcctgatcctgcaggcaagctaaaccagttccggaagaacctgcggtaatcgcagcagctcggatgggatgagagctgggtgcagactgtgctccctttggttatggacacataactcctgggccagaggctaaaaccccgggacccctgctgtccttcccgcagcttcttctcggagtctcagggcaaaccctttcgagcagcgcctcccagtggccagaaggtgaaatgacggcagtggtgccgcctggtgaatgaattggttctgtgacccgggaagctgtgcttggttctgatttcttttctggaggctcagaaacacttcctctcttcttctgttcttcatgccccatgcccctgctagcgtattactgttctgtgacttctgcagtactccttatcctgcgtttggtctccaggtgtcatctttctgccgtgttcctaacattttgattcctgtcttgaaaaaagcacctgctgcaccgtaagcccagggatgtggcagctgcagcgggcttggctttgtgaagaaccgagtgtgtccacggatgtggcagctgcagcgggcttggctttgtgaggaaccgagtgtgttcagggatgtggcagctgcagcgggcttggctttgtggggaacagagtgtgtccacgttgggggaacatcatacttgatacacactttttatttgcacaaagaaaatgctgtttttggagccagagttttcatgtctgattgatggcgattttcttcagaaccagaactgctggcagaaagggagcacccacacgcttagatagctgatgtcttattagagggcagtttgtggttcctgatttggaaattaacattctccaaacattccagtccaatgaaagttttatctgctttcccatataaaaactcttcccacaagagtgacttgattctcacaatcccgttggagtcgtgtgtgaatcctacagtgtgaggttcagcattgccatctccaagtgctcttcgtagggaaatagtttctggtcatgacgagggttccacttcccatctgatcctggcctgcctggaaacagaggacatgtgtttcaggatggcagagtttggggacaggacatgagcgtattgtgtggggctgctaggacaggcctggcggggtcggggggtgtccaagtcagtttacttggttcacaggttcccaggcccacccaggtgcctagaattggcctccaggatgggaccagaaatctggttttgcatagaaatggctagcagcaggcaccgtgccgctgtccagtctctgcccgcgtctgccccagcacttggcacagcgggacagacgcagagatctgaacccacatctacctggctgctcagtcaacccactctccacaaagcttagaaagcagccaggcacagtggctcacgcctgtaatcccaacactttgggaggccaaggcgggtggatcacttgagatcaggagttcgagaccagcctggccaacatggtgaaaccccatctatacaaaaatacaaaaattaggcaggcacgatggcaggtgcctgtaatcccagctacttgggaggctgaggcaggagaattgcttgaacccaggaggcggagtttgcagtgagccgagattgtgccactgcactcgagcctgagtgacagagtgagactccatctcaaaaaaaaaaaaaaaaaatcacacacacacacacacacacacacacacacacacacacacacacacagcttagaaggggctggtgttctcataagcacagatatctgaagagccgttagccagaatgattcttttttttttttttttttttgagatacgatcttgttctgtcacccaggctggagtgcagtggcacagtcattgctcactacagcctcgactcctgggctctagcaatcctcccacttcctgagtagctgggatgacaggtgcgtgccaccatgctagtaatttttttattttgtagagatggggtccggaatgcatggcctcaagtgatgctcctgcctcagcctcttttattattattttttagacagagttttactctgttcccaaggctggagtgcagtggtgcaatctcagctcactgcaatgcatcccaggttcaagtgattctcctgcctcagtctcccgagtagctgggattataggcgtgcaccgccaagcctggctaatttttgtgtttttagtagagatggggtttcaccgtgttggccaggctggtcttgaactcttgacctcaagtgatccgctcacctcagcctcccaaagcctcagcctctaacagtgttgggattacaggcgtgagacactgtgtcctgggatgattttcaatcacagttttttgttacgagtggaaaatgcatatttataaaaatgaagtagtacagacatgaacgtgtagaagtctctataatcctgccatccaaggatggcacctgttaacgtgtatatcaggtatgtccaatcttttggtctccctgcaccacattggaagaagaagaatcgccttgggccacacataaaatacactaatgctagcaatagctgatgagctaaaagaaaaaaaaatcacaaaaaaacctcgtactgttttaagaaagtttacagatttgtgttgggccgcaggttggacgagcctgctatatatatattctaggttttcccctataggtatacttatgtgaaaatgattattgtgataattttattttgagatgaagtcttgctatgttgctcaagggggccacaaactcctgggcttaagccatcctcccgcctcagcctcctgagtagttgggaatataggtactcataactatgtgtgggtgattattattatttttaaaacaaaaatggggctgggtgcagtagctcatgcctgtaatcctaacactttgggaggctgaggcagcagatcgcttgaggtcaggagttcaagaccagcctggccaacatggcgaaacctcgactctacaaaaaatacaaaaatcagccaggcgtggtagcacgcacctgtagtcccagctgctcaggaggctgagatgggaggatagcttgaacctgggaggtgggaggttgcagtgggccgagatggcaccactgcactccagcctgggcaatacaaagccagactctgtctcaaaaaaaaaaaaaaaaaaaaaaggtggattggggcttatactatgtgtgctgcttggcactctttttttcacttcaaagatattgcaggtattttttcacataagtatctgaagaaagacttccttttttttttttttttttttttttttgcatttttgagacagggtcttgctctgttgcccagcctagagtgcagtcgtgagatcagggctcactgcagcctccacctcctgggctcaagccatcctcccacctcagcctcccaagtagttgcgcaaccatgcccgactagtttctgtacgttttgtggagatggggtcccactatgttttccaggtaggtcttgaactcctggtgtcaagaagtccccctgccttagcctcctaaagtgctgggatgacaggcccgagcctcgcacccggccagcctcctgtgcgaggttgtgcgggactctgtcgtggaacccagtgtgtcttcgtgtgctggcttgtttgttggctctgtagttaacgggctgccccacgtggacaggcattggacccgtgtctctctgtgcaggcagaggctgctgcacgtgcatctgtgaacatggctgccaagaggggctgtgctcagggggagctggggcagaggctggtggcaatggggggcttgggtgtagtgtggaggcacgagagccaggtggccgggctacagtctgtgggagcttgggggttgcttgtcctctgtgtgtcccagtgtctttgtcggtgagatgggacaatgatagcacactctcacaggtgctgggggctgacaaatgtcaggtctgaggacagtggctggcccactacggggccagttcccctactctatagtcaccctgctcgtcttccatcaactgggtgctcaggacagtggcatggtggatccgcctgtacagcctgtgctccagcgtcctgcaggccacagcggtgtccagccctgaccatgactgcccctcccgccacctccattttatagatgaggaaaccgaggcccaagggcttagggaatcttgctctgaagcacacagtagggctgctgggctcagatcctccctccctgtgctgagctgccctcctcctgccgcaagtcccccacgccatgagcccaccctgctcaccggcctctgccctagttccccgcatggtgtgggagtgtggggcttcctagcttttaccctgccctcagttctttcacttccactggagtcccgcagggacagctccgggaccatgcaggcccgggtgggcgtgggggctcagctagctcggtggtgaacagctggcacgtctcttggttgcggacggtaagggccacatagacttgaggagcccgttggtgttcccggtaggcagccagcctccgcaggaccccgaccagcgacacaatggcttctgggcaatacggcacgtctacggtgaaagcttcagattactgaaggggaccagcggacagttccaggtcatgctgacctcagcagaagggcgaggccagagaggcagcggtcatatgagactagtagatgccatttgaccatttgggccattagatggaaaggcaattacttgggtgaaaaaggagaacccttagtagagaaagctgcaaaagaccgaagcaaaagaaaaaatctccagactcactggtgttccttaaaaaacgagctctggttctcggcctatctagagggctgtgaatgacacaaagcctgaccctgccatgaacttcgtgtttcaggcgtctgccgatttgtctgctggcttgcaggggtgggcctgtgtccctggccactgctggacctgtggttttcagggctgggacccaggaccacaggcagagctctgttcgacccgagaggagactgagtgtgctggcaggggcgaggggttttcggtggcccagccaaacaccaccttctctcaagggccctgtcctcatcccagaagtggttgttttcctcctgtggtctctgaaagacacaggcatggctctgggacagagccatgtggtgatgactgtaatgggagtatgcctgtctccaaaaagagggctgtggctgtaaggtcaccttaagaggcacccctgtcctttgatgtcaccctggaggcccagagtaactcttctggaagccccatcatgtccatgcccaacagcgtccatcgttcccttttcccagagcccagagctgggtagagctgcaaggacaccgcctgcacagggtgcccggggctgggcattacctgctgcagtgacaacatctggctggatggcagagagctgacggactgtcgcgacatcccagtccagctgggccactgtcaccctggggttgtctaagttggcagagatgtctgcctctaatgagaggccattgagaaggatattccctcggagcttcttgaggacccggctgtgacagtcgctgaagatatatgcccgggggaggcacatcttgcagatggccaggcctgtgaggccggcgccactgccaagctctaggacagtcctggcgggaggaaaggggaccatgtctgcgactgcaccagggtaagcctgcctcggtgccctgccatgcaccccgaggtcacctatgagagaaggctgccgggttctcaatggcccattctgcaaggtagagggcagcatctcatgtgaccaggcctgtgatgccgtgggagatgatggctgtgctctcagagagtgtgactgagcctcccgagggctgcaccaagagagggcgagagagtcagtccagcgatcagaaggcaagtggcttagaagacaagtagccatccaccacatggctgaataaaccatgacaggaccaatcgccactcagcaatgagaagcaactaactgttgacatgccaacagcttgcacgggcctcaagggtgtcatgtggcatgaaagacactcatctcaggccacacaggattccattcattgaacattcctgagacaacggaattctggtgatagagcacaggtcagtggtggccaggggccgggtgtggctatgaaggggtggctgccttgtgatgattcaatatgctatgtttttcctttgtggttttctgtatctatgttttatcttattttttttgagctctgttccccaggctggagtcagtggcacaatcttggctcactgcaacctctgcctcctgggttcaagcaattctcctgcctcagccgcccaagtaggtgcaactacaggcatgtgccaccatgtctggctcatttttctacttttttttgagacagagtttcactctcgttgcccaggcaggagtgcaatggcgtgatcttggctcactacaacctcctcctcctgggttcaagagattctcctgcctcagcctcccgaatagctgggattagaggcacccactaccacacccgctaatttttgtatttttagtaaagagagtttcaccatgttggccaggctggtctcaaactcctgacctcaggtgatccacctgcctcagcctcccaaagtgctgggattacaggcatgagccaccacgcccggcctaatttttgtatttttagtagagacagggtttcaccatattggccaggctggtcttgaactcctgacctcggatccacccgcctcagcctcccaaagtgctgggattacaggtgtgagccaccacacccggacctgtcaagtattctttgaggaatggacaccaggtccttgtgaaggaggtagagtgtgtcacctattggacaaatgcccaacaaccccatgagacatgctgttgttgttgaagtgcttgatttacagacagggaaactgaggctaaagaaggttgacggacctcatgtctaagactgcagaatgggtgagtcaggatttgaacccacacccacgttttcactttgtctgtgcaggaagggtatctgggctgtgagggggaggagggtgcccttcttataccagcaaatagctccggtggccctgggtggactccttggccatcagggtctccgccagcgcctcgtacagctcgtccaaaggctccgtgtggacagcctcctgctgggggcaggcagagtgagagcttgtttgctttcgttctaatctgtaaaaatggtcagatgatttcaccaagtttggaggggagatttgggatggaatggtgtaatactggccagctggcatataaaatattcacttcattgggcttggtggtgtgtgccgaatagtcccagctactctagaggctgacatgggaggactgcttgagcccaggagttcgaggacagcctgggcaagagaccttgtctctaaaaaaaaaattcacttggtagggaaacctggatgggagggccttcaacgagaggtgttgagagggtagtgttaggtgtagtctagggcaggagacaaggatccgtgagagctgccacatgaccatgacagagaggaggaaaacaaaaggtgcttttaagtgagcccaggcagaactgtgagggcggcccatgctgtaggctgtggctgtcagcaggctgcttctccacggctggccccatcctaagattcacagggcagcagcaagatacactgggtgactgctgccctctcctggtggcacagggcagacctgctggtgactacagatgcacccttttggggaggattagggagaaagcaggtattggagaagcaggggattgtttacttgctaaaagtgtggccctttcactcagcaggtctgctactgcctactgaggaatggcctctcgacatccttatgtcaaacgctgcatgttcgggcccatctttaaaatccatcctaggccaggtgcggtggctcatgcctgtaatcccagcacattgggaggccgaggcaggtggatcacctgaggtcaggagttcgagaccagcctggccaacatggtgaaactctgtctctactaaaaatacaaaaattatccaggcatggtggcatgtgcctgtagtcccagcttcttaggaggctaggtacgagagttgcttgaacccaggaggcagaggtttcagggagccgagactgtgccacagtaatccagcctgggcaacacagtgagactctgtctcaaaaaaataaataagtaaaaaataaaatccatcctgtatcagtcaggaaagagcacattccagcaggatcaatgcggagaattcaccagaggaactagttccaaagttatggcaagagctaaaccttccaacaggggcccgtggggcaacccagagacagacaagagtaggaaactccaaacccttcggcgggtaggacagagggtgtgggtgagggttccagtgctgtgggctgggccagcctggtaggaatgagaatccatatgctaggagctggggccccagagcagcagctgcggcagaaaccccaggaggcagagtgagggagagacgctggcctccccttcttcccatcctgcattgtctcccatgggtcacacgcggctgcagccagttgcctggttaggcccctgccacgctggggtttgcaaagcaggcccagggcctgggaaggacgggggctccagcacgcaggtggctatgctgtctggctactgggcggacactccccataactgacctttttgatgagttctgagagaaagcaccgggcatacttgactgacggccggtgcttcacacacacaggatgcttcacagtctaccgcaaaggacagaacgttggttgctcgagagcccgtcttaagcctcctatgagcttcaagccaacacagcagagggcaaactccaggctacccgatcccccagcaaagatgtagatggacacagcgttctggccccatgcatctgaagtttgtcttatgatataagccgtttcctaaaaatgcttccactgcagtggcacaggctatggcagcatttctaacgcccattctgagcaagaacgcagggcacgtgggcccaaaccacctccctcccaggggagccagtgtgaaccagggtttacagtgaggacagtcgccaactgtctggctctatggaagaggcgggaaggcccactcggcaactgctctcttggagcgtgtgtccctggggacaggatggaggggaggggacgctcagggtgacaccccagctaaagccgagagaagccgagtgcaggacgagcaagttccaggcagtggcaacagctggtgcaagctctgaggtggccgcggcctggcacttggaacggagggcagagggactgctgcagcaggagcggggacagcgggaaaacaggagcctggagggagagggaggagacggtccgcagcgcctgctggctgggagggatgcagattctgcccaagggcagcaaagtaccccacgcaatacacaggctcttcaggctgctgctggtttttcattttttctgacacagtctcgctctgttgcccagggtggatggcagtggcccgatcttggctcactgcagcctccgcctcctgggttcaagcgattctcctgcctcagcctcccgagtagctgggactataggcgtgcaccaccacgcacagctaatttttgtatttttagtagagatgggtttttgccatgttggctaggccggtcttgaactcctgaccttaggtgatctgtccacctcggcttcccaaagttctggaattacaggtgtgagccagtgcgcccagccttgtgctgggttttaaagcagctatccctgcatttcatgcttcaccacctacgagagtgaggctcagggtgaaactcagagcagggtgcaagataactgcaggtatctccatgttcgaagccctgacctactgcattgacctgaaagttgcttgagcccaggagttggaggctgtagtgagctatgattgtgccactgcactccagcctgggtaagagagtgaggctctgtctcaaaaaccgaagaaaacaaaaaacaaaaaacagatgctatgtcccattccagaggttgaggtttaattattctggggtggggtgtgacctgggttttggaacactgaaaaaatcccaggtgatcctaaagtgtagatgagtctggaaaccacacacctaaggcacacttgaatgggggagcagtgaggtggtgtgggctagccggccagaacccaggggtgggaaccaacattgcagatgccataaaggctgggaagcatagtgtctggggcccataacaatgcttggacatgaatgctttagacctaagacaattggctcctaaatgtgaaaactgcaaggctgaaatgaatgcatgtttaatgctttgcaacattgtcaagtggtcagctgcaactccgttctgagggcgtgatgcctgagatacgcctgtcatggcggttgattttaatgaatttaatatggtgtggagtggggccttcaaaagtaaaaacgtcagttctaagttggttgcgggggtctgggcaaaggtcttcaaaccccgtggtaaacaccccgattttaaaacagggccttttttccaagagactttttgaaaatagctcctattttgaggggaggaaccctggcgggagagagccagagttaagcccagctgagagggggttggcaggcacgggcctgcctggtcctcactgaaacttgctactcagggtgagcttcctaaaccaatgcagacttgctggcccactgagcctcccagctgagaacctgcatttcgacaaggtcctcagtgcagcaaagtttgagatatactgggctagagcacccaggggacctaaaggttctttgaatactaaggaaaataggcagggtgtggtggctcatgcctgtaatccttgtattttgggaggccaaggtgggtggatcacttgaggtcaggagttcgagaccagcctggaccaatatggtgaaacaccgtctctacaaaagatacaaaaattagccaggtgcagtggcaggtacctgtagtcccagctacatggggagctgagacaggagaatcgattgaacctgggaggcggaagttgcagtggcccgagatcgcaccactgcactccagtctggtgacagagtgagactccatctaaaaaaataaaaaataaataaaataaatataaatactggactagaagacccaggagacccgaagattctctcaaaactaaggaaaataatctaggtcacaaatatattctctttctccttctccccattgcccccccctgccagtaatctttatagactcaaatagagttgatgttctataatcaattctagtcacttttatttatatttatttattttagagatgggggtctcactatgttgatcaggctggtcccaaattcctgggctcgagtgatccatccacctcagtctcccaaagttctgggattacaggcatcagccactgcacttggccatcacttttatttttgatgttcaaattataagctaatatctgtgagaccatagattctttttatgcactcaatacatttttgtgtttaccttacatttttattatggaaaagattctgttttttcgacttgtttctatttgataatgaagccctctgtgcctatcaccagcctcagccgccatcatctcattaccaagctgggttatttggaagcaaatatcttcaatatttagccagtgttcaaatttccccaaccatcctaaatgagtgtttagaatagttgtttcattggaaacaaggtcaaaacaagtacattttacatttttaggccagtcttgaaagtaagtgtaaaaccatgtgtggggtaggaggtgggactagcctctcaaggtggggcctgcataccagacccaattgaggactagctaagacagattccacaatgaataacaccaggaggtgggaatattaaggtccattgcaaaggttggctaccacaattatttgatcaactagttatcaaccctgactgcagctgagagagatttctttttgcttttttttttttttttcagagacagggtcttgctatgttgcccaggctggactcaaactcctgggctcaagtgattcttctgcctcagtctcccgagtagctgagactacaggtgtgtgccactgtgcccagcaagatattaaaatatacgtatgcacggacaccactctaaaccaactaaatcagaatcagatactgtgaagtcattaatcattttgctcctgggtctttttgacagttttgctcctgggaaactcctggcaatgtgttagagagaaagagatgggaaaataagattttaagaagtgttgctatgcattttgaaaataatttttctttggtgttggtcttgagggacggcggtaaacatttcaattgcctttaagtatgcttgcatgctggaatgatggttctctgaatgcagcaacgaactggcattgggccacatggcagccagtgtgagcctttatgccacatttataaaacatgaatgtcatgagcccactctcagggaccttacaatttggagggttaggtcagatccacaaatctcctctatctcatggtaaaggaaacctggcgtgtagcaggagatggtgtgataacaatgtcatattgcatgatcaatatttgtattcttcttggcaatattaaactttcggaccccctccattgtgtcatcaatttgcttaatacagtttctgcttcagcgtcggtttttaggcctggcataagctgtttgaaacccaagcacgtaccccgcccatcatctttggcctagttaacacctcccctccctgtgtggtggtttggagaacctgcttgttcctcatcccactgatcccaaacccaggacaccccacagctgctgaccaggattaaacctaacagagatttaatgcctttcttctgattctcagggactgacattcattcacttaaatacttgcagagtcagccaggcgtggtggctcacacctgtaatcccagcactttgggaggccgatgtgggtggatcacgaggtcaagagttcgagaccagcctggccaacatggtgaaaccccatctctactaaaaatacaaaaattaactggtgtagcagtgcgtgcctgtaatcccagctactcaggaggctgaggcaggggatttgcttgaacctgggaggtggaggttgcagtgagccaagattatgccattgcactccagcctgggcagcagagcgagactctgtctcaaaaaacaaaaaacccaaaaacttgcagagtgaatttaggaaaccatgaagtccagagtttgatccaatcccttcctttttctctttctcaaatattttgagccaggtactattctagattgtcttgtgatatttacaatctaggagaaggcaggagagagaactaagaacagagagcatgttctgagatgtctgctgtgcttgcaggtaccttccctcaatttccctgctcattggccatgctagaaagcaggtcttggcgccatatttgtaccatggtacttcccctccctatactcaattggttggccagaagcccaattgtcgttctctctctctctctctctctctctctctctctctctctctctctctctctccctctccctctctcctccctccctccctcccactccaagatatccagtaactgactgatcagctggtggtgggctctgctggctgccatgatgggccaccagcaagaagggaaaattggttgtgagtgagagaagcagagataaggaagtccacagggctgataggaaagaccatgggctgccgggcacggtggctcacgcctataatcccagcactttgggaggccaagacgggcggatcacgaggtcaggagatcgagaccatcctggctcgcatggtgaaaccccgtctctactaaaaatataaaaaattagccaggtgtggtggcgagtgcctgtagtcccagctaattgggaggctgaggtgggagaatggcatgaaccccgggaggtggagcttgcagtgagctgagatcgcacgactgcactccagcctgggcgacagagcaagactgtgtctcaaaaaaaatgggcttctgagagccagaaagaggcattttggtttctgtaactgcagtttccattctctcatggcctctcatttatttctcgtgcccatgagtttgcctattagagataaggtgtgctcctttccctccagctcatgcaaatggatttctgtttcttacaatcattgttcccagatatggatggtgactgatgctctactaaatgctgaaaaaaagcagagtggaagcacagaaaagagggcttctctgaggaggtgacgttagagcccagttggaaggcaggagtaaatgtgcaccatgattttttaggattaaaaccaagtatctcactgcttgggcacatgtagatagaggtgatttaagagtaaactgtcccagtggtacccattgtcagttacctcaccacagggattatgtagccctgagtttgcttagtgcttatttattttaggttgttgtttatccaaacctcttaaatggtaagcgtttcaaacaagtgacagcatcgttcattgatgttgtggacaaaccactattttattactcaagactgggtaatttataaagaaaaagaggtttaatgggctcacagttccatgtggctgaagaagcctcaaaatcatggtggaaggcaaaaggcacatcttacatggtggcagacaacagtgatgagagctattttagtcattgttcactggccatagaatttacttctatattttgaactaagacaagagccaggcacacaagaccgttacaggtctgtcttttgtttttgatgatgatgatgatgatgatgatgaaatggctgacatggttcatgacttgctttttctcatcatctcagacctagatttttggctggactattgtcttgagatagatgaaaatcattccttgtatcccctgatcttaaagtcaagactgaaccagcctccagacgcaagccttcatggggcttcagataccatgaggaatgggcgtccctgcaatattgtcatggctgtcaaaagtgttattggagctgggcaagtgggcgctctcctgccactgcatcctgcttagattttccattcaacatcaatcttatttcctttttttttttttttttgacagtctcactctgtctcctaggctggagtgcagtggtgggatctcggctcactacagtctccacctcccaggtttaagtgattcttgtgcctcagcctcccaagtagctgagattgtgggtgcacaccatcaagcgtggctcgtttttttttttgtatttttagtagagacagggtttcgccatgttggccaggctggtcttgaactcctgacctcaagcgatccacctaccttggcctctcaaagtgctgggattacaggtgtgagtcaccgtacctggccccatttcctcttataccataagtcattgcccgcagatgtgttttctccattagtttgcaaaagcttccggagagtaggtctgtgcctcatttattctggaatcttcctggcacaaagcacagggctttatcctcagtaggcatccaacaaatgtttaatttcattcaacagctcctcttaccactgcccccaccttatttgcaggtggctaagtacaatcagaacaagtaggtatcataagatttagtccagagtcaatccgggaagaaattaccttagtgatgtgaaaagaaaccaagctctttagtcagaatgtttctgagagtatcccctgtccaagcatttgcggaatttcgatctactaattttcaggtggaacagtatggttgcagagtccatttggacatagatacactttcatgcattcatgtctttaacaataatttgtggccctactgtgtttgttcactaactcctttgaacctaccatataagctatatatttcccttgtaatttgggaggtccaatgcttcattaagctcacatgcctgaaactaatgaagaaaatagctcgttaaccagctagtataaaaatagccaccaaaacaagtcaatcacccgccttaaatcagctcattactcccatcttgagtggagaagccctttctgaatcacattcaagacactgatggaagaacagctctgtctgggtatcaaaaccacgctcaccccacatcctcttccccagagttctactcatttctcacccactgaacccagaacaaaccagaagtgcttgaaatgaggacgggtagctccgtgtaccaattggaatttaaaactatatcaattcctgctatagaaatgaggcttctccccaggaccagcattccatgaaggcagcccttctctagatggagaaatagaacctgaaggcacccgtttccctaaactgctcttgctcatgtgtaagtacaaatgaaaaatgctgaggctgcttctgttggcattgctttataattacggccatcaataaatcattttatccttgaacaagacttgagaatggcccgaaggcagaggcatgattccttaggaattaggccaacagagaatgggctatctctcttcccacctcttctcttactctgctgtcagaaacagaaaagttctctgtgagtagctgggagcagacggcggcactcgagttccatctgggggttctgttgacacagttttaccccagcctgccttgatggccactgccacacaagctgcatctgttctttcttctgcgccttttgttacttcgttatttttcctctttctagtgtagtgagctgaatggtggatttgcacaagatatatccagatccttgtgcctagaatctgttgaggtggcattatttggaaaaagggtctttgcagatgtaattaagttaaggatcttgagatgagattctcctggggtattttaggtaggctgtacatctaaagacaagtgtccttataagaggacactactgtccgggcgcagtggctcacacctgtaatcccagcactttgggaggccgaggcgggtggatcacctcaggccaggagtttgagaccagcctgaccaacatggagaaaccccatctctactaaaaatacaaaattagccgggcatggtggcgcatgcctgcaatcccagctactggggaggctgaggcaagagagttgcttgaatccaggaggaggaggtggcagtgagctgaggtcatgccattgcactccagcctgggcaacaagagtgaaactccttctcaaaaaaaaaaaaaaaaaaaaaaataggacactctttttcatgcacgtccgtgtgaagagaccacaaaacaggctttttgtgagcaataaagctgtttatttcacctgggtgcatgtgggctgagtccaaaaagagagtcagcgaagggagataggggtggggccattttataggatttgggtaggtaaaggaaaaaggggtgctctctggcaggcaggagtgggggtcacaaggtgctcagtaggggagcttttgagccaggatgagcaaggagaaggaatttcacaagataatgtcatcagttaaggcaggaacaggccattttcatttattttatagtggaatgtcatcagttaaggcaggaaccggccatctggatgtgtacatgcaggtcacaggggatatgatggcttagcttgggctcagaggtctgacgttcctgtcttcttatattaatacgaaaaataaaatgaaatagtggtaaagtattaggatggtgaaaattttttgggggtggtatggagagataatgggcgatgtttctaagggctgcttcaagggggattaggggtggcatgggaaccttgagtcgagagattaagctgaaggaagattttgtggtaaggggtgatattgtagggttgttagaagaaacatttgtcatttagaattattggtgatggcctgtatacagttttgtatgaattgaaaaactaaacggaataagagaaggagaaaaacaggcattaaaggacgaagaattgggaggacctaggacatctaattagagagtgcctaaggaggttcagcatagccttgccagcaaagattatttatttaagagttaagagtggtggtttggggatagcaccaggagatatcacctgtgatggcttggagaaacagtgtaaaccaccagtgtaaacaagagcagggcatatatgagtagttgagaacggtgaatagaagtatgactagacagaagacagtagggatgacaagttttttggggcacagtccaagttggtcttgtgtctggaatgagactggggcctaataaaaaggagcgtctatacaggagctcaagtgggctgtaccttatagcattccaaggacaggcctgacttctgagaagggaaagtggtaaaagtattgtccagtcctttttacgttggtggctgagcttggtaagatgtgtttttaaaagaccattagtctgttctacctttcctgaggactgaggactgtaagggatataaaggtttcactgaataccaggagcctgaaaaaatgcttggctgacttgattactaaaggccggtctgctatcagactgtatagaggtgggaaggctaaactgaggaattatgtctgacagaagggaagaaatgaccttggtggtcttcttacaccctgtgggaaaggcccctacctatccagtgaaagtgtctacctagaccaagaggtattttagtttcctgactcggggcacgttgagtaaagctaatttgccagtcctgggtgggggcaaatccctgagcttgatgtgtagggaagggagggggcctgaagaatccctgaggagtagtagaatagctgatggaacactgagaagttatttccttgaggatagatttccacgatggaaaggaaatgagaggttctaagaggcgggctagtggcttgtactatagcatagcctgcctttgctggtgtgtggcgattaggcctggtggaactgccatcaataaactaagtgtgatcagggtgagaaacagagaagaaggaaatgtggggaaatggggtgaatgtcagatggatcagagagatgaagtcatgagggtcaggtgtggtatcaggaataatgtgggaggccggattgaagtccgggccaggaacaatggtaattgtgggagactcaacaaagcgtgagtacagctgaaggagccagggagcagaaagtatatgtggcaggtgtgaggaagaaaatagattttggaagttatgagagctgtagagagtgagttgagcatagcttgtgattttaagggcctttaaaactattagggtggcagcagctgcttcacggagacataatggccaacctaaaacggtaaggtcaagttgtttggacaaaaaggctacaggacgcgatcctggtccttgtgtaagaatttcaactgcacagcgctgcacttcggctgtgtgtaatgaaaagggttgggatgagtcacggagagctagagtagcaggacgagttgcagacaaaactcctcagacaccggattaaagaaggaagaggtttttttattcggccgggagagtcagcagactcgtgtcttaagagccgagctccctgaaaaagaaattcctagcccttttaagggcttacaactctaagggatctacccgaaaaagtcataatagatcaagtaagcgtgagaaatgtgactgggggctacaaacatcagctaacagaacaaaaagtttttacagtgctttctcatacaatgtctgggatttacagataacaccagtagttttggtcaggggttaatattattgatattttaaccaccggggccaggtggtggcgccgagggcgtctagctatttattttacttctgttttttccagctttttgctttctcccttttttcctgtcttataaactagggaaaaagggaggttggggaggaactgggaaggacagcaggagacgtggtggtctcacaccatatttccctcctttgagaattttcacttttagtgggagttctcgctctcatctttactttttgagtctctctgtgagattgaacgatagtgatttatataatacacctgtgctgaagttttctgatgaatcaaagtagcaacaaaaccttttgtcatttgaaaaagcgagggtaatacacgggggagcagcaagcaagctcctatcactagcaatacacctacaatgaggggtttaaatcctcctatagctggaaaccattttccaaataaagactcagggttaaactcgtgccaaatctgtaaaggcacatgtgccacctttgtcatgtccctgactatccttgatcattttaacctcctatccttgatcatttatttgtaggcagcaattggttaagttaaattttccacaaactcctccttcagctactaacaagtagtctaaggccagtctattctgatagatagcattcctcatttgggtttcttgccaagctaaaacagtcaaagctctgccagtttcattagtaattatttctaagacagcctgcaaccgtatgatccaattgagcatgtagatgggggttcggtatccccatgagccatcttgtgcccatgtggcaggcccataatactgtatgatcctttcagggggccactcattatctttccagtttcctataactatgcctttcttttctcgggaagtatagacagggaaacctagcagcttacctgtttttatgggtaataagaaaaaggacggcttaatagtgccaataacacaactgcctgcccatttattaggtaactgaaagtaggctctgtgcctacatatctagtatagtccagagggaactgtccagtcctgatgagattctggatgagccaaagcagtttgtaatttagaaaatttactaaatggattcttttcagtgtggtttaggccctactaagtaattgtctttgttgtgctgttatacaacttctgtcctatacaattaagctttcctacagggatgataaagtctttcccttctctagctatacagtattgtctaataattgaggtttttggacctagaagttgctagcttgggccttctgaactggaattatatcaggagctggatcagtaggcaccaactctcgggcttcccaaggccatctgtctccgacagtggttcctccgcgtacataacaagaagtaacattaagggaatgagctacattttctgctaattggagaaacaaattttttgtctttttcggaagttctggtgctggcagattcagctcctcataaaaggtttgaaatactggttttgggagagcacttgtggacctcccctctaattaaaatggcaacttgagggtttaaccctgtcctattgatccccagggttacacgttctccctttttccaacggggatctagggaatggtaattattagttctagtgggttacagtgactggcagcacaggaggggttggcttcccccttctgaagataaaccgggtcctttttgttcttttttaaagtagcctaaataacacatgtccaatagccacaattttcacaaacccctgactcatgacaaacatatttattttctactctttagctcctttcttaattaagagaaccacatcctatttctagctgtttactattaatggctgcacaagcatcaaatcttaaagttatttgcttggggatttctttttcttctgttctagttattattttacttgtatcacctaggaaaaggccagttcttattcttttttcaaaaacggcggttgcagggggctcagatgggttataacacacatcaggtcggtcatttcttcggctacataccttgtactgagtggcattatacaaacaagtttcttttaatgttcccatacattcataactatagaacagaaagattgttttaatttgctgtcctacttcggtgacctgatgaatacactgggaacagtccccagtttgagtaaggtcagttgaagcccttactgtataagtccaaaatttaagaaaaatgaatctcatgatgagcttcctcaggcttcggccgtgcgtggaccagtcagcttctgggtgtgactggagcagggcttgtcgtcttcttcagggtcactctgcaagggttgtctgggcttggtcttgcctcccaggtttcaggccctgcaggttttatatggctgtgttggatccaggctgggattccttctaccttcacagcggtgggagtgctcaggacgatagtctggggtcctttccaccgtgggcacaaagaggctactttccagtccttgatccacactcgatcatctggggagaaagggtgaactggggagaataagctaacagggcatctctcatttacccaggctgagattgtttgtgtaatttttcataaggcctgtagctgtcgctgtaactcaatttcacctaactctcagggagtgcctggaagtccccgcaatataggagggggcctacgatataatatttcataaggggaatatcctgttcttttagaacgggtacatctaattttaaataataccatagggagagcctgtagccattttaatcctgtttcctgacatactttccctaaactatttttgatagtttgattcattcgctccacctttctgaaactctgaggccagtaggcagcatgcactttccatgtgatccctaacatctttgccaccttctgtactaagtcagccacaaacgccggcccattatctgagctgatccataagggcagtccaaatctaagaataggatctcgaagaagcacacgagttacttcacgaggtttctcagttcgtgttggataagcctccacctaccgagagtaggtgcgcccaagaactagtaaatacttgttacctctacactttggcatctcagtgaagtccacctggagatcttcaaagggggctgctccataagcttgtatgccgggtggaacggctggaccttgcctcgcattatgctgtcggcaggtaacacaccactgcgtcaccgttttggcaaggcctgacaaatgtgagatgtagaaataccagcctaacaacttttcaagtgattcctgacctcaatgggtggtttcatgcacagccagtacaactgcagctcctggcagctgtggcgcagctactctcccatccggtaaccgaattcatccttcctccatcacttgtcctccctctgcctggagaaagtccttttcttctttagaataagtaggtacaagatcaggtgcttgagggagcaggggggctgtgactgatgcccggaatggggcagatgctgcttttcgagcctctgagtcagcgcgggaattccctaaacccaccaaggtggaagctcgctggtgtcctctgcaatgcataactgccaccttgtggggtctccatactgcttttaataattgcaagatttcttgttgatattttatgtctttccccccagagttcaataggcccttttctttatataatgctccatgcactagaagggttaaaaaggcatattgagagtcagcgtaaatgttgacattcttagcttcactgagttctaaggcccgaattaaagcaatgagttcagctttctgagctgaagtgccctggggaaacgatctggcttcaacaacagtgtccagagttaccaccgcatatcttgcacatctctctcctcgtgggttgatgaagctgctcccatccacgtatagttcccagtctactgatgcctaaggctggtcctggaggttaggtctgctagagtaaactgagtccaacacttctacacagtcatgctcaacagggctctctgatactgggagcaaggtggcggggtgcagggtgttaaaaacttcaatggttatacggggattttcacagagcaaagtctggtacttggtgagtctggcattcgttagcccatgatgtcctttagtattcattaaagtcaccacagcacgggaggcctttatgttcaggttctgcccaagagtcagcttatttgcttcttgtactagcagggcagttgctaccaaggccctcaaacacgggggccgtcctttagaaaccctgtctagttgtttagagaggtaggccacccaccttggccagggccccacagtttgggttaaaactccaactgccatcttttctctctctgacacatacaatggaaaaggctttgttagatcgggtagccccaaggctggggctgacataagtctttcctttaactcatgaaaggcttgctgttgctgggatccccattcaaaaccttcccggttcccccactttgtgacctcatacaaaggcttggctaatactgcaaagtttgggatctacagtctacaaaaccccacagcccttaagaattctctcacctgccttctggtcttaggctccggtagattgccaatgacctgctttctttctgatcctaggctgcgctcccccttcggatagtaaatcctaagtaacgtacctgctgtcggcagatctgagcttttttcttggacaccttatacccacagtcctccaggtgccggagtagaatatctgttcccttggcgcacccaactgccgtggggtgtcccagcaaaaggtcatcaacctactggagcaacacgcagtctaggtctctggtgggaaatttctggaggtctcgaggcaatgcctccccgaagatggtggaggagttcttgaacccttggggaagccgggtccaagtgtactgagtagtgacacctgactccggatcttcccactgaaaggcaaacagcttctggctctctggggctaatctgaatctaaagaaagcatctttcaggtccaagcaggtgaagcagctgttctcagctggcagcaaccccagcaatgtgtacgggttaggtactgctggatgtaaagtcactgtagcctgattaaccaagtgcaaatcctgtacaggcctgtagtccttggtcctaggcttgggaacaggcaggaggggagtgttccatggagactgacaaggaactctaattcgaaaagttcttaggtgcttgagatggacctggataccttcaggagcttctctggggaccggctcctgtttttgcctaaacggctgggccctaggcttaacttctataagtatgggggcttggttgactgccaaccctggagggttgtcttccgcccacactcttggccactgcttagccagagctggtcttatctcttggcccaactcagttaagaaaaatctccattcctcctctggggggaccataagggttataatgactcccgttctgggtaactttagcagcaaaaagccatgctctgtaaaagagatagtggctctcagtttgctaagcaagtgccttcccaataagggcaagggacagtcaggcgtggacaaaaactgatgaatcactttatgtcctcctacagtagaagtccggggcaagcagaaagcttgctttgctgaaatccttttggctccgatgacgtcaataatctttttgtataagggggctaccggcgcggttactactgaatgtttagcaccggtatctacaagaaaatcaatgtctttacccctaactgtcatcctgacaataggctctttgggtgtccttgagccctgtccccctcagtccaataacccttctgccaggttgagcagggtcccttcctccttgtctggagcctcttgctccaagtcaccttgttttctttttagctgagggcattttttcttccaatgtcctatttatttacaataaacacactgattacgctgcaagctctgacagccaggctgagtttccttcctgggaccccccttcccttgcctcttttgggggacccttttgattgctgccgctaacaggtcggcatttcgctgggcctgatgtttcttctctctgcagttttccttacggcttgctgcatctctgtttacaaacacctggttagctatttctaataactgtgatgtgttcatccctgcaaacccagcctgattctgcagtttttttctaatgtcttctgtgctttgactaactaaagccgtgttaataatgcattggttttcagggctatggggatcaaagggagtatacataccataggcctcacagtctctcctagaattgtgctggactttcttcttttctctgaattacctcagagaccttgttaacgtttgtggcctcctgggttcccctctttaatccttccaagagagcttccctgtatcggtttagcctttgcatatcctctctttcatttgggtcctactgggggttggttcccagtaactgggtccttccatactcttgggggttttggtagtcagctggtgcatgttcctctagccacttagttgctgcttggagcactctccgcctttcatctgtgttaaagaggaacatgagcaactcgtggcaatcagcccaagtggggttatgggtctggataatagtttggagcaaatcaatcagagcttgtggctttttggtataggatggggtattgttttcccagttgagaaggtgggcagaggtgaagggctggtacacagaaacacgcctccccaccacgtggccatcctcatctatcccagtataccgctgttctcacaggggcatttgtatccccgttttgagtcttaaacgagctgccaagggaggggtttctcctgagtcctcacctcttctcttgtatactctgggtggcctagggatatgtttgtctcgtggaggcacaagcaccgtggactcaaaagtggggagcctctctccctggtaaggggagggcaccactgggatcactggtgccatctcctgcagtgcatcttctgatgttgggtcgaatagaacttcaggagttgatttccctcagcgggtggagcgggatccttccttggctatctgtccctttgctactagcactgctgctgcctgcccccttagccactgtggggggtttagcatcagctgtaaccaagtgtctatgtatggaaactggtctgagtgtcctgacttaccagttaccttgtgccataccttagaaacaagggacctgtccaggcttccttctgatggccatcctacttctaatattggccaatctattttacacaaagttctaagtttccctggtgtcatagtaaccccatagtctccattaaatcctttcttaaaatttttcaacatagttcctagcagagtaggcttactttgtgtctgacccacgtttcctcgagacaaaacaccaagctcacaccacacgcacacaacagaacaaagaatgggtaaaaagggcacacacacactttttcagttttcaccaaaccagaatcaaaaccaaaatcagagtatccagaaatccaagccaggtctaaccaaaaccaaagtatcaagcaattcaagtcaagtcaaaaacaaaaaccaaagtgccagtacaggcacgccgtgggtgatcaggccacacttccactcagatagagtgggcaagttccaaagaccagtcttaccaagtttcaaatgtccggactccaagtgcctgttccttcccagtgttcacccactgcgtcgatcctccacgggggcctaccacacactgctctgacgaggcattccaccgggtcaattgcctacttgggagagctctcagtatccgtgtcgctcaagctggcaggagtcccccgcagggatgctccacagggcaggcctaagccgcctaaagtgctgcctcaactgtccgccaattacctcgcttcccggtcaggtaaccaagactagggtgggggcagtctttaaagctgtcttcaaggaacagaaaggggagtggggaaaggatttaggatctatggggtcagctaggtttccttttgtgagtttatataatggttttgttaggatggcaaaaccaggtatctaaaggtgagagtgtctaaccatgcccaggaaggaaaggagttgttgttttgtagaagggtttggggtttgagagatgagtcacacacgatcggcagggagagcacgtgtgtttttatgagaattatgctgagataggtaacaggtaaggaagaaatttgggcttgactgaagtaatgggggctgtctgtgaagctttgcggcagtacagcccaggtaatttgctgagcctgataggtgtcagggtcagtccaagtgaaagtgaagagtggctgggatgaaaggtgcaaaggaatagtaaagaaagcatgtttgagatccagaacagaataatgggttgtggagggaggaattgaggataggagagtatatgtgtttggcaccttggggtggatgggcaaaacaatttggttgataaggcatagatcctgaactaacttgtaaggcttgtctggttttaggacaggtaaaatgggggaattgtaaggagagtttataggctttaaaaagccatgatgtagcaggtgagtgataacaggctttaatcctttcaaagcatgctgtgggatgggatattggcattgagcggggtaagggtgattaggttttaatgagatggtaaggggtgcatgataggttgccaaggagggagtagaggtatcttctacttgtgggttaaggtgggtggcaatgagacgtggctgtagtccaggaatagtcagggaagcagataatttagttaaagtgtctcagcctaataagggaactgggcaggtggggataactaaaaaggagtgcttaaaagagtattgtctaagttggcaccagagttggggagttttaagaggtttagaagcctggctgtcaatacccacaacagttatggagggaagggaaacaggcccttgaaaagaaggtaatgtggagtgggtagcctccgtattgattaagaaggggatggacttaccctccactgtgagagttacgtagagcatctgtgatggtcctgtaggcttctgaggcaatcgatcgggcattgtcagtcttcagctgctaagccaagaagatctgggaaggagtcagtcagagagccttgggctggagttccaggggctctgggagtggctgccaggtgagttgaacagtccaatttctagtggggtcctgcacagatgggacatggctcaggaggaatcctgggctgcaggcattccttggcctggtggccagatttctggcacttgtagcaagctcctgggagaggcggttctggaggaatgcctggccactgcgctttagccgtttggaagttcttgtgtgctggagatttggctggggtttgtctcacagtggaggcaaggaattgcaactgagaaatatgttgctacttggctgcctctgctctattattgtacaccttgaaggcgaggttaattaagtcctgttgtgggatttgagggccggaatttaatttttggagttttatttaatgtcgggagcagactgggtaataaaatgtatattgagaataagacggccttttgaccttttagggtctagggctgtaaggcaactcagggttgctgccaaacgagtcatgaacggggctggatttttaaatttgatgaaaaagagcctaaacgctatctgatttgagaaaaagaaaaaggagcattaaccttgactatgcctttagctccagccacctttttaagacgaaattgctgggcaggttggggagggctggtcacagaattaaactgcaagccagatccagtgtgaggaggggaggtgataaaaggattatagggtggaggagcagaggctgaggaagaattgggagctagctcagcctggcgaggaggggagaggtcagatgggtctgtagaaaaggaagattagaaagactcagcgacactaggggttgggactgaggggacaggtgggagggaaagaaggaagatttgggatgagttgcattgggaacagagactagggagggaccaatgtgtaagagaatacctggacatcaggcatctcagaccatttgctcattttatgactagaattatctagatattgtaggatggaaaatttgaaagtgccgttttctggctatttgaaaccactgttgggtttgtattggggtcaagcggcattgtagaagaaaataaggcatttaggttttaggtcaggtgtgagttgaagaggttttaggttttgaagaacacaggctaaggagaagaaaggggaatggaggatggaagcttgcccatagtgaaggaggcaagcctagagaaaagagacagtagagacatggagagaagggatggggggttcttgccttccagaaaagagggaaaggggttggggcacagaaataaaaggttggggtgcagagataagaggtcaggttgtggaaataagggatcggggctcagaaataagagggcgggcatggaaataagggatcagggcacagagataagaggtcagggcatgaaaataaggtatcggggtgcagagataagaggtcggggttcttgcccctcccccagaaaagcaggacttgctgctaagggtgaaggaccaaggcaggcatccctgcgtggtctgacacctctgaaacctgggtgaataatcagagaggcgtccctgcaatgattaaacaccaagggaaggctgccttccctagtccatgaccagcgccggagtttcgggtccacggataaaacgtgtctcctttgtctctaccagaaaatgaaaggaattgaaattaagagaagggagatattgaagtgtgatgccaagattggaaggagaaagaggttgagggatagtgagggaggttggagaagagagtaaaaagaagccgcttaccagatttgaaattggtgagatgttgcttgggctggtcagtctgaggacctgaggtcgtaggtggatctttctcacagagcaaagagcaggaggacaggggattgatctcccaagggaggtcccccgatctgagtcacagcacctaatttcacatgcatctgtgtgaagagaccaccaaagaggctttgtgtgagcaataaaactgtttatgtcacctgcgtacaggtgggctgagtccaaaaagagagtcagtgaagggagataggggtggggccattttacaggatttgggtaggtaaaggaaaaaggggggttgttctctggcaggcaggagtgggggtcacaaggtgctcagtaggggggcttttgagccaggatgagcaaggagaaggaatttcacaagataatgtcatcagttaaggcaggaactggccacctgggtatgtacatgcaggtcacagtggatatgatggcttagcttgggctcagaggcctgacactcttcctccagaggaggagacccagacagaagaggaggaggcaaggtgatcacagaggcaaagaatggatcatgcagccacaagttgaggaattctagtagcctctacaagctggaagaggcaaggaatggattcacctctagaacctctgaagaagcatgctcctgctgacatttgattgattttggacttctggcttccagacaattttttttttttttttttttttttagacagaggcttgctctgttgcccagtctggagtgcagtggcacgatctcagttcactgcaacctccgcctcccaggctcaagccattctcttgcctcagcctcccaagaagcagggactacaggtgcctgccaccatgcatggctaatttttgtatttttagtagagacgaggttttggcatagtggccaggctggtctcgaattcctggcctcaagtgatccacccacctcagcctcccaaagtgctgagattatttaggtgtgagccacggcacccggcccagacattgtttgaagccacccatttcatggttctttgctgcagtggttgtggaatatgaatgaactcgtgctgttggttagactttgctgcccttgtgtctgttattccctggcagttctacaaggcctggagctgatacgaaaaacctcccttctttccctaatggtccccagcttccccgttcactgaaggccctgcagtcaggaacagtcaggactttgcacccagttgttgtgggtgtttggccgacccttcctctagtgtgattcatggacccacagcattgcgtcaccagggagcttttggaattgaagactctcagggctcacccggaaggacctgctgggccagaatctgcattttaacaagatgcccacgtgatttgcatacacgttcagatctgagaagcgctagtaggagaggctttaaggtggtaattagatcttttctccacctgcaagaatcttagtttcttcatgttaaatcaattaagtgtggcaatgtcatgggtgttataaaacaaaacaaaatccttacatcaagaatgcaccctggcgtgttatggatgtgggtgaaatgaaatgtctggaatttgctttaaaatatcctaaaatagcaagaaggaaaagaaaagtgggaactggaatgagattggcgaaatgttgacaagttcttgcagtgggatgatgggtgcatgggggttcatcgtgcaattctctccctgctttttgtgcgtatgggaaatttccataatgaaaagttagaggtcgggcacggtggctcatgcctgtaatctcagcattttgggaggctgaggtgggtagattgcttgaacctaggagttcaagaccatcctggacaacatggtgaaaccccatctctactaaaaatgcaaaaattaggcatggtgacaacatgcctgtagtcatgttgaggtaagagtttgagatatgagaatcacttgaacccaggaggcggaggttgcagtgagtggagatcgcagcatttcactccagcctgggtgacagagtgagacttggtctcaaaaaaattttcaattttcttttttttttgagatagggtcttgcttttttgcccaggctggagtgtagtggggtgatcttggctcactgcaagctccacctcccgagttcactccattcttctgcctcagcctccagagtagctgggactataggcacccagcaccatatccggctaattgtttgtatttttagtagagatggggtttcaccgtgttagccaggatggtctcaatctcctgacctcgtgatctgcccaccttggcctcccaaagtgctaggattacgggcatgagcaatcgtgcccggccttaattttgtttaatttttttcttttttgagacaagatctgtagcccaggctggagtgcagtggtgcaatcccggctcactgcagcctctacctcctgggttcaagcgatcctcccacctcagcctcccgagtagctgagaccacaggcgtgtatcatcacacctggctaatttttttccctttttctagaggcaaggtcttgctattttgcccaggctggtcttgaactcctgagttcaagcaattttcccgtctcagcctgggagtaatcccaaagtgctgggattacaggtgtgattcactctatccagcctcaactgtttttcatgactccactttttctcccctcttggaaatgagtagtctttgagggaatgtcattttgtctcaatctctggtttctttgctcagtgcagctgtgtttggggctttgttgatctccaggcctttttcagcagcgttgtccctggagagcaggatgggagctgatggcttctcagcatcttttaacctcagtttaaagatgactatcaacaacatctagtcagcatctgttgctctcggcagctgggacttcatttcctttctctttctccacctctctaacctctttaagactctggctttgtcaggggtacagcatcacctgtgtggcccttaggctctcttacttacatgtgatctgcgtattatgtctttacttcagggcttctcagccagggggtgattttgccccccagagaacatgtggccatgtctggagacaattttggtggttgcggctggaggaggtggtgctactggcagctaatgggtagaggccagggatgctactaaacatcctacaatgccccggacaactcccactaagacaaaagaatgatccagccccaaatgtcaatagtgctgaaagtgagagaccctgattccatcttagagatcatccaagcacacttggccaaattgtttttgctactgtcccatgaagaaaaggcagactcatgactgatggcaacatcgatgggagttttgcttacctcttctttgtggactttgggatacgatgacttaccgtttgtgcaagttgtgcattacatacctccagggggcgccacccacatatttatgaaaatgccaccccaggaattgcacagtacatagtctacgtggcaataagcagttgctctggttttggggttgccctggggtgctctggaactgggaggaattttatctctggccattagaggccctgagcgtgacattgagtatcctttcaagaaaggagaaatgttgaacagagaggacctcatttttataactcttgaccatcatctagttacggagcgtccacttttctcccctgggccatatccatttgacggatgaaaaatcatcaaattataatatcatggcttatacttttgatagattctgcccggaacatggcggtaagagcttctcattttcaattgattcattgggggagagaatatacacagctgtcctaagactttcaatgacacaccatttgcttgatgggatttctttagtttctgtagcataacttattctaactggtcctcaatcactttgcaataaaacctgagattgtgaagatgttcattgtcattaccagtgatggagcagtaagtacagagttctggagagagaaggaattgagagagttaaactagcagaatgagccgctcaccctcagaattgcttttaatcttggtgagaactgaggggaattttgacagggttcagggagactgcggggagtggggctgggaggtggctgtttgcacgtgtggtcagcaaatccagtgaggggttcatgtactgtgggcagccccgcagatggagttgggattgccctggactgagtactgtgtcatcagtactcaagacatcgaggcccaggctggtgcaggagatacattgcactgtgtcagcctttcttctatcgctgctctccaatgacagtccccgattttccactgaggagtcactagtcccccatggcatgtgtgccactggctattccccaccctgatctggagctggggcatgtggtcccagcctggatgccagtgtccttccaccaccctggccacagtgattgggtctgagaagcagattagccaaaggagagacaatcttggaaatttcatgttcatgcttaagaaagtaaaatggaaagcggggggagggtgaggggtcattctgatgatatagttttaggacctggatgtagccacacctgtagctgtcaactctgtgctatagtactgcttttttttttttccttccaatttaaatactttctaaaggcaagatcttgctatgttgcttaggctggttttgaaaattccctttcgtggggatgctttctctgcttcacttcctttctatgacagctcagggaatcagaagacaagggagatgcctttttttttttttttttttttttgagacagggcttgctctattgcccaggctggagtgcagggttgcaatcacagctcgccacagccttgatcttctggactcaagcgaccctcctgcttcagcctcctgagtagctgggactgtaggtggctaccaccaagcccagctaattaattttttttttttagaaatgaggtctcactatgtcacccagactggcctcaaactcctgggctcaagtgatcgtcctaccttagcttcccaaacttacaggtgtgagcccccacaccagtcaacgctgtggtcttatgcacctggtgtcccctacgccctgagcaatgatcctcctgcttcaacctcccaaagtgctgggataacagatgtgaagcagcatgtgtggtccacatagtattcttacgggttaaattgagtcctcctcaaaacatgttgaaatcctaaattccagcagctcagaatgtgaccttatttagaaatagagttattgcggaccgggcgtggtggctcatgcctgtaatcccaacactttgggaggtcgaggcgggtggatcacctgagttcaggagtttgagaccagcctgaccaacatggagaaaccccatctctacgaaaaattcaaaattagctgggtgtggtggcccatacctgtaatcccaactactcgggaggctgaggcaggagaatcgcttgaacccaggaggcggaggttgcattgagctgagaccgcgctattgcactccagcctgggcaacaagagtgaaagtccctctcaaaaaaaagaaagaaagaaagaaataaggttattgcagatgctgttgattaggatgaagtcatcctggagtagggagggcctaagtcaatgactggtgtccttataaaagaggagaggacacaccgagtcacagagacacagggaagaaggccatggattggacagaagattggactgatgcgtatgcaaaccaaggaacactgaagactgccaggaaaccacagaaagctaggaagaggcaaggcaggaatccctgacaagtacaggagggaacgtggccctgctggcacttccatttcagactgctggccaccagagccacaagacaatcaatttctctggtttcaagtcacccagcttttggtacttggttgtggcagccctagggaatgaatataagtactttctttcttttttctttttttgagacggagtctcgatctgttgcccaggctggagtgcagtggcgggatctccgctcactgcaatctctgcctcctgggttcacgccattctcgtgcctcagcctcccaagtagcttggactacaggcacccgccaccatgcccagctaattttttgtatttttaatagagaagagatttcaccctgttagccaggatggtctccatctcctgacctcgtgatccgcctgcctcagcctcccaaagtgctgggattacaggcatgagccaccacacccggccgaatataagtacgtttaaattaactctcctcttctctccatcttcttctaaatcatcatttttgcctaagcaacagctagggtctaatacagatgtgacgactcacttgaaagtgggggaagcccccatgtgcacccaaagctcctgctgccttggccctgggttcagagactggaccatcattttggaggcttgctggagatctgagccagggcatcattctctgttgcctttaaacaaaggctggtgctctcccaggcatgtgagctccaccgaggatctatttggagggcagaattctgagatgaccccttaggttcttgccctggataaatgccaggtgtaatctcctctcccctggagtgtaggcaggacccgcgtcttgtttctaatctatacctatggaaaagttgaagggattttgcagatgtaactaagcccctaatccattcactttgagttaatcaaaagggagattattcagggtgggcctgacatctataggtgagatcttcaatgagggtctggaggagagagactccttcctcctggtttttgtttgtttatttgtttttgacatggagtctcactctgttgcccaggctggagtgcagtggcaaaatctcggcttactgcaacctctgcctcctgggttcaagtgattctcctgcctcagcttcccaagtagctgggattacaggcgtgcgcaatcatgcccggctaagttttgtatttttagtagagacggggtttcaccatattggccaggctggtctcgaactcctgacctcaggtgatccatctgcctcggcctccgaaagtgctgggattacaggcgtgagccaccatgcctggctggttttgaagaagccagccacatgagttccacagttgcatggaaataaattctgccaacaaccatgtgaggttgggagaagaccccaagcctcataggagacactaattcccgccaacaccttgatcacaaccttgtaagaacctgagcagagggcccagctaaagctgcacccccagactcctgacccacaggaaaggagagggaatagatgggtgttttaagctgctaaatttgtgttgatttgttatgcagcttagaaaatgaatacatcattccatttttaaaaaatcataagctaatcacaccactcgaattcttttttttttttttttctttgaaacagagactcactctatcgcccaggctggagtgcaatggtgcaatcttggctcactgtaacctctgcctcccaggttcaagtgattcccttgcctcagccacccaagtagctgggactacaggcatgcacaaacacacccagctaatttttgtatttttagtagagatggagtttcaccattttggccaggctggtctcgaactgctgacctcaagttacctgccttcctcagcctcccaaagtgctggggttactgacatgagccactgcacctggcctgacgtactattcaattttaaggaacttccaggttctgtggtcatgcccctcttgtgtggcatgcaggtggggagagatgggttggaagatgactggatgggggcatggagttaggtgggaagaggaaaagtgtcttgaaggaagtaagtcccttcagataagggagggagaagcttgatcaatatgcagactttcacagtccttcagtccttgggatattggaggagagacaggtcttgccttatatttgagagttaccatcccaggcagaggccctacttccaccttcttgcatgtggggctggggggcaaatacttagaggagaaacgaacaccctttgtaagtatgtgaaaagtttctggagtggagagatgatgaagcaggatatttggagtcaacagcaaaagtttttatttcattttttattttttattatactttaagttttagggtacatgtgtacaacgtgcaggtttgttacatatgtatacatgtgccttgttggtgtgctgtacctattaactcgtcatttcacattaggtatatctcttaatgctatccctccctcctccaccgaccccacaacaggccccggtgtgtgatattccccttcctgtgtccatgtgttctcattgtttaattcccacctatgagtgagaacatgcggtgtttggtttttcgtccttgcaatagtttgctgagaatgatggtttccagcttcatccatgtccctacaaaggacatgaactcatcattttttatggctgcatagtattccatggtgtatatgtgccacattttcctaatgcagtctactgttgttggacatttggcttggttccaagtctttgctattgtgagtagtgctgctataagcatacgtgttcatgtgtctttatagcagcatgatttataatcctttgggtatatacccagaaatgggatggctgtgtcaaatggtatttctagttctagatccctgaggaattgccacactgaattccacaatggttgaactagtttacagtcccaccaacagtgtaaaagtgttcctatgtccccacatcctctccagcacctgttgtttcctgacttgttaatgattgccattctaactggtgtgagatggtatctcattgttgttttgagttgcatttctctggccagtgatgatgagcattttttgacgtgtcttttggctgcataaatgtctgcttttgataagtgtcttttcatatccttcatccagtttttgatgggttgtttgtttttttcttgtaaatttgttggagttcattgtagattcttgatattagccctttgtcagatgagtagattgcaaaaattttctcccattctgtaggttgcctgttcactctgatggtagtttcttttgctgtgcagaacctctttagtttaattagatcccatttgttaattttggcttttgttgccattgcttttagtgttttagacatgaagtccttgcccaggcctatgtcctgaatggtattgctgaggttttcttctagggtttttatggttttaggtctaacatttaagtttttaatccatcttgaattaatttttgtgtaaggtgtaaggaagggatccagtttcagctttctacatatggctagccagttttcccagcaccatatattaaatagggaatcctttccccattgcttgtttttgttaggtttgtcaaagatcagatggttgtagatatgtggcattatttctgagggctctgttctgttccattcgtctatatctctgttttggtaccagtaccatgctgttttggtaactgtagccttgtagtatagtttgaagtcaggtagcatgatgcctctagctttgttcttttggcttaggattgacttggcaatgtgggctcttttttggttccatatgaactttaaagcagttttttccaattctgtgaagaaagtcattggtaacttgatggggggatggcattgaatctataaattaccttgggccgtatggccgttttcatgatattgattcttcctactcatgagcatggaatgttcttccatttgtttgtgtcctgttttattttgttgagcagtggtttatagttctccttgaagagttccttcacatcccttgtaagttagattcctaggtattttattctctttgaagcaattgtgaatgggagttcactcatgatttggctgtttgtctgttattggtatattagaatgcttgtgatttttgcacattgattttgtatcctgagactttgctgaagttgcctatcatcttaaggagactttgggctgagacaatggggttttccagatatacaatcatgtcatctgcaaacagggacaatttgacttcctctttttttaattgaataccctttatttccttctcctgcctgattgccctggccagaacttccaacactatgttgaataggagtggtgagatacggcatccctatcttgtgccaattttcaaagagaatgcttccagtttttgcccattcagtatgatattggctgtgggtttgtcatagatagctcttattattttgagatacgtcccatcaatacttaatttattgagaatttttagcctgaaggttgttgaattttgtcacaggacttttctgcatctaatgagataatcatatggtttttgtcattggttctgtttatatgctggattatgtttactgatttgtgtatgtcgaaccaatcttgcatcccagggaggaagcccacttgatcatggtcataagctttttgatgtgctgctggattcggtttgccagtattttatagaggatttttgcattgatattcatcggggatattggtctaaaattctcttttttgttgtgtctctgccaggctttggtatcaggatgatgctggcctcataaaatgagttagggaggattccctctttttctattgactggaatagtttcagaaggaatggtaccagctcctccttgtacctctggtagaattcagctgtgaatccgtctgttcctggacttttttttggttggtaagctgttaattattgcctcaatttcagagcctgttattggtctattcagagattcagcttcttcctggtttagtcttgggagggtatatgtgtcgaggaatttatccatttcttctagattgtctagtttatttgcgaagagttgtttacagtattctctgatggtagtttgtatttttgtgggattggtggtgatatcccctttatcaatttttattgtgtctatttgattcttctctcttttcttctttattagtcttgctagtggtctatcagtttttttgatcttttcaaaaaaccagctcctggattcatggattttttgaagggtttttggtgtctctatttacttccgttctgctctgatcttagttattcttgccttctgctagcttttgaatgtgtttgctctttgcttctgtagttcttttaattgtgatgttagggtgccaattttagatctttcctgctttcttttgtgggcatttagagctataaatttccctctacacactgctttgaatgtgtctgagagattctggtactttgtgtctttgttctcattggtttcaaagaacatctttatttctgccttcatttagttatgtacccatagtcattcaggagcaggttgttcagttttcatgtagttgagcagttttgagtgagtttcttaatcctgagttctagttggattgcactgtggtctgagagacagtttgttataatttctgttgttttacatttgctgaggagtgcttcacttccaaatatgtggtcaattttggaataagtgcagtgtggtgctgagaagaatgtatattctgttgatttggggtggagagttctgtagatgtctattaggtccgcttggtgaagagctgagttcaattcctaaatatccttgttaactttctgtctccttgatctgtctaatgttgacagtggggtgttaaaatctcccattattattttgtgggagtctaagtctctttgtaggcctctaaagacttgctttatgaatctgggtgctcctgtgttgggtgcatatatatttaggatagttagctcttcttgttgaattgatctctttaccattatgtaatggccttctttgtctcttttgatctttgttggtttaaagtctgttttatcagagactaggattgcaacacttgccttttttttgttttccatttgcttggtagatcttcctccatccctttattttgagcctaggtgtgtctctgcacatgagatgggttttctgaatacagcacactgatgggtcttgactctttatccaatttgccagtctgtcttttaatcggagaatttacccattgacatttaaggttaatattgttatgtgtgaatttgatcctgtcattatgatgttagctggttatttcgctcattagttgcagtttcttcctagccttgatggtctttacaatttggcatgtggctggtaccaatttgcagtggctggtaccagttgttcctttccatgttcagtgcttccttcaggagctcttgcagggcaggcctggtagtgacaaaatctctcagcatttgcttgtctgtaaagtattttatttttccttcgcttatgaagcttagtttggctggatatgagattctgggttgaaaattcttttctttttttttttctacagtgatgactttattttatttttttatatttcttttttaaaattaattaattaattaattaatttattttttaattgatcatttttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgtgggtaaggtcacagatcaacaggatcccaaggcagaagaatttttcttagtacagaacaaaatgaaaagtctcccatgtctacttctttctacacagacacggcaaccatccgatttctcaatcttttccccacctttcccccctttctattccacaaaactgccattgtcatcatggcccgttctcaatgagctgttgggtacacctcccagacggggtggtggccgggcagaggggctcctcaattcccagtaggggcggccgggcagaggcgcccctcaactcccggacggggcggctggccgggcggggggctgacccccccacctcactgctggatggggcggctggccgggcggggggctgaccccccccacctccctcctggatggggtgctggtcgggcggggagctgacccccccacctccctcccggacggggcagctggccgggcagaggggctcctcacttcccagtaggggtggccgggcagaggcgcccctcacctcccggacagggcggctggccgggcggggggctgacccccccacctccctcccagacggggcggctggccgggtggggggctgacccccccacctccctcccggacggggcggctagctgggcggggggtgacccctcccacctcccttccggacggggtggctggcctggcgggggctgacccccacctccctcccggacggggtggctgcccggcggagacgctcctcacttcccagacggggtggctgccggacggaggggctcctcacttctcagatggggcggccaggcagagacgctcctcacctcccagacggggtcacggccgggcagaggcgctcctcacatcccagacggggcggcggggcagaggcactccccacgtttcagatgatgggcagccgggcagagacgctcctcatttcctagatgggatggcggccgggcagagacgctcctcactttccagactgggcagccaggcagaggggctcctcacatcccagacgatgggcagccaggcagagacgctcctcacttcccagatggggtggcggcccggcagaggctgcaatctccgctctttgggaggccaaggcaggtggctgggaggtggttgtagcgagccgagatctcgccactgcactccagcctgggcaccattgagcactgagtgaacgagactccgtctgcaatcccggcaccttgcgaggccgaggctggcggatcactcgcagttaggagctggagaccagcccagccaacacagcgaaaccctgtctccaccaaaaaaatacgaaatccagtcaggcgtggaagcgcgtgcctgcaatcgcaggcactcggcaggctgaggcaggagaatcaggcagggaggttgcagtgagctgagatggcagcagcacagtccaggtttgactcggcatcagagggagaccgtggggagagggagagggagagggagagggagagggagagggagagctacagtgatgaaaattcttttctttaagaatgttgaatattggcccccactctcttctggcttgtagagtttctgccaagagatcagctgttagtctgatgggcttccatttgtaggtaacccgacctttctctctggctgcccttaacattttttccttcattttaactttggtgaatctgacaattatgtgtcttggagttgctcttcttgaggagtgtctttgtggcgttctctgtatttccttaagttgaatgttggcctgccttgctagattggggaagttctcctgcataatatcctgcagagtgttttccaacttggttccattctccttgtcactttcaggtacaccaatcagatgtagatttggtcttttcacatagtcccatatttcttggagactttgttcatttctttttattcttttttctctaaacttctcttctcgcttcatttcattcatttcatgttccatcactgataccctttcttccagttgatcaaattggctactgaggcttgtgcatttgtcacgtagttcttctgtcttggttttcagctccatcaggtcctttaaggacttctctgcattggttattctagttagccattcatctaattttttttcaaggtttttagcttctttgccatgggttcaaacttcctcctttagcttagagtaatctgatcatctgaagccttcttctctcaactcatcaaagtcattctctgtccagctttgttccattgctggtgaggagctgcattcctttggagcaggagaggcactctgatttttagagtttccagtttttctgttctgttttttccccatctttgtggttttatctacctttggtctttgatgatggtgacgtacagatggggttttagtgtggaagtcctttctgtttgttagttttccttctgagagtcaggaccctcagctgcatgtctgttggagtttgcctgggtatcagcagtggaggctgcagaacagcagatattggtgagcaggaaatgttgctgcctgattgttcctctgcaagttttgtctcagaggagtacccggccatgtgaggtgtcagtctgcccctactgtggggtgcctcccagttaggctactcgggggtcagggacccacttgaggaggcagtctgtccattctcagatctccagctgtgtgctgggagaaccactactctcttcaaagctgtcagacagggatatttaagtctgcagaggattctgctgtcttttgtttgccagtgccctgcccttagaggtgcagtctacagatgcaggcaggcctccttgagctgtgttgggctccacccagttggagcttcccagctgctttgtttacctactgaagcctaggcaatggcaggcgcccctcccccagccttgctgtcaccttgcagtttgatctcagactgctgtgctagcaatgagtgaggctccatgggtgtagggccctctgagccaggcatgggatataatctcctggtgtgccatttgctaagaccattggaaaagtgcagtattagggtggaagtgacccgattttccaggtgccgtctgtgacccatttctttgacctggaaagggaattctctgaccccttgcacttcctcggtgaggcaatgcctcgccctgcttggactcatgctcactgcactgcaccaggtgtcctgcacccactttctgacactccccagtgagatgaacccagtacctcagttggaaatgcagaaatcacctgtcttctgcgtcgctcactccgggaactgtagactggagctgttcctattctgccatcttggctccacctccgctattatgattcttacacagagtcctttgcttttcagcagcctccttttcctcctttttaggttggaatccctctgttttagtggccactgggattctgaaatgaccaggtctttgtctcagagacctgacacatgctcttccctctgcctggaacacatttccttgttctggtcccctgagaactctttcagctcaactgccccatgctcagagaccccctttctccctctctagtttgaagccagtttactcctgtagtctgcgcctggaaaactcgttttcctccttgatgcctcccgagttgtcacgggatgtatgtgtctgtttgggtgtctggtgtctgtctccccgactggactgcatgctcctggtgagctggagggactggactaacacaggccaagactctggggctggagggagcagggcagaaggcacaggcaaaaggcctttgtgatccggaaggaagtgaaggagagggagagagatgagagaggctggcagaagatgggccaggcgccaggctgtgtgggatcttttgagccacagaaagacatttgaattctcatgtaagagaaccagaacaccattggagggtatgagtcacctcatctaactgagctctgtaaatgtcaatgttttattatttttatacaattatttaaaagtgactttagttatttacctttttatttttattacttttattttttttgagacaaaatctttctctgttgcccaaactggagtgcaatggcatgatcttggctcacttcaacttcaaccccacaggttcaagcgattctcctgtatcagactcccgagtagctgtggttataggcatctgccaccaagcccagcttatttttgtatttttaggatagacgacgtttcaccatgttggccaggctggtcttgaactcctgacctcaggtgatccacccacctcagcctcccaaagtgctgggattacaggggtgagtcactgtgcctggccctatttacttttttaaaaaagatcaggccaggcatggtagctcatgtctccaatctcagcactttgggaagctgaggtgggatgttcacttgaggccaggaattcaaaaccagcctaggcaacatagtgagacaccccctgccccaattcctaagaaaatgagaaaattagacacggtggcttgtctgtatccccagctactggggagcctgagctagggaggactgcttgacaccaggagtttgaggctccactgagctgtgattatgccacagtctgggcaacagagtgagaccccggagcctcctcagcctccctagagctgaccgagcttttgcttcttatcacagggaatgacggacgctggggctttgatgggcatcgggtgaaatgggcagagtggcgcttacctgtgatggcagtgaagtgggacggggaggtcattgtgacaaggggtggcatgaggtacttggccttgacgccctcctcggccagatggtccaggttgggggtgtccacatcctcatcctagttccagcggaagccctggaaggtgatcagcagcagctgtgagtgctcttcttccctgggacggggtggccacccagtaggacaggcggcggcagcagcagctggagggcaccgagccatgtcatcctacaagcacctgtcatgcactcctcacagagttcatgggcttcgccctctttagtccgttgttgaacaaagtccacattaataattcagcccagctctgttgtgggacagacaacctggagtgaagcaaggtgctgcatatttgcaggacaggatgaaagcgttctggggttggatgggggacatggttgtacaatgtggtggacgcacttaacaccactgaatttttcctttgaaaatggctaaaataatagattttgtatgtactttaccacaataaaaaatcaaactggccggacatggtggcttacacctgtaatcccagcactttgggacgccaagatgggtagatcatttgaggtcaggagttcaagaccagcctggcccatggagaaatcccatctctactaaaaatgcaaaaattagccgggcgtggtggtacatgtctgtaatcccagctacttgggaggctgaggctggagaattgcttgaacccgggaggcggaggttgcagtgagccgagattgtgccactgtattctaacctggacgatggaacgagactgcatctccaaagaaaaaaaaaatcaaactacatgaaatattttggactcttatactaattcgccacatgaaatattttggactcttatactaattccaacattttgaagatctggggagaacaaactagattggtgctttccttggcttagtatgtcctgtttttatagggagagcaaatttttttcaccagcactattaaaatagctacaacaggatgggcatggtggctcacacctgtaatcccagcactttgggaagctgaggtgggagaatcgcttgtgcccgggagttcaagatgccagcctgggcaacatggtgagaccctgccactaccaaaaaatacaaaaacaacaacaaaaacagctaggtgtggttgtctgcacctgtagtcccagctactttagaggctgaggtgggaggatcacttttgtccaggaggttgaggctgcaataagccatgattatgccactgtactcagcctgggtgtcagagtgagaccctgtctggggaaaaaaaaaaaaaagctgcagtggactcagtgaccatgaggccaggcactgtatacatatacgtcatctcatttaattttttctcttgtttaaaattattttttcctctaatccccatgttgatcgacatttttttaatcctaggaatatattagttgaaaatttcacataagaattaaaaattgcctggcctgatggcttacacctgttatcccagcactttgggaggctgagatgagagaatcacttgaatccaggagtttgggccagtctgggcaatatagtgagaatgcaactctataaaaaaaatttaaaaagctgggtgtggtaggattcacctgtagtcccagaaacttggaagactaggtgggaggattgcttgagcccaggcggtaaagacagcagtgagctatgattgtgccattgcactgcagcctaggtgacggagtgagactctatctctaaaataaatgaataaaattgtggtataacatatgcaacttttaccattttgtgcatctgaaagtgtacaattcagtgacattttgtacatttatcatgttgtgcaattatcaccactacctagtttcagggctttttcaacacctcaattggaagcctcatatccattcagcagtcactctccatgccctctcctctgcagccctcggaaacctctcatctactttctacctctgtcgattggcttagtctgaacattgcatataaatggaattgtacaatatatgacctttcatgtctgcttctttcactcagcatgtttttaacgttcatccatatcacagcatggataagttttattttctttttagacgctatctaaaaagaaaaaaaaattataaaaaacaaaaataaaaaattatataggatggagatcagatgagtcctgcaaagtttataatatttactatctagcagtttacatagaagcttgcctacctctgaatgatatgcaggtacagagatgacatttatcttggcacttatagaaagacctataaattgtataaagacatcatcattggatttccagtaacaagaagcggcaagacatgacagtgtgtccaggtgttcaggtgaagtttagggaaggtcttgtcttgacgaggtcggatgtgagacccagatgagataaccccatttcccctgctgaaattgcctgagaatttcattccagttatttgcgtaggttgattctttcggtgggggtggggtgggtgaggaggtgaagtgtcaggggagttctattgtgtatttgcacaacttggctttcttttcacttggtgtggggttttgctgtctgaggaatttcatagaattttgtgatgagtatgcagcatagtggtttgaatcctgccaggccgagggtcatatctcagctctgcaactcattatctatgacgccttggggcaggtcccataactccccaagcctctgttatatattccatggggttgtgaggttcagatgaaataatgcatgctggcgggaatggttactgctcatgggatttccatgtgctccccgtattcaccagacccccagtagttagatggatccatgccagggtccagtgctctataagtggaagtcactgacttcacctctagtctacagcttttgagggcttggggataactatctcattctctcatctcatggtgcagtaactatgggagaatccttgcattaagatggtagaatttccatcattctaggtcttcgagtggccatatggagcacaccgtacccagccaacccattgtggacatggaatgtaagaaatcaaccttggttgctaagctgctgagtctctgtggttaatttgttactgcagcataacctagtccatcctgatgcatgcagcatgcaaaccacttatgttgacccttagtcatggtaagtgctccacagatgttggttacttttggtaggaagatagattgcctctgaaagttttgttagctgatctcatgatgccaatgttgctattttgtaattggataaattggacttgtctctccttccagcaggtgggagagaaagatgactgagagacaataaagcactattatcttcagtttgtgtccttggatacccttggtggcaatgaacaatgtatgctcctctgagaaaactggacttaaatgagaatgggaggtgataccagaattgggaacgtccaaggccccaggcattccctggtctggagacaactttgagtccttggtgggaagattctccaagggaacataaatgcttttactatctagtttgtctctttgagaattaaaacatttttttttcattccagtagcttctgggatacagtttgtctctttgagaattgcatactaattaattttaggggtcatctgtacacatctctatattcctgaaacatggtagaaacagccagcagtcagacaacaatctaccatgaccactaaaacatccccaaagtgaaacaccagatgtgacccactaggtttagtggggatggctggctcgagagttgattatatttattattgtcactgtggtgattatggccacaacattgtgatgcgtgttggtcttcttttggtgagttgcagtttggaaggaataaatccattatttttttgtttgagtctcgctctgtcgcccaggctggagtacagtgatgccatctcagcgtgctgtaaactctgcctcccaggttcaagtgcttcccctgcctctatggccaggctggtcttgaactcctgacctcaggtgatccacctgcctcagcctcccaaagtgctgggattacaggcgtgagccaccatgcccggccctattattcatttaaccaatatctattgaacacattgggtgtggtggaggatgaactgctgactatgttttcaagttgtcctaatactccactgtgggacacgcaggcttgtgggtcccagagctccagaagcatcttctgaccgcaccatcctgacccagattctactgaaaaatacgtgagtctagcagagccatctctgacacttcccttcttttgaacggctgatctgtcagtcatggggagctcttatgaaagtgtagtgtgttttgtgaaacttgaggttggtcaaagaataccattaaactttgttaagaaatctacatattgatgacataggcagtggggtggaggtgggaaaattcccaaatacattttaggaattatctcagaaggaggtaatagtcagaactcttggttgccagtgacagaaactcatcttactagtgtggagtacaaaaggggtcatgtttttgtctgcactccccaaccccaagcagatcctgaaagagggacaggattgcaagtggattatttaggagatgattccagggaacaccaataggggagtgaggaactgattcatggaaaggcaggaggccacacaggggccttcaatgagcagcttaccactccaggcaactaggatttgaccccactggggacctctgggaggtgatgtggaatgcatttcaaagttgttccatccagggggcaaagatattgaagcatttatagcctagctcccatccgtcactggctgaggacaggtcccagggcatcaactctctggcttttcttttttctttttttttttgagacatagtcttgctctgttacccaggctggactgcaatggcatgatctcggctcactgcaacatctgcctcccaggttcaaacgattctcttgcctcagcttcctgagtagttgggattacaggtgcctgccaccatgccctgctattttttttattttttgtagagacggagatttgccatgttgatcagtctggtctcaaactcctgacctcgtgatccacctgcttcggcctcccagtgttgggattacaggagtgaaccactgtacctggcttctgtggcttttctgacataatccatgcctgactttgagaaagccctcaggtgaaagtcttggttgtatgtagtagcaagcatgtactagaatgataaaaaccaaggggtttaccataagatctctctctctatctctgtctctagctttgtctgcatactggcttaatttcttcttactcaagctttttctccataaggtgagaaacgtggccacaaaagctcctatatttctcactacacacagttcctgtcatcacggagaatgattaaattggtctagttacagtttggaaaaatattcaagggaagaattctgattggccaatttaggccagattctcatccctggaccaatcaactgaggccagaggggtggagtcatgtaagaatatggcagcccctatgagagccacgtgactggagtaggaagtgtgagtctctatagaggggagggctgctaggctgaaaaggcaatagatgtctgcagtgaaaggaatagatcaggagatacattctgttaaacctgttaattatttttgaaaaaagagaaactttcaatatacagttatagtataagtaagcgggtggctcacgcctataatcccagcactttgggaggctgaggtgggcagatcagaggtcaggagttcgagaccaacatgaccaacatggtgaaaccccgtcttgtgtgcctgtaatcccagctactcaggaagctgaggcaggagaatcacttgaacccagaaggcggaggttgcagtgagctgagatcatgccactgccctccagcctgggcaacagagtgagactcggtctcaaaaaaaaaaaaaaagttacattgtggttcccacagcatgatttatcagaaaggaaaaacttaaaatatgcgtattttctatgcacaggctactgctatgaattcaaattcttaaattccaaagattaactaaaatgtttctcaagacacataaactgttagaatctgcttataatgaggctgaagttgagtaagaagagaactggcatttgggaccctacttttcttctgtcgagtactgtcaagttttggttctgcctggaagtagatgcacctcaagggagggttacatgtaaagttgtgtgtgtgtgtgtgtgtgtgtgtgtgtgtgtgtatggtagtttccaaagatgggtacaactttctgcaaatgctcgtgcagtgtaatcgaaccaatctttcctttaagaggtagagtttatatttctctacataaatctgggctgcctatgacttgctttggccagtggaatgctgccaaagtgatggtgaccaacttctagccgtgaaaggaaaataaaccttgggtccccaagatcactaagctaggctgggctcggtggctcacacctgtaatcccagcacttttgggaagctgaggcaggcggatcacctgaggtcaggagttcccagcactttgggaagctgaggcgggcagatcacctgaggtcaggagttcaagaccagcctggccaacatgacaaaaccccgtctctactaaaatatatgaaaattagccaggcgtggtggcaggcgcctgtaatcccagctacttgggatgctgaggcagggaaattgcttgaacactggagttggaggttgcagtaagccgagatggtaccactgcactccagcctgcgcaacagagcgagactctgtcccccccaacaaaaaaaagttactaagctaaagagaaaagtcaagctgggaactgcttaggggaaacctgcctcccattctattcagttacccctttgctcactgagataaatgtatatctgattgcctcatttggagaggctaatcaggaactcaaaagaatgcaaccatttgtctcttaactacctatgacctggaagcccctaccccttgtctcaccatcaccttcacctggacttgtcccgactttccagactgaaccaatgtacatcttacacatattgattgatgtctcatgtctctctaaaatgtatcaaaccaagctgtgtccccaccaccttaggcacatattgtcaggacctcctgaggctgtgtcaggcgtgcgtcctcaaccttggcaaaataaactttctcaattaactgagacctcagatttttggggtgcatatagtcttaggccttgagagccctctcctagtttctatatttttgccctcttggatgctggcaccaagcaaaccttggctatcctgcttaaagggccatttggagaggggttctgcagggcgaggggccacatggaggaaaacaagtttccccagctgacagccagcaccaactgccaggcacatgcatgaggtcgtcctggatgttccacccagctggccctccagctgcaggtagccacacaaatgagccccggttaaaacagccaggaagtccccatgcaactcacagggtcatgagcaataatgacttgaggtggtttaaagtttctaattttaggtgcaataggtaactgaaacagcccacaagggtttgagcctgtggagggtgcatttcccacctgctgaagcttctcaattcccaggattcaatgcggataagactcttgttctcagtgtccttgatggaaatggcaatgaactttttgcagattggaccatctcaggggaatcccaaagatcggaaactattttctttctcagaatcttccacacaacattgagccttaggaatttctaagaaggatctggaatgaaaaaaaatcttttgaaaaggtatttgtatagcttcacttcagcaagattcatggtgggtgttagactaagtgctggtgttaagccaaaccatgtttttcaaagactcatctggcctcaaggttggcaggatcagagtggcctcccaggatctaccacatcctcaaaagagttggttcaactggcatgtacccagatctctttgagctagtatgatactcccttgagtcaaaggctgccacatcacatctcctttaagtctccctaagtacgaccccagaagtattgacaaaatagtgctattcctgaagatttcaggaggacataaatgaagagattaaactgcaaggtaccaaaacttccatctttgctaaagaccctcatccaggctgggcacggtgactcacgcctgtaatcccagcgctttgggaggccaaggcgggcggatcacctgaggtcgggagttcaagaccagcctgaccaacatggagaaaccccatctctatgaaaaatacacaattagccgggcgtggtggcacatgcctgtaatcccagctactagggaggctgaggaaggagaatcgcttgaacctgggaggcgtaggttgcagtgagctgagatcgtgccattgcactccagcctgggcaacaagagtaaaactccatctcaaaaacaaacaaaaagcccttatccaatggtcatgccactctatctggccatgtaatttctcctcctggctttctgtagcaacagccttctgaggaacctcactctgcctttcaaaaccccttcaacttgtacccttcatcagcaaagtacttagctcaacatgtatgcgtctgggggaactcatccacatgctatttaaggatatttccagcaacatcatcttcactaccccaggatggcattttagagtggattacgtgcctgccggatgtgttgtagttgaacgagttagagaaaatgccacactttgagacgaattaagagtctgttcatttagccggtggctaagaaatggctaacatttaaagttctctcggcctcgaagaaggggctagattttcttttatactttggtttagaaaggggagggggattttttacaaaagtaggaattttacagaagtagacaaaaaagttaaaaggataaattgttacaggaaagtaaacagttctaggtctaggggcttttagactattatgaggtgacagatgcggggctttgggcgttatcaattggacgaattcctgggaactgcggatattgctcgccacagtatcttatcagttaattgcattcttggatgtgctgggagtcagcttgcacaagttaagtccttgaggaaggggctgccagtgaaagagccaagatggagtctgtctggctctcttagctaagggagagtcagttcaggttgaaacaaggctaggtgattaaaagaaagggagagtctaagaacagggttagtaaaaacaaggttgggcattacattcctcacttgtgtttttggggagtcaaatcgttgattcttcagttataacaagggggttatattgagtcttaagatacataagtttgacagaagctatgcgttgttttacaaaattaagaaactaatttaatatacaaggtccaaaaattagacttaatactaggatggggagggggtctggctaacttagtaattagaatagttagctctgggttctagttgaacatgctttgatactagcggatgttattttcttgttcttgttggcgcttatctagattttcttgcactttctggagtgtatcttttatgactaagaatggtggaggaacagttaaatcaactttgtcagggtgtttctggaacatagggttacttagatcagttaaaggcctgattgacttgggtgggctttatgagactatggtttttttggatggtgaacatagacttaacattaaatcctgggatgtaaaatcttaatcttcatgacatgccatgatactattgagttgagttaaggtcatggacagttacagtaagaggattacaattttttctagtacataatttaggatgagaagcaggacttatggaaagagttgaagatctggttgatcttttagagtaggtggctaaagttacacatgtctaatcaggacaggaaaactgataagtatcttgacagctagcatcagggtgatttctaggacagaggtaaaagtcaatattttggagtcttttttctgcacttttggagcttctacacttagtttggctcttggagtgtctgaatcttgctgaaaggtcgacccttgctgctcctgggactggcagattgtgttgcttttcatgggtatgggctggctttgggaaaagtacaaataagtcaactgcaaaggagacttccttggaggtactggccttctaagtggtgtttgcaaatacaagtcctgttgtgaaagaggtgaggagaaaggagtaggaaggcacagaggacgtaaagggcaaaaacaaataagtgaggcagataaaaagaatgaatctaatgggttcacctgacttaggtgcagttttaaggggcctaacttaggcctggggacttatgtttttagttgggctctgttggcctttttgatgcgggagtgatgaatgtaagcaggaatgccgtctactttcagagccattggcgttgtgaggatgacggtgtgaggtcttttctaagcaggagtgagtctttctttctggaaatttttaacaaacactaggtctcatggctggaacgaatggctggactttggtcaggaattggattgggatgggctcctggaacaagtggcaggataatatcttgtacctgttggagagactataggtactgtaataaattattttgtgatatttctgctaatttggcatctcttagcttaggcaagatagggggttccttcttatacatgatttcaaaaggtgagaaactagcctggtaaggggtgcaccttactttaagtagggctaaaggaaggagacttacttaatttacacttttttttaagattaattttgtaagagtgttttttagggtgtggttcttgcgttctacttgcctggaactctggggttgataggcacaatggagcttctgttgaatgtttaaggccttactgactgactgagctataggcgaggtgaaggttggtctattatcagactttatggcagcaggcagcctatattgagggatgatttcattgagtaaaaatttaactactgtgttggtggtttcgttttcggtagcaaatgccttagtctatctggagaaggtgtctaccagtactagaaggtatttgtacttagcctggtgtggtttgacttctctaaagtcaatttcttacttttttcttggtgagttttttcagagacagtggcctgggctgggtttaggactttgtttggcatttacttgggcgcaggttgtgcactggagagctgcttaatctgttaggctttgaagatgggggatcttaaaatggctctggaggagctaaggtagatttgctcttcttaaatgggtggtagactgtaggtaactgattaaagtttctttaagagttcagggtatgaagattctaaagtctggaagaatctactaactttcctgatttttattggctctgagatccgaagccagttttttttgttgttgttgttgttgagtatacgggattgtcaggcagatctggctgtggaaaggagactgtgggcagcaagtttagaggcgtgactgaaagtcgcgctgagacctgagctgctgaatcacgtttctggttactatgggcaacgggtgtgttttctttttgatgtcctttgcagtggatcacagctacctgctgaggtgagtagcctgctttcctggtagatggctttacgtacatacacagtagcaaaggcgtacttgctgtcagtgtaaatgttaatacgtttattcttactttatcagagagcctgagtgagggctatcaattcagccttttgggctgaggtgttcgctggtaaagcttgagcttacaacacatgtgtctccgtggtaacagctgcactgacttttcatacttcctgcttgaggaagctgctactgtctctgaacacggcggtacctgccttttctaggggcacaccttgaagatcacatcggccagtttcgatagtttctaacagttcttgacagtcatgagcaggaatagtggagtctgagtcaggaagtactgtagctggatttaaacactttgtgggagagaaagtcaaacgaggctgatctaacagtaaacttcgatactgcaagatgcgagcatttgacatctatttgccagaagcacttcgtagtaaggtctttatggcgtgaggagctgtaagggttaaattttggcttagagttaatttatcgtcttcttgggccaggcttgctgtagccgctacggctcgcagacaacttggccatctagaggccacaggatctagcctcttagacaaataggccactgggcgtctttagggtcttagagtctgagtaaacacgtttttagcaactccttggcttttatggagatattagggagggctaaagcaggggcttcagttaatgctaaattaacgggctatttcattctgtacttcttggatagctgccactaagatttttgtttgtcttttgaatgctttatcagcggccttttcagctgccagtgtagcttgtttttgttttttaaacttttgattgtcaaaaacttcttgggctatttctaaaagctgactgatatttattctagcaaatctttttagtttttggagtttctttttaatatctggggctgccagagccacaaatgctaaatgaagagcacggctattttcgggagctgccgggtcaaaagggatgtaaatccaataagcctcctggaggcgctctaaaaacgttcttggtgacttatcgggcctttggacaacttcgcttgtcttagacaagtttatgggtttctgagcggctcttttaatacttgcgaggagataccggtgaaaatcacctaaagctccctttctacttgaggaatttgggtgctggttaggccgggtagagggaaagacctcctcaagggggtctctagcttcttcttccggtccgttggctgatgtgaggaagtactttttggcttctttttggatacgttctttcttttcagaggtgaaaagggttaaaaggagctgtcggcaatcatcttaggtgggcgggtgagtctggagtacagactctgtcagagaggtcaaagcctggggcttttcagagaagggaggattatgggttttcgaattacataagtcagaagtagaaaaagggacataaactaagaagggtgctgagcgctcatcacctggagggacttgtgcctctctcagtggtaggagaggggctacttcttcctgccacggtcatgattgagaggcaatgggtggcgagcctacaggggacgtcgtcgagcagacatgggataactttaagggagaaggttggtagtaaggcggtgggactgggtgagggagactcccctcttcttcagagggaggcagtacagggggagctgaaccggctgagggtcgaggcgaaaacgtggtctggcttaggaggaccttggaggtagaattatgaatggcgcatgaacggagccatggagagtggatcctgactaaacttagctcttgatcaatgtagggaaactgatcagggtggctaggagtttcagtaacaacctgccacacagcttgaacaattgtgaggttcaatgacccttcagggggccacttgactttaaactttggccattttattttgcagagtgtctagagcttgccttttttaaggcggactttataatctgagaaactgagaggaaaattctgcagcatacattggagagggctttaactttacaaggctgggaggaagtgtttcttttttttttttttgaaggcaatttaataagatttgagcatagatattaaacttagcatggacagagaaacttatttcttgggggactggagtagtgaaagaacagaatcaatatgactagaaagagcagaaaaacttacaacagctaatactacttgctacattgctgtagctttaagactgagggaggaggactagagccagcctgagatcttctgggtcagtttgatctaggcgttcttcttcttcttctagatctgcactttaaatacttttggtgtctttataacttaaacgcaaatagcttaaacttagctttttctcttaagggtttaaggagtgagagcagagccaagtcctggagacggtaaacttgctgtggcaccggaaaacgagatgtgcgggatacggggcagggacaaggtggaaaaggactactcggatcatttttaagatggaagagtagccacagaggaacagagtaagaatctcaatgaagtaaagcagtacgggcgtacatttctttacacagtgctctatttcagggcacaggaaaagttacagaatgacaagagaggtgagcaaggaaatctgcagggtggctgttttgaactcattactggtttagtttagaggacgtctaatcacttggacgtggagtatgatgatctaaatacttaacaactttcttggtgctagaaatcttaatcaggcgaatatttttcacacttgttcttgtaacaacacttgacttgcttctggcagaaaagacaggactgtggtggccagcctaaaagattgatgagaaatttaacctcctgtgacaaaaaatcagcactaaggactttgaagaagtttttacttagaggtcttgggcaataccaacgtcttgacatgcaaaactttgacaactactaacaagacaatagacgctgaacagaacaatcaatataaaacaaacagttgactttagggcatgtaaacagttatgacagtttttccttttttttttttttttttagacagacaaggggagggtttcctgtgatgggatcagtcagatgcctgcctggccactccccttgaggggacttgggctcctcttagcattggcaggccggtataaacttccggctcagatcaaggtacgcctgatgctgccttaagccttatgaggtcgccacggaaccgcaggtgagggcccacttgaactccgtagctttcgccgtggagctacaaactggaggacaagcgcaaacccttgtcctccctcattcattcattattcacacagagtatataacagttttttttttttctttcttggagattcttcaagaaacttgaacaagagaaagatgagagatacaaaaagagagagagagagtgaccggtctgccagaaaccaggactcagtcctccagcatcctgggatgtggactgagtcaagggagggcccctgtcagggccacttccctcctagaaagagacacagaggagcctaacagaaaaccagggctctaccttctagcgtcctagagaaacaggcagagtcaaaagagggacaccctcatcagggccgcttccctcttactagaactgaagtcaaatctgacctacctgacctcagggtcagaagtcgaggactcagaggtggaatttttatgggcacccacaaggtagtcgatccgctctcctctggaagacggtcacctttcgaggacctgaaaatttttttgtaggtggcaccccgcaacaagccggccgtccttccgggggagcccggagcgagcccggttctcgcctcgtggcgtttctcgctggggcctccaaatgttgtacttgaatgagttagagaaaatgccacactttcacatgaattaagagtctgcttatttagctggaggtcaagaaatggctaactcttaaagttctcttggccctgaagaaggggctagattttcttttatacttcagtttagaaaggggaaatgggtctagttaaaagaattttacagaagtaaagtaggcaaaaaagttaaaaggataaattgttacaggaaagtaaacagttctaggtctaagggctttaagactattacaaagtgatagacatggggctttaggcattatcaatcggacaaattcctgggaactgcggatattgcttgccccacagtatcttatcagttaattgcattcttagatctgctaagagtcagcttacacaagttaagtccttgaggaaggggctgccagtgaaaaagccaagataaaagctgtccccagtgttagaggtggggcctggtgggaagagattggatcatgggggtggatttctcatgaatgatttagtgtcatccttttggtcctgtccttgcaatagtgagtgagttccggcaagatcgggttgtttacgagtgtgtagcacctccctccttactctcttgctcccgcttcaccttctgccatcattgtaagtttcctgaggcctccacagaagctcagcagatgtcagtgtcatgctccctgtatagcctacaaaactgtgagccaattaaacctcttttctttatatattacccagcctcaggtatttctttatagcatgagagaacagccaaatccagcagccatagacaatatgcagcaaatgtgcatggctgtgtttcagtaaaactttattgacaaacacatgtgcaagcaggtcagatttggcccatgggccatagtgtcccaacctctgctctggaatattctcttcagcctggacggacatctctaggttgttgttgttttttttgtttgtttgttttgagacaaagtctcactgttgcccaggctggagtgcagtggtgcaatctttgctcaccgcaacctctgcctcctgggttcaagcaattctactgcctcagcctcccaagtagctgggattagaggcacctgccaccacacctggctaattcttgtattttttaatagaaatagggtttcaccatgttggccaggctggtctcaaactcctgacatcaggtgatccacccacctcagcctcccaaaatgctgggattacaggtgcccaccaccacacctggctaatttttgtatttttagtagagatgtgatttcactctgttgtccaggctggtctcgaactcctgatatcaagtgatccagctgcctcagcctcccaaagtgctgggattacacgtgtgagccactgcagctgccctctagatttttttttttttttgaccattgcttatttggtttgactttcattttcttccccattgtggtagtcattttctgaatgcctgttagtttgtccatctctctcctctgtagtccctagagtcagatgaactcctctgcaggtgcaatggtgtaacactctctagtgctgaattttgagcaggagaaagagagcaagagtgaccagtacctttggaaactctgccctcctgagaatttggtgtcttctctgcaaatgttgcaaacctgttaacccacaggctggagagagagacaagccagaatcatgatctgttgagcttcagtttaatatttgatgcacagagatcactgagtttttttataagaattagagggggaagaaatggccacagagagcaatttctatctccaggtgaggattcaggagataattctgcgaacagaacttcctgagaactgagatgggggaaatcgctggtattagaagagtgaaaagttcagtaattaaggctacgactgtgctcttagaggcaaaagaagaaaatgagactgccaggcatgaataatgagaaatctttgatggaattagccatgcagaacagatactaaatgcatcctcattcttctcatagtcaaaagtttttgcttaagctggataggaaaaagagcatcccatttcactaagtataaaagaggggattttagagaaggtctcagaagaaagagatgtgggggtttggtgaaactcaccagaggctggaccctctccagcataacacagggattgggaggagcggggcggcattaggccaggtgcatagcccagtgctgctatctctggactttctgctctctctggacttgtttactagctgagcttatccatttacataattttcagtgccatttctcagctgatgagtcctgaacttttgtcctgaggctagaattctccttgaaacagcagtcttaaacactcaacttctttcttgttttttccacttgtcaactcatgaacacctcaaccttgttacatccaaagccaaactcatggcttggtgtggtaggtgatggctgtaatcccagtgctatgggaggctgaggtgggaggattacttgaggccaggagtttgaagccagcctggaaaacacagtgagactccctatctacaaaaaaaaaaaaaaaaacaacaaaaacaaaaagctaggcatggtgatgtgcatctgtaggatctgtagtcctgctacatggcaggctgaggcaggaggatcaattgagcccaggagtttgaggctgcaaagagctatgatggcaccaatgcactccagcctgggtgacacagccagagaccctgtcttaaaaaaaacccaaagccaaactctctttttcctcctccttctccatgggctctgtccatgccatctctcttctgtaaatggcaccaccccctgctgagctgctcaaggtggtcataactcatgtgttgtgctaactctgcttttgccctcttctccagtcagcaagtcctgtgattctaaactttatccaacttgtccactctctctagcttcactgtcattatctttgcctaggacaccagtatctcagctgggctacagcagcagcctcctaactggtcttaactggtactctgcacctgctctccatgctcagcaatccatttcctacctggcagcttcagtgatcttaaggtgtccattgagtctcatccctgcctttcctgcccatggtacatagaataaaatcgagaccccgagtcttctgcctgttcctgccacctctccagccctctcctatctcctgcccttggcctactctatttcagccactatggcctccttttgttttcttggactttcaaacctttttccacaacagggcctttgcacttgctgcttcagcctggaatgattttcctctgcacctccccagattagaccatcctttaggtctcagctaaaatggtgcttccacagacagctctttcctgacccctttataaagtggacttccctgctcttctccaccttaacctcttattgtttcttgttgtgggaagtcagggaccccaaatggagagggactggctggagccatggcagaggaacataaatggtgaagatttcatggacatttatcagttcccaaataatacttttataatttcttatgcctgtctttagtctcttaattctgttatattcataagctaaggatgtacatcaccgcaggaccactgtgataattgtgttaactgtacaaattgattgtaaaacatgtgtgtttcaacaatatgaaatcagtgcaccttgaaaaagaagagaacagcaatttttagggaacaaaggaagacaaccataaggtctgactgcctgcagggttgggcaaaaagagccatatgtttcttcttgcagagagtctataaacggatatgcaggtaggagagatatcactaaattcttttcctagcaaggaatattaatagtaataccctgggaaaggaatgaattcctgggggaaggtctataaatggctgctctgggaatgtctgtcttatgcggttaagataaggactgagatacaccctggtctcctgcagtacccaaaggcttactagggtggagaaaaactccgccctgatatatctgtggtcagactggttctctgctcttgaaccctgttttctgttgtttaagatgtttatcaagacaatacatgcgtgaatgaacatagacccttatcagtggttctgcttttgtcctttgctttgtgatctttgctggacacttctcagtagttctgcttttgccctttgtcctgttccctcagaagcacgtgatctttgttagacccttagtagtagttctgctttgtaccatttgaagcatgtgacctttgtacctattccccattcttacaccccctccccttttgaagcccttaataaaaacttgctcatctgagactcagggggcatcatggtcctactgatgtgtaatgtcacccccagcagcccagctgtaaaattcctttctttgtagtgtctctctttatttctcagctgcctgacacttatagaaaatagaaagaacctacattgaaatattgggggcaggttccacctatacttctttcatggatttacttattttttgtttgtccccctgtgtatcctagaaactcctggagggcagaggcatgcctgccatcttcatcattgcattaccaccacccaacactattgggggacctgccccgataatcatgtaggttcttttctactttcctaagcgtcaactggcttgagaaataaaaggacagagtacaaaagagagaaattttaaagctgggcgtccgggggagacatcacacattggtaggatccgtgatgccccacaagccacaaaaaccagcaagtttttattagggagtttcaaaaggggaggcagtatacgaataggtgtgggtgacagacatcaagtacttaacaggataatagaatatcacaaggcaagtggagacagggcgagaccacaggacatttagccccccagctctcttacctcaaagcttgtctcctgaaggccacagcttctgtcaactgaccctttccacacctccttttcttcagattccaggaactgctccctatccagctactctatcacaatgctacttgctttctcactctaggatctgttaaaacaaaaagtgagtctgggtgcatggttcacgcctgtaattccagcactttgggaggccaaggcaagagggtggcttgaggccaggagttcaagaccagcctgctcaacatagtgagattctccccccactcccatctctggtctcacacacatacacatgggcacaaattaaattttatctaaaaatttaaaaattgttttaaaattgaaatagttacatggattatgtatatattcattttgtaaaactatagatctcatggaaatgggaactctttactcttccagcaaaacatttttttagccacaaataaaagaagaccagtgatttagcctgtacacacaaaaaagacataagaaaatactgctaaggctggggcaggggtgggggaaagagatctaaaaaattcaaattttactgggaaggaccactaattagaatcagaataattactgttttaaagcatttaagaatagagcacaatgaaccccgggaagaaatagatatgattcagagtcgagctcacagagcagatggtacctcagctgagactgatagaataacattaataagggcattcactgccatttattatctcctaactgcaatgcattttgtataagttatttgtactcttcacatcaaccatggaaaataataattattcttatcttttgacgttaaggaagtggtaagtggtgtaagaagataaattaacatgccaacaccaaacagctcaagttcgataactcaggagtgcccgtgtctccccaagaggttgcttagcaggcagaccaggtagagagagcccttccaagaagtggcagtgagatgtgaaacgtctcagtgtgtctctaagaacaacagaaaccagtacgtagaccaagtgggaaaagccaaggaagaggcaggaatttcctcttaagatagcaagaagaataaacaagagcaggactgagggaagccatgggaaatgggcaaaataccatgcattaagcgagaaaaaacaacttttactttagaataggaaagggggaaggaatggtggtagtctaggtaagcctagaagagtaaagggcagcagagaaaaaattagttgtactagggttctccagagggacagaatcaattggatacatgtatatgaaaaagggagtttattagagagaatcggttcacaggattacaaggcaaagtcccacaataggctgtctgcaagctggggaaagagagaagctggtggtggctcagtccaagtccaaaagcctcaaaaccagggaagcccacagtgcaaacttcagtctcaggctcagggcctgagagcctcggggaagctgctggtgcaagtcccagagtccaaaggcagaagaacctggagtctgatgtccaagtgaaggggtgggttgcccctccacacctgtgggtgttttaattaggtgaaacgagagacctggaaaagaaagagacacagagacaaagtatagagaaagaaaaagggagcccaggggaccggcgttcagcacacggaggatcccactggcctctgagttcccttagtatttattgatcattattgggtgtttctcagagagggggatgtggcagggtcataggataatagtggagagaaggacagcaggtaaacacgtgaacaaaggtctcagcatcataaacaaggtaaagaattaagtgctgtgcttcagagatacatacacataaacatctcaatgccttaaagagcagtattgctgtccacaggtcccatctccagccctaaggtggttttcacctatctcagtagatggaatatacaatcgggttttacaccgagacattccattgcccagggacgggaaggagacagatgccttcctcttgtctcaactgcaaagaggcgttccttcctcttactaatcctcctcagcacagaccctttacgggtgtcgggctgggggacagtcaggtctttctcttcccacgaggccatatttcagactatcacatggggagaaaccttggacaatacctggctttcctaggcagaggtccctgtggccttccgcagtgttttgtgtccctgggtacttgagattagggagtggtgatgactcttaacaggcatgctgccttcaagcatttgtttaacaaagaacatcctgcataaccctaaatccatttaaccctgagttgttgacacagcacatgtctcagggaacacaggtttgggggtagggttacagattaaaatggagtctcttatgtctactttgtatacagacacattaacaatctgatctctctttctttttcccacatccaaggtcaggaggaatggaagcaagcttcctgcatgggaagaagaaaaaaaggcttctggcagaagcctccactagcaagcctatcccaccttcctccgcctgctttgttctagctgctctggcagctgattgactggtgcccacccaccttgagggtgggtcttccttcccagtccaccaactcaaatgtcagtctcctctggcaacaccctcacaaacacactcaggaacaatactctaggcagctgtcaatccaatcaagttgacacctaattttaaccaacatacaagatttataagctaagtatgtcaatgatgataaataagtgttgtggagaaaagcagagcagagaggagaaaaggaatgcagagaagggtttacaagttttagaagaattcatacttacaggcccctgttttccataaaaaacaggaggctcatcttctgcaggtactgaagggcttgggatgttgtgagggtgaacttgaaaataacagacaaatatcagagttaatgaggggaaaaagaaaagatgagtgggcatcatggtggtccagcaaaggaggaaaacccaagcatgaatgtggactggcaccatcagagagggcagagcctccaataacatggggcagtctgagagccagagtcaagacgtgggggaaatggatccaggttctgtgtttggcacagtgtgtgtggaagaaggataagagggctcgggaggacaggtacagtgagtgtgcctccacagggatgctcttttggtatgttctattattgctgaaaaatatgcagtgcccctccctgggggaggattatgctatatctagcccattgatatcagtgtagccaggtgacttgctattgccagtgaaatgtgagtagaagtgacaggtgttacttgtgagcagaaattttaagaaccacgatgtagctcaacaccaactttttttcctctgccagtattccaggtaggagcgactcccccaaccaagggcccagaatgaaaattatgtagagaagggtcacagcctacccatgatcaatatgtagctggagtgagcaaacaaacttttctggttgtaagtgtctgagacttgggagtcattttgtaactgcagcataacccaatctaaactggctaattcaagcttgaatattttaagttgaaagggaaattagtaaagccataagtgacctaatttgttgagagcagtaacaggagctgatgattagaggcttggttgcaggctatgggagagaagtatgggaatgaaagagacagatgaactggacattttcatgggtaaggaatgtataattttacagtgttaaataaaatgatgaatgtaagattatctagcttaggtccctgaacacaatgtgtgttaaataaacaaaagctttcttcaaacagaattcccctaagcatttccaggttgttccctgtccagacatagatacaccctgtgcagtcatagatactgttgaaagattcggaaataggaatcaggagccctggagtaacaggcccccagaaaatcagagtggaattgttagtccagaagcttgacaaacatccaccttcattgtcttccaactgtatctctgacttccctctccctagttcattacatcccagtcatattgatatcgttgctgttcttgaacacattaaggagaggcgaatagggtttttagctgctgaaagttagactcgtggctagagaccagactaagtccttttccttcatgtggaggttatgattaggattgtcagagagagttagggtttaattttttcattaaactaataatatgttttgagtatctattgcattatggggcatggagcttattacattcatggtgcagaggaagagggggagttaacaaggcacataaattacatatataaatgaaggtaagtgctatagagaaaaatagagtagagaagaaaatgccataatggggcccgggcattgcattatgtaatatcatcctatatagtctgctatagtccaaatagtctgctatcatttggttttctcattggataaaatgttgtgaacatctctctgggatgaaacaaaaacattctgtattgctgtagtgaaaggtcctcagaagggaatcattttgtcattcctgaggcttgttagatatgaccaacccatccaccgcatctcagtcataactactctaaacaacacccaccaaagggggaaagggcttgctggaatccagccatcagtacatccttgcagcagctgaagactcatttcacttttaccctaacttggccatcatgacagcacccagcccaatattccaaagctaggtatttaacaccataatggggaccactgtttcctaggaggtactgaagggtttcagaggctgcagatacaaatgatgcttactgctatatctgcagtgcagaaagctgagagcaaaagtgatgagatatcaaggctgcctctgtggtctggatgctttctttaagaaactggcaccaagtgtaggctatatgcagactgtccagatcaattgtggcagaccttgaaataacaatcatagctactgtttattgagagcattttgggtcaccttttcaaagtgatttatttttgtccaatgttaagtaaccggcttagaagctgaactcacagggtatggcagggtcagccccaccctcagaaaatccttcagaccaagcatgtctcagccatcaggccccagcatagacagaaaaacacatctccccacggcatctggctgtgatctagaacatctggtgacaggacaaaggtgaggaagactgacaggaaattatcagagcaagcaaataacagtctgaaattcgggtttctctgtgaggctacctctgtccatttctatctctgagcatagtatgtaaaggagttggtgtagtagtcgaatggtggccccccaaaatatatacacatgtcccagaacctgtgaatgtgactttacctggaaaaaagcatttttgcagatgtaattaagtggaggacttcaggatgagaccaccctggattatccaggtgggccttaaatccaaggacaagcgttctttttttttttttattattatactttacagtttagggtacatgtgcacgacatgcaggttagtaacatatgtatacaagtgccatgttggtgtgctgcacccactaactcgtcatttaacattaggtatatctccgaatgctatccctcccctctccccccaccccacaacaggccccggtgtgtaatgttccccttcctgtgtccatgtgttctcattgttcaattcccacctgtgagtgagaacaggcagtgtttggttttttgtccttgcaatagtttgctgagaatgatggtttccagcttcatccatgtccctacaaaaaaggacatgaactcatcattttttatggctgcatagtattccatggtgtatatatgccacattttcttaatccagtccatcattgttggacatttaggttggttccaagtctttgctattgtgaatagtgccacaataaacatgtgtgcgtgtgtctttatagcagcatgatttataatcctttgggtctatacccagtaatgggatggctgggtcaaatggtatttctagttctagatccctgagggatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgacgatgagcattttttcatgtgtcttttggctgcataaatgtcttcttttgagaagtgtttgttcatatcctttgcccaatttttgatggggttgtttgtttttttcttgtaaatttgtttgagttcattgtagattctggatattagccttttgtcagatgagtagattgcaaaaattttctcccattctgtaggttgcctgttcactctgatgatagtttcttttgctgtgcagaagctctttagtttaattagatcccgtttgtcaattttggcttttgttgccattgcttttggttttttagacatgaagtccttgcccatgcctatgtcctgaatgatattgcctagcttttcttctagggcttttatggtttcaggtctaacatttaagtctttaatccatcttgaattaatttttgtatgaggtgtaaggaagggatccagtttcagctttctacatatggctagccagttttcccagcaccatttgttaaatagggaatcctttccccatttcttgtttttgtcaggtttgtcaaagatcagatggttgtagatatgcagcattatttctgagggctctgttctgttccattggtctatatctctgttttggtaccagtaccatgctgttttgtttactgtagccttgtagtatagtttgaagtcatgatgcctccagctttgttcttttggcttaggattgacttggcaatgcaggctcttttggttccatatgaactttaaagtagttttttccaattctgtgaagaaagtcattggcagtttgatggggatggcattgaatctataaattaccttgggcagtatggccattttcacgatattgattcttcctacccatgaccatggaatgttcttccatttgttcgtgtcctcttttatttcattgagcagtggtttgtagttctccttgaagaggtccttcacgtcccttgtaagttggattcccaggtattttattctctttgaagcaattgtgaatgagagttcactcatgatttggctctctgtctgttattggtgtataagaatgcttgtgatttttgcacactgattttgtatcctgagactttgctgaagttgcttatcagcttaaggagattttgggctgagacgatggggttttgtagatattcaatcatgtcatctgcaaacagggacaatttgacttcctcttttcctaattgaataccctttatttccttctcctgcctgattgccctggccagaacttccaacactatgttgaataggagtggtaagagagggcatccctgtcttgtgccagttttcaaagggaatgcttccagtttttgcccattgagtatgatattggctgtgggtttgtcatagatagctcttattattttgagatacgtcccatcaatacctaatttattgagagtttttagcatgaagggttgttgaattttgtcaaaggccttttctgcatctattgagataaacatatggtttttgtccttggttctgtttatacactggattacatttattgatttgcgtatgttgaaccagccttgcaacgcagggatgaagcccacttgatcatggtagataagctttttgatgtgctgctggattcagtttgccagtatttaattgaggatttttgcattaatattcatcaggaatattggtctaacattctctttttttgttgtgtctctgacaggctttggtatcaggatgatgctggcctcataaaatgaattagggaggattccttcttttgctattgattggaatagtttcagaaggaatggtaccagctcctcattgtacctctggtacaattcggctgtgaatccatctggtcctggactctttttggttggtaagctattaattactgcctcaatttcagagcctgttattggtctattcagggattcaacttcttcctggtttagtcttgggagggtgtatgtgtccaggaatttatccatttcttctagattttccagtttattggcataaaggtgtttatagtattctctgatggtagtttgtatttctgtaggatcagtggtgatatcccctttatcattttttattgtgtctatttgattattctctcttttcttctttattagtcttgctagcggtctatcaattttgtcgatcttttcaaaaaacttgctcctggattcattgattttctgaagggttttttgtgtctctatttccttcagttctgctctgatcttagttatttcttgccttctgctagcttttgaatgtgtttgctcttgcttctctagttcttttaattgtgatgttaaggtgtcaattttagatctttcctgctttctcttgtgggcatttagtgctataaatttccctgtacacactgctttgagtgtgtcccagaggttctggtatgttgtgtctttgttctcattggtttcaaagaacatctttctttctgccttcattttgttatgcacccagtagttattcaggagcaggttgttcagtttccatgtagttgagtggttttgagtgagtttcttaatcctgagttctagtttgcttgcactgtggtctgagacgcagtttgttataatttctattcttttacatttgctgaggagtgctttacttccaactatctggtcaattttggaataagtgtggtgtggtgctgagaagaatgtatattctgttgatttggggtggagagttctgtagatgtctattaggtccacttggtgcagagctgagttcaattcctggatatccttgttaactttctgtctcgttgatctctctaatgctgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattaatccatttaccattacgtaatggccttctttgtctcttctgatctttgttggtttaaagtctgttttatcagagactaggattgcaaccccgcctttttttttttttttttttccatttgcttgtgagatcttcctccatccctttattttgagcctatgtgtgtctctgcacgtgagatgagtttcctgaatacagcacactgatgggtcttgactctttatccaatttaccagtctgtgtcttttaattggaacatttagcccatttacatttaaagttaatattgttatgtgtgaatttgatcctgtcattatgatgctagctggttattttgctcattagttgatgcagtttcttcgtagccttgatggtctttacaatttggcatgtttttgcaatggctggtaccagttgttcctttccatgtttactgcttccttcaggagctcttgtaaggtgggcctggtggtgacaaaatctctcagcatttgcttttttgtaaagcattttatttctctttcacttatgaagcttagtttggctggatatgaaattctggattgaaaattcttttctttaagaatgttgaatattggcccccactctcttctggcttgcagattttctgccaagagatcagctgttagtctgatgggcttccctttgtgggtaacccaacctttctctctggcttcccttaacattttttccttcatttcaactttggtgaatctgacaattatgtgtcttggagttgctcttctcgaggagtatctttgtggcgttctctgtatttcctgaatttggatgttggcctgccttgctagattggggaagttctcctggataatatcctgcagagtgttttccaacttggttccattctccccgtcactttcaggtacactaatcagatgtagatttggtcttttcacatagtcccatatttcttggaggccttgtttgtttctttttattcttttttctctaaacttctcttcttgcttcatttcattcatttcatgttccatcactgataccctttcttccagttgatcgaatcggctactgaagcttgtgcatttttcacgtagttctcgtgccttggttttcagctccagcaggtcctttaaggacttctctgcattggttattctacttaggcattcgtctaatttttttcaaggtttttaacttctttgccatgggttcaaacttcctcctttagctcggagtagtttgatcatctgaagccttcttctctcaactcgtcaaagtcattctccatccagctttgttctcttgctggtgaggagatgtgttcctttggaggaggagaggtgctctgatttttagagtttccagtttttctgctctgttttttccccatctttgtggttttatctacctttggtctttgatgatggtaacatagagatggggttttggtgtgcatgtcctttctgtttgttagttttccttgtaacagtcaggatcctcagctgcaggtctgttggagtttgctggaggtccactccagaccctgtttgcctgggtatcagctgcggaggctgcagaacagcaaatactggtgagcagcaaatgttgctgcaggatcattcctccggaagttttgtctcagaggagtacccggccgtgtgaggtgtcagtctgcccctactgggggggtgcctcccaattaggctactcgggggtcaggcacccagttgaggaggcactctgtctgttctcagatctccagctgcatgctgggagaaccactactctcttcgaagctgtcagacagggacatttaggtctggagagggttctgctgccttttgtctgcctattccctgcccccagaggtggagtctaaagaggcaggcaggcctccttgtgctgtggtgggctccacccagttcgagattcctggccactttgtttacctactcaagcctcggcaatggtgggcgcccctcccccagtcttgctgccgccttgcagtttgatctcagactgctgtgctagcaatgagcaaggctccgtgggcacaggatcctctgagccaggcacgggatatctcctggtgtgccatttgctaagactgttggaaaagcacagtattagggtgggagcgacccaattttccaggtgctgtctgtcacccctttctttgactaggaaagggaattccctggccccctatgcttcccaggtgaggtgatgcctcgccctgctttggctcgtgctgggtgcgctgcacccactgtcctgcacccactttccggcactccccagtgagaagagcccagtaactcagttagaaatgcagaaatcacccatcttctgtgtcgctcactctgggagctctagactggagctgttcctatttggccatcttggctccaccccgacaagtgttcttaaagagacacacagaagggaaacagagaaggccacgtgaaggcaaagattggagtcatgcagtcacaagccaaggaacatctggagccaccagaagatggaaaaggcaaggaagggatcttccctagatgcttcttaggaagtgtggctctgctgacaccctaatgagagacttccagtttccagaacttcaagaaaataaatttctgttgctttaagccacttggtttgtggtaatgcattacagcagtcctaggaaactaatacacttgatgactctctttagcctgaccccacgtttgatgcctaccaccgacacaagaagaagcccaggcagcagcaccactgccaatcctaaatgcctctgcaattgtcatggcctccatttcatgtgcactccctgtcgtatttaaactaagggatctcttgcacctccatcctcccaacaaccatcgaggtcagagcaagctacataatcattaaagagattctccatcttcatggactattcagccaattagtctccaaccttccattctgatggatgcccccactttgcaagacaccattcaaaactatctatgtaattaccagatgcccttctgatacacccttccagacaccttggctcttttacctgctcagattgcatagaaatgggctacagtgaattagtaaattgctattttcctcttacagaatagccatttccctgaaagttatcatttcctcctctacattttctcaggtgtctgctgctcttgacacagtgcagagccaagcacaatgcgtggcacatagaaggcactcaataaatgcttgccaactgaataactagaggccaggcagcttaggaacacccaggaggataacctagaacccacaaaaacgtcagggagtgctctaaacactttcccactggcactgctaccactggcctcctaatacatttcaccactctccttagcttgaccctatttttgatgcctgcacctagtgatggtggaagcctattctgggctccccacagtgggcatatggagcttgcttcgggcaaagtcttcctgccaaagggagaggaatttaccaggtgaacaagcaaaacttcaaggacaacctctaccttctggctagcattctgcctcctgtctcttttctgttttgacctccctggttccatgcattgtgttcagacacccagaactccgtctcttagtgtttggatcaagttctctacttaatattaggctcacaagctctcatgctgtgttttgggagtgtgacagtaagaaatatatacttggtgtttgtctttggtttccaacacagagctttaaaaaataataataatttttaagagacagggtctcaccagtggcatgatcatagttcactgcagccttaaactcctgggcccaggtaatcctcctgcctcagtatcctgagtagctggaatgacaggtgcttgccaccatgctgactcctgacagaattctaaaacccttggaatttcctgagtgacaagggtgataggagcatcttttgttatcatagcaagcacctttcaaccatatctgagtttatgctaacaatgtgactcttggaggataagggctggttgtcctaggaaccaatgaagtgattagagggttggaatttcctccccgacccctcgacctcctgggaggggacaggggctggagattgaggtaatcaacaatggccaatgatttaataaatcatgcctatgtaatgaaagcttcataaaatgcctaaatggtggggctcagaatgctcctggattggtgaacacagccaggggctgagagggtggtgcacccagagagagcatggaagctccgtgtacccccataccttaaactatgcatcttttctgtttggctgtttctgagtcatatcctttaagataaattggtaatagtaggtaaagtgctttcctgagttctgtgagctgttctagcaaattatcaaacatggagagggagtcttgggggaatctccaatttgtaaccaatcagtcagaagtatgggaggcctgagacttgggactggtttctgaagcgagggcagtcttgtgggactgagtccttaacctgtgggattcacgcttactccaggtagatggttaaaactgaactgaattcttggacatccagttggagtccggagagttcagggagacaggatctgcgctatggtatcatacagatcaaacataagaacctcagctacattaccttgaagctgtatgaccttgagcaagtcctctcagattctcagtttcttcacttgccaagtggaaaaaagataagaactatgcaggcttgtttggagacttaggaataatgcgaggattagcaaactggcagggtagttggaacacaataaaatttcaaaatatatcagctcttgttatcactggactatattcacgtttggcctccaaattcatagcatttaatgcagaaaggagttcttgcagaaccctgggcagcctcgctcactctttcagacccgaagaggtgaacagaatactcccaactattcccagatgtttctacagttctctcttactgaactggggatggaaataacaaaagccattagaaaatactagtttgaaaaaattaactttcttagcacttaattttatctctagcaaatgtaactttctagttttacacagtgtcagcagatgtaactcaaaatgccttacaagaatacatcagtcacaaaacattgtgatgtactaaatatcactgaattgtacactttaaaatggtgaattttacctcaatttaaaaaatttgtttaaatgtggttgatacaggagttaagaagaaattacttaggcagatagtgaggctatggacataaggtaaggttttttccttttaatgaaaagcagccccaaattatttttctttctaacaaagagcagcctgtaaaatcaagctgcagatgatgctggcagttgtgccagtcggagcagaaaaaatggtgctgccaacgggaaagtgcatttgcataataagattatggtggggcagccagccttcccccttccctggctatgtaaatgttatacctgatcaaaaccaatctgtgagccctgtgtaaattagacactgcctcctcaagcctgactataaaatcctgcacatctgccacaggccagccttttcctctcagaagtcccctctctcccattaaagagagtgctgttttcctttctctttctttgtctttcttttgcctattaaacctccactctgaaactcctcatgtgtatctgtgtcctaaattttcttggcatgagatgacgaaccctgggtatttaccccatgcaacgtaactgccgcacagtgactgatgttgtctccaggatcagaatgttgacctggagttcattttaaaaacaggttcttgagattctgattctctaggtcaaggtaaagcatagtcatccatgccttgtaaaatctcccttagagattcagatgagtcagagttgagaaccattgattcacgatttaaaatatctcaaaattgggcaaaggatatgaatagagtagaaattgcacttaaaaaaagaaaaagactgttgttatctggctaagatggttggattctgggggcattcttttctctatcatttctattatttgaattatgataaagtttgggttttcttgttgttattttgggggatttttgagacagggtctcactcctgtttcccaggctggagtagctgggaatacagtcacataccaccaagcttggcttttctttttttcttttaatttttagtagagatggggtttcgccatgttgcccaggctgggcttattaatccagggcagattactcatgggcttaagaaatccacctgccttggcctcccaaagtgctgggattataggcatgggccaccatgcccagtctacgataacgtttgagcaatgcatttaactatgtacttttctgtgggtttttattcattttgtttttaggaagaagtgtctgtttagtggtaggggcaagcttgggagctatgaggggggaaaacaaaacatggtccctatagcaccctctggattctccttatccaggagaggatgagaggagctagggtagcatagcaagacctcatctctacattgaacctcttccattcgaaagggtcccaacaccaaaagcaatttcaataaaagcaagatttgatacatgggacctaattaaagagctctgcacagcaaaagaaactatcaacagagtaaacagacaatctacagaatgggagaaaatattggcaaactaggcatcccacaaaggtctaatatccagaatgtataatgagctcaaacaaatcaatgagcaaaaaacagccccattaagaaataggcaaataacatgaacagataacttttcaaaagaagaccttcatgtggccaataagcatatgaacaaatgctcaacatcactaatcattagggaaatgcaaatcaaaactacaatgagataccatctcacaccagtcacaatggctattactgttagtattattattattattatttagacaaagtctcactctgtcacccaggatggagtgcagtggtgctatcttggctcactgcaacctccacctcccgggttcaagtagttctcatcccttagcctcctaaatagctgggactacaggtgtgcgccaccacacctggctaatttttgtatttttagtagagacggggttttgccatgttggccaggctggtctccaactactgacctcaagtgacctgcctacctcagcctcccaaggtgctgggataacagacttgtgccctgatgcccagccacaatggctattagtaaaaagccaaaaaacaacagatgctgatgcggctacacagaaaacggaacgcttatacattgttggtgggaaggtaaattagttcagccactgtggaaagcagtttggtgatttctcaaagaacttatatcagaattgccacctgacccagcaatctcattattgggtatataaccaaaggaatataaatcattccaccataaagacatatgcacacctatgttcattgcagcactatttgcaatagcaaagacatggaatccacctaaatgtccatcagtgatagactgtataaagataatgtggtacatgtttacagtggaatactatgcagccacaaaaataatgagctatgtcctttgtagcaacatggatcaacatggatgcagctggaggccattatcctaagcaaactaacagacaggaacagaaaaccaaataccccacgttctcatttataagtggaagttaaatgttgagtacatatagatacaaagaggggaactatagacatcggggcctacttgaggatggagggtgagaggaagttgagaattgaaaaactacctatcaggtactatgctcattacccgggtgatgaaataatttgtacaccaaccacccctccattgcaacatgcaatttacctatttaacaaacctgcacatgtgcccctgaacctaaaataaaagtttagaaaataaaataaagtagttgtgaaactctttaaaagaaaaaaagggtccccaagcacagctcagcatccctttgtttcctgatgggaggtgggcagtggggatatgaactttccggggtgactgaggctcttcagtgaagcagggtgctatgagatctggaggagagaggctatataggaacagccagggtgcagcagacaacactccaatgctcggttgtcttcagctttccctctgacctcctcccctcacacctcctgccacccaccccacctcccccacaacccatcttccccgccacctccaagtccacttgtaactggcatatgaatgtagactgggcagtacctcatttctgaaagggcttgctgcttccaggaagatttcacctaaggcaaaatcttactagatttgcaagcaaagagcaaacaaccccattaaaaattgggcaaagaacatgaacagtcacttcaaaaacagacattggtgcagccaacaagcttgtaaaaaaatgttcaacattactaaccattagagatacgaaaatcaaaaccacaatgagatatcatctcataccagtcaaaagaaaacatgcggggagaaagggaatcaggtggcagaaataaagggaagtattaaacctacatctatgagccagagagaaaaaaaaagactgaattttaataaaaaaaaaaatgttcttactaggttcttcatttcacagggtaggagaaagaacctcatctctgactatttggagttttcccagtttgctattatccaagagaagatgcttttggatttttttgtatttcttttagggatgtaatcactacttgttattatcctcctctacatttcatttctccctcctccttttgattgtaaactctgacttttcagatcaactcaaacactccctggctgagttgttaccacataaatacctgttgaattactaagtgattagttgaagtggaaaatgtaagaatcgtagagtgttctgcttttactataaaagatttgatgaagcttttcttgtggttcctaggaaaatacattctttttttttgaagcttccacctctctcacagctgatgtcccagcttataagattggaaactgagttgagatatgagtctccaactaggccgtgaggtcctactggccccttcaagccatgttaacaatgccaggttaggagactagaatattgaggtctagtcccagatgcatatagtagtatattactatactgtatattaaggcttcacctgaatgcctcttttggaagttaataagagaccacagggaatttttaattactttaattgagctttttagaatgtggaatttattccattccagtttcaaaaagactctagtgtcagtatcccaatcttcccccacaccaattacctatttccactctgtaactgatacattaccaaagtttattatgcagaattaacatgacctagctgcaaggtccacagccagaaaacagacatgtcgaagagtattagttaaaatgagagcttttacataacaataatcaaatcggtatgtagttatgaatgagtatcttttttaatgtcaaaaaattgagcagactcataagacaatcgttgtgcattaagttacccattgagaaaaaataattgattacttttttccttttttttgagacagggtcttgctctgtcacccagggtggagtgcggtggcatgatctcagctcactgcagccttgacatcccaggctcaggcgatcctcccacctcagcttccccagtagctgggactacaggcctgtgccaccacgcccagctaattttttgtattttttgtagagacagggttttgtcatattgcccaggctggtcttgaactcctgggctcaagcaatcttcctgcctcagtctttcaaagtgctgggattccagatgtgagccaccaaaccaggtgaataactcatttttaatttaatgaatttatttaaaatttagtaaagattttgaaacttgttttcttcagcataagaagtatctacatatatcttaaaatgtaattattcacatatgttcatgatgtgtctgacaggcaaggaaggcacggccatttatgtctctataaatcctctaagaacacaagaaatcctctaagaacacaaatgactctggaggtgacaaggcccattggagatttttaggtggagtggaatgatgacattgattttttgaaaagctaaccttgacagctgtagggagaaccaactgcagttgggaactcagcagcccagaggtcaattaggaagcagaggggaatgccggctgcgctgggatgcagagacgcctctgtggtgacttggagaccaacggaaattacaatgagggagagagaaaatccaaagtgttcttaaggggtggattaaaggagaaagcatgataagaaataagaaatatcagagaaggaggtgttgaaatagggacaattgaagggtagaaaaggggttgaaaggagggacaagtaatatgaatttagtttaatacctactaaggcagaagtacctgagctacatccagtgggtagttggatgtcagtctaaaaccaaggagatctgagttagaggtttagaagataatgaaatatagtcgttataacaacagcttcaaagtcaaatagacaatgggttcaatcaaagttctgccacgggattagacaaaatttggggtcttactgagcatacacttcttcattttagaatgaagatggtaattctcagaagagtatttggtatgaattgggtgagacaaggcaggtacaaaagttagcaaagtgcctggcacaagtactatgctaactgctcagtaaatgttagatgccgttactattacgtaagttattgagtcatgaatagagtaggaattgaagccaggatggaagctgataaccctgaagtgtgtgagacaggagaatcaaagacagggccttggggatgccaacccaggaggggcaggcagagctggagcaggcaaaacagactaagaacacacagagacagggggacggagaatcaggattgggtgataacctggaagccaatgaaagaaagagttgcagcaagtaggaggatggttagaatcgtatttagcagataagcagcagaaaattaactattagatctatcaataagtatgtctttgttgacctgaacagcaatttgaagaaagatagggtagaggcagtgcacagagacagcattcagctttcctatcagtctgaaagtttaattattaaaatagccatataattctgaaagagtgaatataatctagctaaaaaccaggcagggactaattactagtattaacacagctgaagcggatctcctcaggaaccttcccctcagtgtgtgatcatgctagtatttctcccatcttaaaaaagtaaaaacaaaaacaaacaacacaataacaaaaaaatctcttaactttacaactctgcagctctacttctttttccattctacttctgctccatttctctcattaccttcacagcaaaactctgccagtggttggtctaaattccccatttccagtttttttatattctctcttacacctactccaaaatggcttctctctgacattccactaaaactcttgtcagagtcaccaaggacttccacattgcaaaatccgatggtcaattctcagtcctcatcttcgttgcctgattagcaacatttgatacacctaatcaccctttttctttaaatatttgattcatttagtttccagaatgcacattctcttcaccctcctcttttttcatcagccactctctgagtctcctttccttgttcccttttatcgtcttgacctcttaatattgaagagccctaagctcagtccttagacttctccaatatatattttaaatctatgcactcctcactcaacaatctaatccagtcttgtgacaaaaataaattgtatgctggtaactcctaaatttgtattttaagcctagaactttccagaaactccaaactactacttccatgttcatttaaagatttttatttgaaaccctttttttcaaaaaactgtccatttaaaaaataaatatcaacaaaagcaatgcatcatctcttttaatttttattttaggtttgggggtacatgtgaaggtttgttacatggataaacacgtgttgtacatattattacatcatcctcgtattaagctcaatatccaatagttatcttttctgcttctctccctcctcccaccctgccccttcaagtaaactcagtgtgtgttgtttccttttttgtgtccataagttcttatcattaagctccctcttataaatgaaaacatgcggtatttggttttctgttcctgtgatagttttctaaagatgataacctctggctccatccatattcccacaagagacatgatctcattcttttttaatggttgcataatattccatggtgtatatgtaccacattttctttatccagtctgtcgttgatgggcatttaggttgattccatgtctttgctattgtgaatagtgctgcaatgaacattcccatgcacgtgtctttatggtagaatgttttaaatttctctgggtatatacccagtaatgggattgctaggtcaaatggtaattctgcttttagctctctgaaaaatcaccatactgctttccacaatagttgaactaatttactctcccaccaacagtgtgtaggattcctttttctctgcaacctcacaagcatctgttatttttttctttttagtaacaaccattctgactggtgtgggatggtatctcattgtggttttgatttgcatttctctaatgatcagtgatattgagctttttctcatatgttcattggccacatgtatgtcttcttttgaaaagtgactgttcatgtcctttgcccccactttttaaggtggttgcttttttttttttgagacggagtttcactcttgttgcccaggttggagtgcaatggcgcaatctcggctcactgcaacctctgcctcccaggttcaagcgattctcctgcctcagcctccctagtagctgggattacaggcatgtgccaccacgcccggctaattgtgtatttttcatagagatggggtttctccatgttggtcaggctggtctcgaactcccgacctcaggtgatccacccaccttggcttcccgaagtgctggggttacaggagtgagcacccaaccttgtttttctcttacaaatgtcagttccttatagatgctggatattagaccttcgttgaatacatagttggcaaatattttctctcgttctgtagttacttgcttactctgttgatagttccttttgctgtgcagaagctcttaagtttaattagatctcatttgtaattttttatttttgtcgtgtttgctttttgtgtctttgtcgtgaaatctttgcccatttccagatccaggatggtattgcctaggttgccttctagggtttttatagttttgggttttacatttaagtccttaatccatcgttttaaatatttatttattcttcaacttttcttttaagttcaagtcctgcacatgtacaggacgtacaggtttgttacataggtaaacgtgtgccatgtggttggttgtacagatcataccattacttaggtattaagcccagcatccgtaaacaattcttcctgatgttctccctgcccttgcaccaccaacaggtcctactgtgtgttgttccccgcaatgtgttcatgtgttctcatcattcagctcccacttataagtgagaacatgcggcctttggttttctgttcgtgtgttagtttgctgcggataatggctcccagatccatccatgtccctgcaaaggacatgatctcattcctttttacgactccatagtattccatggtgtatatgtacaacattttctttatccagtctgtcactgatggacatttagattgattccatgtctgctattgtgaatgctgcaataaacatacacgtgcatgtatctttataatagaatgatttatattcctttggttatatacccagtaatgggactgctgggtcaaatggtatctctgcctctagttcttcgaggaatcaccacactgttttccacagtggttgaactaatttacgctccaacagggtaaaagtgttcctttttctctgcaactttgccaggatcttttgttttttgactttttaataaaagccattctgactgcagtgagatggtatctcactgtggtttcgatgtgcatttctttaatgatcagtgatgttgagctttttttcatacgttcgttggctgcatgcatgtcttcttttgagaagtgtctgttcatgtcctttgtgtgctttttaatggagttgtttgtttttctctcgtaaatttaagttccttgtagattctgatatcagatctttgtcagacagatagattgaaaaaattttctcccattctgtaggttgtctgttcactcttgtgatagtttcttttgctgtgcagaagctctttagtttaattagatcccatttgtcaatttttgcttttgttgcaattacttttggtgttttcatcataaaatctttgcccatgcctgtgtcctgaatggtattccctagattttctcctagagtttttagtttttggttatacatttaggtctttaattcattttgagttgatttttgtatatggtgtaaggaaggggtccagcttcaatcttctgcatatgactagccacctatgcaagcaccatttattgaatgaatagggagtcttttctccattgcttgtttttgtcagaaaagcaaaacatcttaaccttaaaactcaatcagttttcatgtgtcttcctcagaccaaaatttaagaagatgtcctactcctgctaggtgcatgtaaaactattactatttttggtctatagtagcaattatgggtctcaaatcaatcctttcagaaagtccatgatgtcaaagatattttcataatatgagacatgacctgaatttttcactttcatacacccaaatgtacggagtacaaaaagttcattgataccatttctgtttccacattatagcaaacctttagtaaactagtacttaaacaatttgatgtcatatcaaaaaatactcacaattgtctaaaaagaccattaaaatactactccttttttcagctatacatctgcatgaggccaaattatcttcatgtgtttatctaacacagtatatcacagcagattggaagtaaacagatgtgagaatccagctatcttctaggacaaacataaaagagattacaaaatttgtagacaatatcactcataactaatttttatgtttgggaaacataattatttcttgtaaaaattattatttatgttaaaatgtaaagggtttattattgttctatttttacttttgtccagctttattgaagtataattaacaaataaaaattgtatatatttatggtgcactatgtgatgttttgatatatattcacatagtgaaataatccctacagacaagctagttagcatatgcatcctctcacatagtcagcattttgtgtatgtgtgtgtgtggtaagaatatttaaaatctactctcttagcgaattttaagtatacaatatagtattattaactatagtcaccatgctgtccattagatctccagaactttcattctgcgtaactaaactttgaacatgctgaccaacatccctccctctgcctcatcccctagcctccagtaccacaatgctactctctgcttctatgaggttgacttttacatatttcacatgtaagtgagatcatgttactgtttatgtttctgtgcctggcttatttcacttagcatgatgttctctacattcatctatgttgttgtaaatgataggatctccttcctttttatggatgaataatattccattttatatgcccattgacacttagattgattctatatcttgactaatgtgaataatgctgcagtaaacatgggagtgcagatgtctctttgacatactgattttctttcaatatatgcccagaagttggattgcttcatcatatagtagtttcatttttaatttttttgaggaacctccacagtgttttccattatggctatgccatatcatgtacccaccaacagtgtgcaagggttttcttttttctctttgtccccatcagcatttgttatccttctttttttgatactaattattctaacagatatgaggtgatatctcactgtggtgttaatttgcattttcctgatgattagtgatttttagcacctttatatacccctgctgactattggcatgtcttctttttagaaatgtctatcaagccttttgcccttttgaaaattgtttttttttccttgttattagttggttgagtttctatatattttggatatcaacacctcatcaaatgtaaggtttgcaaataatttctcctaatctaatctgtaggttgtcttttcattctgctcactgttttctttgctgtgcagaaacgtttcagtttgatgcagtcccatttgtctatctttcctgttgttgctcatgcttttggggtcatatccaaaaaaatgatttcccaggccaacgtcagaacacttttttccctatattttgtctagtagttttacaggttcagacatacattcaaatatctaatccatttttagtttatttttgtatatggtatgtgataagggtccaatttcattttttgaatttggatcctgttttctcatgtagtgtgatgccttcagctttgttctatttctttcatctttcaaaagtttttttaattttaatttttatttcaatagttttggaggaacagatggtgtttggctgcacaaaaaagttctttactggtgatttcagagattttggtccacccgtcacctgagcagtgtacactgtacccaatgtatagtcttttatccctcacccccttcccatccttccccctaagtccccaaagtccattatatcatttttgtgtctatgcatcctcatagcttagctctcacttataaatgagaagatggacagtgtttgattttacattcctgagttacttcacttagaataatggtctccaactccatccaagttgctgcaaatgccattatttcattcctttttatggctgagtagtatgctgtggagtatgtatactatattttctttattcacttgttggttgatgggcatttggctggttccctatttttgcaattatgaattatgctgctataaatgtgtatgcaagtgtctttttcatataatgacttcttttcttctgggagacatccagtagtgggattcctggatcaaactagctctacttttagttatttaaggaatctccacactgttttccacagtggttataatactttgctttctaaccagcagtataaaagtgttcctttttcaccacatccacaccaacatctgttattttttaattttttgattttggccattcttgcaggagtaaggcggtatctcattgtgattttgatttgcatttccctgataattagtgatgttgagcattttttcatatgttttttggccatttctatatcttcttctgagaattgtctatttatgtcctttgcccacttttttatgggattatttgcttttttcttgctgatttgtttgagttccttacagattctgaatactagtcctttctcaaatgcatagtttgtgaatattttttcccactctatgggttgtctgtttactctgccaattatttctttggctgtgcagaaaccttttagtttaattaagtcccatctatttgtttttgtttctgttgcatttgcttttgggttcttggtcatgaactctttgcctaagccaatgtctagaagagtttttctgtagttacttttcaggatttttatggtttcaagtcttagatttaagtctttatccatcttgagttgatttttgtataagatgagagataaggatttagcttcattcttttagatgtggcttgccaattatcccagcaccattggttgaatatggtatccttttcccactttatgtttttgtttgccttgttgaggatcagttggctttatttctgggttctctattctgtcctattggtctatgtgcctatttttatgccagtaccatgctgttttggaaattgtagccttgaagtatagtttgaagttggataatgtaatgcctccagatttgttctttttgtttggtcttgctttggctacgcaggctcttttttggttccaaatgaatttagaattattttttctagttctgtgaagaatgatgaaggtattttgatgggagttgcattgaatttgtagattgcttttggcagtatggtcattttcttttcttttttttttttttttttgagatggagtctcgctctttcacccaggctggagtccagtggcatgatctcggttcactgcaagctgcgcctcccgggttcacgccattctcctgcctcagcctcccaagtagctgggactacaggcgcccgccaccatgcccggctacttttttgtatttttagtagagacggggtttcactgtgttagccaggatggtctccatctccttaccttgtgatccgcctgcctcggcctcccaaagtgctgggattacaggcttgagccaccgcaccagcagtatggtcattttcacaatattgactctacttatccataagcatgggaggtgtttccatttgtttgtgtcatccatgatttctttcagcaatattttgtagttttccttgtagagatctttcatgtccttggttaggtatatgcctaagtacttttttttttttcagctgttgtaaaaggggttgagttcttgattcaattctcagctttgtcactgttggtatgtagcatgctactgatttgtgaacatttattttatttcctgaaactttactgaattcatttatcagatctaggagctttttggatgagtctttagggttttctagatatacaatcatataatcaatgaaaagtgacagtttgacattctctttaccaatttggatgccttttatttctttctcttgtctgatttttctggctaggacttccagtagtatgttgaatagaagtggtgaaaatggacatccttgtcttgttccagatctcagggaaaatgctttcaacttttccccattcagaattacattggctatgggtttgtcataaatggcttttattacattaaggtatgtcccttctatgccgattttcctgagggttttaatcatagagggatgatggattttgtcaaatgctttttctgcatctattgaaatgattctgtgattttcgtttttaattctgtttatgtggtgtatcacatttattgacttgtgtatgttaaaccatccctgcatccctggtatgaaatccatttgataatggtgtgttatttttttttgatatgctgttggattcggttagctagtattttgttgaggatttttgcatctatgttcatcagggttattgatctattgttttcttgtagtgtcaacaagattggtacaaattcttctttgaatgtctgatagaattcagctgtgaatccattgggtcctagacctttttttgttgacaattttaaaattaccatttcaatcttgctgcttgttattggtgtgttcagactttctatttcttcctagtttaatctaggagggttgtatatttttaggaatttatccatttcctctaggttttctagtttatgcatgtaaaggtgttcatagtagccttgaatgataatcttttgtatttctatggtattagttgtaatatctcctgttttgtttctaattgaacttatttagatcttctctcttcttttcttggttaaccttgctgatggtctatcagttttatttatcttttcaaagaaccagctttttgtttcatttatcttttatattttttgtttcaatttcatttagttctgctgtgatctttgttatttcttttcttctgcttggtttgtgcttgatttgttcttgtttctctagttccttgaggtgtgaccttagattgtctatttgtgctctttcgggttgttttatgtaggcattttatgctatgaaatttctccttagtacaacatttgctgtatcccagaggttttgttaggttgtgtcactattattgttgagtttaaagactttttaaatttccatcttgatttcattgttgacccatcttgatttcattgttgacccatcttgatttcattgttgacccagtgatcattcaggagcataaaatacatggattttttttttttattatgagggttcatcttggagttaatttccgattctatcccactatggtttgagagggtacttgatatactttcaattatcttagatttattcagacttgttctgtggcctataatgtggtctgtctctgcgaatgtttcatgttctggtgaaaagaatgtatgttctgcatctgttgcatagaatgttctgtaaatatttattaagtccattttgttgtaggatatagtttaagttcattgtttctttgttggctttctgtcttggtgacctgtctagtgctgtcagtggagtactgaagtcccccactattattgtgctgccatctgtctcatttcatgtctagttataattgttttataaatttgggagcactcatgttaggtgtgtataaatttaggattatgatatttttctgttggactgatccttttatcattatataatgtccctctttgtctttttttaactgttgttgctttaaagtctgttttgtgagatataagaatagctacccctgctcacttttggtttccattttcatggaatatcttttcccactcatttaccttaagtttatgtgagtccttgtgcattgggtaagtctcgtgaagacagcagatacttgattggtagatttttctccattctgccattctgtatcttttaagtggagcatttaagccatttacattcattgttagtattgcgatgtgaagtactgtggtattcatttttgctacttgttgcctaaatccctttttataattgtattttgttttctaggccctgtgagatttatgctttaaataggttctattttggtatattttgaggatttgtttcaacatttagaactccttttagcatttcttgtagcactggattggtagtggtgaattctttcagtatttgtgtgtctgaaaatgactttatctctctttcatttatgaagcttagttttgctacagccaaaattcttggctgataattattttgtttgaggaggctaaagatatgaccccaatcccttttggcttgcaggatttctgctgagaaatctgttattcatctgataggttttcttttataggttacttaatgatttttgtctcacagctcttaacaatctttcctttattttgactttagataacctgattactatgtgcctgggattactatctttctgcgatgaatttcacaggtgttctttgagcttcttgtatttggatgtctagatcttttgcaaggccagggacatttttctcaattattccctcaaatatgttttccaaacttttagatttctcttctacctcaggaataccaattattcttagatttggccatttaacataattccaagtttcttggaggccttcttcatttttaccaaattccttcttctttgtttttgtctgattgaattaatttgaaaagccttgtatttgagctctgaagttctttcttctacttgtttgattctattgttgaaactttccactgcattttgtatttctctaagtctgtctttcattactagaagttgttatttaaaaaatatatatatacacatatatatacttatacacatatatacatacatatatatatagacacatacatatatatatatataatacgtggagcatttttcatccatatcctgttttttttaatttaagttagtctccacctttctctgttatctccttgagtagcttaataatcaaccttctgaattctttggcaatttagagctttcttcttggtttggatccattgctaaggaactagtgtggtcttttagggatgttacagaaccttgttttgtcatattgccagactaacttttctgattccttctcatttgggtagactatttctgcacaaaagtctggaactcaagggctactgttcagattcttttgtctcatgaagtggtcccttggtgtggtgtgttccccctttccctagggatggggcttcctgttagccagactgcagtgattcttattgctcttcttggtctagccacccatttgggctactgagctctgggctggtgctagataatgtctccaaacaatcctgtgatgtgatccatcttcaggtctcccattcatggataccagcacctgctctggtggaggtggcaggggagtgaagcagactctgtgacagtcctcggttgtagatatttttagtgtgctggcttcttaaatacttgttacgctagcagtgaagttgttacatggacacactcaggacacactctggttagccaggatgttgcgggcagtggaattagctgttgccttgttcttcctgggatcaggcttattttgtcatgagttgctataaggatctgagttggttggcctccagccaggaggtggtgctttcaagagggcaccagctatgatagtagaaggtggatataagcttgccctaagttgaccagggtaactatttgggtttctcaggcaatgggaagggtcataaagctcccaagagtttatattttgtgatacgctaccaggacaggtagagaaataccatcaggtgggagcagggttaggtgggtctgagctcagacacttgagtggggcttgttgtgaccactgtgggggatagggggtagttcttgggccaataggcttatgttccagaggaaattatggctgcatccgtggctagggaagtggtggaaaggcattagtgataggccttacccagttcccacgtgttggtgagactggtatcttttccactgtaccctgctaacagcgctaagtttgtctccaggcagcctgtccacaggactcagaccttaccccagactataagtttccccactgagaaagcaagcaaggctttcaggccatgccccttcctgtctgtccacactgtctgcctcaactcctgctctactctttgaggcaattcctgttcacccccagattctgctcaagaaagtttgcacccagtcaaaattattacatagttcagttggaagctcctttcatgctgtgacccctcccgaattttgccagctgccttcaccaaggttccctgtgagatatagtcagggatggcttctctgggctcaagctggagaacgagagtgcctacaaggctcttcccctgctgcttctatttttatattttatgctaaatccgtttaatctctaggtaaggttaagtcctttcctcatgatttgaattttcaggctctccagtggcaacatgtattcagaggcaggttttccccgctcacgctttgggaatgcacggttttttgcctgtctcatggaatatacagcatactgccacttctttcaaaggatctgtgaattctttcagtttttctgttatggtgctgctattgttcctgaaccaaaagtccatggtgtgagtctttatacactgttgtgtctgtccaagtgggtgctgcacatcagccctgtcccatatccatcttccatttatctcctggctttgttctttttattcaagatgactttggctactcggggccttttgtgcttccatactaattttaagattttttttttctatttctgtgaataatatcatcagaattttggcagacattgaattgaatctgtacactgctttgggtagcatagacattttgataatattaattcttacaacctatgaacacaggatatctttccatttatttgtatcttcttcaatttttttcatcagtgttttatagttttcaatgtacagatcttttgcctccttggttaaatttattcttatgtatgttttggcagctattgtcattgaaattgctttcttgatttctattttggatagttcattgttagtatgcagaaatgctactgacttttgtatgttgattttgtctcctgcagttttattgaatttattggttctaacagttttttgatggtgtctttaggattcttctgtgtataaaatcatgtcatctgcaaacaaagaaaattttacttctttctttttgatttggatgattttatttctttctcttgtctaattgttgtggctaggacttccagtactacatatattgtttgtttgtttgttcgtttggagatggaggcttgctatgttgcacaggctggactcaaactcctgggctcaagtgattcttccatctcagcctcccaagtagctggaactataggggtacacaagcatgcccagcttagtactatattgaatggaagaggggagattgggcaatcttgtcttgttcctaatcttaaaggaaaagctttcaatttgtcactgttgagtaagatgttatctgtgaacttgtcatgtatgacctttgttatgtttaggtagtttctctctcttcctactttattgggtgtttttatcacaaaagagtgttgaattttatcacatgcttttttttaatctattgagatgatcacatggtttttgtcctttattctgtgaatgtggtatattacatttattaatttatttatatttaaaagtctgcaccctagggacaaattccacttaatcatggtgaatgagccttttaatgtcctgatgaatttggtttgctagtattttcctgagaattcctgcatctatgttcatcaaggatattggcttgtattttattttcttgttgttttctgacctgactttagtattaacatactggcttcataacatgagtttgaaagtgttccctccgcttcaatgttttggaaaaatttgagaaggattgacattagttccttaagtatttggtagaattcaccagtgaagccatcaggtcctaggcttttctttttattgctgattcaatctttttcctccttattggtctgttcaaattttctattttttcatgactcagtcttggtggctgtttatttatttattctaggttctttgatttgttggtatataattgttcatggcagtctcttatgacactatatttttgtggcacctgatgtaatttgtctttcatttctgattttatttatttcattcttttccctttttttcttactctagttaaaatattgttgattttgtttatcttttcagaaaactcactcttatttgcattgatcttttctattgcttttctggtctctatttcatttatttctaccctcatctctgttacttccttccttctactaactttggccttagtttgcttttcttttttctaattccttgaggtgtaacagaaagctgtttatctgaaatctttttttcttttttgatataggtgtttattggtataaactcctgtcttggaactgcttttgcttctttctataagttttggtatgctgttgtccattttcatttttctcaagattttttttaaatttctctttcaatttcttctttgatgcattcattgttaagtagcatgttgtttaattttcatatacttgtggaactcagaatctttggacaggctgactggtgaagggctttccctgccaaagccagtttataaagactgaaagaggtgcctacttcttcaattgtgcaaataccaatgcaaggccacaggattatagataattggggaaagataacactaccaagggaacaacaacaacaagaaatggagatctataaactgtctaaagaagaatgcaaaataatcatttttaagaagctctagggagttccacagacttggtcaagctggtctggtgtttggtcagtgggtagatgatcctagtaccctgatccatcaagttaattttgggatctaggtctgtaagtgcaaggctggatcttgagtttacaagggttttctggtgctggggtccacttatgtgggtctggaaactagagccacaggggtatttcagaagcctgggtccatgggggctaacctgatgttggggggaactcctgatcttgaatacaaaggcttatatagccctggggcagtcctagtgtctggagtctggcggggatgtcctgaacctgggtttatgagtgtgggcctgggtttatgagtgtgtgtatgcaggggccagccctggtgctggggtctactggggcaggcctggaaaccagatttgtagggttgggcctggatcctgcatctggggttcaggtctggagcctgagtccaatggagcatatatcattaatttaaaaagaatagataaataaatatttttaaaatttttcttttctaatttcttatactgtaaatattgatcagtaccattcaggtaaacaaaagctctttgggggtcctaaataattttctcaggctctaaagaagtcctaagattttaaaaagtttaagaatcattggtttataaaaatttttttgttaaatggagctataatgctcagaataggcaaatcaatagagacagaaatgagattagtgattgcctagggttggtggcggtagtgggctggggtgggattagaaattagttacttaacaggtacagaatttctttttgaggtgatgaaaatattctaagattgtctgtggtgatggttgcacaattctatgaatcaagtaaaaagcactgaattgactttaataggtggattttatggtatatgaattatatctcaataatattgttacccaaaaaattgagttataatactggagattgtgggaaatttcagctcctcagcttttgtaaccatgacatcctcccacatatctaaaaatatgtggcatttttagcttaaagaacaaagataatatgccttgtggtatctccgccaaactgagtgaagatctcaaggtacctctaagattctcaaggagactcaaacaaataacattatgacctgggtatgtactggtaaaaccactgagccaataccccagtggaaggatccttcttctctgcttctaatcacatatgtctctggtaagtgtcactgaaagtggtagtcaatcattacaccccctagaaagacccataaatatatgggtatagatatttgggttaaaatctacaagggagtggaagctgatgaagaagaaaaacagtttccataataaacagaacttgttgtcatatatcctaacaggtaaatctcaaggtttccttattctactgcctttcagaataaacactgagactcctgcattgtgtgttagtgttttactttcctaggcaaatattgtgaattctccttaaatcttaaatattttattggataattaatataacttctttcaactgcaggtagtcgcctttaaacaatcttcttccaatttgccaacttaagaccacaaggtatgaccttcaccagtctgacccattcccacatatcacaaaatcccagtgtgtcacaagacccaagatttccatttatagtacatgttgtgatagaccataaatgcctatataagtttaaaaagaaagaaaaggaaacaagaatgtaagtaatgggaagaatatgggaaaatggaggctaatgtggtctctattcgttgagtgagttgaagtagcatgtcagaggttgctcatcacatcataatcatcataaatttgtatagatttacacaaatttgtattgatttatgatgtaaaactataacaattttctagcatgtggcagtacagtgtcttgaggaaggggtgctttttttctagttcacaaaaagttgccaacattagtcagcagtgatggaaatagcccttcttattggctgactatggagtactttccaagaggaaattaggttacagaatatatataatgaaaacccatcattttgaggtgctaaggaactaggagtgatattttctttagcctcttgctggtttgtggccattatcctccttccatcttgcaatatggttttcatgtacaaaaatgttttatttaaaattctgaggctagggtcttttttcacaataccacacacaacaagcaaaagattggttgatccagaattggggttgattagagcaatgctagaagtaaaaaagaacaaggaagaaaaaaaggtatgggatgaatatcactgatgtcacagaatgtaagtttagactggaaaggttaaggaaaaataaatcattaatagaatggaagcatatagaggaatggaagaaaatgtggtctcagtgagttgaggtagataaagcaatggaaggagcagaagaattgagaacttccctgccctaataactgaaacaaaaatgcccatgagaagagaaagatgtgtgcttgatctccagccataagtttagcctatagaagctgaagacagaattatctgtgcacaattctgaccaacatgaacaggcccagcattagatttcaaaatctaggcttgcaaaatcacagaaagcctcatgtgtctcaagagtatctgggtaccaatggcccacccctgcccctacttgctagggaactagaatcaagaattattagcaaccaaagctgcctttaagtatatgtagaatgtcgaataatggcccacccaaagatgttcatctaaattcccagaatttgtgaatatgttatgttatacagcaaggaaaaataagattgaggataaaatgaaggttgctaatcaactgactttaagattagaagagtgtcctggattattcaagtgtgcccaatgtaatgacaagggtcttttaagtgagtaagagggaggtagaggccaggtgagaagagagatttgaagatgacactctgctggctttcaagatgaaagtgggccatgagctgagtaatgtgggtaacttctagaagcttcaaaagatgggggtatagattctctcctaaagcttctgaaaagaaaagcagccttgccaacatcttggttttggaatttcagcagatgcagaaataacaataaatgctagcatttaataaatctactttaattcatcatttcaagtacgtgcacttctccatttgctaagtgcccagtggccaacactatctgaaagatgcccaatctggaaatgcagacaccaggtgaaaaggttgctattaacccagatatctttcaagtaagaactttaccactacctggtcctcatggaagaagcagaaagacattctttctgtagagaacatctagagggaattctaggtattaggaaggctgagagctttatcaaaacaagtaaaggaacaggaagcagcaaaatggagatgcttccccagcagaccctactgtgttggttgatttttgctgtggaataaagagttgcaaaattttatgcaacaacacatttgttctactcatgagtttttgggtcaatggaggtggctctgccttggattgcaggtctcagtcagctgtataaggcttttttttttttttttcggggtctcactctgtcacccaaactgaaatgcagtgatgcaatcacagcttattgtagtctcaacatgcaggctcaagcaaccctccgacctcagccaccctgagtagttgggactacaggcatgcaccactatgcaagtaaccctcctacctcagccatcccgagtagctgggactacaggcatgcaccaccgtgcctggctaatttttgtagtttttgtagagacagggttttgccttgttgcccaggctggtcttgaactcctgggctcaagcaattcgcctgcctcagcctcctatagtgttgggattacaggtgtgagactccatggccagccctctgtgtaacttttatcctctttgatcactaggcttaccatggcatgtccctcaaaatgataacagatacgcaagatgattaaccccactgtgcaaggatatttcaagtggatgaaagtgctaatatcctattgctcaaagcaagtcacatggccaagcccaatgttaagggatggggaatttcactctttccacaagaaaatgtgtggataaagagaggagtgaagaattgaagctaataattcaatctaccaaaaatattatctgtcttagtctattttgtgctgctgtaacagaacacttgagactgggtaatttataaagaatggaaatttattttctcacatttttggaggctaggaagtttaagatcaaggtaccagtagattatagcctggtttatctgcttccaagatggcaccttgaatactgtatcctccagaggaaagggacaccatgtcttcacatgagaagagcagaagagagggaaagagagagagtgagacagagagacagagagcccactcccataagcccttttttatggtgacattagtccattcataagggtagaacccttttgatcaaacacttcccattagcctccacttcccaatactgttgtattggggattaagtttcttacacatgcattttggtgggacacattcaaaccatagcactgtccattggatatctgaaccgaatctgcagggaactttggtgacacagatattcccaattagtctctctagctggatattgactttgacatctacctacagggaaaggacaagcctaggtggccaaagggtctactttagccttgcaatctaaaatgtctttggaaaaacctgactatggcttctattttattttattttatttttttagagataggatcttactctgttgcccaggctggagtgcagtagtgggattatggctcactgcagcctcaaaccctggactcaagcaaccctccacactcagcttcctaagtaactaggactgcagagatacaccaccacacccagttaattttttaatttttgtagtggcagggtcccatgttgcaaaggctggtcttgacctctgttctcaaggaattgtcctgccctcaattcccaaagtgctaggattatagccctgaaccactgtgcccagttggcctttattttagatacatttcctgccaccttcaacctatattgtgtcccgaaagttcttcctaaaagcaaggccatctattacaatcttatttatcaaagaacatttttgtatttatgtactgtccagctgtctgcaccccaatcttcaattcacatgctttttccacgtaggaggacattattccaagtagccctgctttgcaatgcccgaaatactcagacagaagggactctttttgtatacctgctaagacatcatagcttttgcacctacccaagccaaatggcattttcctgtggcaatcactgcctttgttgcaggttgcattctcccagaagcagactttgagaaagcaattaacataaaggagttttatttgggagtactctttaggtcaacagctatggaagggaaagggccaggatagagcagggagaggttggattataacgtgtcaatgaacatgtcatccaaccccattggagctctgaagctgaaagagcccttaaagttgtcccaagttgggattatatagctaggcctttatgactctgcatcaatcagtcgttggttaaggagtgtaacgttagacaagaaaagtcctcagctgaaagcagtgaatggagggctctcaaccagcagtactcggatatggctggtgcaccacaccagcctatcctatgcaaaatggcatagttccctccaataagttcctgttataacagttccctgatccccactcttcctggagccactgacagctaacagcaataaaatatcaagagaagcaaaacaacacatggtaggttcagagggaaagctgagggcagcatctctgtaatttttgagattcgtggatagcctctctaattacgaatatctcaaaattgtgcaaaacagagaatacatttgctggcaagatggccgaataggaagagctctggtctgcagctcccagtgagatcgacacagaaggcaggtgatttctgcatttccaattgaggtacccggttcatctcattgggattggttggacagtgggtgcagcccatgtggagggcaagcagaagcaaggtggtgcgtcacctcacctgggaagcacaaggggtcgggggatttccctcccatagccaagggaagccatgagggactgggctgggaggaacggtgaactccagcccagatactgcacttttcccatggttttcacaacccacagaccaggagactccctccggttcctaggccaccagggccctgggtttcaagcataaaactgggcagccatttgggcagacactgagctagctccaggattttttttgttcatatcccagcggcacctggaaccctagtgagatagaactgttcactcccctggaaagggggctgaagccagggagccgagtggtcttgcccagtggatcccacccccacagagccagcaagctaagatccactggcttgaaattcttgctgccggcacagcagtctgaggttgccctgggatggtagagcttggtggtgggaggggcgtctgccattgctgaggcttgagtaggcagttttaccctcacattgtaaacaaagccgtcaggaagtttgaactgggtggaacccaccgcagctcagcaaggctgctgcagccagactgcctctctagattcctcctctctgggcagggcatctctgaaaaaaagacagcagccccagtcagggacctatagataaaaccccatctccctaggacagaacacctgcgggaaggggcggctgtgggtgcagcttcatcagacttaaatgtccctgcctgatagctctgaagagagcagcagatctcccagcacagtgttcaagctctgataagggtcagactgcctcctcaagtgtgtccctgacccccatgtatcctgactgggagacacctcccagtaaaggctgacagacatctcatacaggagagctctgggtggcatctggcaggtgcccctctgggacaaagcttccagaggaaggaacagacagcaatctttgctgttctgcagcctctgctggtgatacgcaggcaaatggtctggagtagacctccagcaaactctagcaaacctgcagcagaggggcctgactgttagaaggaaaactaataagcagaaaggaatagcatcaacatcaacaaaaagaacgtccactcagagacctcatcccaaggtcaccaacattaaagaccaaaggtagacaaatccacaaaaatggggagaaaccagcacaaaaaggctgaaaattccaaaaaccagagtgcctcttctcctccaaaggatcacaactccttgccagcaagggaacaaaactggacagagaatgagtttgacagattgacagaagtaggcttcagaaggtgggtaataacaaacaacaaactccttcaagctaaagaggcatgttctaacccaatgcaaagaagctaagaacattgacaaaaggttacatgaattgctaactagaataaccagtttaaagaagaatataaacgacctgatggagctgaaaaacacagcacaagaacttcatgaagcatacacaagtatcaatagctgaatcaatcaagcagaagaaagtatatcagagattgaagatgaacttaatgaaaaaaagcgagaagacaagattagagaaaaaagaatgaaaaggaacgaacaaaccgtccaagaaatatgagactatgtgaaaagaccaaatatacttttgtttggtgtacctgaaagtgatggggagaatggaaccaagttggaaaacactcttcaggatattatccaggagaacttcgccagcctagcaagacacaccaacattaaaattcaggaaatacagagaacgccaccaagttactcctcgagaagaacaaccccaagacacataattgtgagattccccaaggttgaaatgtaggaaaaaatgctaagggcagccagagagaaaggtcgggttacccacaaagggaagcccatcagacaaacagtggatctctctgcagaaaccctacaagccagaagagagtgggggccaatattcaacattcttaaagaaaagaattttcaacccagaatttcatatccagccaaactaagcttcataagcaaaggagaaataaaatgctttacagacagacaaacgctgagagattttatcaccaccaggcctgccttacaagagctcctgaaggaagcactaaacatggaaaggaacaaccggtagtagccactgcaaaaacataccaaattgcaaagactatcgacgctatgaagaaactgcattaactaacgggcactaaattaatttgatgtttcttaccttcttggtatactactaaagggaactaaaggcctagggagattgataagctgaagtgagtaagtacctgttcagatactggctaagttcctcagaatggttcagaggatacatctttcatttcagctttccaaaatacattgggaaagaaagatctttgtggtagctgttctctaaaggttctaaatgagagggggaaatgctaccttctaactggggtctgtgacttcagtggaagtgatgagatcccagggagaatgcgccaattgctggcatttgatcacaaaagatgaggaaggtagctgggaccacaggtgtgtaccaccatacctggctaatttttgttgtttgttttgtagagacagggcctcactttgttgcccaggccgatcttgaatccctggcttcaagcagtcctcccacctgggcctcccaaagtactgggattacaggcatgagccactgcacacagccagatagagatctttaacattccacttaatagttgatcatggtatccctagaactgaaacaggtaattatcatatgccttagtcattcaggctgctatagcaaaatactatatactgggtagcttacaaacaacagaaatttatttttcacatttgttaagccttggaagtgcaagatcaaggtaccagcagatctggtgtctggtgaggtccacttcctcatagacagcacattctggccatgtcctcacgtggtggaagaggcaagaatctctctgaagtctcttttataaggccactattcccattcatgagggcttggccctcatgacctaatcacttcccaaagacctcatctcctaaagccatcaccttgggggttagggtttcaacaaatgaatttggcggaatgtaaacattcagtccattgcactccattaatgtcctacttgattcacaaacagtctggtgaaccgacgccatacctgcattagcacaataaggaattgtggaacctcaaccaattttcagacttaagatgcaaagattttgaaagaaaggaagacagcgtctctttgaggattgcttctatgagaccaaatatgtacactctagccctagccctagttggcggtgtctcaacccagggcaatttgcccccaagaagatatttgccaatgtctgcagacatttttggttgtcacgactaggagcatgctactgacatctaatagatagaatccagggatactaaatatcctacaaagcacaggacaaccccactacaacaaagaattatcttgcctgaaatgctgaaagtgctaaggttaagaaatcctgcttttctcaaaagacctgtgaccaccgagttacaacaacagaaagtgaaccaacatcatcatactttgcagtaattcaggaggacctagactaaagtcacactgggcaataaaaaagtcataacacagattgaagagtgatatgagcttaatgttaatacacagggacaatattcagtctcccctagagttctgcaatgttaattatccaaaacattacataattgcaagagagataaagtaatctggattaaaaataggaagaatataattaaccgtattaacaaactgaaataaaatgttgttttaaaaaaagttaatcttctttcatttaccaaatccaatccatccacaactgccatgtaaaaatcaataacaaatccattcccttctcctctctccttcttctcttctactaccttccctagtaaagccaccaccatctctctcctggacagcctgtttactgtagctttctacttcctcccttgttcctgcataatcttttttgatatgctgttgccaagtactcttcttaaaatgtcaactactcacaacactcctgagcatcacagagagtcccagtgaggagggaagctacggtgtgtgagatgaaattggaatctttttcctgcctcaaaggaaagcccggaagtatgagttaaaaaaaaaacaaacaaaacactggccaggcatagtggctcacgcctgtaatcccagcactttgggaggccgaggtgggttgatcacctgaggtcaggagtttgagaccagcctggccaacatgatgaaattctgtctctactaaaaatacaaaaattagcccattgtggtggtgcatgcctgtaatcccagctacgtgggaggctgaggcaagagaatcacttggacccaggtggcagaagttgcagtgagtctagatcatgccactgcactccagcttgggcaacagagtgagacactgtcttgaaaaaaaaaaaaaaagaaagaaaacattgatgcagttttgctctgcctaatacagcctgtatggaaggtctccgtggtctccttgctttcattcctggccctgcctgccttccacacccactcacaaattatcctctgtagcagagggatctatgcaaaccataaatcaggtcactcaatataaaaccatacctgcaagtaccttcccaagccagtgcttgatctaagttgtttcaagtagggcctaggaatcttatattgtctaatatgtccaggagattctaacttagccaagactgaacacccctggcctagagctgtacttctcaaaatttaacttaacgggtctctgaactacactttctcctggacagcctctttagtaggctttctacttcctctcttgttcctgcatgatctatttttgatatgctgttgccgtttgatatgcatgttgtccaggagacccattaaggctgagtggatcccgatatgctgcatttctaacaagctcccaggtggtgctggtgctgcctcccgaggactatactctgagcagccagagcctagaagggaaaaacattgctcccctctacctaaaccacccttgttcatcattactagcaactatattttccaccctttacccaaccttctggacctggtaatctgcagccagcccgctcaagattgcctgacaggaccttcagggcagacttttatagatgaaagaatgacataatgatggtgcgcactaggaacagatcagaatatgtgagaaacactatttttttcccagtgtacagcaggctttcttctggtaaaattaagcaaaactcagccctgccctgcccagttagagactagttcatcaagggggcaggttgaaatttagccacagtaccctcctatgcctgatatgcaactaaaaagcagtgactgtcaaccttttaactatcatgacctccctaaggagcctttttagacttttttttttcctgatcacaccctccgtataaaatgtcaataccacagatatacgatatatatggttatgaactcttgacctttgtaggactacaaaccattaaatgagacctaagaatttttggccgctccctgtgggcaatacaaccctcattgagaatgcatgattgagatccattcgctcattccagtcagctagattccaggcctggtgtgtagaccacatgtttggacacatttctccagctttccctaccaggccaagtggtggagaggacactatctttagaatcacacaaatcaagttaaaaccaagcctcagccatttacaagttgtaggactctaagcaagaatctttacctctcttatcctaagtgccccaactgttaaatggaattaaaatactcacactgaaaatttgctgtaaggtgtagaggtgaggtaatgttcctgtaaagtataaactgtagtgtccagggcaggacaggtattcaagaaatagtagtaactggccataatttagtggtggccctccacagctttctatttcctttgagattagattcattacacctgggctcagtagcgccttgatggcccagtacaccagcccagtacaactgcagagttagatgtctctctcgtcatgccccagtgcagaaaaaagaaagacacaccttccctaagtatctacctgagaaccagggcatcttgaagcagttccgggagtttgattaaagtggagtggggagctgagaaggatttgtcagcacaagcaaaggtacaatctgcatccaaggccactgctatcagtttgtagccctgacccagtctcttcgactcaacactacccttgacgcccatcttctggataagaataagcctagtcagcctacgtctaccacactacactttatctcaaatgctcctggacaatctgactacagttccatttcaagaatcatctttaacctcatttgccacattggtcctaatttgtcttttgaaatacacttcctgccaaacagtactagctatctgttagagagcaaagagattttccattttctcaaactacccgccacctagtttataacctcaacctcagtgtttatcccaattttgcagagtaccattgatatgcttaggccactcaaatctcatcttgaattttaatccccaaaatccccacatgtcaagggagagaccaggtggaggtaattgaatcacggggggcagcttccccaatgctgttctcctgatactatgtgagttctcatgaaatccaatggggctcttccccctttgctcaacccttcttcctgccaccttatgaagaaggtgtcttgctttcccttcactttctgctgtgattgtgtttcctgaggcttccccagcaatgctgaactgtgagtcaattatacctctttcctttataaactatccagtcttgggtagttctttatagcaatatgaaaatggactaatacaactattcaaagctgtcattgaatatcttctcctgtcaagctcccaaccacaacagaaagagtgaatcagctcttgcccttttttttaatattcgaaaatatttccaaaaaatagcctcgtctctcaaaatgaaaatcttgccttataccaactccctggtctccactcctcttggaaccccttgtcataagccagtgcttagcccagttccccacaaatagaaagccctaaataaacacctgttgcctgttcctctattgtcagcaccagaaatacccatctcctagggagtatctggctctgtcacctgcaggctgtgtgaccttcctacaggtggccttgcctccctgagcctcaactcctttacctgtcaaatggaagtaaaagaaccacctcccagggccatttcaagtgttgggacaattaaagaattagacacctagcagagagactgaatcctacccaagacctctctagtgagaaattaacccatcctcttttgatggcctggtaatgctgcctgaaactgatggcttcactgggaggggaaatcattttcagtctctttttttaaatttcaggatgtagctgaggaccaagttatattgtactactgtacagatttattactaaggaattattactactttttcctgactttaacctcttcccatattagatcctatcatcaaagccaaatacttcttaagattctaccacataaaaaatagaaatgatcttgaaaacatttagtatttcaacaaataacaaaaaaccttagtattttatagataaatacattttagccataactattattaaggctttgtctcttacaaaggagaaaggtaaaggcttataatttccctattaagtcagcacataaaatgcaattttaacttaaaattctgttaaaagtatatttattgtcatagtttccagccctgattggtcctaagaatcacctgtagagcatcttaaacataaagagctgtttggggccattacaaatgtagtactaagaacatcttatatagtacctatcttttggggcacatatgtatgcatctctgtgaagtgtatatctgagaatagaattgctaaatcaggatatgcatgtgatgagctttcatagatatcaccaaagagttttccaaaatggttgtacaaattaacactcacaccaatgcaatatgagaatccccattgttccatattcaataccattgcttggtattttatatctttttaattttaaccactccagtggatattttaatttttatttcctgagccataaatgaagttgagcatatatttattgagtatttgcatattttctctgaggtgtgccaagtatttttaaaattgagctgtgttttactggttaatacataggattcctgtctatatattcattccctctcactggggtacaggtcttttattttttatatgtgtattgagaatatttttcttcacatatccctctctttaatggtgacttttgttaaattttgttgttccttaactttaatatgctccaatttatcaattgttaactacctaggtgcccatcaacagtgaaatggataaataaattgtggtttattcaatcaatgaaatactataaagcaatgaaaatgaacaaatcacaactacctgcaacaaatataagtgaatctcatataacattgagggaaggaagctagcacaggagtagatattattttaattttttttttttttagtttcaaaaacaaacaaaactaacccatgatgttagaagttaggatgttgacaactttcactgggctgcagtagctagaaaggggccctagtggctctcttgagctgctggtgagaatctgtttctgaatctggaaagctagtcactcagttttgttcagtttgtgaaaatctatctagcttcacatttataatatatgtttatttcaataaaaatttaaccaaaatagaggtacatatatctgagcctcaacacctggacatccatatttcttagtgattcaaatgggcagccagggcaaggaccttcgatcaatattctgatcacaaatatgtgtgcaaatataaggactggaagccccattttttgaaaaatgtctgtggtttatgggaaacattaaaatggtgggattctagagtttcttttttctctaacattgtaatttgtattcttacaatgttgttttgtgcaattgtgaaaatcctgtgaattacacttctctgtgctctcatttgtcagtgttgtccatttctaggaagaaacatttgcttgcatgtctagaagtgtggcaagagggaggagggacagaagctatgaggaagtgagaaaataagtgctggctttcctccatcttgtgctactctgattagtcccagctcacagccaaacatcctcctctgaccagatgtgggggcacagtggtgatgtacactcgccaggagggcagagtccaatgtttatggggttctgcaaattactggagcagagtgtggtcccgaagaacaggagagacagaggaagcttccagctacagctttctcctccactttttctctgccctctcatgccctgcttgtctggcaatttgaatgcagactagacatttcatcatttgttacaaggacttatgaaaagggatacggactccgatgttgttgggcagattctagtttaggctagaagctggggagtaggggaggagatataagggaggaggatgaggtgttaatgttgtgtgtacttttgagccaggaaagaaatgtgattctgggtggtgaaggtcttggccaaatggatctgtttttcagagagacaaagagcccctgtgatattgtgaagtatatatttggtatccgtcccctttcctggcatacaacttttaaaatactttgaatctccaaagtgcttttttttttttcatatgcaattgttgactgatagattgaggatgggactggccactaaaaagacaaaggcatgatcacagggttgggactttcagccccaccccccaaccttccggggaggggagagaggctgaaggtcaagttgatcaccaatggccaatagtttaatcaatcatgcctatgtaataaagcctccataaaaacccaaaagggcagagttcagagagctgaacacatgcaggctgacaggaaggtgaaccagaatttattcatgtgccaggaagatggaacaccccaactccacaaggcagaaactcctgtgcttgggacccttgcagacctcaccctaggtacctcttctctagctgcttatttgtatcttttaaaataggccaggtgttgtggctcccacctataatcccagtaacgctttggaaggccgaggtgggagggtcatatgagcccaagagttcgagaccagcccagccaacatagtaagactccgtctctatgaaaaataaaagaaattatccaggcatggtggcatgagcctgtagtcttacctatttgggaggctgaggcaggaggatcactggagcccaagagtttaaggttacaatgagctatgatcatactgctacactccatcctgggcacatgcgcaagaccctgtcttaaaaaaaaaaaaaaagaggaaaatcctttaaaataaaccaataaaaggctgggcgcagtggctcacgcctgtaatcccagcactttgggaggccgaggcgggttgatcatgaggtcaggagatcgaggccatcctggctaacacggtgaaaccccgtctctactaaaaatagaaaaaattagccaggtgtggtggcgggcacctgtagtcccagctactcgggaggctgaggcaggagaatagcgtgaacctgggaggtggagcttgcagtgagccgagatcgcgccactgcactccagcctgggtgacagagcaagactccatctcaaaataaataaataaaccaataaacaaaagtaagtgtttcctgagtctggtgagccaatctagcaaattaattaaacccaaagaggggattgtgagaaccccaacttgaagccggtcagtcagaagttctagaggcctgaacttgcaactggtgcctgagacggtggagcaatgttgaggactgagccctttgcctgtggaatctgacatgatctccaggtagatagtgttggaactgaactgaaggacacccagctggtgtctgctgcagaattgattgcttgtttgctaggggggagaaatatccacatattttggggtcacagaagtcttttgtgttgatgattattgatgtgtggtatgagagcagaggaaaaaacacagtttgagtttttcccaacagttcccatccccagctgcttgatggttgcgagttttttgccactataaatcaggggacttctgtaatcatttacgcctcgtttagggaaaaaaatcaaattattgcattgtttgcttctgtatcttatttcctcctcccttaaaccgttagttgttttcaaatacaaaatcctatgtagcccaaaattagcatttctacaccataaattgattgtattgaattagcgaataatgaggcaaattggaagaaccagaacaactgaaggcaaacctcccaaagccttactttttatcgcagacaaagcaaatccctcctttcttttcttctgctgtgcttgtcacttctgtagagctgctattccagctggcctgccctgttcttggtgatattagagatctgtaactcaccctagaccacaggttctcagagtgtggtccccagagcagaagcatcatctggaaactttcagacatgcacattttaaggccgcagcccagacctcctgaatcagaaactctgggaatggggcccagtgccctgggatttaacaagtgttctaggtgatcctaatgcagtctacagtggttctcaaactctatgagttcctttaggtagagagcacatctgaggtacctcctgcaggacttggaaaccaattgaatgtgggaaggtagagaggaagtaaaagataaagatgtttcaacaaaccaagtaaggaatacaaagaaaagaggtgttttggttttgttattgtttacttgtttgtggtatttacacagaaagaagtaggtgataaaaagcttttttatgcctattttcaaaagcccgttctacatacatgtgttgtccgctcaaaacatccatctgctacggacagcagcgaccatagctgaggagccacatgggtttggctgtaaatcgaagctctgccatgtttaattcttcgagcctgggcaaagccttgcacattcctgagctttagcttcctcatctgacaattggaatagtcatacctaccccacagagttcctggaagtattaaatgagatcatgtatacaaatcaattagcaaaattcctgactcagaaatggctggtactatttgcgtatagatttgtgagcctgcagaatgtatatgagaaatgtagacaatagaatggctctgattatcctagttgtgcaagagagatggaaaactgagcacacttgaggatgccagcagtgggagcgggtggaggaggagcaggcagagagactgatgagaaggcacatgggagaggcaggaagagaatcaggagagtggcctgggagccaatggaggaaggagtgaatcaacagccacacatggggcagagattaagtaggactgaaactaagaattagccattttatttggccgtgaaaaattcactgttggcctggaaaacagcaacgtccacgaaggtgtaaagggagaggcagaacccactagcgggaccatgcaatcctgaagtgctgtaactttaatcatggaaatggattgataactgggagagagaaagagaatgtaagccatcttcaaaatggatagagcctgattaatggtattaatacatataatgaaagaattttcctgaaatgaaaattttggagttatccatgatttatttctttccatcacatctcacatgtgatatgtgaaatatttgttaatatttggtgataggtccaacagaggttgttgagttcatcagcagcctctcttggacctatcaccaaaataaatcccaaatatatccacttttctgctccactactgtcacactaatccaggctaccctcacctgacttccaggcaactacaatggctacaactggcctccctatctcctctcttgatttcctccctgcctcagctctcttcccagcagcctcagagatgttttatcatgtaaataaactacagtagtcccctaattcaaacccttcacaattagcaaataattcacaagatttaccttggtgagcaaagcctcacctacctggttcctgctaatcttctgacaccatgtcgtccaatacaactgccactagccacatgtgactcctgagaatttgcaatgaagctggtgtaatagaaaagctaaatgttagattttatttaatttatatcaacttaaatttaaacagccacatgtgactactgagaatttgcaatgaagctggtgtaatagaaaagctaaatgttagattttatttaatttatatcaacttaaatttaaatagccacatgtggctagtggctaccatattatccagcacagattcagaacacgtctatcatcacaagttctgttgaatagtgcttatctgacctggtgtctctgtgctcttccttgcttattgcacttcagcagcattggcaaactcacccacaacaagctacttcacccttgaaagcctttgcacaaactggatattatgagaggaagatattactcccaatattgcagaggcagagagaatgttactaccaatatcgtaaacaccctgggtatacaccatctgtgatattgttcataatatccatgggggagaggaagatactactccccatattgcaggcggcgaacaacccaccatcatattgtttgtaatattcaggggggaagaagataaaattacttcccatatcgcagggggtatacacttccttgtgatattgtctgtaatatccggcgggggagaggatgacattactccccataatgcagggggtacacaccccacggtgatattgttcgtactatccagagagggaaaggatatcactccccatatcgcaggggggtacatccccctgtgatattgttcgtaatatccagggggagagaggatgatattacttacctgtgacgttgttcataataaccagaagggaagaggatattacactccatattgcaggaggtgtacactccccctgtgatattcttcataatatccaggggggagaggatgatattactcccaatatttcagggggtgtacacccacctgggatattgttcgtaatatccaggggggtggggcataagattacttccaatatcgtaaacacctgtgtacacctactgtgatattgtttgtaatatccagggagggagaggataacattactcccaatttcatagggggtgtacatccccttgtgatattgtccgtactattcacagaggcagaggatgatattactcccaatatcgcagggtttgttcactgccctgtgatattgttcataatatccagggggacagaggatgatattactgcgattattgcaggcagtgtgcaccttcctgtgatactggtcataatatccagagggggagaggataatattactctcaatatcgcagggggtgtacacccatctgtgatattgtccgtaatatcaaggatggagaggaagatattactccccatatcgcagggtttcttcacctttctgtaattttgtttgtaacatccacggggggagaggatgatatttctcccaatattgcagggggtgtacacccgtctgtgatactgtctgtaacatcagggtggagaggaagatattactccccatatcacagggtttcttcacctttctgtaattttgttcataatatccacgggaggagagcatgatatttctcccaatatcgctgggggtgtacaccccctgctagatattcttcataatatttaggggggagaggatgatattactcccaatttcgcagggggtgtacacctccctgtgacattgtccacaacatcaagtgtggagaggaagatattactccacatattgcagggtgtgtacacccactatgatattgtccctaacatccggtggggggggggagtggctgatattactccccatatcgcagggagtgtacacactcctgtgatattgtccataacatctagagtgggagagggtgacattactccccatattgctggtggtggtattcaccccacctgtgatattgtctgtaacatccaggggtggaggtgatgatattactccccatattgcagggggtgtacgccctccggtgttttgttcgtaacatctagggaaggaaaggattatattactccccatatggcagggtgtgtactcctttctgtgatattgtccataacatctagagcgggagaggaagacattactccccacatcgcagggaatgaaagcccccttaagatatggactgtaacatccagagagggagagaataatattactccccatatcgcagggggtacacacccctgtgatattgtttgtaacatccaagaggggagaggatgatatttctccccatatcaaaggggatgtacacctcactctggtattgtccgtaatatctagggagggggagaggatgatgcaactccccaaatccaggggcacacccctgcgatattgtgtgtaaagtccgggggtggagagaaggtgtacacacccctgcgattttgtccataatatccagaaagggagacgatgatgtatctctccatatcgcaggaggtgtacaccctactgcgatattgtccataataaccagggggtaaggatgctgttactccccatatcgcaggggctgtacaccctccagcaatattgtccataatgtccagggtggagaggatgatgctactcctcatatcgcaggggtgtataccgctgtgtgatattgtctgtaaaatcaaggggaggagagggtgattttcctccctatatcggagggaatatacagctgtctgggatattgttcataatatccaaggagggagagagtgatgctactccccatatcgcaggatgtgtaaaaacccctgtgatattctttgcattatacccgggggaggagatgatgttaccaatcatatcgccgtgtgtgtgtgcccccctgcgatattcttcgggatattcagtggtggagaggataatattactctctgtatcacggggggtgtacaccacactgacatattgttacccccagcgatatgaggagtagtagcaaccccctttccccccccggctactacgatccacatcgcagggggctgcacacaccccaccgtgatgcggggagtagtagcaaccccctctccccacctgactattacgatccacggtggacctacacagtgtttatgatattgtgagtaaatcatgtccccctcagcaaattacgaactatttcacagacgggtgtacaacctctgccgtattgggaacaatatcatcctctcccccactggatattaacaacaatatcacaggggtgtttttactctctatgataatgcatgtcatatcatcctctcccacgttgaaattaggaacaatatcactgggtgtgtgtacacctgcgatgttcaaagtaatattatcctcttctctcctggatcatgggaacaatgtcacttgggggtgcacactttttccaatattgggagtaataccatcccctctgctttggaatatcaaagacactctcacacgggggtgtacatctcctgcgatactgggaataatattatcctctccccccctgcatattaggaaatatatcacagagtgggtgtacaccttctgcgatattgggagtaatatcctcttctccccttctggatattagcaactgtgtcgcacggggtttacactttctctgatatctggagtaatgtcatcgtctcctcctttgaacgttaagaacaatatcacagggggcatgtacaccccctgccatattgggagtaatatcaggctctcccccttctcttgatattaggaacaatatcccagcgtgggtgtacacctcctagtatatggggagtaatatcatcctctcccttcctggatattaggaacaatatcacagggtgggggtacagagcctgcaatattgaaagtaatgtcatcctctccgcctccggatattaggaacaatatcacagaagggttgtacactctcttcgatattgggagtattattattttctccttccctgaatattaggagcaatattcctgggtggatgtacacccactgttatattggcagtaatgtcatactctgccccctggatattaggagcaatatcacagggtgggtgtacacccacggcgatattgggagtaatgtcatgctctccctccctggatattcggaacaatatcacaggtgggtgtacatctcctgcagtataaggaataatattatcttctcttcctttagctagtaagaacaatatcacatgggggtgtacaccccctgcactattgggagtaatatcattctctcttattccggatagtagaaataacatcacaggcgaagtgtacaccccctgcgatattgggagtaatatcatcctctcccaacgtagatattaggaacaatatcgcagggggcgtgtacacttcttcgatattggtagtaatatcaacctctcccccttggatatatgaaacaatatgacaggcggggtggacacacctcgccatatagggagtaatatcaccctgtctccctccctggatattacgatccacgtggacacaccacgttgtttacgatattgtgagtaatgtcatctccccctctagaaattacgaacaatatcaaagatgcgtgtacaccctctgcaatatagggagtaatatcatcctctccccacctggatattagttacaatgtcaaaagagtgtgtataaccccagagacattgggagtaatatcatcctatcccacgttgaaattaggaacagtatcaccgggggcgtgtacgccccctgcgatattgaaagtaatatcatcctcttccctcctgggtgataggaacaatatcactggggggtgtacacttcctgtgatattgggagtaatatcatcctctccgtctttgaatattgaggacaatatcacgggaggtgtacaccctttgcgatattgggaataacatcctctcccctcctgcatattaaaaaaaatcacagagtgggtgtacacctcctgcgatatagggagtaatatcctcttctcctcttctgtatattaggaacaatatcacacgggggtatacactttctgcgatattgggagtaatatcaacctctcggcctttgaatattaagaacatcacagggtggatgtacaccccctgcgatattgggagtaatatcagcctctcacctccatggatattaggaacaatatcccagggtgggtgtacacctcctgctaggtgtggagtaatagcatcctctcccttcctggatattacgaacaatgtcacagggtgggtgtacacagcctgcgatactggaagtattatcatcctcttccccctccagatacctggaacagtatcacagaagaggtgtacactccctgcgatattgggagtaatatcgttctcttcttccgtgaatattaaaagcaatatcaccgggtggatgtacacccaccgctatattgggagtaatgtcatactctaatccatgaatattaggatcaatatcacagggttgctgtacacctactgcgacactgaaacgaatatcatgccctctctccctggatattagaaacaatatcaccagggggtgtagacaccctgcggtattaggagtaataacattattaatgattaatcctagcttcttaatattaatattaatgatcaatattaatatgaattttttctaatatgatattaattaatagtaacagtaattaatattaattactcattattttgttattgatagcaccatcaactaatgttaatcattaatattaatttttattaacatgattaataacataattgataatattaattggtatgattgtcatgtttattaatatttataatcaatattaattaataattatcaatgttattgtaacaatgattattaataataaataactaataatgtgttgattattcataattacaacttaattagaattaattaaaatcaattattaattattaataaatagtattattatttctgatatcggggcggggagggtgtgatattactgccaacatcgcaggaactgtgcacccttctgtgatattgttcctaatagccagaaggggagagcattactctcaatatcacagggggtgtacacctgtgatagtgttcttaatatctatgatgggagaggatgatattactcccaatatcacaagaactgtacagcgtcccgtgatatagttcctaatatctaagtggggagaggatgatattactcccaatatggcacaaattgtaaaaccctttcgatatatttcctacaatccatggggagagggtgatattactcccaatatcgaaggaggtgtacaccctcccgtgacagtgtcctcaatatccatgttgtcagacgatgatattacacctaatattgcaggggctgtacacccaccctgggacattgttcctaatatcgagaaggggagaggatgatattaatcccaatatcgctggggctgtacacccctcctgtgatattgttcctaatatcctaggtgggagagcatgatattactcccaatatcgcagggctgtatacccacccagtgatattgtccttaatgtccagaagggaaaggatgttattactcccgacattgaaggggttgtacccctcgacacgccaggatattgttcctaatatccggggaggagagggtaacattgtacccaatatcgcagggggtgtgcaccccccctgcgatattgttcctaatatccaaaggtagagaggattatacactctcaatatcgcagggggtgtacaccccacttgtgatactgttcttaatatttacggggggagacaatggtattactgtccatatctcaggggtggacaacacccctgtgatattgtttttactattcagtggggcagagaatgataatttcaatatcacaggggacacactccctgtgatatcgtttctaatattcaggggaagagaaatcatatgactcacagtatgacagggggtgtactcaccctccataatattgtatctaaaatccaggggggatttgaaagatattactcctaatatcacagtgggtgtaaaagacccctttgatattgttcctaatatccggggagggagaggatgatattactcccaatgtctttggaggtgtacacccccccgtgatattgtttctaatatttacgtggggaaaggatgatattactatcaatatctcagagggtgtacacccttcttgggatattttttctaatatcaagtgggggagagcaagatattactcccaatatcgcaggaggtgtacaccccgcctgttattttgtttccaatatccaggttggtagaggatgacgttactgccaatattgcaggagttgtacccccaacctgtgatattattcctaatagccaggggaagagaggatgatattactcaaaacagcgcaggaggtgtacacacccctgtgatattggtgctaatatccagtgtgggagacgatgatattactggccatatcgcgggggttgtacaccccctctgatatttattttaatatccagggggtagagtatcacattactcccaatatcgcagtgggtgtacaccaactctgtggtattgttcttaaaatccagggagggagaggatgatattactgtcaatatcgcaaggggtggacaccccctctttgatattgttcctaatatccagggggagagcatgatattaatccccatatcgctgggggatacacccctttttgatattgttcctaatatcccggggggagtcagtgatattggcaatatcacagggtgtgtacaccacacctgttatattgttttttttttccggcaatgaagaaattgatactattgtcaaaacagaatgcgcggtacaccccgcatgagatattgtttctaatatccatgggagaaaggatgatattactcccaatgtttcagtgggtgtataatccgcctgtgatattgttcctagtatcaagtggggggtgaggatgatattactcccagtctcgcagagggtgtacaccgcccctgtgatatcgttctcaatatcgatgggggtagaaaactatattactcccaatgtcgctggtgatgttcaccttcccggtgatattgtttctaatatttaggtgagggaatgatattactctcaatatcgcaagtggtgtacacagcttctttgatatttttcctactattttcggggggagaagaggatattactttcagtattgaagaacgtgtacacgacccctgtgatattgctcctaatatcaaggttaaaaaaggatgatattacccccattatcgcagggggtggggtgtacacttcacctgtgatattatttctaatatccaggggaagagagaatagtattactcccaatagcgcagggggagtacacaccttttgatattgttcctaatatccagggaaggagccgatgatattggtggccatatcacagggtgtgtatatccttgtctgatattgttcctagtattcagtgggggagaggataacattaatcccaatattgcaggaggtgtacatatttgctgtgatatagttcctaatgtacagggaaaagagaataatattattcccaatatcgcaggggatatattgtctctgtacattgttcctaatatggagaggggtagaggctgatattactcccaatatcgcagggggtgtacacaccccttttgatattgttcctgatatccagcgggaaagcggctgatattactcccaatatcgcagtgggtgtacacctcctttctggtattgtttctaatatacagggtggaaaaggatattactgacaatatcgcagggggtttacaccccttctgtgatatggttcctgatatccagggggtgagtagatgatattactcccaataacgtaggaagtgtacacccccctgtgatattgtccccaataaccacatggggagaggtgatattactcccaatattgcaaggggtgtacacaccgcctgtaatgctatttcttatatccaggaggtgagaagatgatattactaccaatattgatggaatgtacaccacccatgtgatattgttttgaaaatccacgtggatagaagatgatattactcccaatataacaaggggtgtacacaccgcctgtgatattattcgtaaaatcgagaagaagagagaatgatattacttccaatagtgcagggggagtacactcttcctgtgatgttgttcctaatatctaaatgaagagataatgatattactttcaataccgcagagagtgtacaaccccctgtgatattgttcccaataaactagtaggggagagaatgatattacttctaacattgcagtggctcttctccacacccccaaccccgtgatattgctcttaatttccagctggtatagtataatgtttctcccagtatagcagtgggtgtacactcaacctgtgatatttctccgaatattcagggaaaaacaggatgatactactctgaatatcgcaaagaatgtacactccttttgtgatattgttcctaatatccagaaggggagaggatgatattacttttaatatcgcaggcagtgtacacccccctgtgatattgttcgtaatatccaggtgaggataaaatgatattactcccaatattgcatggggtatacattctcctgtgatattgttagtaatatccaggggagcagaggttgatattactgtcagcatcgcaggtggtatacatttccctgtgatatttttcgtaatatcaagggaagaagaggttgatattaatcccaatatcgcaaaggtcatacaccctctgtgatattgttcgtaatatacggggggggggggaaggatgatattactctcaatatcgcagaggaatatacacatatcacagaggaccatatcacagaggaggtacgccccctgagacacccccctgccatatggttcataatatccagagggggagagaatgatattactgccaatatcgcagggagtgtacaccttcttctgatattgtttgtgatatccatagtggaagaggatggtattactcccaatttcgtagggggtgtacacccccttgtgatattgttagtaatattcagagggggagaggatgatattaccctcaatatcacaggttttgttcaccgccctgttatattgttcataatatccaagagtagagatgacataactcccaatgtcacatggaatttaccttctatgtgatattgttcatgatatccaaggtggcagatgatgttactttcaatgtcgcaggaggtgtacaccctaactcataatgttcgtaatatctaagggcggagatcatattactcccagagtcgcaggggatgtacaacctctgtgatactgtttttcatatccaagggggaagatgatattactcccaagatcgtaaacaccctgtgtatgcactctctgtgatattgttcataatatccaaggagggagatgattttactcccagtatcgcagggggtgtacaccctgtgtgaaattgtttctaatatcccaagggtagatgacgcttctcccagtatcacagaaggtatacatcctctgtgatattgttcgtaatatccaatgcgggagatgacgttgctcccagtatcgaagggcgtgtaccccctctctctgtattgttgttcatgatattcaaggggggagatgactttactcccagcatttcagggggtgtaccaccttttagatgttgttcgtaatatccaaggagggagatgacgttacccccagtatcgcagaaagtgtgccccctctgtaatattgttcataatatcccatgtggtagatgacgttacttcgagtattgcagcaggagtaccctgtgatattatttgtaatatctaaggggaaagatgacgttactcccagtatctcagagagtgtaccctctctctgatattgttcataatatccacggggtgagatgacgttactcccaggattgcagggggtgtaccccctctgcgatattgtttgtaatatcaaaggtggacgatgatactactctcagtgtcgcaggtggtgtacaccctctgtgatattgttcataatactcaaggggggagatgatactacacccaatgtcgcagggggtgtacactctctgtgctattgtttgtactatacaaggggaaaatgatactactcacaatgttgccggaggtgcacaccctctgtgatattgtacgtattatctaaacggggagatgacacaaatcccaatgtcacagttgttggacaccctctgtgatgctgttcgtaataatcaagggggacgatgatactacccccgatgttgcaggaggtgtacaacctctgcgatattgtgtgtgatacccaagatgggagataatactactcccagtgtcgcagggggtgtacaccttctgtgatattgttcgtagcatccaagggagagatgatactacttccaatgtcgcagggggtgtacaccctctgtgttattgttcataatatccaaggggtgagatggtactacttccaaagtcataggggatgtacttcctctgtgatattgatttgtgatatccaagggaaaagataatattactcccaatgtcgcattgggtgtacaccctctgtgatattgtttgtaatatccatggggggagataatattactcccaatgtcgcaaggggtgtataccttctgtgttattgttcataatatttaagaggggggaatgatattactcccaatgtcccatgggtgtacattccaagggtggatataatattactcccaatgctgcagggggtgtacaccctctctgttattgtttgtattatccaaggggggagatgatactacttccaatgtctcaggggatgtacatcctctgtgatattgtttgtacaaaatcacagaggatgtacaccctttctgttattgttcttaatatccaaggggggaatgatgttacaatgtcgcagggggtgtacaccctctgtgatattggtcttaatatccaaggtgggagatgatataactcccaatgtcgcatggggtgtacaccctctgtgatattgtttgtaatatccaagttgggagatgatataactgtcaatgttgcctggggtgtacaccctttgcgatatttttggtaatatccaagggggatgatgatgttactcccagtattgcaggaggtgtaccccctctgtgatattcttcataatatccaaggagggagatgtcataacacccattatcgcaggggatgtacccctctatatcatttgcaatatgcaatggaggagatgacattactcccagtatcgcagcaggtgtacccccttgtgatattgttcataatattgaaggaaggatatgatactactccccatatcataacaccgtgtgtatacactctctgtaatattgtttgtaatatccaagggggggagatgatactacttccaatgttacagggggtgtacaccctctgtgataatgttcttaatatccaaggggggaaatgatactactcccaatgtcgcagagcatgtacatcctctgtgatattgtttgtaatatctaaaaggggagataatactacctccaaatgtcacagggggtggacaccctctgtgatattgtttgtaatatccaaggagggagatgatactacacccaatgtcgcagggggtgtacaccctctgtgacattgttcataatatccaaggggggagatgatactactcccaatgttgcagagggtgtacaccctctgtgatactgtttgtaatatccaagggggaggtaatactactccaaatttcgcagcggatgaacaccctctgtgatattgttcacaatatccaaggtgggagactatactattcccaatgtctcaggggatatacaccttttgtgatattgtttgtaatatccaaggggggggggatgatactacttccaatgtcacaggtgtgtataccctctatgatattgtttgtaatattcaaggggggagatgatactactcccagtgtcacagggggtgtacaccctctgtctattgttcataatatccaagaggggagatgatactaccttccttgtcacaggggatgtacatcctctgtgatattgtttgtaatatccaaggggaaagatgatattactcttaatgtcacaaggggtttataccctctgtgatattgctcataatatttaaggggggaataatattactcccaatgtcgcatgggtgtacactttctgtgttattatttgtaatatccaaggggagatatgatattactcccaatgtcgcagctggtgtacaccttctgtgatgttgtttgttatatccaaggggggagatgatattatgccctgtgtcgcagggggtgtataccgtctgtgatattgtttataatatccaagaagttagatgatattactcacaatgtcgcaggggtgtacacccttggtcatattgttcgtaatatccaaagggggagatgatataactcccaatgttgcattcagtgtacaccctctgtgatattgttcataatatccaaggaggggagataatattaccttcagtgtcacaagggtgtatacaccctatgtgatattgttcataatatccaagggggagatcatattactcccattgtagcagtgggtgtacaacttctgtactattgttcataatatccaagggggaagatgatattactcccaatgtcataaacaccctatgtgtacaccctctgtgatattgttcgtaatatcaaaggagggagatgacattactcccagtattgcaggcgatgtgtaccctctgaaattattcctaatatccaaggaggagatgacgttattcccagtatcacagaagatgtatcccctctgtgatattgttcataacatccaaggggggagatgacgttactctcagtatctcatggggtgtaccccctttgtgatattgttcgtaatatccaaggggggagattacattactcccagtattgcagcaggtgtaccctcactgtgatattgttcgtaatatctaaggggaaagatgacgttattcccagtatgtcaggaaatgtacccactctgtgatattgttcgtaatatccaaggggggagatgacgttgctcccagagtcgcagagagtgtaacccgtctgtgatattgcttgtaacatcaaaaaacggagatgacgttaccctagtatcacaaagggtgtatccccccctgtatattgttcgtaatatgcaaggggtgagatgacgttactcccagtatcgtagggggtgtaccttctctgtgatatttttcataatatctaagaagggaggtgacgtttattccggtatcacagggggttgtacccactctgtgatattatttgtaatatccaaggtgagagatgactttactcccaggatagcagggggtgtactgcctctgcaatattgtttgtaatatccaatagagaagatgacgttactttcagtatcacagcacgcgtaccccctctgtgatattgtttgtaatatccaagggagcaaatgacataactcccagtatctcagggggtgtactgctcctgtaatattgttcataacttttaaggggaaagatgacgttactcccagtatctcagggggtctaccttctctgtgatattgttcgtgatatgtaaggggggagacgacgtcactcccagtgtcgcagggggtgtaccccttctgtgatactgttcttaatatttaaggggggagattatgtgccgagaccagctcggtcggtcggggagaccctaacccagcggagctagaggaattaaagacacacataatgtaaatgacgagttaatgggtgcagcacaccaacatggcgcatatatacatatgtaacaaaccagcacgttttgcacatgtaccctgtaacttaaagtataataataaataaataataaaaaaataaagttacaaaaaaaaaaaaaagaaacatataagtgtggagtaggaaatcaggggtctcacagccttcagagctgagagcctcaaatagagatttacccacgtatttattgacagcaagccagtgataagcattgttcctagagattatagattaacaaagtattccttagggaaaataaagggaggggctgaaataaagggatgggtttggcaggagtgtgtccttaaggcacagaccgctcatgctattgtttgtggtttaagaaggcctttaagcagttttccaccctgggtgggccaggtgttccctgccctcattccggtaaacctacaaccttccagcgtgggcatcatggccatcatgaacatgtcacagcgctgcagagattttgtttatggccagttttggggcaagtttatggccagattttggggggtctgttcccaacaattatgtaactcccactatcgcagacggtgtaccctctcagtgatattattcgtaataaccaagggggagatgacgttactctcagtatcacgggggtgaaccgcctgtgaaatggttcataatatccaagctggaagaggacgttactcccaatatcgcagagggtgtaccccctctgttatatggttcataacatacaagaggggagatgatggtactttcaatatcgcagtgggtgtaccccctctgtggtatgattcttgtagtataaaatgggggagaagacttaactcccaatataacacgggatgtaccccctctgagatatgtttcataatatccaaggaggaagaagactcccaatatcgtagagggtgtaccccctctgtgacatgggtcgtagtaaccaagaaaggagatgacgttactcccaatatcgcagagggtgtgctccctctctgatacagtttgcaatatccaaggggggagatgacattactcccagtactgcagaaggtgtacaccctctgtgatatggttcataatatccaaggaggggaatgacgttactcccaatatcgcaggttgtgtatcccctctgtgatatggttcgtactatccaatagaggagatgacgttactcccaatatctaaggaagtgtacgcactctgtgatatggttcataatatccaagagggaaatgacgttcacccaatatcacacagggtggacccttctgtgatattgttcataatatacaagggaggagatgatgttactcccaatatttcagggggtggacttcctctgtcatattgttcgtaatattcaagaagggagatgatgttacacccaatatcaaaggggatgtaccccatctatgattttgctcataatatccaattggggagatggtgttattaccaatatcacagggggtgtacaccctctgtgatattctttgtaatatctcaagggggagatgatattacttctaatatcgctgggggtgtaaaccctctgcgagattctacataatatccaagcggggaggagatgatattactcctaataatatcgcaggtgtgcagcgcctctgtgagattcttcgtaatatccctgcggggaagagatgacgttacttttaataatatcgtaaggggtgtaccccctctgcgagattcttcgtaatatcccaatggggaggagatgatgttactcgtaaaaatatcgtggggtgtaccccctctgcgagattatttgtaatatcccgggggagaggatgatattactcttaataatatctcagtgtgtgtaccccaactgcgagatttttcataatatccccgggggaggtgacattacccctcataatatcgcaggggggtgtaccttcactgtgagattcttcgtaatatcccagaagggagatgatattaatcctaataatatcgcagggggtgtacaccctctgcgatattattcttaatatcccagtggggagatgatattacttataatattgtaaacaccctgtgtgtacaccctctgtgatattcttcaaaatatccatgaagggagatgatgttactcttaataacgcagggggtgtacaccttctgtgatactcttcgtgatatccaaaattggagatgatgttactcctaatattgcagggggttaaaacctctgtgatattcttcctaatatccaaggggggaaatgatgttactcctaatatagcagggggtgtacaccctctgtgaaattcttcatatgatccgagcggggagatgatgttactcctaatatcgcagggggtgtacacgctctgtaacattctttgtaatatccaaggggggagatgatattactactaatatagcagaaaacgtacactctctgtgatatgcttggtaatatccaaggggagaaatgattaatttcgcagggggtgtacatcccctgtgatatttttcataatatccaagggggtagatgatgttactccaaatatcgcagggggtgtacaccctctgtgatattctttgtaacatcccagggaagaaatgatgttactccttacatcgtgtacactctccgtgatacttttcgcaatatcccagggggcaatgacattacttctaatattgcagggggtgtacaccctctgtgatagtctttgaaatatccaaggggggagataatgttactcctaatatcgtagagtgtgtacaccctctgtgatattcttcctaatatcccaggaagagatgatgttactcctaatatcgcaggggatgtacaccctctgtaatattcttggtaatatcccaggggggagatgatattacttctattatggctgggggtgtacaccctctgtgatgttctttgtaacattccaggggggagataattttacttctaatatctcagggggcgtacaccctccgtgatatttctcgtaatcattttcaagaaaggagatgacattacttctaatatcgcagtgaacgtacaccctttgcgatattattcgtaatgatgtccaagggaggagaaaacattacttctaatacctcagtgtgcatacacactccattatataattcataatcatgtccaaggcaggagattacattactcccaatatctcaggaggtttataatatcgcagtgggcatacaccctccgtgatattattcgtaatgatgtccaaaaagtagatgacatttctcttaatattgcagtaggcttaaaccctctctgatattgttcgtaatgatgtccaagggaggagatgacattactcctaatatcgcagtggacgtacaccctttgtgatattattcataataaagtccacgggaggagatgacattactcctaatatcgcagtgggtgtaaatcctctgtgatattatttgtaatgatgtccaagggaggatatgacattactcctaataccgcagtgggcatacaccctctgtgatattattcgtaacaatatccacgggaggagatgacattactcctgatatcgcagtgggtgtacaccctctgtgatattattcataatatccaaaaaaggagatgacattacttctaatatcgcagtggatgtacaccctctgtgatattatttgtaatatgcaaggaaggaggtgatattactcccaatatcctacacaccctgtgtgtacaccctctgtggttatatttgtaatatccaaggaaggagatgatattacccctaatgtttcagtggtcgtacaccctttgtgatattattggtaatatccaaggaaggagatattactcctaatgtagtagtgggtgtacactttttgtgatattattcgtaatatccaagggaggagatgatattactcctaacatcgtacacactttgtatgtacaccctctgtaatattattcataatatccaagggaggaaattatactgctcccagtatcgcagggggtgtacactctctgtgatactctttgtaatatccaaatgagatgatattactcctaatatcgtgctgggtgtacaccctctgtgataatattcataacatccaatggaggagaggaattactcctaataatgcagggagtgtacaccctctgtgatactatttgtaatatccaacagaggacatgatattacttctaatatcacagagggtttacaccctctatgatactattcagaatatccacgggaggagatgatgttacttctaacagcgcatggggtgtacaccctcagtgatactattcttcataatatccaagggaggtgatgatgttacttctaatattgcacagggtgtacaccctctgtgatactattattcgcgatatttaaggaaagaggttatgttacttctaatatcgcatggggtgtacaccctctgtgatactattattcataatacttaagggagaatatgatgttactcctaatatcgcacggggtgtacacccttcatgatactattattcataatgtctcagaaaggagatgatgttactgctaatatcgcatggggtgtacaccctctgtgatactattattcataatatttagaaaaggagatgacgttactcctaatattgaacagggtgtatattctctgtgatactattatttgtaatatacaaggaaagatataatgttactcctaatatcgcatgggacgtacactctttgtgatgctattattcataatatccatgggaggagatcatgttccttctaatatcacattggatgtacaccctctgtgatgctattatttgtaatatccgagggaggagatgatgttactcctaatattgcatggttacaccctctgtgatgttattgttcgtaatatccaagggagtagatgatgttacttgtaatatcccacggaatgtacaccctcggtgatactattattcataatatccaaggaaggagattatattccttctaatgtcacaaaggtgtacatccttggtgatattattattcataatatccaaaaaagaagactatattattcctaatatcacagggggtgtacacccttagtgacattattcataatatccatggcgtatgatgacattgccactaatatcaccgtgggtggtcaccctttgtgacattattcataatattcatgagagataattatattgccacaaatatccccatgggcggacattatgtgacattatgtcacataatgaggtgacaatatgtcacctctgtgacattattcgtaatatccaaaggagatgatgatgttgcccctcgtgggtggactccctctgtgatactttttgtaaaggaggattatagagtgagcaatatatttttatatatttgttgagggtccctagcaaatattataacatctgaactatgaaagcctggcttgacaactagaattttaaataacacttgtcttattcacaaaatgttataaagcttaagatggaaaaatataaaatgctttgacattacctaaagaagcatgagctcttgttaggtatatgatggtggccctgaacttgagccgacatctataatcccttttatcaatcaaaaagccatgttcttttatatggcatgcagactattaaaatacgaaaatgtgataatggataagcaactaacacaaagcccccacacttcaaatactgtcctggattgatgagggaagactggttggtgtgggggtgggggagaattcaaatatttatctgcaatcctaatggttaaaattttaccaggaacagacctgccactctcttgaaatactgtctctgagattaacgttaagaacagcatcatctctgttgaaaggctacattcccttatgatgctgattttttttttgtatgtttttgttttttgttttgttttgttttgttttgagatggagtcttggccagctggagtgcagtggcgatctcggctcactgcaacctccgcctgccaggatcaagcgattctcctgcctcagcctcctgagtagctgacactacaggcacgtgccaccacgcctggctaatttttatatttttaacagagacagggtttcaccatgttggccagaatggtctccacctcctgacctcgtgatccacccgcctcaacctcccaaagtgctgggataacagatgtgagccaccgcacccagcctgtgtatgttctttgtgtttaccgtaccaaaagcagacctgagcattttgctggccttagaggtctataaaagaactctaagcttaggcatgcagaacaggcactggatgtatgtagtgagcttaccaggagtcttgttggctccctgatgtccttatcatctctctttgcaggctgtggatgcacacaaggcaactaaaatcttgggcatcgtttgaaaatgtttggctgcctgctacaaactcagaagagagaacacttacttatattcatacttgtattggactggatatattttaaatccaattcttttttaaaaaagatgcctcactttaggaaataagacatcagaccagcaacatcaactaggtatggaatacttgctggtgagacacttaaaactaggaatcttctaaatcttctaaaggtgcttaagagcatggagaaatcaataaacaggcatccaagtgttgtggctgtaaagcaataacatagggtccctagtaaagagtaggcctaagagttggttttggagagaacttgggccaagaacagcagaaaaagctaaatgagctacttatgttgatgtgttttaatactggtgcattcgcagtatcttatggaagttgtgaacactaagaaccaatttcaagaaaaataaaaatgtttatagggcatattaaaataaaaacagcttaaattagttctgtaaataaaataggcctagcacagtgactgatgcctgtaactccagcactttgggaggacaaggtgagaagatcacttgaggccaggagttcgagaccagcctgggcaacaaagtgagaccccatctctgttctttttaatatcaaaattattataataaaaaagtaaaaataaatgtacctacttagaacacatattaaataaaggaatgccatgagaaaatggcactgcatttaccaagtcaccactagattcttgtgcaatgataaagtttgagactatgtattaacaatttcataaataaataatcaacaattttctttccactattttgatgttgggtaaagcctgacatgtgctgtcaagttttccatttgcattacatcaaattcttgtctactatggatattctgatataaaaaagactagttaaactcctattgaaagatttgccattcactacactcacataacttctcttagatatagattctttgatgttgaatgagcgttgggttgtgactgaatctcctcgtgcacatacacatttattacattcataatctttttgcatggcatgaatttgatactaaacaaggtagtttctttgactgatggctttttcacattcattgcagtaatggaattttattcccatacgaattctccaaatgtgactaaggtatgaaattattaatagcatgaaaattgaattatctgatgctgagtaacggttgagctatgactgaaggctttaccacatgcagtacgtacatgatttctccctggtgtgaactcccggatgttgaatgaagcctgaatttgactagactaaatgtcttctcaccctcgttatattcatgagttctctttggtatgaatgctccgatattgaaccaggtgtgctctctgactggagttctttttccgtacatcacaatcaaagactttctgtctggtgaggacatcttgttgcaggataaggtctgagctatgactgaaactgccctcatactcgttacatttatatgatttctctttcctatacattatttgatggtgaataaggcatgaggtttgactgaaagcttttccatattcattacactcatgcagtttcattcctgtgtgaattttttgatgctgaataagatgtgaattcaatctgaagtcttttctacattcattacatgtatagggcttttctctgaaatgaattccttgtttaatataggccaacccatattcatcatattcataggatttctcttcatggtggaccctctgatgttcaagcagatatgaaggatggcagaagtcactgccagatatagtacacttacagggcatctctttgtgaattttctgatgttgagtaaggtggacactatgactgaagattctttcacaactgctacatgtgtaagctttggctctggtgtgaattttcttgtgttgaattatgcctgagcttggactacaggatttatcagatgcttcacatttgtaaggtttttctctagtgtgtattcttttatgtcgactaagactcgagctctgactgaaacgcttttcacattctttacatttgtagggcttctctctagtatggattctctgatgtctagtaagggctgagctctgatggaaaactttctcacatacatcacatttataggattcctcagtgttagggatgctgtcccatttattaaggagggagagatccattaagctttccttacatatactactctgaaaatcctgtgttagatttatgtgttcatgtttaccagaggctgaattctggctgaagctcatgtcgttcttatcattatcatcagtgttctgtattctaagaactttctgatctgcatcaatagtagagtccagactgaagcttttttcaggtttattacattcattgttcttctcactggtgaaggcttctttgctgattgttatttgcctaaactctccaggtacaggaatttccttagaatttcctgaagcctttctaatctgtcctcagacttatacacttctctagtctcaggaacttaggtaatattgtgtttgagtcttcctactatcactttgcatgaatgtacttcttctgaaattttctccttaggaatcaacagcttgttctctggtctctccatctgatacaatatataaatagaagatacaaatgtaatctgtaccctgtgcttaggaaaagaaaactcagatgagaaaactgaacaatgtaatatctacaaggacaagaaaagtttatttatgctgaaaaacaggctcaaaatctcaacagcagaagtaagggcatgaacaggagcagtgaggtaaaacagcggacatctttagcaaagtaagaagacaccagttaaggagataatagggaaagagtttgaaagaattttagataagcaacttgattagcggtccagtacaacatgtgcacaggtcctaaacaaatggaaagggtcaacctaactgaaggaaaaagaaaataactctccatgctgggacacacacagaactcttcattctgagtgccaaagcagctacaacttggctcaacaattgaactttacttccctactaattccatctgattgattctgccttcctcacctgagaagtcatctcttaagacttctctagtcttagtttccagatcaaagacctgtagatcctgttccagctgggagagcccatcaggcttggaaattggaaatcctgatcatagagaaggaaatgggtgtggcaatgtatccccagatgctacaccagccactttttcttttaactaatgattaagacagagagaaggtaaactctgagaagacgttaattaggaaggcctggagagtgaagagggcaaagatcttctacaaggagctcaaatttgggctctagaaagatgtgtgttaaggggcaagttgatggcttgggagcagaaggattcatttaaacattattcggacaacaggatgtgtgcatgggtttgtcttcacagaagttatccttatcactctccatctgttacctaaagatcaatctttggattagagctggtctacaagcatcaaaatggaggtcatcaaaatataattctgctggactggagaaaggtgaaactcaagcatctgctacatggttagctaacctgtagcaaaagaatcagtgaaaactgaataaatattctaagaaccaatctcaagaaacaattcgtttcagtgcacataagaaaacaaagaataatatgacacattcttacccattaggagtgtagcatttattcagtaaacatttgtggagtgcctcctttacgcaaagtatgcaggggataaagagggcaagcaaggtcccttcccttaaggacctcaaggatcccacactctacacagagagagctctaaacaactaactacaataaaatgtagatagaggaaagtgcaatcaaagtgcatcttcacataaaacggtctttctatggcttgcataatggaatgcttggatctaaatctctttaaaagcgaaagcaataggcagtctgcttctgaggagacagaattttaatactattagcatcaaagggcagtttttatatgtgtccagcccagaaagcttctaatagcacacatacaaggtctagctcaagctcctcatctccaaaaacctttctctccatttactgaatgtctacaaaatttattagttgttcctcttaccctgacatgtcacatatcatggtgtttacatagatttgttttgttttttgtttttttgtgacagagtttcttcactctgccgtccaggttggagtgcagtggcatgagctcagctcactgcaaactttgccttccgggttcaagtgattcccctgcctcagcttcctgagtagctgggattacaggagtgcaccaccacacccagttactttttgtatttttagtagagatggggtttcaacatgcctgaactcctgacctcaggtgatccacctgcctctacctcccaaactgctgggattacaggcatgagccatagcacccggccctttacatagattttttaaagtagtttcaggtattatcattcatacttgatttataaactctttgacagaagggaccatgtatcttgtatcttgcacttcttttgattcatttacttaacagctacttattgaatgccaactctgtgcccaagtatcaatgtattaacagctacccaattttgtaaaaagggtattggggctggaaaatatgaagaacagctccccagaagattccatgtgacagcctatgagcaaggagatcaggacagatagaaaaaggtatttacaccccctgcgatattgggagtaatatcatcctctcccccctggatatttaatccttataaccgcctctgagatgtgtgctaaagaattcacacttggctgggtgcagtggcttatgcctgtaatctcagcactttgagaggccgaggcgggcagatcacctgaggtcaggagtttgagaccagcctggccaacatggtgaaaccccatctctattaaaatacaaaaattagctgggcatggtggtgcatgcctgtagtcccagctactcaggaggctgaggcaggagaattgcttgaacctggaggtggaggttgcagtgagtcaagatcgcgccactgcactccagcctggcgacagagtgagacttcgtctcaggaaaaaagaaaaaaaaagagaaagtattcacactttacaggtgattaaatcaaaagcaaacaggcccaagtaatctgtccaagcccaagaagctagtaaatggaggagtgagaattcgaaccctggcattcagaacccagagccagagctctttgccacattgtcatactgccttcctccttattacagaggtgcatatagtagccatttcattaaaaatgtaataaatgaatgttcattgcagggctctgatagctcctcattccttccaaagtagcaaaccaggcataaataaaagatgagatacataacttagaaacgtttacataaatttctacatattagaaatttagcacacaaaatggtacacattatgcaagaatacaaacaaaaagatgttaaacatttgagaatggttatgtatggagcattgtaaataaacaggaatagacaaaacaagagaggcctcccgatatcgcatggacatataatgataatgtgccatgaactgaaaatacaattatttggcactcagcacctgaggtcttagcacctgggcccacgtctccagaggtgaagagcagagtcacatgcctccctcctcccccacggaggtctcccaccattctaacctcacagggcttggggtgggatgagatttaaatttatatgaaaatacttacaaatattttaaaattatttcttactgttgctatatttattatataaaaatatgaatacttaatcatttttaggtgaggctagtgtaaaaaaatggaccttccaatcaaaactctataaataaaaattttaaatgttatcttggttctcatccttggcaatgattcttaaatatatctctatatattaggaatctgcagctctgcagtgtggcccaggcatctggtagtgtgtgtatgtacgtgtgtgtgtgtgtgtgtgtgtatgtgtctgtgtttatttctgtcattgctttttttaaattttaacacattttcagcactccaaaaaagaaaccaatacactttaagagtcactcctcattctccagtctcacacctgacccacagtcccaggcaatctcctttatgtctctttagagtgactcaatttccggacattttaacctactttctgtatcttggaattggtctattctggacacttcatatagatagaacaatacaatatgtaaccttttgtgattggtttctttcacttgacataatattttgaagtttcaaccatgttgtagcatatgtcagtatttcattccttttttttaaaaatatactttaagttctgggatacatgtgcagaatgtgcaggtttgttacataggtatacacgtgccatggtggtttgctgcacccatcaacctgtcatctacattagatatttctcctaatgctatccctcccctacccccctacccccagacaggccccggggtgtgatgttcccctccctgtgtccatgtgttctcattgctcaactcccacttataagtgagaacatgcggtgtttggttttctgttcctgtgttagtttgctgagaatgatggtttctggcttcatccatatccctgcaaaggacatgaactcatccttttttatggctgcatagtattccatggtgtacatgtgccacattttctttatccagtccatcattgatgggtatttgggttggttccaagtctttgctattgtgaacagtgctgcaataaacacacgtgtacatgtgtctttatactagaatgatttacactcctttgggtatatgcccagtaatgggattgctgggtcaaatggtatttctgtttctagatccttgagaaattgccacactgtcttccacaatggttgaactaatttacactcccaccaacactgtaaaagcattcctatttctccatatcctctccagcatctgttgtttcctgactttttaatggtcaccactctaactggtgtgtgatggtatttcattgtggttttaatttgcatttctctaatgatcactgatgatgagcattttttcgtatgttttttggccacataaatgtcttcttttgagaagtgtctgttcgtatttttcacccacttttggatagggttttttttttcttgtaaatttgtttaagttcctgtagattctggatattagccatttgtcagatggataggttgcaaaatttttctcccattctgtaggttgcctattcattctgataatagtttttttgctgtgcagaagctctttagtttaattaaatctcatttgtcaattttggcttttgttgccattgcttttggtgttttagacatgaagtctttgcccatgcctatggcctgaatggtaatgcctaggttttcttctagggtctttatggttttaggtcttacatttaagtctttaatccatcttcagctaacttttgtataaggtgtaaggatggggtccagtttcagttttctgcatatggctagccagttttcccagcaccatttattaaatagggaatcctttccccatttcttgtttttgtcaggtttgtcagagatctgatggttgtagataagtggcattatttctaaggcctcacttctgttccattggtctatatatctgttttggtaccagtaccatgctgtttgggttctgtagtcttatagcatagtttgaagtcaggtagcatgatgcctccagctttgtttttttttccttaggattgtctcggctatatgggctcttttttggttgcaatatgaactttaaagtagttttttccaattctgtgaagaaagtcaatgatagcttgatgaggatagcattgaatctacaaattactttgggcagtatgaccattttcacaaaaatgattcttcctatccatgagcatggaatgtttttccatttgtttgtgtcctctcttatttccttgagcagtggtttgtagttctccttgaagacgtccttcacatcccttgtaagttggatttcttgttattttattctctgtagcaattgtgaactggagttcactcatgatttggctgtttgtctgttattggtgtataggaatgcttgtgatttttgcacactgatttttatatcttgagtttgctgaagttgcttatcagcttaaggagacttggggctgagacgatcgggttttctaaatatactatcttgttatctgcaaatctgcaaacagagacagtttgacttcctctcttcctatttgaatacgctttatttctttctcttgcctgattgccctggccagaacttccaacagtatgttcaacaggagtggtgagacaaccttgtcttgtgccggttttcaaagggaatgcttccaggttttgccctttcagtatgatattggctgtgggtttgtcataaatagctcttattattttgagatacattccatcaatacctagtttactgagagtttttagcatgaaggtgtgttgaattttatcgaagaccttttctgcatctattgagataatcatgtggtttttgttgttggttctgtttatgtgttgaattatatttattgatttgtgtatgttgaactagccttgcatcctagtaatgaagccaacttgatcgtggtgggtaagttttttgatgtgctgctggattcagtttgccagtatttaattgaggattttcacatcaatgttcttcagggatattggcctgaaattctctttttttgttgtgtctctgccaggttgtggtatcaggatcatgctggcctcataaaatgaatcagggaggagtccctctttttctattgtttggaatagtttcagaaggaatggtactggctcctctttttatctctggtagagtttggctgtgaatctgtctggtcctgggctttttttgttggtaggctattagttactgcctcaatttcataacttgttattggtctattcagagatttgacttcttcatggtttagtctggagagggtgtatatgtccagtaatttatccatttcctctagattttctagtttatttgcataaaggtgtttatagtattctctgatggtagtttgtatttctgtgggatcagtggtgagatcccctttattatttttattgtgtctatttgattcttctctcttttcttctttattagtctggctagtggtctattttgttaatcttttcaaaaaatcagctcctggattcactgattttttaaggatttttcatgtctctatcttcttcagtgctgctctgatcttagttatttttggtcttctgctagcttttgaatttgtttgctctttgcaaaagaacaaaatttgttcttttaattgttatgctagggtgtcgattttagatctttctcactttctcctatgggcttttggtgctataaatttccctcaaaacactgctttacctgtgtcccagagattctggtacgttgtgtctttgttcttattggtatcaaagaacttatttatttccaccttaatttcgttatttatccagtagtcattcaggagcagattgttcagtttccatgtaattgtgtggttttgagtgagtttcttaatcctgagttctaatttgattgcactgtggtctgagagactgttacgatttccatgattttgtacttgctgaggcattttttacttccaattatgtggtcaatttcagcataagtgcaatgtggtactgagaagaatgtatattctgttgatttggggtggagagttttgtagagaacttgctttgtgaatctgggtgctcctgtattgggtgcatatatatttagtatagttagctcttcttgttgcattgatccctttaccattatgtaatgcccttctttatcttttttgatctttgttggtttaaagtctgttttatcagagactaggatggcaatccctgcctttttcccttccatttgcttggtaaatattcctccatccctttattttcagcccatgtgtgtccttgcatgtgagatgggtctcctgaatacagcacactgatgagtcttgactcgttatccaattttccagtctgtgtcttttaattggggcatttagtccatttacatttaaggttaacactgttatgtgtgaatttgatcctgtcattatgatgctagctggttatactgcccattagttgatgcagtttcttcatagtgtcagtggtccttacaatttggtatgtttttgcagtggctggtaccggtttttcctttccatgtttactgtttccttcaggagctcttgtaaggcaggccttgtggtgataaaatctctcagcatttgcttgtttgtaaagtatttcatttctccttcacttatgaagcttagtttggctggatatgcagttctgggttgaaaattgttttctttaagaatgtcgaatattggcccccactctcttctggcttgtagggtttctgcagagagatctgctgttagtctgatgggcttccctttgtgggtaacccaacctttctctctggctgcccttaacattttttccttcacttcaaccttgatgaatctgaggattatgtgtcttggggttgctcttctcaaggagtatctttgtggtatcctctgtatttcctgaacttgaacgttggcctgtcttgctaggttggggaagttctcctggataatatcctgaagagtgttttccaacttggttccattctccccatcactttcaggtacaccaatcaaatgtaggtttggtcttttcacatagtcccatatttcttggatgcttcattcattccttttcattttttttctttctaattttgtcttcatgctttatttcattaagttgatcttcaatctctgatacctttcttctgtttgattgattcagctattcatacttgtttatgcttcacgaagttctcatgctgtgtttttcagctccatcaggtcatttatattcttctccaaactggttattctagttagcaattcttctaacattttttcaaggttcttagcttccttgcattgggttagaacatgcccctttagctcagaggagtttcttattacccaccttctgaagtctccttctgtcaattcgtcaaactcattctccatccagtttacttcccttgctggcaaggagttgtgatcctttagagaagaagaggcattctggtttttggaatattcagctttttaccctggtttttcctcatcttcatggatttatctactgttggtctttgatgctagtgaccttcagatggggtttttgtgtgcaagttcttgttgatgttgatgctattcctttctgttagttttccttctaatagtcgggcccctctgctgcaggtctgctagagtttgctggaggtcccctccagacacagtttgcctgggtatcatcagtggaggctgcagaacagcaaatattgctgcctgttccttcctctggaagcttcatcccagaggggcacccgccagatgtcagctggagctctcttgtatgaggtgtctgtcgactcctgcagggagatgtctcccagttgggaggcatgggggtcggagacctacttgaggaggcattctgtccctcagcagagtttgagcactttgctgggggatacgctgttctcttcagagccagcaggcaggaatgtttaagtctgctgaagctgcgcccacagctgcaccttccccaggtgctctgttccagggagatgggagttttatctataagcctttgactggggctgctgcctttctttcaggagccctgcccagaaaggaggaatctagagaggtattctgactacagcagctttgctgagctgcagtgggctccacccagtttgaacttcccagcagttttgtttacactgtgagaggaaaatcacctactcaagcctcagtaatggcagacaccccttcctccaccaagctggagcatcccaggtcaactgtagactgctgtgctggcagtgagaatttcaagccagtgggtcttagcttgctgggctccatgggggtggggtccactgagctagaccacttggctccctggcttcagccctttttccagggaagtgaatggttcggtctcgctggtgttccaggccccactggggtatgaaaaaaactcctgcagctaccttggtgtgtgcccaaagggccgcccagttttgtgcttggaacccagggcccttgtggtgtaggcaggcacctgagggaatctcctggtctgcaggttgcgaagacagtggaaaaagtgtagtatctgcgcctgaatgcactgttccacgtggcatagtcccttatggcttcccttggctaggggagggagttcctggaccccttgcacttcccaggtgaggtgatggcccaccctgcttctgcttaccctccatgggctgcacccactgtctaaccagtctcagtgagatgagctgggtacctcagttggaaatgcagaaatcacctgccaactgcattgatctcgcttggagctgcagatcgcagctgttcctatttggccgtcttgccagccccctcattcgtttttaagactaaatgatatttcattgtatgtagatgctaattttgtttatccatttatctattgataggcacatgctaattttttatgattacgaataatactactatgaacatttatgtgtaagttttgtgtgaatgcatatttttgtttctcttggctacatacctaggaaaataatttctgggtcatgtgggaactctacatttaactttttgatgagtttaagcatcttcatgctttaaagttccctggaaggacaaggacctggctctctgactccccaggctgtctcttgaaaggtccacactccaggtcaggtttttgagaagttactttaatgttttatgaaaagagaggtgtcttcacttcaactttttaatgaaaagattcatcataatgattattatctccctttcatcatacctctctccttagctctatatactttgagaatgacattattcacctttttaagtaaataggtcacatagcacagttatgagcacatgctatagaggcagccttcctggcttacatgctgccttccctacttaccagctatataattttggccatgttacttaacagtttctcatgtataaaaatgatatgatgacaatatgatattactttcttagggttattgtggaaattcaattaattaatatctgtgaagtccatagaatggtacctggcatagtctaagtattctataaatgttcatttttattatcctactaccaacattccacaatgtttgtcatacagatggtgctccacgagtatttgctgaatgagatacatgataagagggcttagctagagcaagactcatcacatgtaaagtattaatagaatgaaccagtccttcccatttgttcctagggaaactaatcactccttcctggttgcacctacagcacttagaacatccaatagagctgacatctgggccttggaatattgtggctgtgctcatatctgtggctcacaaacagctccaaactcttcttcacctttttatagctgacacccagcagaggagccaagcactaagcaggtttgcaaatattcaatgcaacaccttattggtacttgattggcaataagaccagtcttaaataaaatctatatatatatattagccattaaccaagaccaccaagttttatgtgcagttttataattagctagtagtacgacatttgaccatatagctaccctcttttgtgttttcctaaggtataatattggcccagatgaaaatgggatttgtttggttcaaaaatcgtcaaaaatcagctatttcatatgattcaagctgatacttccagccctcaagttctatgccctaagcaagtagttctcaaaagactcctttagtcgagaaagaaaaaatactccttatgacagactcgtacaacataacgtacacacaagcatgagtgtacttaataagcataggtaactttgaagcacagcactaaacgaagggaaatacgtatttattaacagtcaggaccacaatcccatttaaatttcaaacaactttcagaaataggtatctcttcacattacaaatgaaagaaacagatgccaaatgaatcacttgtaaatgatacagaagtattaagtgtggatccaggactcccacctacccccaagtctatctgaatatagagcctatgttttccccaccacgaccctctgctttcgctgaggaagcctaacctacacagaatggccctggaaagaatgactaaaggataagcagccaaaaccagaatggaaaataattcgtatactctaattttactgcaggatgcaactgcaattttatttcagtcgtaccatttattatgaaatatctcttcttgatttcctccccaaacctgacattgaagtctcgatggtaacattaaaaaatctcttagctatatccttaagggttcagaataaaatcttcctgtacatgataagaggcagcataggtcaagagcctactctgatttctgcttcttggtgatcatacaacttcatacaagttacttggcctcctcttgcctcagcttctcacttctggaaaaattaagaaaatatcagtaactatcatggaattttaaaacacaccttccttttcttacagaaaaaaaaaagaggagctaaaaaattatatttctggggttttttgtttgtttgttttttgtccattcttggttaaaaaggaatcagctaaggaaacttgaaggcaaaagagtgacgtagaaactacagatactttattgataaacagttgatgtaaatatcttattttgagtaggtgatgtaatggaaatggtactaaaacttgattaagtaaagacaaaactggccaggcatggtggctcatgcctgtaatctaagccctttgagaggctgaggtaggtagatcatctgagcctgggagttccagaccagcctgggctacatggcagaaccctatctatacaaaaaatacgaaaattagccaggtatggtggtgtgcacctgtggtcccagctacttgggaggctgaagtgggaagattgtgtgagctgagaagtcgaggctgcagtgagctgagattgcgccattgcactccagcatgggtgacagagtgagaccctgtctcaaaaacaacaacaaccaccaccaaacaaacctaatatgttatgaataaatttaactctgtaactcctctgtataagtcatggcagttttcctcttgtgtgatttccttcttttcactataaaaaaaatgaggactcttctgttgtcgaactttgctaaatcatattaataaaatgtatgccagttaaggtgtgattttttctttttctcttctttcttttttctccaaaaagccatcacaagagagaacaattttgtttttttttgagataacgactaagattaatgtggtcccttttatataagctaataagacaaattgtttttaatttttaaacaaaattattattttttagagacacggtctcactctgtcacccaggctggagtgcaatgacagtattactgctcactgcagccttgacttcccaggctcaagggatcctcctgcctcagcctcctgagtagctaggactacaggtgcacaacaccacacctggctaattttttattttttgtagagacagggtctcatcatgttgcccaggctggtctggaactcctgggctcaagtgatctgcccacctcagcctcccaaagtgctgggattacaggtgtgggccactgtgcccggcctataatattttaaattgtaaaattaaaacattaataagtttctaaacctgaatctaacatgtggctttatgtcctgataactccacatgatgttacgatgattaaaggagtaaattcatgaaaaacacttaggacagtgtctggcacaagctaagtgttcaggaaattattattattagtgttgcatcttaatggtctcaagctattatttttcacccatcatatttagtgtaaaatagaatttggccctgggaatcaatgaccacatacatggtataactaatctcaaatatttaaattgactaagatatctatgtttcattaaggtaatcttggcccatagagtctaactagatcaatcgtttacaatcattaaaagaaaaaaaagtgaagcacataatgcaaaaacatttcacaggactccatgtgatataaattatataaattgttattttgttttatcccctagctgaaaaaaatacataaagagtaaaagctaccataaatcctctaatgctttgaaattaatttgtattttgtttttgacaacgtatatttgaaaatttatatttgagccatattcattcacacggcagttaagcttgtagaatatacagattcactggcgttttaatagcttaatgagctcctgggaagccatggctagccattaggaataatgagttagaaaggtcagcaaaaccttttctgcaaagggccagagagtaaatatattaggctctgctggccatgtatgtctctgttgaaacaactcaactttgccattgtagcagtgggcaacatgtaaacaaatgggtgtagctgtgttccaataagacttcactttcaaaagcctcagcccacactgaaggtggggaggttatgcaaaggtgtaaatgccaggcagcaggcatcactgggagtcctcgcagaggctgctggccacataacccaatgctcacgatccccaaagtgtatttggaggaacatgaattgttgatgtgtttgggaatttttttgaagctgcattttatatttaaactatattttcaaaatttcacacaggagcttcaatcaagctgtgtaataagtatatgggagtcatttatattattctctataatttatttgtaatatatcaaaacaaaaatgcctcaaaaatatacagtaaaagaatcaaacacattcctagagttgtttttatgaacaatctgtttatatagtgctggtttatgttttatatcttgtcataattttaacatatgtttaagtatgaatgtttatataatagtaagtttctctcatagaccatctctcttctgcttaccacatttcctttaacaccctaattacaacgactctgagattctacctgaaaaattagcaagatgcccccacattctagcttttctctccacaaatattgaggaaagtcccagctttgtttacacatgtccttgagtcagacctcattgccacctactgatgtgatataatttgggtgtgtgtctcctccaaatctcatgttcaaatgtgacctccaatgttgcagatgagcctagtgagaggtgtttgggtcacgggggcaaatctttcatcaatggcttggtgccatcccaatggtaatgagtgagctctcattctggcagttcacacgagagctaggttatttaaaggagactgggacctcctcctccctctcttactacctctctcctgccatgtgatatgtccacttcccctttgtcttccactatgaatggaagcttcctgaggccctcccgaagcagatgctgttatcatgcttcttacacagaactatgagccaaataaacctcttttctttataaattacccagcctcaggcattcctttatagcaatgcaaggtagactaacacgtgatgctcatttttttttaaagcctgcaaacagtaagaagattcccctctctttctcagtggatgtaaagcagtgattctgcataaatgtatcaacactatagctcaactccttctggagtggacttcccctagacctggagagcgagtcctgcctagcatacacggcctgaagttcgagatctcttccaattcaggtaatattccgctttctgtatgcctgatctctacatatatctgacattgatttttaactcaaatgaggaaacaggaaattattaattacaatctcctaaaactacaacaggtgttataaaacttctgaatataaacaggcagacagcaaaaatgtacacaggcataaaatgtaaacttgagtgagaaaaaggagctgaaaaatgaaaggctcgctttgaaacaaaacagcactgaagagtctacaaagagagagtgactggagagagactgatgtgggagagcagaatggggatcagattataatgagtatctctcccacactaaggaatttgcagctttttttgataggcaataaagagttacatataacagctgtatttaaattgttcctaggtgatggagctgcaggtaattcttttcttcttcctttttgtattttactttttctttttttttttttttttttgagacagagtctcactctgtcacccaggctggagtgcagtggcgtgatctcagctcactgcaacctccacctcctgggttcaagcaattctcctgcctcagcctcctgagtagctgggattataggcgcacaccaccatgtccagctaatttttgtattttagtagagacggggtttcaccattttggccaggctggtctcgaactcctgaccttgtgatccacccaccttgatctcccaaagtgctgggattacaggtgtgagccactgcacctggccttaatttttgtttattggaaaagaaggaaaatctatatttttaaggccaccagccacagcacttagagaagaaggaggacgtatattgcttttgctgtttcctgttagcctgacatttgcgactacattgactctgctggggtcactttctctaatttgtggatttttttttctttctcaactgcctggaggatatgtatgggtccatgactcggccaccacataagattgtgaagattatacctgtcaagggtgcccagtcaaggaagaagagtggctgaattcagcctgtgctctgcctgaaagccctatgctctgtgtgggccttagtccacctagaggaaggggtaccttttaaaagtacacacaaaggcacatcatgggctggccgcagccctgcctggccccaggtgagctagcagtgccagatgcctccagaatagactggaaggccttctgtccctctattatgtcaaaactgcaactggaactactttgtccaaggaaaggagagagaaaccataggaaaaggccataggagaatggtgtctggaaaaaaaaactgcaacgaatataagagatatgaatgaagcagatgcaatgaaacaacaggtttaatttcaggcttattttagcgaatggaatagaatccccattgagtaaacacgaatacaaagggtttattgagaagatacagaggaattgcacagagccaaaagcccagtctggcttcacaagacttggaaaactagagtgaggttcaaggaggttttccccgttcatttctccagagtcacacagcctctcctctcctcacctctgtactgtctgctctactcttcagtctctctctaaagacaagtttttcttactcgttagaaagctcacggcaaaaaatggctcctcgatctcaactttatgggaccattctcttcatgcattcactgttctccgaccacaatgtctatagatttggatcaaatttccaagagatgagagagcaaattcctattttactcacttgcagattcaaaattaacacagatatgatttgtaaagagagtatttctaccagtcttgaccaggacagtagatttctatattgagttctacagatcagcccatagctgtgttgaagtcagataaaatataaagactaatctctaaatttaaaacattttatttgggaagcaaagattggattcagcacatacccacagactggctggcctttagtatgtccaaagaaaaaagagaaggttggaggcttttataaaaaggacaaatgttacatattattttgaaagtaatttcattggcactagtaaggttttggatagctggcaagctctggttggtgaacgatggtggtggctgaaactagttgtagagttacagcaggctgtttctgtagctattatattaaaactggttcacgttaaaacaggcagtttcggcagccaggtttgcagagaattacattcttggagcaatatgatatgccctgagtgcattttccccctggttcctcaactctgatttagttgagtataacaagaatgacccaatttgtgtgatcaactttcacagctggttcccaatcattgagtcacaaagtaagaaataatcaagacaagatataagcaattttatgaaaattcccccacaatgtgatgaatttattgatgatcatcaacagtgaaataaccatgcttaaaactccctgttctatataaattattgaactgacagacacaggcatgtgacttatcaaagaaaaaaataagtatgctttttagctagaatgcctggggaattaatgagttcaaaacttagggagatgcattattctctcttgttaaacaaaatgagaccgtatttatgggttaatatttggcaaaggtgtacaactaccatcagagatggctttgaacagtcatggagtctgaatgctttatttagcaaaaattgtacaagaaccctattagaatactaaggctacaaaattcagagcaggtaaccttgatttatacgtgtaggaaaaataagtctttcaaatgtcagagtctggagttttctgcaattaagtcataatttttgctatttttacaggtcaacaagaaaactcaattcctcttcaggaagttaagtgacttaaagattacataagagctaagaagacaagccagctaagcatgttcaagaccgggctttttgaaactgcactaattgatcataacggtgtgagtttcaagccccttcatagctttcctatagctcactctgtgcctctcccaaatgacaaaaacaaggcaaacccatagagtatgagtttacatcatatgcaaaaaacacaagtccagagtatagaaaatggaagaagaaaaatgaaatcaatgaactttaatatcgttaaagttaacactatatccatggaactttgatctggcatagttttttgccacattttatttaaaagatttcaatttatgcatccttttccacatctaggttatggattctggcagatataagattgtctcttatttaatctctgtatccttagcaactagtgatatacctagcacagaaaaagcactcaacacatttgatgaatgaatgtgattgttctgttgacaaaaggataataatctcttgactagaaaaaaaatcattctaaaaatcatcacatcagggactaaaagaatttgggagtttatttactgttgttcctctttgtttaaacacagcaggccctcccaagtatcctattgcatctggcccacaagatctagttgcagagataaatgattcaagaaaatttccctggcttactccccatttataccagatccactacttttgcttccatcctccatttctctgaattcagggcccagtacctctgactttgatcaatgctttgggctccttcaggtttgatgactgatagaagttaccctctggttcatgaaacctctgcctcccacatgactcttgtcctagcttgcttcacaatgattatgattgtattaggctccataaataccatcatgataatcaaatcaacactcttagagggctaactgataatggcaatgaatacaccatgaattcaatggagacacctgtctgtcattacttgtgtaaacgatactcattagtggttctctgccttggctgttcatgggaaatacctggggaaatctagaaatattgatgcttacccccatagattttaacaggattggcttgggggaggcctggcattagaactttttaaaaactttcagcggattcttacataaagttttcaaatcactgctttaggctgaaaacctaactggtgcaattttttccatattgcagagaatagacattacaaaatgaaaatgaaaaaatttcctagctttgtgttctagtttcttgtctgtgtataccataacatttatctaagtattgctaggtgaatgtaggttggctgagatgacatgttaaaaatttccctggagtaaaatgagctatattgagtggataggtttgagacatgttaaaaccaaaaaatccaaaacgttaatgccataaggattgattcttctctctaaagtgagaaccaggggagaatgttctcctccacttcctatcttaactgaaggctgaaagctgtccatccccactcccaccccacaggatcaacaagaactggcattctctgactgtcccctcccacttgcaggtcatttgcccaggcattggctatttcgagagctgtctgtctggagacatagggaacttagctgttaatggagggacaaatgccagccctgggagctgactcatgcctaaaatatgcagagggagcccaagggaatgcaggcttcctttctcttcctttctatttgtctttaaacagctgatggggaagctcccttgctacaggcaactgagaaatagtgctgactcagcttctgttccaaggctcaagagataagggcatagcacagccctgggtgctggcatcttcaattttaactcctgtttgccatttgtccctctctctagaccataagtgtctgcttatatgttgtgccaaaagtaaagcttcaatttctagaagaaaaggagagtttattacatttaacaaaaatggcaaacaatactgtaaaaattgcataccatgtacagtttaaataaactacatatagtatatttggcttctttcattaggcctcattattatggttgtcttcgatttctccattgatagtgatcctccccttggatagtcctggtttgaggccagggcagagctgggaggagaggggtcactaactgttcacagcttgcaccatccctaacatgagattccaaatgaattttgccacagcccaattcttacagacccttcaggctgtagcagtgtcatttaagacacctggctcttctccagagacacattcgaacaggcattgcaatcaccttgctggcagaagaaagaggagataggacagtccattagtggctagagctgcaacttgaacagagtcagagacaggcaaaaagaagcaggtagcccacgggcaggcagcgaaagctgacattctctctggacagggctatgtcacaggagagctcacggcagggcttgtgtggattaagatgagggttagagataaacagcagactcctcagtatcttgaacagcaggcctcagcttgccttgtatgtggagacagcaatgaatgggtctccttggcaacggaggcatgcatgctcagcaggactaccgggcaggcatctgcaagcctgcgatgagtgttggtgtccctgccctcttcttcttaatgttcatgtcatctaagtataccgcccttttactcctcttcactgctgtcatctactgccttcagatcactgtccatcattgcgtagaaatcttctccaccacaaatcctgagagatttcaacctctatttagatagccactgagcaatattgctttgtaattcctgagtctcctttgctgcattgcatttcagcctcctaatccaaggagctgatctgggatcttaatatcctccaaatgccccaattcagaaatcctaactccagttgtccggtctcagattatcccctatcctttctgctgtctctaccttcaaaccatctgttcacagagactcctaattccttgacttgttctttcattaaggtctaacaggatcctcttagcctctcttcttccattacactggccagaccccttcattctaaattactacctcaccagaaagatcaaaacttatgatcaattttacaacctaccttttctgattctaaactctggtgttgctgctgcaagtgcacactggcacaaagttactatacaattcatttgtgcttttcaatctcagcctagccctgagcaatttgtcaaccttcctgtttgtctttgaccaggttcttcatcccacttctcaatggctctcagttgaccacctcatctcatactttattcacaaaattggcagtgtcagtaaaacatcctatatcatcctactcatacacattacaaagttgcctgcctcctctgcccaagtctcagagggcaagttcttcctgccctcatcaccactgggaacctactccctcctgctccctctgcaattggcttcatcaatctttttcttgttttcctttaccttcaacctcaccttcttcattgagccctcctctagtatctacagacctgctcatgttcctctcaacctaacattttatgccttgtatatttcaaaggaagctagaaatgcagatttcttgagatacctctcaattcttaactgttggcaactatttttaaaaaatattgtaaacactggtgagggaaacaaaatgaaaatttgggccaacttggtccaaaggctgtggatgagtgcccatggattccatggctgaatttgcttggttttctttgggaatctttggtttttgctgctggtggttgtttgtgagccaacctccctctgcctactcaggtgttcatccccagcccatgagtcttctcttactacacagtctttctgagtgacgtcctaagtctatatctcacactcttacctatgcttttgtttctgacttccatttccagttcctgctatagctggaaatcttacaaacacttcaaagtccacaccagccctcccatcacccccaacctctatccttcgctaagccaacacctacacataatttaagactcagcttccctgaaaccaagctgccctcctctccatttctctctcaggattgggatacccctcccatgtcttcagaacatttttataattatactttctagaaagtattataatgatctgtcttggtatctgtcttacccacctacaatgggacatgtcaatgagcaggggctgtgtctcattaatctttgtaatcccagcttcaagcatagtgctgaaatatagtagcttcctattaaatgcttggcaaattaataaacaaacaagagaaaaatgcactaaaacagaaaattgtcatatgcccacagaacacatttcctatgttatttttatttatggtctctgttacataattcgtgttatagttaacgtaaaattttggtattttatcagaaaaaaatattttcccttgttactttttaaattaagaaaaaacttagactagtcaagtgcagtagagagaaggcagggaagagtggaacaacaagttcaatctgtaactatgaacaatcaattgagataactcactgccttcagaccagccttaattgttattttgtaaagcatttatttgcatgataaaataaaactttattacattcagcaataaaaaatataaaactgaatgatggaagtcaattaataaggtaggatttgccaaataaacatacaaaacataatgatacacatttcttttattaagtgagagatttactaggacaattttctaccataaaaatggaaaaattagggttttttgtttttgaaattatttatttatttatatgtattattattattattaccttttttttttttgagacaaggtcttgctttgtagctcaggctggaatgcagtggcacaatcatggctcagtgcagcccccgggttcaagcgatcctcccgcctctgcctccatgagtagctgggaccacaggcgggcaccaccacgccctgctaatttttcttttgtgttgtttgtagagacggggtttcaccatgttgcccaggctggtctagaagtcctgggctgaagcgatccgaccgcctcccaaagtgctgggattacaggagtgagccatctcgcccagccgaaaaagtgttttttgatcttaaaatcttacgtggaatgaaagtgaacaatgaggcaatgaaagtggaagtttctcttaagcaaacacagaagtcaaccattccagctttctaaggtactggtaatactctttcgtctattttattttatggcataattttaagactcctgtgagctatgtctttaggggaagtttgggaaggacaggcagagtgtcaatactaaattaacatcagtttaatttccgcccatggttatctgggcctcattccagcattaagactttcagaaaaaacattgagataaagctgtctttttataccaacaggtggcagtattgctttgaaacaaacgacagcaacgacaccgtactgtcccattttaagaaacttctagatccattgcatttctaaaatcttacacttttattagacttcgcctttttaatttaattttatttgtatttatttatttatttatttatttatttggagacagggtctcgctctgtcccccaggctggagtgcagcggcgcgatctctgctcactgcaacctctgcctcccgggttcaagcaattctcctacctcagcctcccgagaagctgggattacaggcatgcaccaccacactcggctaactttttgtattttagtagagatggggtttcaccgtattgcccaggctagtctagaagtcctgagctcaggcaattcgtccacctcgacctcccaaaggctaggattacagcgtgagccaccgcgcccggccttttttttgaccgtctggtggctttgtctcccaggttggagtgcagtggcgcgatcacagctccctgcagctttgacctcccgggctcaagcgatcctcccacctcagcctcccgagtagctgggaccacaggccaccatgcccagcttctaggcttcaacatgccccccaaaatgacagtggaatagccagatgcggtggtgccagcctgtagtcccagctacttgggggactgaggtgagaagatcgctcaccaggaggtcgaggctccagttggctgattgtgccactgggtgacagagccagaacttgtctcaaaaaacaaaacgaaacaaaagtggattaaataaagcacaaacgtggtatttgaagaaaattaaaaaggactcaccaatatcgcccgttcattcagagccttgcctttggaagaaacacacactcatttatcttcccccaggaaggcctctttcctatcaagtaaacctagagtgatgattaatgcagaaaaacaggccccgtgttgcaaatgataagtttgcttctctgagaacctccagattaggttacattcaattcactaatctagtctccagcctggcaaaaatttactgtgaaaacgtcttcaagtaagtttcttttttacactgactgttgggataggactggaatcagcgatcacaatttgatcctaatttgttgatgttcccttaatttttaaaattttttgcatgtacatgcactcatgtaaccatcacactgattaaaatatagaatatttctagtacctaagaaggtttcctatgctcgctcaaactttaaaatcagaaaaaaatatatttctcaatttgtgtgtttaaaaccaaaacaaacaaatacaaaacatgaagtagaagggttggggatgtgaaaggaaaataaaagttggggtccccaaatcactaagctaaaggcaaaagtcaagctgggaactgcttagggcaaacttgccttccattctgttcaaagtcactcctctgctcactgagatagatgcatatctgattgcctcctttggaaagactcaaaagaaactcaaaagagtgtaaccctccctccgtcacctatctgcgacctgggagccccctccctgcttcaagtcttcctaccttcacttcaagttgtcccgcctttccagaccgaaccaatgtacttcttacatatattgactgaagcctcatgtctcctaaaatgtataaaactaagctgtgctacatcaccttaggcacaaggtcaggactttctgaggctgcgttacaggcacatcctcaaccttggcaaaataagctttctactcaaattttcagggttcacattttggtaaccatggagggattcttagtggagatggccctgacctttgacaagtctcctattggtgcttgataccagcaggagctaactttatggctcaaaccgaaagaacaatttgctaaggtctgagggcacccactccagagaatccctgatttccccaaattcagtcatgaccccaactttattttgctgtacaactcctctttttcttttgagttttacttgctcccaacacaaggaaggcaagttttcttgcttccatgacgttgaaaggcaggtaactccttcaaggagtttgagctcgcttgcaacagagaaaatgagcttggttttttgttgtggttgttttttcctgcttctagggtggtagagagcagtctacagcctgagacccatcactaggtaggaaactggtttgggattctatcttgcaaactccttttaaatgactaaagttagcatttaacaaccagctggtgttaatttcttcttaatacttagagcgctcagaaatagtatatttttgtgtgatcattgttagtttagcagcattttgtcctagttgaaatatggtaataagatttaaaaaacatttttaaaggagctcaatgttaaaaatcaacttaattaaaaggccatccaagatgtgtgtatgtatgtgtgcatgtatgcatctttgtatttgaaaggtcttcaagtttttgctttttgtttgtttttctctcctaagaccttgtctttttttttttttgagcaaaagtttttttttctttttcttctcagttgactgaattctgttttcacctgattttttttttcttttttactaaaatagttattgcaacagaggctactgttaagtttttaagaaagagtgtagtttaattttatgtttcatttggctcaaaataaaataaaaaacatctccctctaggaccaccagactctttctctctgtaccttatgatgtaaattttgctatttgattttcacctgagttgtttcctttagtgtgcaaatttaaggctatttagctgacaactgcctagggttgtgaaacaggctatcaagaatctgaaagtctaagataggaaaaaaaaagagcggggtctttataaatctataaaatgtacttccatcggcatgcctaatacatctttgtatgtatttatgcgctgtgtacaaaatgtttcactactaaaaatatataaaagagctctaatcaattggcttaaaggaaaataaaagctcttaaatcagatactaaaaaatagactagtcaaatgctttttcaagtttatgtaacttaaataaaatctttaacaaataagctagctttaaaattattggtaaagtaatattagaaatgtcttaagaattgccagcatacagtttttgttttgcatttattaatcaagcaattccatacttatccctgccaaatgctataaggtgtcaaaatttggcatgggattacgaaactataaaaccagtccaaaacagaatgatttttgtttgtgtaatttttaataagtaagacattgatatgggtttaatgaaaatagctgcatcttgaatttagtaagattaccataatttctaatcctgtggctttaggcagtctagtccacaggcaataaggaagtttgttttgggaaaggactgttatcatttttgtttcaaagctaaactatagactaagttgctcccgaagttagtttggcctatgcctaggcatgaacaaggatagcttggaggttaagagcaggttggagtcaattaggtcaaatcttattttcactgtctcagttatacataattttgcaatggcagtttcataactttaaattcatgactatcacagttttcataaataatctaggtagacaattaaaataaaatagataaatgtaatgggataaatacttgtagaaaactggtcataatttcataatttagaatataaagttatattaaattaaataatatatatttcattatttgggtattttccaataaatatatattgtaggaaaatattcttgcaaaaaaaagtgtgactttttaaaaaaaaaaaggtgaaaaatttttgtctaattcgaagcttatttaaaggttatatataaaacaaggtaaaaggaaccatgaaataaaaagagatgtaaagttataaaaataaagaggtatttttgtgtgtgtgtggtaagaaagcttaaagagaaataattttatatgagaaagaatcttacatggtaaacttcagtcctaaaataaaatgactggttgtttaaaaaggaggcatattcaggacaaatcagaaagtccaaatattaagttctggtttgcttagggaaaaaaacctgagattaaaaaaaaaaatttttttaaggttattatatccatgtattttcctgtatgttcttttaaagtccttgtgacattgagttacagggttttgactcctggatctaaaaaggacacaaagtcttgctaaatcttaaacaccaacagcaattaaagcctcatcttcaggccctgtagaagatgccagtcaaaataaactgcatttctgcgacacagggcaagaaattaaagctatttcaactcctcaaggcccagggactatcacagaagagatgggcacacacgcaatattgtaagggccaattttgaaagataaaataagttaagcttctttatagatgaatcattaatgtcaaaggcacactgatggaagaccagcatatgggcccctgtgtcagattaacaaagttttctcaaagcattaaccaactccttagtgaaggtcataaagattataaagtgctatggaagctatatcttatgttcaagattaaaaattttatagattgtttataaaattttgaaaaacaaatttaattggattcatgctgtttttattagggcttattgtttggaaaattaagtctcttctcaaagaataaaggttcttgccttttttttaaagtccagaagttatcactttggttaaatgaatgacttattttacaatgacctgtgatcctattttatgatatcaaatgtttaaaacctttgatatttgacaaactttccaaaatcaaattataaattatgtctttttctgacctaattaaagctttaacatattaggttccctaaagttcagaaaataacataatttggcttatttggtacaaaaatcatataggaagcattgtcaaatatgaaatggtgttgggtttttgagggctgcatttttaaaatatgttattagtatgtgttccaaaattatgggaaattcctataattctatataactcagtgtacattatcagtaataatcataattgttatgttaaaattattgtgtgccgcagaggtaacaaatgtccttttcaactgtgtttttgactatggctgtcctaaaactttttgtcatccatggacaatttttgtcttgttttggtcctctttagaaggtggctttataatcagctacaaaactctaacaggtgctcttgaatgcaggtttctgataactttggagattgtgacatcagaatagaggaaaaactttcaggactcatggagagctataaaatattcatgagtatcaagcagaacaggaattaactgcatggactgaactgatctttttgactttttgcttaaaatgttgctgatcttttgttttgcttttcagagtcttaaaacttttcttttgagctattggcagcttttaacaatttagtatactcccataaacaaagtttggagcatatttgtttctctttagctgatttctccagaatttggaaactatttgtaagtattcttaactcatggcaatacagttatttgcataagtgcaataagaatctgttttcattaataacagaccacaattggagaaactgcttattttaccaaggctttgactggaatggtgtgctttcgtttaaggaatcaaacttgacttatggagccaataaagcccttgaaaaaattggcctcatattttgtgtacacagtccctgtacagggtttctgacctgtggtaagtaaagaatgtcacttctaacaggcgtagaggcccccggtttatcttggaacctcaagaggagagaaaattcacccaactcacaggtatttgatggcacaaatccatggctgggctctgctttaaaaacatcttatctggtattccttctatggaacaaggttccatcaaagccaatataaagcctatgtaaaaaataattttttttgcactgtatataagtaattaggccaagtataataaagcaaaccaatcctaccatgatttgtctttagcaaaaatgggaaactggagagagaaaaattatgtttcaaaaacaattgtacacctgttgttagattctagtcttgtctaatgtttttcaatttttattatttctacagtttgggctaaattctaattttctcttgactacaagtcttcaaaataatgttttcaattttttttttcttttttttccttctttttttttttttttttcaatttttcctaactgggagtcactgaaaaccaagctgtgctttcttaaagccctgcaaactgaaactagacaacttaaagttcagaagaaaataacagccacctatttacatgcataagccactttcatacctgctactgatttatagacttcagagtagtggggcctatattgattttccaggagtgttcttttgtttgttgtttttctcccttcttcttccactatttgctcttctaggaataaaccatcctagccatgaaagatcaggtgaaacctgagaccagagactaattttctagttaaatgccatctccaaaatatttttaaaaagaaaagagggtaaatgtgaaaggaaaacaaatcttgaggcccccaaatcactaagctaaagggaaaaagttatgctgggaactgcttagggcaaatctgcctcccattctattcaaagtcacccctctgctcactgagatgcatagctgattgcctcttttggaaggactaagcagaagctcaaaataatgcaacccttcctgtctcacctgtctttttacatatattgactgtacttcttatatatattgattgatgtctcgtgtctccctaaaatgtataaaactaagctgtaccccagccaccttgagcacatgttgtcaggacctcctgaggctgtgtcatggggacatcctcaatcttggcaaaataaacttttaaattaactgagacctgtgccaaattttcagagttcacaggaagaaagacaaccctcctttatacgttgctctgggcctctgcattgcctggatgggaactctgggatagatgcttttagaagggtctactgaacccatgagccattcccttctctggaaatggctccccaagtaatagcttgggcttctaggaatcctgttggtagtctgtaactccctactcatctggatatagttaattggaaaatttgacctagtttgagctaatcatttttcttctcaggaatgtggaatccagaccaaaggaaagccagccagtctattttcatggctgttaggtacaatttgtatgcttgggagctgtggagttgctgtattctgtcataagggcagatcagcagagaaagctaaagcaagaggagaatagtaacatggacacaaggcagaaatgcagagatcaaagatggaaagagaatatatcccagattcctaatggctttccaaaactgatccccttctttcttgttccccaaatactgccctcttcatatggcccttaaattcttgtaataaattctcccttctttgtttaggccatttcaaattggtttctgtttcttgcaaccagacaccttaaaaaaaataaactcaaattttctttcatgctccctttttgcatggtaattaagagcatagaatgtggagtaaaagagataaaactttaaatttcagctccttcattcactagttgaaaacctagtagaaaaacttaatcacttaaactctctgagctttaatttccatatctggaaaaggggaatacttttagctatctaaaagcatatgggtgtcaaacaaatataacgacgtatataaaatgctaattatagtacctggcacaaaagaaatacttaattagtggtaataatgattacatatttattcaataaatacttatcgattactaactatacaaaagttagatgacctgaagtgtacaaatatattcaagatttaatctctgctctcagacatgtacataaatatccataatagaagacattatagaataataaagggtacatgaatgtttttaaaaaacaaggactctaggtcataatcaaagaaatgcaaattaaaaccacagtgcaatgccatcagaatcagaaaaataaaatagattaaaggccgggcatggtggctcacgcctgtaatcccagcactttgggaggccaaggcggacggatcacgaggtcaggagatcgagaccatcctggctaacatggtgaaaccccgtctctactaaaagtacaaaaaattagctgggtgtggtggtgggcacctgtagtcccagctactcgggaggctgaggcaggagaatggcatgagcccgggaggcggagcttgcagtgagccgagatcacgccactgcactccagcctgggtgacagagtaagactccgtattaaaaaaaaaaaaaaaaatagattaaagatttttctaatttttaaattctttttctttttaaacatttttaatgtagaaacagggtctcactatgttgcccaggatggtctcgaactcgtggcctcaagcaattctcccaccgcagcctcccaaagtgctagaattataggtgtaagccaccacatccagccagtttagagatttcaagtaatagtgaggatgttgaacaactggaattcttgtacattaatggtgggtatgtaaattgatataatcacttgggaaaactgtgtggcagtatctacatatgcataccctatgacccaacaactctactcttacctctatacacaacaaaagtgcatacatactttcaccaaaagaaatacatcagaatgttaaatgtagcaaaaagccaatcgacagatgcataactagattgtgatagtatgcacacaatggaatactgtaccaccacaagaatgaagcattcacaaataactataacaatatgaatttcattaacataatgttaggagaaagaagctaacataatgttaggagaaagatccaagagagtacacatgttataattccacttttataaagttcaaaattaatctataccctaaagtgtgagttgtagttacccttaggtgggagtagtgactggagaaagggtttctggggtgctagtagtgttctgattcttgattattccagtgtgttcagtttgtgaaacttcttcaacctgtatgcttacatttaggtaagtatgtaaggaagtacatgtaaattatacttaaagtttttaaaaattaagcttagccaagtatagataaaagtcacttctacctggaatgacagtacaactggatgaaggaaatcacatttcttttcttttttttactttttttttttttttctttgagacagggatctggctctgttgcccaggctggagtgcagtggtatattcatagctcactggaacatcgaactcctgggctccagtgatcctccccaaagcacagggattaaaggcaggacccacctcaccctcagatctcacccagtaagaaatcacatttgcattaggccctcaaaggtgggcaagtcttcctaggtagagacagggaatgagcattctagaaaaaaaggaatggcagaatggcacaaaagcaaaagcacagaggtttgaaaaagtaaggagcatttggaaaatgactaaattagccaaagaataagattggtagaagaaagtaggaaaaaagtttcaaaacttatctaaagaatttgttccttattcattgggcaacaaggagctagtgaagtgttatgttctattttgtttgaagtggaaaacaacatgatcagatctatactctgagaagatcaatatacaggagatagtggaggaagaagagcctagaggttgggtagggtagcatacaaggagaacataggaccctttgtgatccgccccaaactgtcactgaatactcccatttttctaagagatagtttaattattttttctgtctcttctctttttcctttttccaacttcctacttagctctttagaaatgcaattatagcctttaccacctcttcagcagatattcctcacagggcaaattcatctaactgtgtgcttagaagctccagaatggaactcttacccaccaggaggttgccccgagagataacagtcaatttacaatccaaagtatgcccgctagagtttttggccaccattacaactcatttctgcccatgaagacaccagcttgacagcctgatagataaggcaccaagctagcacaaaacccctcacctgcttgtgtcctcctttgccttttaaaagtgcccactttctgctccaaaggtgaagcagtatacttaaggacggaagcctgtacttcttcccctaagctagttttggaataaaaaggcactttctttataccagaccttgttcttattaattggactctgcaagcggcgaatgattgaacctgcacttcggttgcatgactaccaacccatctcttcagcctcatccctcacccaaccccacccagctgcaagccagtcatccaatcacttgccgttccttgaacaaaccaagccctgctggctttgcacaagggctcatccctgcagaagacccttcctctgctccttcattacgcttaagctggaagagagacaacttccttccctccagcacgccagagagcttttccataacatgaagcaaagcctgcaggtgcaaaacttgtctttaggattcttaggaccaaagagtgaatatataaaccacataaggaaacacaagctacagttagcttttttccttaaattgtgtgaaaactgtgaaggaaaacaaatctgctactaatttttaacatattaattcacaaacaataaaattgcatattgtagttactcctgagcctctcatcactttgagtagtctaaccaggatctctgtaaccacagaaacatgtagctgtttctataattaaaaaacaccagaggtcacctcaaaagacaaccccagacccaattttattttggtgcacaacatgctatgcctccccctttccacactaacaatcagaaagattctccttggttattgccaagaaattagaaatgagatattgcatcatttgagttatttttacagactcaagttgttcagtgcatgaagaaaatgtataagaacagaagagaattatctcgatgttttctaagattcaaaaggaaacaggaaaactcaggtaatccacaatctttcaggccatctacacaatacacaccattaagcattgttaagtgcagtcttctacaaaagcaaatattagcccaagtaacacacatgcacggcagtggcaaaggagaagaacaaatatttgtagtgaggtttcaatgccagaaccagcccagagaaagaggaagaatggaagccagctaatgccttttgccctgccgggaatgcctgtttttcctaggtcctccatccagcttattactagtcgtctttcagaatacatctgtcgtaggtcatctcttatgagaaaccacactggaccctgcctagtttgaggagggctctgctggagtaccagggcactccatgtgttacactaagcacagccgttgctactgtgaagtgactgaagatttcctggttagctcccattctgacttggagtatcttcaggataggcactgtatcttgttcctccctcagtctcccatgcctagcaagttcttcccacattagggcccagcaaatttgaatgtctgcctcaggttccttttaaagcttttggcctcttaagctggtcctgcaagatcttaaaagaatatagcgtgatctgctcattaagtactacagtcaggacttgaaggcatcttctatctctgaagtccatggttccccgccataataatatcactattttctttacactgttttaaaagacaatgacacaatctagattgcaaataataaaatataggattactttcaaaaacttagaaaatacagataaacagaaagaaaaaaatcactcagaatcccatctctaactacaatcactattaacatcacagtacacacccttcaagatctttcctcacattaagtcattacatatagacatgtccaggttgggaccgggcttatgtgcaggaattgttctttacagggtcagtgccatgactgcagtattgctcaaaagagactattccttgttccagctaaaaaatttcaaaaatttgtgggttttttctttgttttacccctcaccaattgctttaaacaggacatgacttttcattttgtaccatgtattccgtacctttcttatatcctaaagtttttcaagctctcgatgataaaccaggccaatccacctcagtcttcacccaaacagctcccatctggagtcctcaatcctcctgctccaatgtaggctattgctcttcctgctgctgccagcaaatgtcctgaggcctcaacgccctgctctcctgggttggagcgactgctccagcgtcccctacctttctctttcttaaattattctgtcattgctgaaatccatcctcaaggaacattttttaaaagggtatattggagataaaatttctaatacttaaatatttgaaatgcctttttcctcctattgattgtttggttggccaaacaatagcatagcatagcaacctgtattttaaattactatataaattactatttaaaacaatagcatcgcaacctgtattttaaattatttttcccagaactttgaaagcgttgctccatatttttcttagcatttcatgatgctgataagaagtgtgatgctggtaattaagtcttctgttcccctctctctcatctcaggttttagagtgagttgggtttatgtgtgtaattgctagataaaagggaatgtgtatatttcactgtagtgggccgaataatgcgcctcctcctcacacccctcaaagatgtccatgtcctaattcccagcacctgtgagtttgctatcttacacagcaaaagagatttgaccggcataattaaggttaccgaccttgagatggcgagattagtttggattgcctgagtgcactcaatttaatcacacaaatccttgaaagtagacaactttcctgtctggatcaaacttgaaacagaaggaggagatttgaatcgtgagagggactggagctgtcactgccggctttgaagagaaaagactataaccatgagccaaaagtacaggcagtttctaaatgatagaattgccctcagctgatagtcagcaggaccacaggcaatttggatttacatattatctgcaagcaactgaattctgctagcaaccagaataagctggaaacggattctagagcctagaaaccctagatcctaggactagatcatagagtttccagaaaagaacacagtcctgatgaccctttgattttaatccagtgagactcgtaccagacttctcacctacagatcttaaattaataaatttgtgtgtgtctttaaatatgtgttgtttgaagccaccatgttcgtggtaatttgttacagcagcaatagaaaaccactttttaaaataaatgctgccaaaatttcatcccccaaagctaaatttatttatacttataccaacaggtgatgagaaaactcttcctcaaaaccttcactgacaagggatattttcaatatcttgatttttccaagctgatcctgagaaatatttcacttttgttttcatttgcaggccaggcctctaatttttttaacaaggttgagcatcctttatatatttgtttaacacattctgttttatttggaattacaccattttgtaaaagtcctatcctggctaacaaggtgaaaccccgtctctactaaaaatacaaaaaattagccgggcgcggtggcgggcgcctgtagtcccagctactggggaggctgaggcaggagaatgccgtgaacccgggaagcggagcttgcagtgagccgagattgcgccactgcagtccgcagtccggcctgggcgacagagggagactccgtctcaaaaaaaaaaaaaaaaagtccttagatttctaaaatttcaaactattaatagttatactatgactatgcatataaaaatatgtcctgtttggtatttgttaaacacttttaatttaatgatttatatctcccacactggaaattattttgcatagtaaacactgtggcagaatctgctagctgcctagctgaatatcaacactcccctccttaataagcacatcttgatctttttaacatcatattgctgcccagaataaaggactacatttcccaactttccttgcagctaggtttggccagtgagatataaacggaattaatgaaaagcttcttaaagttagctcccacagcttagaagggcctttccccacgtcaccctgacttcgcttctttttctcgtctggatttaggcttaaaggatgcagttacagcagccatctcgaaccatgaggttgccgtgcacatggaaaccttttagcggggggagtggtagctcagcctgttttcccagcactcttgagaggccaaggtgggaggatcgcttgagcccaggagtttgagatcagcctgggtaacatagtgagaccctctctacaaaaaataaaaatattacctggacgtggtgacttgtgcctgtagtcccagctacttaggagggggaggtgggaggatcgcttgagccaaggaggtcaagactacagtgagctatggtcacactactgcattccagcctaggcaagaaagcaaaaccctgtcttaaaaacaagaatgaaacaaaccatttggtagatgatagaatgggaaggtaagggcctggtgatcctaatgcctcactgaagtcaccaatccacctcaaaattttcttttatgtgagtgaaaaacttatgtcttttcaatcttctatcattttgtgatttttctattgtatgcagtcaaatccattcctaatacagaattctcacagtgatctgttatgtattttatctgctatcttttgatccctctctctttttattttccaggtgagtgccttgatttcatctttaaaactttttttaaaaaagttctgcaattataatttcattttctaagagttatttctttttcatagcatgtattttcttgttttgtgtatgcaatagcttttcaaatctcagaagtcactagttggaaagtctgtcctattttgaagtatacttctgttctctgaattctttcctttgatgtcacatttttcccgttggtttatcttgggttttccttttcatgttagagactttcatctgatgtttattgatccttggttactgctcacactaagaatgagacaataatggggtaaatttacattacatgccttatcacaagatacgcactgaggaaaacactgacttcagtggtcttcctgccaaaagtgcatgacctgaatttaatcatgaggaaacattagacaaactcaaactaagggacattctacaaaataattgacttgtcatctcaaatattaataccatgaagcacaaagactaggagattgggccccattaaaggagattaaagacataagacaactgaatgcaacatgatctagaaatttcctttcctaaaaaggactttttaaataatcagcaaaatctgaataaggtctatatttagataatagtattatatcagtattaatttcctgcatttgatattcttcctctaattatgcaagagaatgtttttaagaaataagcactggaatatctaagtataaaggggcatcatgtctacaactctgaaatggttccacaaaaataaattgcatatctatctattcatccatctatctctctatatatctatggagagaaaaggataaagtacatatgttaaaatgtcaatatttcagaaacttaggtatactatatatgggaattctttgtacttttcttccaacttttctgtaaatctaaaattatgccaaaatgaagccttttaaaaagaatatggcccatataaagattttctgggagctttgtgggcatagtcaggactggttaatgacaggcttcaatagtgtgtgtgtgtgtgtgtgtgtgtgtgtgtgtgcaggcatgaagccagctgtaactctgggaacctttaaatgccagacttaagaggtatttactctaagagtgctttcccttgccatctgcccaattttttcctgggcaatgtcttaagattatttaaaccctctaatttttggcttggggcaaatggctgcctgcaaatcctttcagtccaatttctcaaacccatttcccactctatctactacagcctttctgggtgtctgccaggacagtcagcttcatggtgctcccttggctatggctgtctctactcagcttcatcaattttaagaaaacttccagaaatgtattgcaatctcttgtctaccaattattccctcattctttttattgtgctgtttttgttttttttctttatatactttatttttattatttatataattttatttttgtttttattctttatatattttatttttgttcttattctttatataattttattcctaagcatgtgtttcatcagccatcttgaatcagaattctttagataatttaatgttaatttttatctgtaactggttattcattatttatgaacgcatacttttttttcttttttggtgtatctgataatccttcagcttttcaacattccatattgtcataatatggtatcactacggatcatattggattctcacccttggtactttttgtcatattattattcattgggccatttagtcaacatatataattctttcatgtgcattgtcttctttagcttcacctcatagatattaagtttgctaagcccaacgtcaagtacattatttattcctttcttttacctaaagtaaatatatacccagaagaataagcagtccaacacattacgtgctacctcttcttccccgagccatggatgattaggtcaggtatctgctccaaatgggcagccaatctgttggtttatcagagacctctgattggtatggcttgactagaacagatgatctgcattaatcagattccctccatcattattttaaactataaaatacagagattgttacgagtcagggttggacactggagtggcaaagtcagcttagtggtggaggaagccatttgcaagctgatgagtaagcaaatgaaattgatttttagagagatgaaagtggtatagttgtggaaaaagaagctgagattaagtgagagacaattaatattggttctaaacagctttctactttgtatgaggcccagtttcacacagttctgtgatatatctgtaacactgaaattaatcatcttttctaagctagtttgagtgagtttctaattctttccaaccaataaaaaaacctttcaacttttaattttatgattttaatttcctgtttttgtttttcaaaagggaaagaattctttattaacaaaactgtgcataaaaattaacatctatactaattattccacagtttttggttttttttttttttgagacagtcttgctctctcaccgaggctggagtgcagtggcacaatcttggctcactgcaacctccacttcccggattcaagtgcttttcctgcctcagcctccctgagtagctgggattacaggtgcatgccaccacacccagctaacttttgtatttttaggagagacaaggtttcaccatgttggccaggctggtctcaaactcctgacctcaggtgatccacccacctctttctcccaaagtgctaggattacaggtgtgagccaccacacctggcccattccacaaattaaagtgtcaaagaattagaattttttacaaatcctctgatagaatatggagtcttcttcactaatccttgactgtttttactgagtttaatcccatcactaaagtaaaagtttattttggggaaatttgtttcaagaatcaaggatcaggcacaattttccattgcaagctcgcctgtcagagttgctacaaaaaatggattagggaaatgccatgcgtcctccgtttccttcatttatccttcttcttctttctccagaagcaacaggagaaagacccaatgccttcaatgtgtttctgtagttgctattgtgaaattatgacctttatatgcattttggcctttgaagctagaatttcttcttgtttttacatcagatcaatcagatatattataggtttttaaaagaatatatagaattataaaaatatccaaccaggataaaattatttaaacacacttaaacaaatcttaattttgaaagagggttacacaataattttacaaaagtcctccaaagtgagttcccaaatgtagggaccatgtcttttaattcctttgtatgttccctccaaaatgaaaaaacaaaaaaagattcagagttatgcaactttcagctgtccaataaatgtggttgaatcgaatcacttcaattaccagaagaaaattatattaaacttccgtgccaagtttcaatttgaaaatacttttaaagcaatgtttggaaatgacattaaaatttttgagttgcaaaagtcggcaattaagaaaagtgctccaaaataagcacgtctcatctcctgtgaataagcagtttactttggcaatggcagcagcttgtcttgggtggattcataatatcccactccatagctgttaacttccaaaccagtgagagatttattttttattcaactatctaactgattgctaaagctaaaacaaatgtgttttcataacaacaattttttccactttaaaatagtttatgttcataaaagaaatttttgaaaagtatgacaaagttggaaaaagaaattatctagagttttattctccagctagatccacttttaatatattctttttattatttccttattgcagtccaaaaaatacacgaattgcttttttcataagataatctaatctgcatgaaatgttgagtaactgattatctaaattacaatgtaccacttgttcgtggattctcccagacttacttctgtgttctagattacagttgccctgctgagggaaacgctttggcctcaaccacaggatgttcaagtatatatatgttgaggaaagagagggaagcatccaaaaacagtgcttctcaaatttttctgcacttagtaatcatctggcaatcttgttaaaatgcagagttggcattttaacctagagtgtaggataattgatggaaatttttgccttaatacatctatctaccattaagcaattaccccaactctaacccatttctgggaatacataagagtatttttcatacctggaaagtttcccatagtctgagggtggagtaggatttatttattgcaatgcaagtgaaagtgttgagcaactatggtgagtccctctgcacaggaaaccttccaaggttcgcaaaatacttgttcatttcttctcccttggtagtaatacatatcatctctgggcacgtagcttcctagaataaagttggcatttcccagcttcctttgaagctggatgtggccatgttaccaagttgctgccaatgggatctaagcagaagcatgtgtacaagccatgttttaggatggcaattatatttaattaagatattttgtttgtccaattcaggttaagttacaacccaagagcagtcagctaaaatttcagttgaaagtttgcactccagaggtggcattaatgttctaattaaaaagcctatatcatagaagtgattgtttctgtcattcatatctgggtctttgctaacattctcagtgaatttcagaaatgggcttttaagggtgaataaaattaacaatctactaatgaatgctagataggaattgtcattggctaaattaatgatatttaaggtataaggttagtgaaaatattttagagacactctccacctttgcaggagtagaataaaagaatccagtgtgacctgtggcctatggtttgtacctttaggaaaaatgcccgtggcttaatctctaaatgatcctgggttcggtatttggttttaagggctttttagctccctgatgctgactacacagataagagattcctgcttctggaacgttgtcataactgccttggttcaatttttcatgtcaggtgagattagagattggaggaaggagagccaaggctaccttcaactgaaagaaaagactaaactattcttatgctttcttataattaaatgttttgttataaatgattgcttttgtggcagaatttgttctgtgacttgctttccatacagcctgatagcaaggttgaagaagcagctgatactttcatctcaaatctagtatattctgccaaagacaccctaagagttgtatgggaccaaatgggcttgtgtcagtccacagtacagaacaatggggtagaaaaagataggtctcctaaaatgctctggactgctctcctccagacaggttgttgtgtccatgttgtgtccaaattgaaaaataaatttccaatgtgtgccaacctttatcatcctatgttttctgttattcatagcagaacctatctgatagtcctgttggccccagtcaccatcacagggaaaacttcccatggaaaactttcatgatttaacctcccccttcctcaagcttgtcttgtcctcctctttagtttagggttctctcttgcccctccctccctctacttttcagatactctacattccccttcaatgtttccaatcagaaatatctactctcccagggaaggatcttctgtaacattgctgccttggtggggacttaatcacttaccattactatttcaaagaaaagagttttgttgttgttgttgttgttgttgttattgttgttgttcgtctttttgagatggagtctagcttcgtcacccaggctggagtgcagtggcgccatctcagctcactgcaacctccgcctcccgggttcaagcgatttttctgcctcagccacctgagtagctgggattacagatgcccgccaccacacaggctaatttttgtatttttattagagacagtgtttcaccatgttggtcaggcggtctcaaactcctgacctcaagtgatccacctgcctcagcctcccaaagtgctgggattacagacatgagccaccacgcctggccatcaaagaaaaaagtttctaatcctaattatttttccaatgacagatatatcagaagtcagatatttaaaccttagactctatatcttaccacatataactttaaaaataaaaatgatcagttgttcaggatcagatataatccaaagcccatataacacgatatagtatttccttattttttcaggtactttttaaaaaactcatcttttcacatgaaaaaatgctcatcatcactggtcatcagagaaatgcaaatcaaaaccacaatgagataccatctcacaccagttagaatggtgatcattaaaaagtcaggaaacaacaggtgctggagaggatgtggagaaatacgaacacttttacactgttggtgggactgtaaactagtttaaccattgtggaagtcagtgtggcgattcctcagggatctagaactagaaataccatttgacccagcaatccctttactgggtatatacccaaaggattataaatcatgctgctataaagacacatgcacacgtatgtttattgcggcactattcacaacagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagcaaactatcccaaggacaaaaaaacaaacactgcatgttctcactcataggtgggaattgaacaatgagaacacatggacacaggaaggggaacatcacacagcggggtctgttgtggggtggggggaggggggaggggggaggatagcattaggagatatacctaatgttaaatgacgagttaaagggtgcagcacaccaacatggcacatgtatacatatgtaactaacctgcacgttgtgcacatgtaccctaaaacttaaagtataataaaaaagaaaaaagagaaaagaaaaaaaatctcatcttttgtgttcatttcacaatttaaaaaaaaaaaaacagtttttcaagattacaaatgcctcaaaattacataatatttgagattacataacatggctttacccattagaatgccttttaggtctattaccattctttgtcattctcttcatacttacactccacttctccaaaaagtaaatagaaaaaggaactaaataaactaaataaaggatctaagacctctccaatatttgcatagatcagtaccataatttgaattcttcgcggatttctctttgtgtaaagttcagcctgtgatgaaagcaggagagtctgatgatttagcttatgctctagaggcagtctgagttcaaatcctgacactacccatgtgccctcaggcaaataacttaaccactttgtgcctcagtttctcacatgaaaatgggaataataacaatacctacctctcaaggttgtaagggttaaagaagatattaaagagcttagtatagtgcttggcatgaagtagcatttaataatattcagttattcaacaaataattattcaacgtgtgctttgagcgaactactgttaaacactgtagggaaatgaacactgaggcagactggcttcttagtcttaaggaatgtacaatccagtaagagaaataaaacatgcaaagtacataactagaataatagaaatggatatatgtgaagctattcagatacattatttattgcaatatattacagatggttgcaaatcatttgctattcctgctattgagtttaattctcctcactttgaatctggagcgagtcttagtactttgctttactaatagaatgtgacaagtgatcctctaggacttccagtgtgtctcttagaatgcttgctctaggggaaactaaccattatgtaagaactccaggtatctgggaccaccatgtatagggaagcccaagatatccccctgataaatctgcatagacatggcactaggcctagctattccagccgtcccaaccaagacatcagacatgtgagaagaagttgtctggcagcatcttggctacctctgtgaacatgaagtagagaagaagcaaggaatccaactaacagccagaaccaagggttcacacctatggtcccaggtgaactatcctagccaactaactagatatgacttaaaacaaggtagtcagcctgtctgtgctacagatgagttatcttaaatgagattatgtcagttgtcattcttatgtctctctgaatgctggaatgaagaaaatagtgtgagcagaatagttaacatagcaggcctgagcctgctatccttagaaaggcccacttacaagatcagcccttagctggcatctgggaacttggctggtaaaaagtttcctgcacacctttaaaaatttgcctaaataacaaaggtgactcactatggctatactgtttgtgtaaacagcatgtttatggtgaacacctccctgggaggggagcctggaattttggtatatggtaggaagagggttcctatttgacaagccttcaataaaagaaaccttggacaccaagtctcttctgagctggcccagtagaaagcactttgcatgtgttgccacaactcattgctgaaggaattaagccactccactatgaaagaacccttggaagcttgtgcctggttttctcctggttttgcctcatgtgccttttcccttttttgatttggctttctatcttttcatggtaataatatcagccataagtacaaatacatgctaaattatttgaatccttttaccaaatcattggaaatgaggggtggtcttgggaacccctgacacacagcattctaaaaattgtgagagaaaagttgggagaaatgagattgctcttctactttctttttacagaaggagatttctctcctacctttcccatgttcttcctcttttcttcttctttcccagaatatgcatgctggacttccttatttattccccaccaaagtccacagtggcctgtggacataaacataactctcagagacaacactcagttcctcagccctggaaaagctatgtaactgctatcttgcatacaaatacaagattggtttcgcctgtattttactttttatctagttgtgtttactttgtaggggtatagtatacagacctttatcttattgggctaaagatattgaaatttatttttaaagcatttacctaaagactaaactaatgataaaaagtgttttccttgcaattacatagcagccttcttatatttttggctaatctctaaaagaactgacactacagcaggaatgtatgtctaccgcataaaatctatgcagcatctcctgctatgtagtatatccttctcatatcatacaatatgcatgacttattttcagatgattttcctgataagctttgtgattatattttgacaggtctgagtatcgtttctttaatcttggagaatgacaagagcttaggcactatgacaagcaaagttcttggatttggctctaaaaattactgactgagcacagtatattttaagaattcatgcaagaagccagtaaactactgagaattgtgtgcaggaattctgttaagtacttaaaatcacgttgtagacatagagactgagagttaggagaccaagttgtgacctggtctatgttttaaagatatggccttgggaaataatttatcctaatgggacctctgttacaccagctgtaaaatgacaggtttgagtgaatcatttttttccatctcaaacattctatggttcaatgataatagaaagtgtgggataagtgtcaaatgagaggatacaagtgtatttcataggaggaagaagtccccagaggctgaaatgagagactttagttggccaaacagagagagatacttctggggaaaggagcttgagtgaaggtaaagagacacagtgcactttgtgggatcttagtgaaatgtcaatgtgcaataataatgatattaataatagttaacctttatggagcactcactaaggtaatatgtgttatctcatttaatttccacaccaatcctaggtattattattattcccattttacagaagagaaaacaggcacagaaagattcagaatttgcatgaggtcaaatagcaagtggtagaatccacatgtgaacctaggcaatctgatactccagagagtaacttctaattactgctgtggcagcaatgcatgtaagtcagaaataaaatgctccatagaagcactatagttttcgtgaatttgactggaaaactagcagttttgataggctgtcatcaagaagaataatgatagttactatttatgtagtgccaattgtgtgcttttcatacattagttctaaacctcacagatgtttttgctttaaatgaccattttacggataagaaatctgggctcagcacatgcaacttgtacaaggtcaaagtttgtaggtagaaagctgggattcagctctgagtttgccttatttcaaagaccttccttaacccactgtgccacgctagattcttggctagagagaagaaactattttcaaatattaaaaacagctgtatattactgtaggctttcatttatatgaaattctagaacagaaaaaactagtcaatagtgacatgaatcagatctctggtttcttggagtgggagaaatgaggggattgcctgcaaaggaacacaaaggaactttttggaatgacggaaagatttcatatcttgattatggtggtgattacatttacatcatatctgtcaaactcactgaattgtacacttaagataggtgcattttatcatatgcatattgtatctccatatagttgatttttgagaagcccagctgaatctagtgtttggtctttgacagaggctggggccactggcataatgtgtctttttatatgcatgggaccatagtgatggatataaaaccctagcttttagcaaccattccaaacaccttctatactactttcctgtattgcagaggctgaaaagctcaaaattagatttctctgactccttcgtagctaactttctgattgtaagtgacatacttccaattaaatagctttgagtgagactagggccacctgcctgctatgatgtttgtcgctgcttggtaagcaggaccatgcaggcgataggtttttctgcaatagcattccaatatccaatgcccagctttatgagtgttatgagttagtagccgcaaggatgacagtggcttctccatcctcagattgcaactatagcagtgtgttcaagaatccaaaagtttccatggcatactcctgatttcacacatttaggactgggacagaagatacagctcccctagcaaatcagcttgatggttatctcctgggagttatttctggaggctcagtttagagactgctcttccagctctccaatgatttgacaagcacatagttacccttattacatctctttctatatgaaattgctggagtgatttctgtttctctggaactatacactgacatcaccatgaaaattggtatgtttttcttcagtcaaaattataactaaaatgattactagcatcatcagattaacagcaatgttttcagggtactgactttctgctaggataaatgcagtaagatgcaaacagagcacacctttattctttctcccatgctacttaaactgtatgggtagattgtcccctactgcatgaatgaaatgaggcagctctcagatcataaaatcagtcactctcagatcatcaaaagttctccaattcatgtcagtccccaaaatgatctcattttagttagtaaaatgtccgatctggggttaatattacataacccaatgcgcttcttgtccacttacatacacccccagcttgagattccttggggctggaggaggacatggttggcttttgctcaatttctctgtaagatgcctctccatttcccttctctttcctcttccccttctatttctcatatttttctctcccgcttgggatcctctcatgtgggaatacaactgggaagaggtaaaactgggaaaggggaagagcctctaaactggtctggatgtcatctggcatcgagccctcttagtatggcagattctcagtgctgactcttgctctgctggggtgctggcggagcttcctcagagaaccttcattgcagcctttccaccgcagcttcttactaagctggccagtgttgaatctctctcagtttctgtatctgacggtatactccaacttcttttagccaagatccagtgtggcaggaagacccctcacacaagtccttttgaaatgactccaggctagcttcatccctccagcccactgggcacacaggaaattcctcacttcattgttctgctgtcagtggcagagcatctggacccctgcggccatcaggcaggcaactccaaacatagcctcccacatttaatcttcacaggtgtgagtcaaacatcaggtcctacttcccctcaagccctcagaagggttcctgtcacctgacctgaggtgaggaggaagcattggagcaggaagaaaaattctctctaagaaacaatttccctctactggccttatcagccttgattcctttttcagtagagctgggtggttgcatataccagcccaaatagttttatactctctaagcatgtcttgcatagttagtctagcaactcactttagaatgtgaatattttggaattaattattttgtttttgttctttgaggccatggccaaaattgaaacagaaggagctctactctaatatcatgttactcatatattatgtaatgatctcaacaaccctataaaataaaaatcaatgaccctattttagaaacaaaggttcagatggcagcaaatgggattccaacacagatgagtcggccgctaagtcctttgccgttaaccatcatgtttatacgattgatatcacaaatactgatgattgtcgtgggttgaattatgtaccccaaaatttatacattgaagtcctgacccctaatacttcagaatgtgaccttacttggaaatagggttattgcagatgtaatttgctaagttacaatgatgttgtaatggagtagggtgggcccctaatccaatgtgaccagtgtccttacaaaaaggaaaatatctggacacagacacacagggagaaagccacgtgaagactgagttatgctgccacaaaccaaggaacgaccagaagctaggagagaggctcagggtagatcctttccttgtgccttctgagggataatggccctgcagacaccttgatctcatacttcaagcctccagcttgggagacaatacatttctgctttacaagccactttctgttggtactttgttaaggcagccctagaaaaccaataaaactactctgtgacagccatagaaatatgatggagatttcatggttgaaatctgcctgtgtgagggagcacctgagctctgagggaagaaaaggtactggagcagccgaagtagggcctgctattgtccatgttcaatgacaacactgggttggtcactaaaaactttggataggctgtgaagtagaaagcttctaaattaattctacttcctttataacagagaaagattacttggaaaaacttgagaaagtttgccttgaaaaacttttaagaaaagaaatctcaaactagaattttgcataattgtttctgagaaggcctaaagaaatttgaaagtggcccaaacaggatattatacctgtatctgaatgtacagaactaggggtaaatgaaaggacaatacagtacaagcttatatttaatatttaatgtcttgctggctttgagaacaggagcgctgagatattggaataagtgtaacggaattctcttatacatccatgggacgtccaaatgcataaataattataaagattttcaaattgtaattcatgcagaatgtgaagacacatctgcatgttctgatcaagatatgcacacacacgttattgttttagagattttagattcaatcaatttccaaaaatattggctcaagtaacacagatatgcaattaaatattaatgcaaatatccaaaacatctcagttgcttatcacaataaatatttattttttgctcacatcacaatccagggtgggtcagatggcccttctatagtttgtaactatgccatctagaacatttgacctccaccgcaggggaagaaagggatagaataaggcactctggctctcaatcgcctcagtccagaagagacataacactacttctgttcatagttcactggccagaacaagtcacatggcccccaacctaactgcaactgagtaatatagaaaaacagctggaaaattttggaaatgctaattgtcttttccataaaaacaatacagtaatgcaaagggaataagtgtgtaaaacacattaactcaaataataagatgtttgttagacgatactccagtgagaatctgatctcattaatcttaacaaggggacattctggtgcctttctatctatgtgaaaattattatagtatggctcaattactaaaattaaatgctgctcaagagatccctatttcttctggaaattcccaaagtagtggctcatatgtgacctccccacaaaaaagctaaactgttccacatacaaaacaaaaaggaactcaagagtttccagggcagcctggaagcaaggagatagcagtaagagaatgccaggacttggaagtgaagtaaaaagatggaggagaggttctcaccagagggcagggggcccagtcagatggcagcagggaggagcccttgagagaagggtggacagcgatacatcccccatgtcaagacagtgatgtctaatgttcaagtttaaatcattgtcaattctttcatgagctttcgtactgtctgttagtttaaacaatacaaaaagtctactatccctgagtaagagtctgaccttcagggtcagggaagtttggagtagctgcagagactttagtcctacattctcctgggtaaggccatcatctggtcccacattctacaaaaagtccacttcccagaccttgtgtcccaattttgtcttcaaaaaatattgtcgttgtgaaatcatccctgtggaaaaactggaaagaaagatttttctgtgctgcagggagggccccatagagagcagatgacagcacagatttgaaagtagaaccaggcagcatagcttttgccaacagtgttcaacagaaagaaaagaaagatctatatttttattgtattacatttgcataagtaaaccctagagggatatcaaagaagctaatcaagtaagtacttagggtggggcgaggtgggtgataaggcagatgagggcagaggtgggagtgataatttttactatgcatacttttatattatttgatttttgaactatgtgaatatattatatattcaaaacgttgaaagaaattgaaaaagaaaaaagtcttccaagcatcacagattttgttcaagctgttttgggagaacaaaggagtaggacagaatccatcaagagggaagcaacatagacagaggacagtagtcaaagaaagaattacaatgtcaagataagcaggaaatgtgaacatgagggaatcaagggaactaggagtccctgactcaaatcccccttccttgaagttccagaaatacttagggggagaggcttaggatgaggaggaggatgttgggctttccagagaatgtggaataggagctggagactttgcaactttgaatattagaagaaagggtggccccagaaggatggtgtgacttgaggacatccaggtggcagatacttagattatattagcatggcatccaacgcccttgacaatttgatctgaccccttactgaccctcacttctttcctgcagcacttttctcattaaggaccagtccaggctaagtgttggggacacaggatgaatgcaagattaaggagcacccagtctgattgataaaagctgatttaaaaacaagatgttacacatgctctactagtaaagtgtacagtttcagtagggactcaagtgcaaagtggacaattgtgtgttccagggcttcattcacttgtcaggcactctagccagggtgatgaaaatagccaggaattggctgggcttctctcttttcaccaaatctctcatcatcccataatctagccctagcttcagtacatggaggctggatcccaagagtctaaagaaatctgtaagccctcttaaggtataggccagcaagtcacattgcatcattttcaccacattctattggtgaaagcaagtcatggggctagtccaaattcagtgtagaggaaacagatactacctcttgatgggaagattagaaaagtcacatcgcaaaagggcaaattgtatgacaaggattatggaggctgtcttgagaaatgaactaccttagtggcaaagcactaatttgagatatctacaactcaattacagactctcacttaaccactcattaaagacttgttctctaaatgtagtgaacttagattgataacccaatatctggactgccattctaagtatgggtatcttccttacgatacccatacacttatggccaccactagactttaacacccgaagagtaagactctatcttaatcatcctctacattcaggattgaatgtgatacctggcacttagtaacaccataaagtattcactaattacatttgttgaattaataaataataaaattaggtatttattgggcactctcttataccagagactattctaaatacttcagatgttgtatttggctgttctcatgctgctaataaagacatacccaaggctgggtaatttatacagaaaagagctttaattgactcacagtttcacatggctggggaggcctcaggaaacttagaatcatggcagaaggggaagcaaacatgtcattcttcacatggcagcaggagagataagtgcagcaaaaggggaaaagcaccttataaaaccatcagatcttgtgagaactcactcactatcatgagaacagcagggagataaccaccctcatgattcaattacctcctaccgggtccctcccatgacacatggggattatggaaactacaattcaagatgagatttgggtagggacaaagccaaaccatatcagatgttttgacttatttaagtagtacaactctggctataatttgcctaagattatataccttgtgtgcagtggcccggcatatagatctcctttatctggctccagagcctgtgccctgaaggctttgctgccttagcaaaagagtaaacaactatagtgaagacaggattgaaaattgcagaaataatggacttggaaaaggacaattgtccaaggcatgaatcacttagaagcattttagtatactggttaagagtgtagtctcttttagtttcaatttcagcgctgccaaatactatcttgggtgggatgctgtctgagtctgttttctcatctgaaaaataagtctaagaatagtgcttatctcatagggctgtggtgaggctcaaatgagatagggcaagtaaagtgtttctcttagttcttcaaacataatgaatgctcagtgagtatttaccattaatcacacagacaagcaattaaaaaatgaaatggcaaaacagtgcttaaaagtaaaaattggagtcagatgtaagtcgtttacaccgtgcatgacaaaattcccttcagaagtgtttattttttaatacaaagaaacctaaattggaaaaagaaaaacaattaaaacccttcattagaaagtcaaaagaactctgaacattgagcaactttctctttatcaacaatgttttgctaaccttttgaagaggaagattacatcacaaaggttttaagggctactacaggaagaaaataaaggctagctataataaaatcattaagcattataaatctcaagagtcaagaagactatcccatgagcaaaacacagaaaatcactgaactctataagaaaggaaaagaaagaaaattccagcatgctaaaaagctaataccagctttcaaattaaggttcaagggcactataaagaaatcaatatgtaaacaccaagtgatgaaagtcatgaaacctatcgacacaagttttattaaaaggaaaccatgctagataagttgaataagactatgatcgatatctgatgagagaaaagtcacagatatgatcactagggttgtcaaataacgttttttggcacatacaggaaacctttattagaaaattagcaaataacttctaaagaaataaaaaatgatgcatcttaaattacatttcagtcatcatccctcaagctactgtggcttccccttctcctatgcctttcccttcgtccctccctcaggagagtaaaggaagtgggaaggagaagaatttgagtggcagcagtggtggtgaggaggagatgggtgcaaacttctgaggctattgctttcttgtttctataacatataacaacaaccaaaaaaggcttgttttccatgtagatattggacactttgttttggctttaaattataaataccaattgaagtagaagattataaaactaggtaggttttccaaaagaggacttttctaaaagaactggctttataaggctctataagactaaagactatcaggtgtttacggtgttcctttttcacttcgcatgttccttatgcagctctgtagactgtaaatgatgcagcactatgagcactttgtggaaaagaggcataagaggccatatttattttaggtataggaagcgtaagagcatgttttaaaagggaagataatatacaaggctacttgactttcattgactaaatgatgggattcatttaatcatgcattcagcaaatatttatgaaatgtaccctatgtgccaggcactattctagacactggggagacagcaataaacatgatgaagttcccactgtcttgtgccttgcattctagtggagggaaacagacaataagcaaaaagacttataaaaagttattgggccctatgaagaaagataattcagggtaaagaaaggagggaagaggttacgaatctctttaggtaagatattcagggaaggcctcctggggagcaaagacctgaatacagtgagagagtcttgcaggtatctgaggagagaacacccaggatccaggcagaggacataccaagtagaaaggtcatgaggcagggtttgtgatctgtatactcacatgggtccccattctcagaaggactctgtgctttcttcaatgctcagcagtcactgtcttaaaattcttagtaatttttgagcaagaggccccaggtcattttgcactgggtcccaaatattatgtagccagtcatgtcgtgaaatgggagtggtcttagcatgtttgaggaatagcacagaaggagcagggatggagatgagtgatcaggtgaggagtaggaacgtaggagatgcaatgagagaggtagaagaggagggagcaattaggacactgcaataatactggtaattaatgagctgttacaatctcagatggtcatcatggtgcttgataagatagtcataagatatgtttcctgataaatagatcactggtatcagatccacaaattccttgtcgttcattataaattgcagtactattggtacaacactgtatagtcatgtgctgcataacaatgtttccctcaaggatggaccacatacccttgggtggtcccagaaaatcataattgagctgcaatattcctatcacctagtcacgttgttgatgttgcagccatcataatgttatactgcaacacattacattttctgtgtttacatacgcaaatacttaacattgggctacaatggcatgcagtattcagtacagtaatatgctatacaggtttgtagcttaagagcaataagctattaccattcaccccacgtgtgtactaggctatgtcgtctagattcgtgtaagtacactccatgatgtttatacaacgatgaaatcacctaacgacgcatttctcagaatgtatccccatcattaagcaatgcatggctgtattcaggatcaaataattgaatgaagcccaagcccttcatttctaggaaacaactaatttggtatctattactagagaaactgctaaatagcagtagtgaacaaaggatttcctgggtgctgacacccagtgcctagctctctcttttaacactctttacaggtattaaataaaaatcatagcaggtcattgttttgggctaaactcctgcactagggtccaatagaccagaccaaaaatcaaaagggagtcaactgtgctaaagttgcacactaccaaaacaaaactagattgttatgtgactttgagaggaatcaggatagagagatgacagccatctgtccaaacaggtcagttttaatcttaacaggcatgatagtgacattccctctgtttttgtttgtttgtttgtttgattattgtactttaagttctagggtacatgtgtacaatatatgtataaatgtgccatgttggtatgctgcacccattaactcgtcatttatattaggtatttctcctaatgctatccctcccccatccctccaccccacaacaggcctcggtgtgtgatgttccctgccctgtgtccgagtgttctcattgttcaattcctacctatgagtgagaacatgcggtgtttggttttctgtccttgcgatagtttgctcagagtgatggtttccagctttatccatgtccctacaaaggacatgaactcatcctttttatggctgcatggtattccacggtgtatatgtgccacattttcttaatccagtctatcattgttggacatttgggttggttccaagtctttgctattgtgaatagtgctgcaataaacatacatgtgctggagtctttatagtagcatgatttataatcctttgggtatatacccagtaatgggatggctgggtcaaatggtatttccagttctagatccttgagcaattgccacactgacttccacaatggttgaactagtttacacttccaccagcagtgtaagagccttccgatttctccacatcctctccagcacctgttgtttcctgactttttaatgattgccattctaactggtgtgagatggtagcacattgtggttttgatttgcatttctctgatggccagtgatgatgagcattttttcatgtgtctgttggctgcatagatgttttcttttgaaaagtgtctgttaatatcctttgcttacttttcgatggggttgtttgatttttttcttgtacatttgtttaagttctttgtagattctggatattagccctttgtcagatgggtagattgcaaacattttctcccattctgtaggttgcctgttcactctgatggtagtttctttcactgtgcagaagctcttgagtttaattagatcccatttgtctattttgacttttgttgccattgcttttggtgttttagtcatgaagtccttgcccatgcctatggcctgaatggtattgcctaggttttcttctagggtttttctggttttaggtctaacatttaagtccttaatccatcttgaattaatttttgtataaggtgtaaggaagggatccagtttcagctttctacatatggctagccagttttcccagcatcatttattaaatagagaatcctttccccatttcttgtttttgtcaggtttgtcaaagatcagatagttgtagatgtgtgatgttatttctgaggcctctgttctgttcccttggtctatatctctgttgtggtaccagtaccatgatgttttcgttaatgtagccttgcagtatagtttgaagtcaggtagtgtgatgcctctagctttgttcttttggcttaggattgtcttggcgatgcgggctcttttttggttccatatgaactttaaagttttttccaattctgtgaagaaagtcattggtaggcttgatggggatggcattgaatctataaattacattggacagcacatccattttcacgatattgattcttcctatccatgagcatggaatgttcttccatttgtttgtgtcttcttttatattgctgaggagtggtttctagttctccttgaagaggtccttcacatcccttgtaagttggattcctaggtattttattctctttgaagcaattgtgaatgggagttcactcatgatttagctctctgtttgtctgttattggtgtataggaatgcttgtgatttttgcacattgattttgtatcctgagactttgctgaagttgcttatcagcttaaggagattttgggctgagagaatgggggtttctaaatatacaatcatgtcatttgcaaacagggacaatttgacttcctcttttcctaattgaataccctttttttctttctcttgcctgattgccctggccagaacttccaacactatgttgaataggagtggtgagagaggacatccctgtcttgtgccaattttcaaagggaatgcttccagtttttgcccattcagtgtgatattggctgtgggtttgtcataaatatctcttattattttgagatatgttccatcaatacctagtttattgagagtttttttagcatgaagggctgttgaattttgtcgaaggccttttctgcatctattgagataatcatgtggtttttgtctttggttctgtttatgtgatggattacgtttattaatttgcatatgttgaaccaggcttgcatcccagggatgaagccaacttgatcttggtggataagctttttgatgtgctgctggattcagtttgtcagtattttattgaggattttcacatcgatgttcatcagggatattggtctaaaattctctttctttgttgtgtctctgccaggctttggtatcaggatgatgctggcctcataaaatgagttagggaggattccctctgtttctattgattggaatagtttcagctcctttttgtacctctggtagaattcggcagtgaatccatctggtcctggacttgttttggttcataggctattaattattgcctcaatttcagagcctgttattggtctattcagagattcaacttcttcctggtttagtcttgggagggtgtatgtgtccaggaatttatccatttcttctagattttctagtttatttgtgtagaggtgtttataatattctctgatggtagtttctatttctgtgagatcagtggtgatatccccattatcactttttattgcctctatttgattcttctctcttctttattagtcttgctagtggtctattaattttgttgatcttttcaaaaaaccagctcctggattgattgatttttttgaggagttttttctctctctatctccttcagttctgctctgatcttacctattttttgacttctgctagcttttgaatttgtttgctcttgcttctctagttcttttaactgtgatgttagggtgtcaattttagatctttcctgctttctcttatgggcatttagtcctataaatttccctctacacactgctttaaatgtgtcccagacattctggtacgttgtgtcttttttctcattggtttcaaagaacatctttatctctgccttcatttcattatttacccagtagtcattcaggagcaggttgttcagtttccatgtagttgtgcggttttgagtgagtttcttaatcctgagttctaatttcattgcactgtggtctgagagacagtttgttgtgacttctgttcttttacatttgctgaggagtgctttacttccaactatgtggtaagttttggaataagtgtgatgtggtgctgagaagaatgtatattctgttgatttggggtggagagttctgtagatgtctattaggtccacttggtgcagagctgagttcaagtcctggatatccctgttaaccttctgtctcattgatctgtctaatattaacagtggggtgttaaagtctgctattattattgtgtgggcatctaagtctctttgtaggtctctaaggacttgctttatgaatctgggtgctcctgtattgggtgcatatatatttaggatagttagctcttcttgttgaattgatccctttaccattatgtaatggccttctttgtctctttggatctttgttggtttaaagtctgttttatcggaaactaggattgcaacccctgcttttttttttttttttttttttttgctttctttttgcttggtagatctttctccatccctttattttcagcctatgtgtgtctctgcatgtgagatgggtctccagaatacagcacgctgatgggtcttgactctttatctaatttgtcagtctgtgtcttttaattggagaatttagcccatttacatttaaggttaatattgttatgtgtgaatttgatcctgtcattatgatgttagctggttattttacccattagttgatgcagtttcttcctagcattgatggtctttacaactgggcttttttgcagtggctggtactggttgttcctttccatgtttagtgcttccttcaggagctcttgtaaggaggcctagtgatgacaaaatctctcagcatttgcttgtgtgtaaaggattttatttctccttcacttatgaagcttagtttggctggatatgaaattctggattgaaaatagttttctttaagaatgtagaatattgtcccccactctcttttggcttgtagggttgctgccaagagatctgctgttagtctgatgggcttccctttgtgggtaacctgacctttctctctggctgtctttaacattttttccttcatttcaaccttggtgaatctgacaattatgtgtcttggggttgctcttctcaagaagtatctttgtgatgttctctgtatttcctgtatttgaatattggcctgccttgctaggttggagaagttctcctggataatatcctgaaaagtgttttccagcatggttccattctccctgtcactttcaggtacaccaatcaaacatagatttggtcttttcacatagtcccatatttcttggaggcttttttcatttctttttacttgtttttctctaaacttctcttctcacttcatttcattaatttgatctcaatcactgataccctttcatccacttgatcaaatcaactactgaagcttatgcctacatcacatagttctcgtgccattgttttcagctccatcaggtcatttaaggacttctccatactgtttattctagttagccatttgtctaatcttttttcaaggtttttagcttccttgcaatgggttcaagcatcctcctttagcttggagaagtttgttattaccgaccttctgaagcttaattctgtaaattcgtcaaagtcattctccatccagctttgttccattgctggtgaggagctgcgatcctttggaggaaaagaggtgctctggtttttagaattttcagcttttctgctctggattctccccatctttgtggttttatctacctttggtctttgatgatggtgacctacaaatggggtttcggtgcagatgtcctttttgttgatgttgatgctattcctttctgtttgttagttttccttctaacagtcacgtccctcagctgcacgtctgttggagtatgctggaggtccactccagaccctgtttgcctgggtatcatcagcagaggccacagaacagcaatattgcaggacagcaaatattgctgcctgatccttcctctggaagctttgtctgtgaggggcacttggctgtatgaggtgtcagtcagcccttactgggaggtgtctcccagttaggctatacagggttcagggacccacttgaggatgcagtctgtccattctcagagctcaaacactgtgctgagagaagcactgctctcttcagagctgtcagacagggacgtttaagtctgcagaagtttctgctgtctttttttcagctatgccctgccccagaggtggagtctacagaggcaggtaggccttgttgagctgcagtgggctccacccagttcgagctttccagctgctttgtttacctattcaatcctcagcaatggtggctgcccctcccccagccaggctgcctccttgcagtttcatctcagactgctgtgctagcagtgagcaaggctctgtgggtgtgggacccactgaaccaggcacaggatataatctcctggtgtgccatttgctaagaccattggaaaagtgcagtatttgggtggcagtgtccaattttcccggtagagtctgtcacggcttcccttggctaggaaagggaaatcccccaaccccttgtgcttcccaggtgaggtgatgccccgctctgcttcggctcgcctctgtgggctgcacccactgtccaaccagtcccagtgagatgaaccaggtacctcagttggaaatgcagaaatcacccatcttctgcaacaatcatgccgggagttgcagactggagctgttcctattcagccatcttcaatgttttcctgacgttccctctgttttaatcttcacaacaaaaagtcacctgcagccaggtgcggtggctcacacctgtaatcccagcactttggcaggctgaggcaggtggatcacgaggtcaggagatcgagaccatcctggctaacacggtgaaactccatctctactaaaaatacaaaaaaaattagctaggcgtgctggcaggcgcctgtagtcccagctacttgggaggctgaggcagcagaatggcgtgaacccaggaggcagagcttgcagtgagccaagatcgtgccactgctctccagcctgggtgacaaagccttggtctcaaaaaaaaaaaaagtcgcctgcagtaagctgatgtcagtcagttatatttctatttttctgtctccctattcctgtcttataataaaagtaactttaaaatgactgcattttgttctttgtttctgttttcttcatccctttctgtgtgtaaaaccaaacccttctgcacatctcagtggaacacttattttatggaacgaagtgtcgtcctattctagaattgcaaatgaagccagttaaaccaataaatatctcagttaagatctttatctaaattgattgtacttttttcttttgacatgagctaattgttttctgctgagaaggttttgcagtttgcattgtgggccattaaagatgctgcctatctgagctgctttacctgcctgaatggtaggctcaatggcaacaatgacaaatcatacacatttttatctttctttatcaaaagtctttcatttttcttttgtatcaactacattatcaactcttataggaaatgttttagctacatatatgaaagcaatcagtgactctgaacccaggacgtattaccattatccaaaagaaggctgtttgcttaaaaagttcctttgattaaaaatgtcttgtagcttgataacataagcccaaatcaccttaataaaattacattgctctcttactgatgcaggtagggtacctcaatgactttcctcattggcctggcctgtagctagtttacaattttacaaatgcttttctaagaacaactgacaggcaaaccacacatttaagtccatgctaataaccaattgtaagcatcttcctcaaccttatggtcaaatttacaaagcaatcgtattcttggcatcagtgggaaccagttggaaagatctttttgaggtacatcatgctggttcttttgagtaggaagaggctgggttgaccacatatatcatagaccaccacttccctcttctttggacctggagattggctgtggcagtgagtattctgagaactgttcctcatgggttctatgtcgtggataattactattgcgggcagcagtttacaccctcattctggttcacatggggcccacagaacctactggattctccatcaagcctgcactgagattctgcacaaactcctgttatcattgcaaagagtttatctcctctcctttaatcatattcagtattattttttagtccccttgggcatttggatcatccctggtgaaaactgagattctaatgagtagtacaattgtcattaagaatttcttataggaagtattcgaatttcattacagtatttggactgaagcagcattaatgtcagatgagtgccctcaccctgttatcctcagtctgatatgtaccagtgtgctctactctgccccaaagtcccatatgtggatttagtactacatatggctttaaataccatctattcactgatgactcctcagtttatgtttctagcataggcttctcttgtgaaccccatatttacaaattcatctacccacttgacatcttcaactgcatgtctaataggcatctcaacttaatgtgcctaaaacaaatttgtaatctttcctgaaatatgttcctttctaagttcccccatctcagtaataaataaaatctctccagttgtgtaggtcaaaagcttggaatcatctttgacgcctcctgctctcatataccccacatttgatctatcagcaaatgctgatgactgtgccctcaaaatatatccagaagtcaatgacttctcatcccttcctttggagccaacctagtccaagttatattaccttttgcgatagcctcccaattgatatcattgcttctgattttgccccaccacaaagagagtcagatcatgtcacccctcagctcaaaaccctccaatgtctcctcatctcactcagtgcaaagttgaagtcctttcacaggcctacaaggccctacatgattctcaggtacttcacctatttcaaatctcttcttccttcatgcatcttcagcctcacttatctcactgttctcccaaaatacaggatataggcccctctgggcctttgaacttgttactccctctgctataaatgcttgtccctgagatggtcacatgtttttctttgtaacctcttttaggtttttcttcaaatgtgcatttctcagtgaccaccctatttaacattacagctcctgcttgcagcactctctgcttttttttttttctccattgcacttatcactatctgacctcgtgattgtttatggtgttactctccccacccaccaaaatttaagctttataaaggaaggaatttttgttctcctgcttcaaaggtctaaccccagatcaaaagcctggcctatacagctaatcttctgtatctgtgggttccacatccatgaattctaccaaccatgattaaaaatattaaggaaaaagttcaaaataacagtacaataaaaataatgtaaatatagtattataattatttacatagcatttacattgcactaggtattacaagtaatatagagattatttaaaatatacaggaggatgtatgagggttacatgcaaatactatgccattttatataagggtcttgagcatctagaaattttggtatcctgcagtggttctagaaccaatccccctcaaatactgagaaaagactgtattaagtactcaagagatctgcattgcatgattaccacagctgtcagtagtctctggtgagcatgagtctccagtgtgtttgctggtgagtaggctagggtgtgacaggtccttaagacaagtggaattaaagaacctgacaagaaaacatacaactgctcagaattctcctcctggaatgcctgggaggtgaaggagaccagaatggcagcctgcctgatggggtgacatctctccactcccacaagcagcctcaggaacacagggctgggtaggcctccttatctggccatcacatggggtatgaagtaatactcactcacaagagttcttttcattgtacccagatcctgacacttcctgggcctcatgcgaatccccaggaccccaccccctctcctttagacccttgggcacaaaaagttctcccgtttctccgaaaacagaattccactacctttgagaaagctcccagaacttagaaaagccagtttatcctacatggagggtaaaaggctctggaattaagaaactctaaagaacaaagaccttcttttatcctatctcaatacctgtactgtgtgtgtgtgtgcgtgcgtgtatgtgcgcacatgggcgcaaatgcctaccattagtctcttacagtcaccagcccctcccttctgtagcaggtcaccaccttgctaatcctgttatttgaatactggaggaaattgaaacagtgctagaagtcaaaataaaatcattgaatccagtttttaaataaataataatgagggaagatttgtttttgaccaagggcctatgagatgatcaggaagccatgtttaatcaatcaaattatatagctatatcacaggagtatatggaggcttatgtgacaaatctagcaggttggcttcttttttaaatattttaaaattattttaactggcattttaaattttaaattggcattgtaaatttaaattttaaattttaaaataaaaattttaattttttcttagcagggatggggccttactttgttacccaggctggtcttgaactcctgggctcaagtgatcctcctgcctcagcctcccaaaggactggggttactggtatgagccactccttccagcctacatgttggtttcttaaacacaaaagttagttgaaggctacaagataaatgagctttttactaactaaagaatcaataatttctacttttattttttgagacagagtcttgctctgtcacccaagctggaatacagtggcacgatctctgctcactgcaacctctgcctcccgggttcaagtgattcttctgcctcagcctcctgagtagctgcaattacaggcgcatgccaccatgctgggctaatttttgtatttttagtagagatggggtttcaccatgttggtcaggctggtctcgaactcctgacctcatgatccacccaccttggcctcccaaagtgctgggattacaggtgtgagctaccatgcccagccaataatttctactttaaaaatatatatgctaattaaaatgctcattttactaaaatatatttttaattggcatttcttctgagagaaatatggagacagaagtgccataaagggcaaaatgaatggactgaattgcctcaatcagtaaaggtgaaacttggcccaccaaaaaacaaggtcatcaccatttacaggtgcctaatacaacttaattaaaggtaataaaacaaactaatagttacgataagtaataaagccggaaagtaagccaaggtcaagtacatggaaacaaatggttccaagaaaagcaattgcctgaggagtggtaaaaaacaaggtaacagagactcacctacataatggtgatatattagctagaaaatgataatctttgctattcaaatgtggctggaaaagaaatttgaaatcactgtcatgcatatttctgttgcaatctttgatctgcaataattcaaaggaaggaaagaaaggtataaacccatacaaatttaaatatagttttttaaggaactgtatttcctttgaattatatttaatagttcctgaaggaaggaaaggtgtaaatttaagcatattcaaatttaaatacataaaacataagttaaaactaacattgaggggtatttatgccacacatatccattatgctattaatatttcatcatcaacaaaccctgctgagatgggcattatcttatccattttactactaataaaattgcctcacagagagatcttgtaacagattcaagttacaaaaccagcaatcactagtatgggatttgaacccaggtctgtataactccaaaacccttgtttattctacttaatgacccagcctcttttctgatcctaattaaacaagtcctgataagtgaaatgcaggcaatgattgtggaagccagaatgcagggtagaacaggactgaactttgggctgcagagccaaaagccaaagatatttaatgacaaaaacaacaataattatatatatatacatatatacacatatatatacatgtatatatacatattttatatatgtatatatatgtgtgtgtgtgtatatatatatacacacatacagcatatgtatatacatacagtggctggtagccactgaaccagaatacaaagccaagaagacagtccaaaaatctgtcaaaaagatgttaaccagtgttccaagaggaagtgggccgtcactggacactctccctttcaaaaaaaaacccctgaaaaaaagggtggggtttttaacaccaagagaaatagagtggtataaacggaaaagccaatcacctgtaagtgggtgaaatttgacagtgacgaaagctattatataaatacccaagggaagtcaggatatgggataaatggggcatttatatctctttcatgagataatagtaatgataataatatcaacaaccataggagcaacagagctaacacttattgaaacttctcaacaactatgttaagcactttgcaaacattacataatttgatcacaatatccccccaaggtatatgttcttaaggaggcctgcagaggaatttggccccagaactctcaactgctacattatagattccaatttcctaaagaaataacctaccctcattagggaaattttctgcttttaacataatttttgtctcctcccctcccctcccccactacccccctcacttcctctcccctcccctacacttcccttcccatctttttaaagagacggtctcactctgttgcccaggctggagtgcagtggtgtggtctggctaattttttgatttttaacttttttatagagaaagacctcactatgttacccagactggtctcaaactcctggccccaaacagtcctctcaccttggcctcccaaagggatggggttacaggtatgagccactgtacactatacctggcctgtatttcttttcttttctttctttttgagacagtcttgctgtgtcacccaggctggcgtgcaatggcatgatctcggctcactgcaacctccgcctcccgggttcaagcgactctcctgcctcagcctatcaagtagctgggattacaggcacctgccaccatgcctggctaatttttgtattttttagtaaagatggggtttcaccttgttggtcaggctcgtctcgcatgcctgaactcaggtgatccacccgcctaggcctcccaaagtgctgggattatacgcgtgagccaccgcgcctggccacctggcctctataatactctagtcttattatgcaaagatttattatttcaaaattcttttctttccctcaactatttaaaagtataagaactggctggacatggtgactctctcctcctctctcatattttcccacttcttcccccacaaagggaaaaccctatcagataacactgcctccaggtttaaacaggtaccaaggagatacaagtgatcatcttggcaagcttaaaatttatgtcaaccaaatataatgggaaaacataaattaaggacacataaaagctaaactatttataaatgacattgaatgaattgaaatcatgaaatgctcaggaaaataaaatataaggtaatattaaaatttacattttcattgatataaaattcattttaaagtttgtgtgtatgtgatttagttctatatttattgaaaatgaaggatgattatgatatatttagagaaaaagactgcaaaagaatatgaccatatgattctatttttgttttaaacatgagtgtgcatttgttcaaagaataaaaatgtcttaaaaggtaacaacaaaaatatgtataacatagtagttatctctgagcgacaggattataaataaagatttttttctaacttttccagagtaaacataaattgtttttgtaaattttaatacttaatgaaacaaatcatggcctggcactcaagaaacattttactctgagatagggagcaggatttatttattcgggggccagagaggggagtgagtaacaatacttaacggttatattttgctggttaccaagttttgtttttctgtttgtttgtttttgcgatctttttgaaatggagtctcgctctgttgtccaggctggagtgcagtggcacgacctcagctcactgcaatatctgcctcccaggttcaagcaattctcatgcctcagcctcccaagtaggtggaattacaggtgtgtgccaccatgcctggctaatttttgtatttctagtagagatggagtttcaccatgttagccaggctgcttttgaactcctgacctcaagtgacccacctatcttggcctcccaaagtgctaggattacaggtgtgagccaccgagctcagtcagccagtgaccaaatttttaaagagatcctcactaagcatcagaaaattctggatccattttctggctctgccatgggccatctgggcatgttggacaagtcacgctgagacacagtttacctatctaaaatgtgaaggtgtaaatgtacttaatctagaatttctttcccagaactaatattcattgacttcacattcctagttctgtggtaaccagtaacatggtgatatggtttggctgtgtctcagatggagataaggaacttgtgaacctctgcctagatttcagaagatatatggaaatgcctggatgcccaggcaaaagttttctgcaaaggcggggccctcatggagaacctctgctagggcagtgcagaagagaaatgtggggttggagcccccacacagagtccctactggggaactgcctagtggagcaatgagaagaggaccattgtcttccagaccccagaatggtagatctacccaacagcttgcactgtgcacctggaaaagccacagaaactcaatgccagaccgtgaaagcagccaggagggaggctgtaccctgcaaagccacaggagtggagctgcccaagaccatgggaacctaccttttgcatcagcatgacctggatgtgagagatgaagtcaaaggagatcattttggggctttaaaatttgactgccctactggatttcagacttgcgtgggccctgtaaccactttgttttggccaatatctcccagttggaatggctgtatttactcaatacctgtacctccactgcatctaggaagtaactagtttgcttttgattttacaggcttacaagcagaagggacttgccttatctcagatgagactttggactgtggacttttgggtcaatgctgaaacaagctaagactttgggggactgttggaaggcatgattggtgttgaaatgtgaggacatgagatttggaggggccaggggcagaatgacatggtttggctgtgtccccacccaaatctcaacttgaattgtacctcccagaattcctgtgtgttgtgggagggacccaaaaggaggtagttgaatcacagaggccagtctttcccgtgctattctcgtgatactgaataagtctcatgagatctaatgggtttatcagaggcttccgcttttgactcttcctcattttctcttgctgctgccatgtaagaagtgccttcctcctcccgccatgattttgaggcctccctagccatgtggaactgtaagtccacctaaatttctttttcttcccagtctcagggaagcagtgtgaaaatggactaatacacatgggtagatcttttcttttccttcccaggtattaattaatttattaattagtttattcctccatccatgcattcatacatctatctctttgatcgaataatatttattggcaagctattacgtgtctagaacttagctgaagcatttcctgtgattttttggttgaagcttgttttctctgtatatttcttagggaataatattcattcagttcttgtatgctcacaattgctttatttttccgtagcttttatattttaacgtaagtttgggtatgcataaaaatttctttttttttttttttttgagacagagtctcgcactgttgcctggtctggagtgcaatggcacgatctcagcttactgcaacctccgcctcccgggttcatgctattctcctgcctcagcctccctagtagctgggattacaggcacgcaccaccacacctggctaatttttgtatttttagtagagatgggttttcactatgttggccagactgatctcaaactcctgacctcgtgatctgccctcccttggcctcccaaagtgttgggattacaggcatgagccactgcacccagcctacttttttctttttaataaatatattgctccatggacttatgaaatctgatgtaaatatgattttatttatgattttatttttgatgacttggtctttatgcctgaatgttcaaagagtttttttattttccagttatactggaatatgtcttggtattggccattctggctccacttttccaaggttaatggtgtgctctttcaaaataggtgttcagtttttttataattttaagaacgtcttgttgtattatggatttttgtatttcctttgttccgttgctttcattttccttccaacataagttacacttatgttggattttcgtttcctgtcttctatatttatcatttttctctcggatcctttctatttctttctttctgttttcttttcctcctttgtaaattgtatttcccaagtcttgtttctgaaaatagtgaactaggttgttttagaacaatttgaaggtattgaaaaaccactcatgtagtgaggacttatggggccaggatccagaagaaaagggaaccccagagagctgagcctgacatgtgccattgcttttagtcttgaggcatttgcctatttgagaacaatggctgaaaggatgagaatttgaacaaaactttcaatagactcaaggagttgaggggaaaattggagttctgagctgcacaaggaggatgagatctaaaataaaacaaaaaccgaaacacgaaaacactaggctttcaattgggaccacaagagaccacattttatgaaaaaggataaattggaaatggaccagtgactcaactccagttctgaattatatcagtccccaattcatgtttagccatctcgtctctgagtttcctggttctaatatatgctgttactttatagtttccattattttcttaatttgcttccattaattttgttatattatttagttttcatttttttaaattatgtcttttctggtacatattaactacccattttttcattatttagtttattttctttataatagtgtacttgttttgtgttcgaccatctcctttctgttgcttttgtataaacaaaatcaggtgttctgtacttttaggaaatgcctcccttgaagggaaatgggatatgctatgatagcctttatagtttcagtgcttaagagattcctcccctattattatcacatagcagacagattaagatacacatgtagacgtggatggcctttgtgtcgtcacacccacttccagagatgtgccttctctggagacccacctgacctcccagtgtttgatctttttctctcaacaaacaacaaaggcattgtaaggtcgtcaaaatattggatttactctcagagtttctatcctgctcaatttgaattttcttcacggaagtgttttcctcaggaaagatattttattggctatttctgagttatttgagtacataagccacccagtaccttctgatcttcccattttctcttagtgtgtggctgagatatttttattctactcagccataaattggagtcagaagccttctcctttttactgttattttcacaatatttacttgctgagaatcccactcaaggtaagaccttctctttttgagtatttgtggacaatttctgtattgcagtgttcgcagaaccttctaaactcttgttctctcctgtccactgcctctgcacagctgctaaaactaggcatgctctgtatgagttctactgctgttgtctgtggtttgggtggggcaaaacccactggcattctgaggctcatggggatgttttttcagttggctttctggaggatgtggtgagtagaacttatcttttgctattctagttggttcagtatgcttttaggaatggatttggggaaattaagaaactgtacaccataaccttgccctgacttgaagtcaagatgggtttatttttaaatcatgaatctatcaatcaaggcactgattccgtgttgctctactgtcttgactggcttctaagattatatttatttcaatatagtttctgttcaacttagttaggtgtctattagcttccctaaagatactcttttgaagtataatcaacctctatctcacagttgccaacattcttatattgctttcattttctttaccaccaaacttcaaatttcagtttcttcattagctagcctcagtaagggtatgtacatgtacattctgaacaattccttcaatcaatgagatctcttttcctttaaaatcagactttatttgagaactgtctttttgctaaaattgctgtattttcctcccaggcatgtttcaaattgttctttatatttcaggaacctcagtcagaatgcctcctttaatgttcagataacttgctaaatcaaaagtagtttcctcaagttgctgttgcattaacttagcagtacattcctttcacatgaaaattggtgtattcaagcctgttaccctcacatgaccacagctgaaatatttctctgatgaatacagtaaaattactatatccctctgaagttttgtagagtccactctagtctttagaacctgttagaatgtcccttcctttctgctaaagaaaagaaattaaatgggaggttagggtggggttaggaagagtggtctctagtctccagtgatctactgcagggctctatacctgactctgttctgtctaattcaatcagcattccagtattccattaacacctcctatgtgctgagttttatgttgaatagaaaggaaaaataagtctccaagaaggcattggagtttgatgtggactcaaattctgattctactgttcactagcacgtggcccgagtcagctgtttgatctctctgagtcttaatttccatatctgagtataacgattcctatataacatagctattgtaaacacttagtatgttttttcattatattttacatattatatacacatacatttttatatatttatatattatataaacatttgtataaatgtacaggtatatacacatgtatctatttatatatgtatgcatgtatatgtatatatacatatatatttcatctataattttataaaagctgtatcatgtaggactcatatacgcatatatgacatgtaataggtggtcaaataagtgtttgttccttttggataatgttatgacctacttgtaattagataacatttctttccctttttgcctacccaaacacacaaaatggctgttagacggcctattgattttcttaatgaattaaaattaactgtgttttaaggcattctatctcaaactgtgtgacatttgtgaaatatattgagacaacgagcagggttcttgatctgagggcggtcataaactattaaggggttcagggagtttttgaatcttctgaaattatatgcaaatagggcatgtttgtgacttatgcatttttggagtgaagcaattcattgctatcaccagatttttaatgggacttagaaacaggaaaaaaaagtcaagaatcatgaaggtgttataaaatcacagctgggactcaaatgattgtatgcttttggaggtcagaaactgtctatgtaattttctttttacaatgcttggcacagagccagaaagagttaagtacttaatttttatttttgaacgactgtaatattgaccaccttttctctactaggagggtcagatataaaaagtagaactaaaaaataaaaaggaagagattggaaagacgcgggacaaataccaagagcagtaaaagactaggaagcaaagaaaaagaaggaaagaaagaaaacaggaagaggagggggaggaggaaatagagtggaacagaaatagaaatgcaaagcggaagagaaagagaaaggaaagaaagtggtgtgttggactgcgctgatttgtttccttccttcttgtcccctttccccaataatctcttcaaggcaaaaggttccccagaggctcaatagaaacaggactcttacagactaaatgaaggtgtatgaattctaattttcgcttaatttgatagtaatgcctttggaaagtcactatttttacacgtagattttctttatctgcaatctttagataatgttagcaaagttaaaaaaattctctgtctccatgtaagctatattcaaaaaattcattttaatgtgattcaattcaaagagggcattttcctatagaaacactgttacacagagtatcactacagttcataaaaacatacttaacatgtaatggaagaaaagggaactggcctttcagctatcagctccgagcttggtaaactggagcacagcatctcttttcatttcctttctcacatcctagggagctttgcaccaatccatgttcataaattgagggatatgtctgcacttcaaagatcaatggcagcaacactgtgaacggctgttcatacataagtaaaactagttaaatttcctgattcttactctttccctcagctctttcctgccccacatgtgtgtccttcttgtccctagtacctttccacattttatattgggtacacgttccaatagcctcatggaactagagatctgtttcttctcaactctggaaaattctttctattccatttctgcatatgacctttaccttccatctagatctttttggtcttcaactgtatagagtgttatttctctcttgaacctccaccttctacctccaacccctaatccctgccatttgactaatcaggtatatccttgacaaaagtctgatgtacaaggggacagataatgttaccttgattgacagtgttctaatacatatattaagcagttgatgtagaacaggcgggaagacaaaatgttaccctgtttctcatgagaaaggaggctacactgctcttcttaggaagtaggaagatagatgcagagacagatatttagaaggggaggaaaataaaaattgtctatgtgtctgctaacctaaatccattcagtaaaagagaagtcaagttcagttcaagacagaagtaaggttggttccaaaggatggacacatacatgcaactcattcctgggtacacaaaagatgaaatagagggcgtgtgtcgaagtacatgtccaaaggtatgaagtagctgcaggaattttatcagagaaaccagtccccaggactaatgttaacagatgacagagggaaagctgtctgaattatttgccagtagactactggtcaagaggacttggaactatagctgaaaaaaaccttagaactatacacacaaacacagtactaatcagcagaagtaatgagtattgagagaaaacaatgagccataatttacaatcaacttaaatagaatttatgcaactgaaatctaagacagaataataggcagtaacttccagtttataataatgactacttgtgtagtcattactacacaaaattactgactacttgtgtactgacatgtattttgcacaatgatatgacagactaagacaaactgaatagtttgcaagtaaactacttgtcaagaggacttggaaccatagctctattgacatgtaaccatccttaccaaagacagactcaaattctcagaaacgtttgcttctattttggggagatcatccaaatctataaacttgtgaggctttaacagtgggaaaaaaaaccttacaactcacttagtctaacttctttactttaaaggtaattgccccttggatgaaaatcactaacattttagtataaacatatttacagtgaataactttacatttgctagccaaaatttgttgccaagggactaaaaaatgtggcaataaatgaagtacttgttaaaaagatacttagttttaaaatttttgtcagtccactttttattataagagttgctgataaaaataactaccatttattgaatacttactacatgttagaccctttgcaaacatcctcccctttaaccagcacaaccactagaaaagacaggcatcatcatcttccttttacaaagttgaggaccatgaggctcagaaaatagtagatagtagttagtaaatagtagagccaggattaaaatacatgttttctaatacttcatactctatcagattgtgtcacaatggtattaaaaaaattagaaatataggaaaacatgaatactttccatattttctatggtaggtgctatttcaagtatccttaaaatatgtgtgcaagtgcagaagattctattgaagtttaccttaaggcaaagacagtcataaagaggtcagaaagagggctgacttactgaaagtacttcaaaattctactctctcattaaatgtgaacagttcaaaaactttagcaattgtcattgatcagcatggtgaaatgattatggcctcatttgtgaacaggcctgataggttgcactggatttatctttcttcatttctttttttttttctttttttttattagctatttttctttttttaaattttattttattattattattctttaagttttagggtacatgtgcacaatgtgcaggttagttacatatgtatacatgtgccatgctggtgtgctgcacccattaacttgtcatgtagcattaggtatatctcctaatgctatccctcccccctccccccaccccacaacagtccccagagtgtgatgttccctttcctgtgtccatgtgttctcattgttcaattcccatctatgagtgagaacatgtggtgtttggttttttgtccttgcgatagtttactgagaatgatgatttccaatttcatccatgtccctacaaaggacatgaactcatcattttttatggctgcatggtattccatggtgtatatgtgccacattttcttaatccagtctatcattgttggacatttgggttggttccaagtctttgctattgtgaatagtgccacaataaacatacatgtgcatgtgtctttatagcagcatgatttatagtcttttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccggaacctgttgtttcctgactttttaatgattgccattctaactggtgtgagatggtatctcattgtggttttgatttgcatttctctgatggccagcgatggtgagcattttttcatgtgttttttggctgcataaatgtcttcttttgagaagtgtctgttcatgtccttcgcccactttttgatggggttgtttgttttttcttgtaaatttgtttgagttcattgcagattctggatattagccctttgtcagatgagtaggttgtgaaaattttctcccattctgtaggttgcctgttcactctgatgatagtttcttttgctgtgcagaagctctttagtttaattagatcccatttgtcaattttggcttctgttgccattgcttttggtgttttagacatgaagtccttgcccgttcctatgtcctgaatggtaatgcctagcttttcttctagggtttttatggttttaggtctaacgtttaagtctttaatccatcttgaattaatttttgtataaagtattgatgggatgtatctcaaaataataagagctatctatgacaaacccacagccaatatcatactcaatgggcaaaaactggaagcattccctttgaaaactggcacaagacagggatgccctctctcaccactcctattcaacatattgttggaagttctggccagggcaattaggcaggagaaggaaataaagggtattcaattaggaaaaggggaagtcaaattgttcctgtttgcagatgacatgattgtatatctagaaaaccccattgtctcagcccaaaatctccttaagctgataagcaacttcagcaaagtctcaggatacaaaatccatgtacaaaaatcacaagcattcttatacaccaataacagacaaacagagagccaaaccatgagtgaactctcattcacaattgcttcaaagagaataaaatacctaggaatccaacttacaagggacgtgaaggacctcctcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaactaagctggaggcatcatgctacctgacttcaaactatactacaaggctacagtgaccaaaacagcatggtactggtaccagaacagagatatagatcaatggaacagaacagagccctcagaaataacaccgtatatctacaactatctgatctttgacaaacctgagaaaaacaagcaatggggaaaggattccctatttaataaatggtgctggggaaactggctagccatatgtagaaagctgaaactggatcccttccttacacctttcttcatttctcatgtggaacattaatgttaacgggtctatgatgtatgaagagctaactctaagtaagcagaagtaagtcaaattctataacctattgatctgagatacctaaaaaggagcttggatttcaggaggattgggatacagctctcctcttgctttacattttgccataggctgggttttccagaaaacagactctgaaatggagatcagcatgtagaaagtttattagggaagacttttaagatcagcacctgtgcatggaaagagacagaagcaggattggacagtgggaaaagttgagctgtgatatagtcttaaagtcctcagtcaacccgacgaggaactctgaaggtggaatggccctaaagagtatcacaggtcagggaaggaaagctctatttttaatacccctatgttgatcagtcattggatgtgggtgcctgagggggcatggctttaagttgtttgcacctgaggcagttccctgagagggctgtaagctgaaggtcatctgctggcagcactcccaatagttgtggaaataaatctttctgtcctgaaggaggaacagggcaaaccattacagtgttcaccttgggtttgctgcctttgattgcatgtaaatattattttgtattatttaagatgtgtagggtgagtaaaatgccctagaaaccctaggaaagattaaccttgcctgtcaactttattcatttatgtgtttcttttagatttgaaagcctcagagaaggaccaaacagtgcctgagaagtttgaatttagaataaaaggttggtctggcatttttatgtgaacagaactagaaaccacagtagccaggaagagaagatggccagataactgaaagacagaaggcaggttaggaaggagctcaggccaggttgtgcccacccatctgtgttagaagatggtgatccttgtgcaagcagatatggaactaaataaagcccctttactcactgtggtgggattatgtggaataaagcacgcatctaggagccttgactatttttccattgcttccttttacataattatacccatttaatttatcctttaatttttgtgaatgcatcactctatttcagttacgctaagggaataagaaaaaaattgtgtccatatttggattaaagagaaaagacaaacatcatatccatggggtgcagatgagacaggtgtaggagaaatcaaagtgagaaagattaagaggacgtttcagtgtaggaagctctagatgcaagaattcaaagctttcaagacaggaagaaagagtccagaaaggcatgtactgctatatcttttctcatttccttctccgatatgttccctttcaggagaaaaaaaaatgaatagttgtaagcaccaatttatgatcacatggtaccagttgagcatctgtaatccaaaaacccaaaatctgaaatggtctaaaatccaaagctttttgagcatcaacatgatgctacgagtggaaaattccacacctaatgttatgtgatgagtcacagtcaaaatagaaaaactcatttcatgcacaaaatttttgaaaatattgtataaaattaccatcaggttatgtgtataaggtgcatatgaaacatacatttcatgtttagacttgggtcccatcccagagatatttcattatgtatatgcaaatattccaaaagttcaaaaactctgaagtccaaaatacttctggtcccaggcacttgagataagggacacctgtaccaggcgtgttcacgttctctcatttactgataacaaccatgtgaaaaaaacgtatattactgccattttatcatgagaaaaaccaagactcagggagaataattaggtttcctaagcccacacaataagtgatggaactgggaagagagtgtagcacaggtttagggtgagaaacaattggattaaatgtccttcagtatttgaatgaatacaaaaattgtggtatattcttataatagaatattactgaacaataaaaagtaataaactattgataaacataacaatatggtttaatttcaaagtaacaatgccagtgaataaaaccagatatgaaaaagcacataatgtatgatatcatttttataactctagaaaatgcaaactaatctctattgacagaaagcagatcagtggttgcttggagatggggcagggtgggaagtggcaggaggaaacttttggaggtgatagatacattcattatcttgactgcggtgatagtttcatgggtgtatacatatgtcacaacatcaaattatgcactttatgtatacttattgaatgtcaattatacctcaataaagcagttaaaaacaaccgggttgaaatccgtgttatactatttacaaattgcttaatctctaagactacattttttaaaaatcagttaaatggagttgctaatgcctaccacagagggttggtgtaaacattaaatcagtaaggcaagtgcttagcacactgtgtaatacaatagtaagcatgccgcagtagttatacaaggagtcctagactgagttcttccttcttagagctttctccactttaactaatcatgttagtcctttttatttacagctggaattcaaacacatcaatcttacttcaaagaccaagatctttccactaaactgtgctaagccatgacaaattttatgatttgaattgaggagggcatgccctgattggacaccaggctcagagtattccacataaatgctcctctgtattaccccagggtctggaaaagtcactctgggccagggaggaagaccagtggttcagctgcatattctttacctatactccttcagattctatctctgctcctttttcagatccctactggctaaacagcaatgaaattgcttatgcagtgtacagataaattgagagcaacaggtcctgtttctcaggagtttgccccgaatggcaatccaaactagacataatattgggagaacagcattcattgagattaactgacttactctttatgaaacatttgctttcctggataaaatagtgtattaagaatgttatacattatgtattaaaaatgttatactgcacattacacatcacatatttaaactacatgtaaatttataaaatatataaacaatgataaatctcccatgtttattttctaaagaatactgttaagagtaatacatctttaatatgtccaatcaagatgccatttcatggaattatgtaagttttttttgttgttcattttttttttctccaagtgataatcattgagagggtcttttcaagcagaatctgtggtatgctgacatcttataagattgtccttggacattccaattcaccaaaatttggaccccctgatactacagctcttttcttggcctactacccccaggcctcttctcacagcgcccagtcccttattctcctgagactgttgtttctcctcttttctcaccctctcttttcctactcctatgaagcagcaaaaacattctcctagactcagaatgagcagcttagtccttgtctctgaaggcttggttagcttcggccttatggaatcctaagaatcttaccttctactccatttttttcaaggttttaaattttctttcaaagaaagacactgttctttcttagagaaattctgatgccatctataaagaagcatgttctccacatttcacaggggaatgaacaaattcatgaataggtaagtagagatggtgaatgcagactgctgtttcaaaaaacctagtgataatgcaaaggaaagaagtgtgcagcagttgtagagggtggtaaggtaatgggatatagaagtcaggggcatgacagaaattggaaatttagaaaagatgcaggttagttgctgaggcaagtgctgaagaggagggaggggctggtctccaaagcagagtacggctggaaggccagcctagagcaggaggagacaacacttcagaagctgctactgagggaagtttgcaggtagaagagaaggagttgaggtatattatcttaaaaaataccacctggtgagaataaaagtgaaggaaataaaggagtgtgaatattgattcaagtaactttcatgggaaatgggaaagagaactaattggaaaagtaaaaggaaagccgtcaggccccagctgagacaacaaacctaataggtatagcagagagattacttccagcaatcttctcctatttttcctgttaatgataactcttaacagttaccattttcgtggttacaaaatatttcatcaactaggtgtatgataatctatcaagattactcagttccttttcaaatgaactaaaatgtggtatttttaaaaagacaactaagcatactttaattacctgtaagaatattgtctacctacaaataattaaagtctctaaaaaaggaagcaatacatttgccttttctgccaacattattcctgtcttcagcaaaacaccgtaatttaaaaatatacaccgaatcatttctttttttattatgataacatatacacaacacaaagtatgacattttaaccattttaagggtacagttcagtggcattaattgcatacatgctattgtgcaaacaccaccactatctgttaatgaagcttttccagcacccaaaacaaattcaataaccattaagcaataacactcccttatcccctccacctttaacctattttctgtctctataaatttgcctcttctagatatttcatataagtggaattatacaatactttgtcatttctctggcttatttcacttagtataatgttttcaaggctcatccatgtagtagcatatatcaaaacttgatttttttcatggctgaataatatcccactgtatgtgtataaaatattttgtttatccatttcttggttgatgaacacttgggttgtttccaccttttggctattatgaagaaggtcacaacaaacgttcatgtacaaatatctcttgagtctctgttttcagttatttggggtgtatatctcagagccaaactgctgggttgtatggtcattctatggttagccttttgaaaaactgccatgctggtttccacagtggttgcaccattttacattcccaccagtaatgtgcaaatgttccaatttctccacatccttgtcaacacttgttattttctgtttggatattttgtttttttttttcttaatcttacagctatcctagtaagtgtgaaatggtacatcattgttgttttgatttgcattaccctaataactaaggatgttgaacatcttttcatgtgcttattagccatttgtacatttttttgagaagtgtctatgcaagtcttttgtccatttttaaatcgtgttgtttgtcttttaagtatgttgttggattcagtttgctagtgctttgttgaagatttttgcttcaatattcagaagggatattggtgtgcacttttttgtgatgtctttatctgactttggtatcagggtaatgctgacctcacagaaaaagttagaaagtgttctttcctcttctattttctgaaagagtttgagaagaattggtgttaattcttcttgaaatatttggcaaagttcaccagtgaagctatctggtcctggacttttctttgttgggaggtttttgatcactggttcaatctctggccttgttgtaggtctagtgaaattttctatttcatcttgagtaagtttagttaatttgtgtgtttatccatttcatctagattatccagagctggcagtaatgcccctattctcattttaaattttaatcatttgtgtctttcttttttcttttgtcagtttagctaaaggtttgtcaatttgattactttttttacagagccaaattttggttttactgattctctctattgtttattctgttttattgatctctgctctaatctttctttccttccattgtctagttttgggtttggtttgctcttccttttctagtttctcaagggataaagttaggccattggttatcttttgtcttttttaatgtaggaatttatagttataagtttgcctctgagcactgtttttgctgcatctgatgttttaatatatgtgttttagttttcattattaaacatcttatgttaggctgggcatagtggctcatgcctgtaatcccagcactttgggaggccgaggcgggcagatcacctgaggtcaggagtttgagaccagcctggccaacatggtgaaaccccatctctactaaaaatatgaaaattagccaggcatggtggcaggcatctgtgatcccacttactcaggaagctgaggaagagaatcacttgaacccaggaggcagaggttgcagtgagccaagatcatgccactgcactccagcctgggtgacagagcaggagtccgtctccaaacaaacaaacaaaaacatcttatgttttaatatgtgtgttttcattttcattattttctagtttttattgtagtttcttctttgaccaatgagtgtttggtagtgtgtagtttaatttccatatatttgtggattttgcagttctcctttgattttgatttgtagcttcattctacttggtcagaaaagatactgtgtatgatttcaactttttaaaatttattcacttgttttgtggcttaacatatcatctatcctgaagaatcttccatgtgcccttgagaaaaatatgtattctgctgttattgggtaaaatgttctatatacacatgttaggtctagttggcttattcaagtcttttattttgtgacttatcttctgtctagatattctattcatttttgaaagtaagtattggagtctccaactattattgtacaactatttatctgcctttaattctgtcaatatttgcttgaaacattttgggtctctgttgtttggtgcatgtatgtttataattatgataactttttgatgatatatatatttatctatatatcaatatataatgtccttctttgtcattacaacagattttgacttgaagttttttgcctaatattagtatagcctccttggctctcttttggttactatttggatgtaatatcttttccattctttcactttctacctatttgtgtcgttaaatctaaagtgaatctcttacagacagcatttatccattctgcccatctctgcctttgagtgaatagtttaatccatttatatctaaaataattactcataatgaagtatttctgccattttgatacttgttttctgtatgtcatacttttttcctctcttattttctccattattgccttcttttatgtttagttgatttttttgtagtgaaccattttgattcgcttctcatttccttttgtatatatcttttagatattttctttgtggttaccatagcaattacgtttaatgccctaaatttaaggcaatatattttgcattgataccaacttaacttcaaaaacatttaaaaactatactactatacatctttatcttccccctttatattgttaatgtctttttacatctttaacattgtgtccccaacaggagatttattatttttatatatgtgtttgttaaatcttattaaaaataaaaggtagagttacaaacaaaaattaaatagtacttgttcttatatttgccctacctttactgtaggcctttattttcttaacatggctttgaattgctggctagtgtcttttcatttcaacttgaaagacttcctttgcatttcttgttggaaggaaacgttgaactcaacttttgtttatctgaatatatcctaacttttccatcattttgaaggacagttttgctagatataaaatttcagttaataggtttcattttctttcacccacttaaatatgtcactccactgtcttctggcttccatgttttctgataagaaactggcctttaattttaatgaggattccttatatgtgatgagttacttttttcttgtttgctgctttcaagattctctctctacctctggcttttgatgggttggttaaaatatcttaagtgtgggtctttttgagtttatccagcttggagttcattcagtttcttggatttgtaggttactatatttaataaaattttggaagtttctggctataatttttcaaatattatttctgcccctctctttgtcatctaaaactcccaaaacacatatgctggtcctcttgatgatgacgcacaggtcccttcatctctgtaaactctaaaaaaaaaattaacagactttatttttaatgccattttaggtttacagtgaaatgcagcagagttacagagaattcccatatattccttactctcacacaaatacagcctcccccactatcaacatctcacaccagagtggtacatttgttactatcaatgaaccaacagtgacacatcattatcaagcaaagtccataatttacattagagttcactcatggtgttatacattctgtaagttttgaccaatgtataatgaaatgtatctaccattatagtatcataaagaatagtttccctgccataaaagtctcctatgctccacctattcatcattccttcccctcatctgattggaatcatgcagtctgcaaccgttccagattagcttctttcacttagcaatatgcacttaaggtttgatatagtttggatatttctctttgcctgaatctcatgttgaaatgtaatccccaatgttggaggtgggacctggtgggagctgtttggaccatggaagcagatccttcatgaatggccatccccttggtaataagtgagttcttgctctggttcacatgagatctggtcatttaaaagtgtgtggcatcacccctccacctctgtctcttgttcctgctctggccatgtgatgtgcttgctctcccttcaccttctgccatgattgcaagcttcctgaggattccctggaagccaagcagaagccagcatcatgcttcctgtaaagactgcagaaccatgagccagttaaacctcttttctttataaattacccagtcttgggtatttctctatagcaatgcaagaatggattaacacaaggttcaaccatgtgtttttttggcctgatagcttatgtctttttagcattgaatagtattccattgtctgtgtgtaccacagtttatttatccatttaccttgtattagtctgtttgggctgctataacaaaatagtacagactggactgggcacaatggctcatgcctgtaatcccagcactttgggaggccaaggcagcagattacttaagctcaggagttgaagaccagtctgcgcaacatggtgaaaccctatttctataaaaaatacaaaaaattagctgggcatggtggtgcatgcctctggtccctgttactcgggaggctgagacaggaggatcacttaagcctgggcggtggaggttgcagtgatcctgccgagatcatgccactgcactccaacctgggttccagagcaagactccatctcaaatttttttaaaataggaaaaaaataatatagattgagtggcttaaacaacagaaatttactttctcacagttctggaggctggaaatccatgacaacagtgctgccaaattcactttctggtgagggttcttttcctggctttataggcagccgtcttttttttttatgtccccacacggcctttcctcgtgtatgctgagagacagaaagagagagtgctctggtatctcttcttgagaacactaatcttaccagatcagggctccacccttaacttgcactacttccttagagaccccatctccaaatacagccacactaggtgttagggcttcagcataggaattctgaagggtacataaaagcgcatcttggttactttcaagttctggcaattattaataaagctgctgtaaacattcaaatgcaggtttttgtgtggacataagtttcacctgatctgggtaaataacaacgagcccaactgctggattgcatagtaagagtatatttagttttgtaagaaaactgcctttcaacatgcctacactgaaccaggtgtggtggcccatgcctgtaatcctagcactttgggaagctgaggtgggaggattacaagctcaggaattcaagaccagcccgggcaacatagtgagaactcatctctagttaaaaaagaaaaaaaaaaagtagctataccatttgcattccaacaacaaatgaaaatttcttcattctttttcctttctgctcctcagcctcagtaatttcagtggtcttatcttcaagttcactgactcttctgcttgctcagttctgttgctgaagccacttagatttttttatttttatttttcagcttcagaatttctgtttggttccttttcataactactatctctttgttgatattctcatcttgttcatacatcattttcctggcttcctttagttcactgtcaatgttttcatttccatgtttagcattttgagcatatttaagacaattgttttaaagtttttgtttagtaattccaatgtctggacttcctcagggacagtttctatccatttattttgttcctttgaatgagccatactttcttgtttctttgtatgctttgtgatttttgtgtgtgagcttgaaaagtggacatttggctcctatgatgtggtaactagaaattagattttcttcactttcctaggggggtttgctgttttctggttcttgaaggctgtagcagtcagtttatttgatgcctgtctcaaactattatttcaaagactgtattccttgtcaatatggtcatggaagactctgtcccttagcctgtgttcagctagtgttttggcagatttcctcgaatgccagaagctctcacagtctttgcaaagtggctctaagccagggctctacttcaattcttagttagccttgcactgtgctaagggatcagcccaaaatgaaagcttagggttttctcaggtgttttctaagcaagtgttttgccctgggcatgtgcatggctttctaaattcccacgtatatatggttgcttttgaatattttaatttcccaaagaaactctctccagattttgccttaggcagtctattgcatgtttcaactgtaatctctgcctccaggtgtctagggttattacttcagtttgctgtgttttccagctttttctgccctaggttctgagttagcaaaacagaggagaggatcttgcatcaatccttcaggtagccccttgtattagtctgcttgggctactgtaacaaaataccacaaactgaatagcttaaacaacataaatttatttttcacacttttggaggctagcaagtccaagatccacattctggctgacttggtttctgctgagggcttttttttttctggtttatagatgataggcttctctctgtgtccttacataatggggagagagaactcttcctcttcttggaagggcaccaggtctattggataaaaggccctacctttatcccctcattttacctttattacctctgtaaaaccccaaaaggatagggttggggggctttccaaacacatagaggttcccagaggtttgtatgcctggagacagcatggaagctacatgccatttcttccataccttacattatacatctcttctatctggctattcatctgtatccattataataagtgagtaaacataggtaaagtatttgcccaagttctgtgagccatttcagcaaaatgggaatttgtggaaaaaggtcgaggaaggagatgcttctctatggaggatgaatagaaacaagaaaaggtatctactataggtccacctttagatttagaaatacaacttgaaataagaaaaaaaaaatgccacattatgcagctacacaatttgtaagtcaattagttcttttcaataacagatgcaacatatacatttataaataatttactcctttgggatttcaaactaaagaaacttcaactatttcacttacaacaaatgtttctgcttctgtttctcatcaattgagaaaacaattaaggaacactcctgattcttattccagggaactagaggaacaaagagtaaccccagggattctagcctcgtaagctgagaatatttttctagatgacacaagttcctcagtgcacacgtgacagtctctgctttcaagctaatatgctgtgagtcacactgagtcctcttccctcgaggttaaatgtatttcctagactttttttctttatttcttcctctgctctattctccatcttaaccctattcctctgtcagtcaattcagaaaacaacaccagccattccaattgtctcaaaatcttggtaaattttgtaaagatgtagctacaaggaataaaaactgtttagaaaatgttctcttaggttatacagggtggcattgtcaggtattttcaataggagacgagaagctctgtctaaaagcacaatgttgccagaaggatttccctgatctttgtttcctggtgtccatttttcacttactccctaatttaacataggaaatgaggtgcaagaagctctgtccctttcttccccctagagttcttctttttcttactcagggatcatccacaacaacaaacagtctgatatctaattaggccagtagtttcaactgatttgggctcacagctgaatagctgaaagcaagaaaaaaccatacaattaaattagggaccttgtatttaaggccattcatccactacataatcaggacttgagtctcacactaaggctctgtcttactcattctaacatatttacctctcaggttagtcatgccacaaaaatgtgcattgttaataattgcctcatctctacctttgatgttccagtatataaagccttcccctgtgtgccctaagttctgccctctgaaagagaaagacatgttttctgccatttattttcttgctattgggtgcaattttgctctaggatgaactcataaactcaaataaccggttatatatatgtttgttattaagtttgtttaagtacctctgtcacaacaaagaggagcagatatactcagccacagttacaaattaattcatgaaaaagaaaaaggagccagtgataattatgcattcttttaaaagagtaataaattttcaacaggctcataaaatgagacctgacatataagctaccattctgccatactcttaaatccaaactgcttgctatgaatgatgctactattttatacagtacacagtaaaatcagtaaataagttgtcacttcctgaaaggtctccatggtattcatgtaaaatacttaatgcttaattgcttaaacatcaggtagacctcatcagcctaatttaattaaaagaatgctaatgctttatatgtaaagcatatttacatataatctcattgactgccttttggggtacattgggataattttccccagttagtggatagggaaattgagattcagaagggttaggtgacttactacaggtcatccagctaatcagtgataaaactgggggcactgaaagataagtacctggattgggcttaccaaagtggtggctacaaaaaggctggagctgtgtttaaaagtttacaggagagccatccatttttagttgacttttttaggaaatgatccagtttgaaaaggagcaagaatgcaggaattctgcaacagagggctttgagagaatttagatctgtagattctgatctttggatagattacatcaaagcagaattgaaccgcccccttggtagacctgagaaatgtagacagacctgttggcgagccatgaaaatgttgcagagagagtcatcagaggcatctgtagctaaacatgctatgcatcagactggtcatttgtgaagagaaataatacagccaactttgtgaaatagtattgcaagccctctgggcaaatttgtattatgagtcaatctgtaatttgcttggagatggcagacaagatggctgtctggtttcaagacatggtttaattttgtgttaactcattaatttttaaaaaattaaaaaaaattgattgaggaaaaacaactgggggcagaattcaagtttcaaggattccgttgttctattcaccatgttacttccacaactggcaaagtttagctctcagtaagattcacactacatctctctataagagatcaaaaaacccttagataatacaggtgtcagggagcaaagataatcctaacattgtatgctacctactaaagtgaaaaagatatacttcattcaattatttattcattcaaacaacaaataattgaacacctgcatgtgtgccaggcattgtgctaggctctattatatccagctgtatgagttacctattgttgtataacaaactatcccaaaacttagtggcttaaaacaacaatcatttaaacatttagtatctcactgtttctgtggcctaggaattcaggagcaccttagctgaatggttctgtctcagggtctctttctaggttacagtcaagatgttgaccatgatgcatgcaatcatttgaaggcctgaagggttggaggatctgcttccaagctcactcacatggctcttgtcagaaggcctcaatacctcaccggttgttggctagaagccttaattactcaccatgtgagcctccttataagttgcctgagtgaccttatgactctgacataacagctacctggccccaacaagtaatcctagagaaagaataaaaagtctggcatgttttatagtctcccctcagaagtcacattacatcatttccactacattctattcatgagaacaagtcatttaatacagtccaaactcaaggtgaggggaatgaagtttgaccctttgaaggaagaagtatcaaataatttgtgaacatattttaatactaccatatgagttaataaaatttaatacacgaaatttaacttaattattataaactggtgttaatatatttgtaaaatgtaggtatttaaagggaaactaagtctattaaagaagacaatgttttaatgttgttgctagcttgtttgcattttctgtcaccattttcacctcattctgtctattaaaaaattctatatatagtgctaaataaatgatgacttggcctatcttattatgtcaactaagaattgcatttgatacttacaacagacaataacaaaatcttatatagaagggatataatcttcctcacctaacaacaaatccagaagtggatagtccagacctggtaagttggccctccaaagcaaccatggacctaggcacctctggtgtcctacactattaatagtgtctgtgtggcttttgttattatgggtgaaatatggctgttctacctccagtatcatgtccctgtttcaggttcaaaaaaaaaaaaaaaaaagggatgggtgcatatcaaatggctaaagcgatatttcttccataaagctttccttgagtctcctctacagaaattcacttttatttaattgatggtcacatggccagccatgacttatgaaagtctaggggcatgaatatttttaactggccacattgtcaccctgaagaaatcagagttctactagtaaagaagaaaggattttggtttagacaactagtaatgtctaccgacctactccaacgagttttgacatgcattattaaacactagacacaagagaaacaacaatactgaggtttatgtgtgtttcaagtatgtttcaaatgggagaatctggtcagttttgagtcccacatataaagtatatttttcaaagtaaccacaatttttattctctaattgaaaatgtcgaagaattggctgacattaatgtcacttctaggaatgtgttcaaggagataattgcacaattgtgcaaaagcctatggataagaatgttcatcagagactttttttatggtagtaaaaacttggaaacataaatgtcaatcaatagaatactggttggataaatgatggtatatccatttaacagacagtatgcaacttttaaaaatgatgttattcatgactgttgttcactgtgcagataatacgatccaatttatgaaatattgtatttatatgtctatatgtgcttttattcttagagagatgcctagaagaatgtaacacaaaatttaagaaatggttatctctatattatggtatttggacagattttaacttctttgcatttttgtttaaattttttaaatttgtttgcataagcatgtattgtttttataaaacaatagttattagctgggtgccacagcctgtgcctgtaatcccaactactggggaggctaaggcgggaagattgcttcagccttcagcccagttattcgaggctgttgtgtgccaagatcacacctgtgaatagccactgcattccagcctgggcaacatagaaagaccatatctcttcaaaaaaaaaaaaaagctattttcaaagaaaggcagggtgggggcagggctgatttggtccagtattgtttctagcaagtaattttccaggataaggctgtggctgaccttattttaggaaagggttctaatctttgctcaatggaaaaaagtgttattctttattaattataacttttaataaaattaaaacgagataaggagttgtgagttttggtttctatttggaacactgacccctgaaagagttctccttccatgtttcacaatggatggcaagacattgcggaaaggtggaaggatgttgcggaaaggtggaaggatattgcggaaaggtggaaggatattgcggaaaggtggagggggaggaggctgagcaacaactgtatacaagttggggaggagtagagaatggacgtaatcatgtaaggcagagaagtctggacccatgagccaaggaaagagcaataacctggacatcaggatagctgcacttctcttctaacatggacctatcagtttatctttctggccttagttttgtcatctgaaaaatgagacatctgtattagaatcactacatgtgctttatgtttcacaattcttttggatatattgatgcaatgtcctgagaaactacactacagctgaacctaagcaaattaaaggaaaaataacaataactaatgtatattattatttgtctcaggcattctaagtaacttgccaataggtggagggaccaagatgccagcccgggcagtctgatttcagagcccatactctttaacaaccatgctgtagagtactaaagaaccgcttggatagggcatttaaaggaagcagggtagctttcctattctggaacgtggtcttgtagataatggttaacgccagtaaagactaaaccttaccctcacctcatgactattgtggggttgcctcaacaggtggcagcctcctccccctattccaaagacaacttccttattcagagcccagcgaaaggggagataggttttgttacgcccctaagaagctcttccggccattgccccacagaaccgaagtgctgacagaaccaaagacgaaatgtgcctatagaaagctttctggtatcattatctcggttctcagctcttcctggttctcacatgatgacccagcacccgtatgcatacttcatcttattacttccttttattaagcccagagagatactgagtaaagagagcacggggagagaacagaaaaacaaatgaacgggttaagagcaggctacaggccacaagagtcctgcagggttagagcctgtacctcagacaaaggtccttcaagcatcccctttctcgctccctattgttaccctgctttcgtcccgctcaaggtcttgaagctagtgcataaccttacagcaggatcagaaatgcggagagtagcagacacaagccgcaagggggatacaacaaaatctactgctcgtgcaagatccgacttcccagaccccttcgcattagggcggagcgtgcacccggcagccaatccccgcttcctcacgtcgccgtatccccgcccaccgcccctcccgctccgcccttccctggggctggtgcggcggcggagacgtcagcgccaggagacttcgggtggcggctgcgccataggcgggccacggcctggacgcgctgcggggaggggcggagcgagcgggcgggagcgcgcgctgggcccgccttggccgccgccgctgtgctgccgctgccggggaataatctgggcggcagcgggcggcctcggctagcggccacgagccacttctgcggctgcccagagaagcaaaggtcaccagtcccaagtcgtccccctctccgccccccaggaggggcgagagggagccgcagctgatgtcaggtatggccggcggaggcgccctcaggctacgggtccaaggtctcgtctcccctcgccctcccccctctccgggttggtggggaagcgtggaggatggaaccaaaccccgggcgcggcggaacaggtgtctcggggtcaaagccgggctggggtcgtccgggctcctgaggaaggcgcgaggacttcccgctcccggagccttagcgatctgccacagcgttcggctgcgtacccggcctcaattttgtggacatgtaccctcctcttcgtcgtgggtccttcccttgtgcccgctcgcgcccctcttctgctcgcgcgctgcctggcggcgcggcggggcgcgcagtgcgcccggaccggaccacttagcggtcctgccccgccgggccctcccagtccctcctcccgggccctccccgccccgccgcagacctgtgggtcccgccggactgggcgcccaggtgttgggcaccttcgccggggagccactcggctgccgcgccgcctgagcgcccagcgagcgggctccttccagaggtgcctggagcttgcttgggtctagcttggatcatcaggtttgtctgtagctgatttatttctttaagtttccctgccgcagagtgaagcagatacgtgtgtgttggggcattcggggcatggaggaggaagaaaggcattaaattttttttttttgcttctgcaccccatttttccccaacaaattgtgatggaattagtaggtgttgacaagttgtccatttgctttgaatttgggtaagtcgtacactcttaaaagatgaccataatttagcgctgtggatttattctttcctggtccttaccgtctccccaccccccaccaccccgcatttaaagcaaacaacagtatcagcaacaaaaaacccacacatcctggaaaaattctcaagatttctaacctagttctctatatccattgtacatactactgtatttccttttaacgcttttttaagatagaaaactattgtgctaaccatggattgatttcattatgaatttaaaagttataaatttagaaccataatgaatcaatgaataattggccgatgtgtaagggagagaaatatgttaacttactaaaagttgggcatagaacatagctctgccaggaaaaagtgcgcataatttcaagttgcttcattctggtgtgagtttgggaagttggaatccgagtttttagaaggtatttagatgacagcttttcaccctcttaggtaaatggcagttgagcttaatgcccatgatgctgtatgttctaaatattgtatatagtacactatactttctaccagtctttatatatagatgtacagtttaagtgaatataaagtttcaagttagcaaacagttaactcttcaccttatggtaagtgaaacaatgacttagtaaggaaagtatgactcatttaaaattcttcataaagagaataatttttcagtattagtggagagctactaaatgcctctcaaatttgcctggaatgtgtatttttttgtatcttcctacttaggattaagcattttagaaatattttgtgtttcctatttaaagtttttcataattatgctttttaagactagactacgttgagtaaattcaatatccagttattcttaaaattgtatcacaaatttatttcagggtacacataatgagttcttgtttacctaatagaaatatgaaaaagtatgtcactaggcacatgctactatttgtgtattgatttgtgctaaaattaaaattgcattatgcagtttaacattataagccatggtaatttagagtctttgtgtggtaaaatcattgattggaatttttgtgacagtgcagctataaataaaccttaagtagaaaatggaaagcttgatgctgaaattaaattcagataggcttaaaagtttaagcttcccaatacaaccatcttttcttttagaagatttcttaagatttgattaaagacgctgatgtacaaactatagcaaggctgaaagaaaggtatgacaaaaatctttttacttcaaattcagtgggattaagtcattcttttaaaagaagaaaggtggggagcgggaaggagacttgttccataaaatgagaagttagccttttatcttaaaatctggttagagaggaactccaatgtgtacttaaattattttgcagctaattcaaatgtccaaggggaatatatatgccaaaatctgtaatatgtgagaataggaagagggagaaaaaaaatatataaagaaactggtgtttgtgatttagggaagcacataagaaggtgggggaaactgaaaggaaagtctaaataaattatctagcacctgtagtatgtgctgccttgcacattgaaggggcgtgttgggggcaacgagaggcaatattagggagattctggaatgggaaacctgtatattaaagcacatttaaacggctagatgttggataataggcagaatttgaaattaaatacagcttggcatagttatttgcattcttggtcattgtattttctagggctgcggtaacaaaatacgacaaactgggtgatttaaaacaacagatttattgtctcagttctggaggcaagatgtctgaaatcaagatgtaggtatggccatgctctctcaaggttcgaggggagaatctgttccatgcctcttagcttgttgtgttactgccaatccttagcattttttggcttgcagctatgtcactccagtctgtgactctgttatcacaacataatccctgtgtggctctgtcttcagatggtgtgctccacttcttgcaaggatactagtcgtattggattaagatccaccctaatcacctcatcttaacttgattacatctgcaaagaccctattttgaaataaggtcacgtgcagaggtactggaattaggacttcaacctatcttttgtggggacacagtttaacctgtaacagttgcacggtttatcttttacatcgttcagtaaatgtttagcattatagactgaatcagaggctatagtggaaacaggatgggacacttacatttatttacatatatcagtgatgtcttaatctgttttctgttgcctctagcagaatatctgaaactggataatctataaagaaaagaaatttattccttacagttaggaaggctgaaaagtcctggttcagggggccacatctggtgagggcatttgctggtagggactctgcagagtcctgaggatagcacagggcaccacatggtgagggggccgagcatgctagcccagaactctttctttctttctttctttcttgtaaagctaccagttcctttcccatgataacccattcatgagggctgaacccttagtacccagtcaccatttaaagactccagctctcaatactgccacagtggtgattaaggttcaacatgagttttggaggagacaaacattcagaccacagcaagtgcttactatgtgccaggtcctggagataaaacagtggataggcaaaaatctctgtcctcatggagcttacattctgaaacacgggttctaaaaatgtggtccctggatctgcagcatcatcatcacctgggaagttgttagaaattgaaattttcaggctccatcccagaactctttatttaactagccttccaaatgattctgatggagactcaggtttcagaaccactgatcaagatggaaaagagacagtaaacaagatgaataagtaaaataatatttgatattaataggtgctgtgggtaagcatagggtggccagtgaagactcctgaaaagtaaagacctgaaggagttggagagtgagccatatgagcacctgggtgcgtgttcttagcagagaacagttaagtgtgaagaccctggcacgtttgaggaatgacaagcagttagtattaggttcaatctatgaaattgctgctgtttgttcatttttgacctacaaaaacaccaaatactggggagaagagatcagaaagaaaggggtggagtaggatgcagattgtgggtagatccttgtaaggttttggctctctaagattaggaagacgggagggttttgagcaaatgagtgatgtgatctgatttcagttttaaaaggatcattgtggctattggtaaaaatgggccaaagaagcaaaggctaaaggaaggggaaagttggttagaatgttgttggagtagttaaaagacagagaggttgctcagaccagggtgatagcagtggagaagtcagaagaggtacaagactaaaaacgcacagtaaatggtttgaaaagtaagtttttttcatcccactccagttacccagttgtcctcctcaaaggcaattagtgttaaaagtagtcttatctctattcttcctgagatttttttttttttgagacggagtctcactctgtcgcccaggctggagtgcagtggcgcgatctcagctcactgcaagctctgcctcctgggttcacgccattctcctgcctcagcctccccagtagctgggactacaggcacctgccaccatgcccagctaatttctttttttttttgtatttttagtagagacaggggagatcttttatgtaaatgtgagaaacagttttaacaaattagtggagaggttgttacctggaaacatttagcaatgtctacagacatttttgtttgtcacaactagggggaatactactggcatctagtgagtaaaggccagggatgctggctaaatatcctacagaggaccggacggcttccacaacagagagttatccagctcttaatgtcagtagcgccaaggttaagaaaccttagtttaatgggatttacagaggttggtgggaagcaagtgttgtagtcagagaagacagtaggaagaggagctgaccatattgggaacctttcagtaactgtagacagttcaggattgctgaagcagacataaattataaggcacagaatagcaaaagacgaggctggaaacctggacaggctctaggtcatagcctttatttatatatcatgttaataaaaaatgtttagtttttgtcttgtaggcagtggagttccgtgaaaggattcatggggtgacatggtcagcttttcattttagagagctcattctggtgacggggtatgagttaaagagggatagcacttgagtcagagaggttagatattgtaatagcctgtggggagagaggagagtctgaaataggataaatactagaaatggagaggagacaatggattagaataatatttaggaagtaatgttggcaagacttggtaattggatttggggtgaagataagggaagcattaagaatatctgtgtactttgtagtttagataatcctgtggctctgagtgaaataggaacccattggtgaataatttaggtaattaccagtaattaaggtaaaatgagcagaggaaagtaatgagtcactttggaggtgttgaattagagatgcctatggtccaggtggaagtatttagcaggcatttgtgtatgtgaatctgaaacttggagaagtctgaaaggatcaagagatcattttgtttgacaagtgtggagaaattagtggactttaatttttatcatattatttcactctgtagataaaaattgcctccctttatttaatttttatcagaaaagtaatgtgtgtacccgatgcaaaattaaaacatcaaaaggttataaaataaaaaaaaatttgtccttccttgctcatgccacccagtgctagttcccagagatagctcttgttaaatatcatatgtatatatatcttaacagattttaaaatatatacagaaacatttaaaaagccaagtgaaatcatactagaaaatatttcggtacattgtcttaaaaaataaaccttttatcttatacagttgttaaaatgaatgacattgtgttatggataaaataagtgaaggggtaaattaaagtgcagactaaccgataagcatgatctctgatgtaaattaaaagctgaacatacatatgtgatgatataggcattacccaacgatacgaaagcagttacttttggggagagatagtggtagagatggtaaagaaaatttactcttttctgtctatgattttctttcatttgtttaggtttgttccttttgttttctttacattttctgatgtttaaaaaaatacccagtataccttattaacaataaaaagtaacctttgtcaaaagcacaaagattttccctatcagcacatgtagatcattgtttttaacagctactactattctatgctatggctctatcttttttttaaaaaactggttcctcatcaacagacagacgtcttatggttatggctgtcgagcatcttggctgacttctatgattatatctgtaaaataagtttctgatcatgaagtgatatatcaaggcataattagttaaaaatttaaaaagatgttgtgaaatgcccttccaaaagacagtaaaagtatgtattatgagaaagaatacaggactaccagttttcttgtatctgtgtcaataacagctgttaataaactttaaaagttttgccaatatgttaggttaaaaataatatctcttcatttgatttacctttgtgagtgaaatttgaacatcgttgaccattttttactgtgaatcttttattttctttatctgtttttgtatttggttaactatcttttttattatttatgatactttttggttctttttgctgtacattaaaaaaatatatttcataaagaaatatgccctttaaccagcgacttcattgccagaagtttatccaatgaataaactcatagtgttttaatagtcacagcttctgagtgtgggagagatctcaattcgtaatatcaaaatgcaaaaatatattttcttccagttttgttttaattccattttctaaaatactgaaatcttagaaacatttgaaattgttactagaaagtaaggatccagctggttttgtttttttttccccaaaagattaattaattcaataccatttcttcaataagccacctttttcttgatttgaaatgctgtttattatgtattaaatttccacatgaatttttgttttccatagagtctttatttcaacctgatgaagtccctttataagattcatctggtagagaccaccagggacacatctgtaggctgacaaaggttaattagcttgctgcagtgaaggagacttgcacagcagaggaaatgtcagcatttctaaagaaggaaccagggttattataggattttggagaatggtggagtttggataaagtttaaacgcaacaatatttgataagcttaaagcacggcaagactgtgtgtcaagggttaataaacatcaggcctgggctgagaagctgactcaggattctgattccctggagactacaaaatcgcgatacatgtggaatgttgtgtctggaaaccccttatctgaagctctgagttgcaaagtgaggttgcttctgtttcataatgatctaccatcagtgcgagagtgggatgttccattctcactttataaaatttcaaataacatagtttctgacagtctgatgtagagaacagtttctcagcacattgtctttagtattaacaaatgcatttttttaaacagactgagagtttgttcagcataaataccaaattgttttcattaccttttttaaggtaatatatttttatatgtagtaaactttgtctcttccccttccccagttcccctttcaagagttttccagtgatactcacctatttttccagataacatttagaataatttttgccacattaattttttaaaatcttttttataacttaaaattgatcagatcagattagtacaccccttcccacaatgcccctttccagaatttcccagttacacccacatgtttattggtccaaagttttagaatactttttgccaagttatataattttttaaaatcttcctgtgttttagctgggattactttacatacaggttaattcggaggaaatcaacatcattatcattgatacctttttttttccaaactttttaaaattttggtaaaatacatacaaagtttaccatcataatcatttttaagtttatagatcagtggtattaactacatttatattgttgtgcaaccatcaccgctgtttatctccagaactctttattttgtaaaactgaagctctatatccgtttaaacgatagctctccattctcacctttccacaggccctggaaaccaaaagcctactctgtctctgatttttcactactttaaagtacttcatgtaggtggaattgtgcattatttgtccttttgtgattggcttatttcatttagcaaaatgtcctcaagattcattcattttgtagcatatatcagaatttccttacttttcaaggctgaatactattccattgtatgtaaatacattttgcttgttcattcatcctcagtgaacacgtggtttgcttcacattttagctcttgtgaatactgctgcaatgaccatgagtgtacaaatactttcttgaaaccctgctctcattgggtatatatccagaagtggaattgctggatcatatggtaattctatttttaattttttgaggaattttcatactgttttccatagcagaaataacattttactttcataccaatagtatacaagggttccagtttctccacattctcttcaacacttaacaattttctgaattttgatggtaaccattgttatgggtataaggtagcatctcattgtagtcttgatttgttttgctaatgattagagatgttgagtatcttttcatctgtttattggccatttgtgtatcttaggagaaatgtgtatttgagtcttttgcacattgttgaatcaggttgattttttttgtttgagttttaggaattttctatatattttggatactaatctcttatcagataatacgatttgcctgtattttcacccattctgtggcttgccttttactgttgatagggtcttctggtgcacaaatttaaaaatttttcatcaaatctaatttgccaatattttctttcagtgactctgcctttgttgtcacatccaagaaatcattgccaaatataatgtcatgaagctcttttgttcaatgttctaagaattttatagttttaggtcttatatttaggtctttgatccattttgagttactttttcttcttttttttttatttcaataggcttttggggaacaggtggtgttgggttacatggatatgttttttggtaatgatttttgagatttgggtgcacccctcacccaagcagtgtacacagtacccaatgtgtagtcatttatccctcaccccctcccaccctttacttcaagttcccaaagtccattgtatcattctatgcctttgcatcctcatagcttagttcccatttatgagtgacaacttacaatgtttggttttccattcctgagttactttacttagaataatggtctccacctccatccaggttgctgtgaatgccattatttcattattttttatggctgagtagtattccgtggtgtgtgtgtgtgtatattatacataccacattttctttatccacttgttgattgatgggcatttgggttgattccatatttttgcagttacaaattgtgttgctataaatgtgtgttcaagtgtgtttttcgtataatgacttctttttctctgggtagatacccagtagtgggattgctgggtcaaatgttagatctacttttggttccttaaggaatctccacaccattttccatagtggttatactagtttacattcccagcagcagtgtaaaagttttccctttttaccacattgatgccaacatctattattttttgattttttgattatggccattcttgcaggagtaaggtggtattgcattgtggttttgatttgcatttccctgataattagttgtgttgaacatgttttcatatgtttgttgaacacttgtatatcttcttttgggaattgtctattcatgtccttagcccactttttgatgggattgtttgttttttttcttgctgatttgtttggtttttttgtagattctggatattagacctttgtcagatgcatagtttaccaagattttctccactctgtgggttgtctgtttactgattatttcctttgctgtgcagaatctttttagtttaattaagtcccatctatttgtctttgtttttgttgaatttgtttttgggttcatggtcaggaagtctttgcctaagccaatgtctagaagggtttttctgatgatatcttctgggacttttatggtttcaggtcttaaaagatttaagtctttgatctaatcttgagttcatttttgtgtaaggtgagagatgaggatccagtttcattcttctacatgtggcttgccagttaccccagtaccatctgttgaatagggtgtcctttccccactttacgtttgtgtttgctttgtcaaagatcagttggctgttaagtatttggctttatttctgggttctgtattctgtttcattggtctatgtgcctatttttataccagtaccatgctgtttcggtaactatagccttttagtttagtttgaagtcgggtaatgtgatacatccagatttgtgggttttggggggttgtttttgtttttgctgagtcttgatttggctatgtgtgttccttttcagtttcatatgaattttaggattgttctccctagctctgcaaagaatgatggtgacattttgataggaattacattgaatccgtagattgcttttggcagtatgatcattttcacaatattgattctacccatccatgagcatggaatgtgtttccatttgtttgtgtcattttcaatttctttcagcagtgttttgtagtttttcttgtagatgtctttcacttccttaggtatattcctaagtattttattttttttttgcagacatagtaaaagagtttgagttcttgatttgatttgcagcttggttgctgttagtgtatagcaatgccaccgatttgtgtacattaattttgtgtcctgaaactttactgaattcatttgccagttctaggagctttttggatgaatctttagggttttcttggtgtatgatcatatcatcagcaaacagcaacagttcgacttcctctttactgatttgatgccctttatttccttgtcttgtctgatccctctggctaggacttccagtactatgttgaatagaagtagtgagactgggcatccctgtcttgttccagatctcaggggaaatgctttcaacctttctccattcagtataatgttagctgtaggtttgtcatagatggcttttattaccttaaggcatctcctttctatgccaattttgctgagtgttttaattataaagggacactggattttgccaaatgccttttctgtgtctattgagatgattatgtgatttttgtttttaattgtttatgtggtacatcacaattattgacttgggtatgttaaaccatccctgcacgcctggcatgaaacccacttgataatggtgtgttatctttctgatatgctgttggattcggctagctagtattttgttgaggatttttgcatctatgttcatcagggatattggcctgtagttttctttttttttgttatattatttactggttttagtattagggtgatactggcttcatagaatgaattagggagggtttcctctttctctgtattgtgggatagtgtcaataggattggtatcagttcttctttgaatattggatagaatttagctgtgaatccatctgattctggactttttgtttgttggcagttttaattaccatttcagtcttgctgcttgctgttggtctgttcagagtttctatttcttcctggtttaatctaggagggttgtatgttttcaggaattcacccatctcctctcgattttctagtttgtgagcataaaggggttcatagtagccttgaatgatcttttgtatttctgtggtatcaatctaatatctccatttcatttctaattgagcttatttggatcttctttgcttggttaatctaactaatgatctgtcaattttgtttatcttttcaaagaaccagctttctgtttcatttatcttttgtgttttttgtttgtttctttctttgtctcaatttcatttagttctgttctgatctttgttgtttcttcttctggatttgggtttggtttgttcttgtttctctggttccttaaggtgtaaccttagattgtctgtttatgctctttcagactttttgatgtaggcattcattgctgtgaactttgcgtttagcaccacttttgctttatcccagaggttttgataggttgtgtcacttttatcattcagttcaaaggatttttaaatttccaccttgatttcattgttgactgaatgatcattcaggagtaggttatttaatttccatgtatttacatggttttgagggttccttttggagttgatttccaattttattccactatagtgtgagagagtacttgctataattttgattttcttaaatttgttgagacttgttttgtgtcctgtcgtggtctgttttggagaaggatccatgtgctgatgaatagaatgtatattctgtagttgttggtaaatgttctgtaaatgtctgttaagtcaatttgttctggggtatagtttaagtgcattgtatctctattgattttctgtcctgatgacttgtctagtgccgtcagtggagtattaaagtcccccactattactgtgttgctgtttatcttatttctaaagtctagcagtaattgttttataaattagggaactccaatgttaggtgcatatatatttaggattgtgatattttcctgttggacaaggccttttgtcatgatataatgtctctctttgtcttttttaacttgttgctttcaagtctgtttcgtctgaaacaaaaatagctacttctgctagctttctgtgtccactggcttggaatatcttttgttgttgttgttgttgttgttgtttttgtaatttaattttattttttattatacttcaaagttctagggtacatgtgcacaacgtgcacgtttgttacatatgtatacatgtgtcatgttggtgtgctgcacctgttaactcatcatttacattaggtatatctcctaatgctatccctcccccctcccccaaccccatgacaggccccagtgtgtgatgttccccaccctgtgtccacgtgttctcattgtttaattcccacctatgagtgagaacatacggtgtttggttttctgtccttgcgatggtttgctcagaatgatggtttccagcttcttccatgtccctacagaggacatgaactcatcctgttttatggctatatagtattccatggtgtgtatgtaccacattttcttactccagtctatcattgatggacatttgggttggttccaagtctttgctatagtgaatagtgccacagtaaacatacatgtgcatgtgtctttatagcagcatgatttgtaatcctttgggtatatgcccagtaatgggatggctgggacaaatggtatttctagttctagatccttgaggaattgccacactgtcttccacaatggttgaactagtttacaatcccaccaacagtgtaaaagcgttcctgtttctccacatcctctccagcacctgttgtttcttgactttttaatgatcgccattctaactggtgtgaaatggtatcttattgtggttttgatttgcatttctctgatggccagtgatgatgagcattttttcatgtgttttttggctgcataaatgtcttcttttgagaagtacctgttcatatccttttcccactttttgatggggttgtttgattttttcttgtatatttggatattagccctttatcagatgggtagattgtaaaaattttctcccattgtgtaggttgcccgttcactctgatggtagtttcttttgctgtgcagaagctttttagtttaattagatcccatttgtctattttggcttctgtgccattgcttttggtgttttagtcatgaagtccttgcccatgcctatggcctgaatggtattgcctaggttttcttacagggtttttctggttttaggtctaacatttaagtctttaatgcatcttgaattaatttttgtatcagctataaggaagggatccagtttcagctttctacatatggctagccagttttcccagcaccatttattaaatagggaatcctttccccattgcttgtttttgtcgggtttgtcaaagatcagaaggttgtacatgtgtggttttattaccgagggctatattctgttccattggtctgtatctctgtttttgtaccagtaccatgctgttttggttactgtagccttgtagtatagtttgaagtcaggtagcatgatgcctccagctttgtttttttggcttaggattgtcttggcaatgcgggctcttttttggttccatatgaactttaaagtagctttttccaattctgtgaagaaagtcattggtagcttgatggggatggcattgaatctataaattaccttgggcagtatggccattttcatgatattgattcttcctatccatgagcatggaatgttcttccatttgtttgtgtcctcttttattttgttgagcagtggtttgtagttctccttgaagaggtccttcacatcccttgtaagttggattcctatgtattttattctctttgaagcagtcgtgaatgggagttcactcatgatttggctctctgtctgttattggtgtataggaatgcttgtgatttttgcacattgattttgtatcctgagactttgctgaagttgcttatcagcttgagatattgggctgagacgatggggttttctaaatacacaatcatgtcatttgcaaacagggacaatttgacttcctcttttcctaattgaatactctttgtttctttctcttgcctgattgccctggccagaacttccaacactatgttgaataggagggtgagggagggcatccctgtcttgtgccagttttcaaagggaatgcttccagtttttgcccattgagtatgatattggctgtgggtttgtcataaatagcttattattttaagatatgtcccatcaatacctaatttattgagagtttttagcatgaagggctgttgaattttgtcgaaggccttttctgcatctattgagataatcatgtggtttttgtctttggttctgtttatatgatggattacgtttattgatttgcgtatgttgaaccagccttgcatcccagggatgaagccaacttgattgtggtggataagctttttgatgtgctgctggattcagtttggcagtattttattgaggattttcacatccatattcatcagggatattggtctaaaattctcttttttttattgtgtctctgctaggctttggtatcaggatgatgctggcctcataaaatgagttagggaggattccctctttttctgttgattgggatagtttcagaaggaatggtaccagctcctctttgtacctctggtagaattcggctgtgaatccatctggtcctggactttttttggttcataggctattaattattgcctcaatttcagaacctgttattggtctgttcagggatccaccttcttcctgctttagtcttgggagggtgtatgtgtccaggaatttatccatttcttctagattttctagtttatttgcatcaaggtgtttatagtattctctgatggtagtttgtatttctgtgggatcggtggtgatatgccctttatcattttttattgcatctatttgattcttctctcttttcttctctattagtcttgctagcggtctatccattttgttgatcttttcaaaaaaccagctcctggattcactgattttttttgaagggttttttgtgtctctatctccttcagttctgctctgaccttagttacttcttgccttctgctagcttctgaatgtgtttgctcttgcttctctggatcttttaattgtgatgtcagggtgtcaattttagatctttcctgctttctcttgtggtcatttagtgctataaatttccctctacacactgctttaaatgtgtcccagagattctggtatgttgtgtctttgttctcattggtttcaaagaacatcttttatttctgccttcattttgttatgtacctgatagtcattcaggggcaggttgttcagtttccatgtaggtgagcggttttgagtgagtttcttaatcctgagttctagtttgatcgcactgtggtctgagagacagtttgttataatttctgttcttttacatttgctgaggagtgctttacttccaactatgtggtaagttttggaataagtgtgatgtggtgctgagaagaatgtatattctgttgatttgggatggagagttctgtagatgtctattaggtctgcttggtgcagagctgagttcaattcctggatatccttgttacaactttctgtctcgttgatctgtctaatgttgacagtggagtgttaaagtctcccattattattgtgtgggagtcgaagtctctttgttggtctctaaggacttgctttgtgaatctgggtgctcttgtattggatgcatatatatttagaatagttagctctttttgttgaattgatccctgtaccattatgtaatggccttctttgtctcttttgatctttgttggtttaaagtctgttttatcagagactaggattgcagcccttgcttttttttgttttccatttgcttgttagatcttcctccatccctttattttgagcctatgtgtgtctctgcacgtgagatgggtctcctgaatacagcacactgatgggtcttgactctttatccagtttgccagtttgtgtcttttaattggagcatttagcccatttacatttaaagttaatactgttaggtgtgtatttgatcctgtcattatgatgttagctggttattttgctcgttagttgatgcagtttcttcctagcagcgatggtctttacaatttgtcatgtttttgcagtggctggtacgggttgttcctttccatgtttagtgctgccttcaggagctcttgtaaggcaggcctggtggtgacaaaatctctcagcatttgcttgtgtgtaaaggattttatttctccttcacttatgaagcttagtttggctggatatgaaattctgggttagaaattcttttctttaagaatgttgtatattggctttcactctcttctggcttgtagagtttctgcagagagatctgctgttagtctgattggcttccctttgtgagtaacctgacctttcagtctgacaattatgtgtcttggggttgctcttctcgaagagtatctttgtggcattctctgtattaccagaatttgaatgttggcctgcctcgctagattgggggggttctcctggattatatcctgaagagtgttttccagcttggttccattctccctgtcactttcaggtacaccaataagacgtagatttggtcttttcacatggtcccatatttcttggaggctttgttcgtttctttttactcttctttctctaaacttctcttctctcttcatttcattcatttgatcttcaatcactgatactctttcttccacctgatcaattcggctactgaagcttgtgcatgcatcacgtagttcttgtgccatggttttcagctccatcaagtcatttaaggacttccctacgctgtttattctaggcagccattcatctaatcttttttcaaggtttttagcttctttgcgatgggttcgagcatcctcctttagctcggagaatttgttattaccgattgtctgaagccttcttctctcaactcgtcaaagtcattctccgtccagctttgttctgttgctggcgaggagctgcgttcctttggaggagaagaggcgctctgatttttagatttttcagcttttctgctctggtttctccccatctttgtggttttatctacctttggtctttgatgatggtgacgtacaaaatgggattttggtgtggatgtcctttctgtttgttggttttccttctaacagtcaggaccctcagccgcaggtctgttggagtttgctggaggtccactccagaccgtgttagcctggttatcaccagcggaggctgcagaacagcgaatgttgcagaacagagatgttgctacccgatctttcctctggaagcttcgtctcagaggggcacccagctgtatgaggtgccagtcggcccctactgggaggtgtctcccagttaggctactgggaggtcagggccccacttgaggaggcagtctgtctgttctcagatctcaaactctgtgctgggaaaaccactgctctcatgaaagctgtcagacctggatgtttaagtctgcagaagttactgctgccttttgatcatactggtgaccagggaagcgggggaaagccggcagtaacaggcctcacccagctcccacaaagcccgaaaggccagtgccactcccaaggtgcctcttccagcagcactgagttaatttccaggcagctgctgagcagtattgagaagctgccccaggctatatgccctccccctcccccgaggaagtaagcagggctttcaggtttcacgcttccctacctgccgtggtttctttgctgctttctgcactgcctgtttgcctcctcccccgattctgtccaggaaacttcatgtttgtttgaaactgttacacagttcagctggaagtttccttctccttggggtctttccccaattccactggcagctctccccaagggcctctgtgagacaaagtcaggaatggcttccctggtgacagagagtgcccacagggctcttctgcttcttcctttatccctatatttctcacagctctctaaattaatctcagctccaggtgaggtcacatccttctctcgtgaattggccctttgggatccccagtgaggatgtgtgttcagaggcagacattccctttcacacattgggcactcagagttttttggctgtctcaggggaccagcagctgtaaactgcttcctttgaaaggtctatggattctctcggctttcctggtacgttcccgtggtagtagttcttcgagtaaaagttcacggtgtgagtctccacacactactcggtgtgtctgagtgggagctccaagttagttatgcgccctgtctgccattattttcccattttgagttagttttcatatattgtgttatgtaaaagtccaacttcattcttttgcatgtggatatccagttttcccagcaacatttgttaaaaacctgtccttttcccattgaatggtcttggctcccttcccaaaaatcctttgaccataaagtgagatgctttttttcctctgaattctttatttcattgttctgtatgtctgttttcatgccagtactgcactatttttattaacgtagctttgtagtaagtcttgaaatcagtaagtatgagttttctagctttgtacctctttttcaaaactgttttggctattcagggtcccttaatattccatatgaattttagaatggatttttctctttctgcagaaagcattgttgggatttcagtaggaactgcattgaatctgtaggtcactttggatagtattgacatcttaacaatattaagttttctaattgatgaacatgtaatgtctttctaattatttatgtattctttaatttcttaaagcagtgttttgtagtttttgtcgtacagatctttcactgtcttggttaattcctaaggtttcttttttttgctgttgtaaatggaattattacttcaagaagtgttctagttagtgcgtaaaaatgtaactcatttttgtgttgactttgtatttgcttctttgctaaattaatttattagttctaacaggtttttttttttttttggaatctttagggttccctgcatataagatcatatcatttgtaagaagataattttactttttctttccagtttggttgtcttttgtttctttttctttcctaattgctctgggtagaacttccagtactatgttgaatagaagtgatgaaatcaggaattcttgccttgttgtagatcttagaggaaaagctttgagtcctttaccatttgatcttaaaggaaaagcttttagtcctttaccatgtgtctgatgttcactgtgggtttctcgtgagtgtttatatcatgaaagcatattgaattttgtcagatactttttctgcatcaattgagaggaccatgtagggtttttttttcctccttaattctgttaatgaggtgtattgccttgattgatttccatatgtacaactatccttgcattccaggataaatcccacttggtcatgatgtatataatcttttaatatgctgctgaattcagtttgctagtattttgttgagaatttttacatcactgttaataatggatattggtttgtagttttttttttctctttttaggttgctctcatttctatttctaaaaataattttaattgacacagtcattgtacatatttatggagtacatagtgatgttacagtacatataatgtatcagggtaattagcatatccatgatctcaaacacttctttgtgttgggaacattcagtatcctcctcctagctgtttgaaactatattattattgttaattatagtcatcctacagtactatagaatacaataacttatttctccaactattatcattagctgtaattttgcatcctttaacacatctctccctatgcctcccttccccttcttggtttctactatcctttgttggtttgtggttttcttgtgtgtctttgtctggctttggtatcagggtaatgctggcctcacagaataagtcaggaagtgttccctcctcttctgtttttttttttttgtttttttgtttttttttttggaaaagtttgagaaggcttggttttagttctttttcacatgttgagcagaattcaccagtgaagccatcatgtccagggcttttctttgttgggaggtttttgattactcattcaatctccatactgatataggattttcagattttctgtttgttattctgtttcagtaagttttgtgtttctcacagtttttcctcatctaggttatgcagttgttgacattcggttgtttatagtatcctcttatcatcctttgtatttctgtgaaactattagcaatgccctactttcatttctgatttcagtaatttgagtcttttctttttttcttagtctagctagagatttatcagttttgttcctttttgaagaaccaacttttagtttcattgatttttccatgttgctttcctgtttcccattttgtttatctctgttctttattgttttatttcttctgctagctttgggtttagtttgttctttttctggtttttaaagttgtaaaaataggttcttgaattgagaactttctttttgtttcgtgtgttaataactataaatgtcttccttagcactgctttatctgtgtcccataaattttcttatgttgtgtttttcgtttgtctctaagtattttctaattactcttgtgattgattcttcgccccattggttgtttgatttccacgcatttgtgaattttccattttccttcttttattgatttctaacttcattgtattgtgctcagagaagatactttgtatgctatctgtcttttaaaatctattaacactttatttgtggcctaacatggtgtatcctgggaaatatcccctgtgtacttgagaacaatatgtatttggttattgttaggcagaatgttcagtctatgtctgttagaccaagttggtttattgtgttgttcaagttctccattctgtgtggttctgttaattattgagagtggggtactgaagtctcccaactgttatcatagaactatttctcctttcatttttttcacctttggttcgttcatctcagtggtctgttattaggtatgtaagtgtttatatagctgacccctgaacaacacagaggttagggatgctatcccccccacggaaatctgcatgtaacttttgacttttctaaagtttactaatagactgccgctggaagtcttactgataatgtaagcagttgattaacacattttatatatgtattatttactgtgttcttatgataaactacagaaaataatgtattaagaaaattataaaggagagaatttatttacagttcattaagtggaagtagataatcatgaatgccttcattcttgtcgtcttcacattgggttgaggaaaaggaaggattggtcttgatgtcttctgggtggcagaggtagaagaagatgcacatatagatggacctatactgttcagacccatgttgttcaagggtcaactataattgttatatcttttgctgtattgaatcttttattaatatataatgtccttcttgtcttttgtaaccttttttgatttaaagtcaattttgtctgatattagtatggcacttctgttctctttgttcttgtatgaatggaatatctttttttcatgccttcactttcaccctgtttgtgtctttgggcctaaagtgagtctttagtagacagcatgtagttggatgatgtttatcaattctgcaaatctctgccttttgattagagtttaaccatttacatttaaaatcataaggaggaacttctgtcattttgccatttttttctatgtgctttgtagctattttgtccttatttcctgcattactgtctcatttctttttgtgtgtattctataagctattttctttggttactgtgatgattacacttaatatttaaaaattacaatatttataccagcttaatttcagtaacataaaaaaattatgcttctttacaattccatccccaccacttattgatgttgcagaattatatctttatacattgtgtgtcaaaaaatataaactaattttttaatgtgttagtctcaagttatgtaaaaaaatgtggagttccaaagttacaataatactagaatttataattgcctatgtatttactgtcactgcaatttttattttttcatatagctacaagttattatctagtattcttttgtttcgactgggagaattttgctctacagagcaggtcttttggtaataaactctctcagctttttacttgagaatgttttatttaagaatgtcttgagaggctgaggcaggcgaatcacctgaagtcgggagtcaagaccagcctgaccaacatggagaaaccctgtctctgctaaaaatacaaaaaaattagctgggtatggtggcatactgctgtaatcccagctactcgggaggctgaggcaggagaatcgcttgaaaccaggaggcggtggttgcagttagccacgatcgcgccattgcactccagcctgggcaacaagagcaaaactccgtctcaaaaaaaaaaaaaagaagagaatgtctcagcttttgttttaaaggacggtttttgtggatgtaggattcatggttggcatttttttttttgttttattatcttaattatattggcctatgccttctgtcctccaaagtgtctgatgagaaatctgataattttattgaggactgcttatgtgtgattagttacttctttcagctttcaggattttctctttgcctcttagtggtttcattataatatattttgctgtgagtctccttgaagtcattctacttggagtctttttcagcttcttagatgtttatattcatgccttttattaaaattgggattttcaaccattgtttcttcaaacattttttctctctccattacttgggactatgacagtgtttatgtaggcctacttgatggtgtcacaagtcccttaggaccttcacatttcttcagccgtttttctttgttttcctaagactcaataatttcaattgttctctcttcaagttcactgattctttttttcttcctgtctagatctgcctttcagtctctctagtggatttttaatttcatttattgtacttttcggcttcagaatttttgtgtgtatccttttaggttttcattctctgtgtttctcttactctgttgcttttttttttttttttttttttttttttttgaggtctcactctgttgctcaggctggactcaaactcctgggctcaagcaatcctcccatcccagcttcctgggtagctgggactgtagttgtgcacactgtgcctggctcagattttccatgtctttattcatatttccattttgttcatacatcattttcttaacttggtccacattttcctttagttctttgagcatttttcagaaagttgttttatagtctttgtttaacagatctaccatcgggtctttttcagggacaatttgttagtttattttctttcttttagtgggccatatttttctgtttctttgtataccttgtgacttttttgttgaaaactggatgcttaaatttaatttaatgtggtaattctggaaattaggtagtatcccttcctcagggtgtgctttttttctttgttttttttttttaattgttgcagtctctttgccaaagatcagtctgagattttgtacaattaaggtattttcaggtcttttctgtgcctgtgccttaagctggatatgtaatacaatagtccctctttatccctgcttccactttctgaagtttcagttatggtcaacagtggtccaaaaatattaaatggaaaacttcagaaataaacagttcataagttttaaattacatgctttctgagtagcatgatgaaatcttgtttcaacctgcttgggacatgaattatccctttgtccatcatatgcacgttgtatatgttactcacccgatagtcacttagcagctgtcttgattattaggttgactctcgtggtattgcagtgcttgtgttcagttcaataaagttaaggttcaataaagttaaaataaaggttcaataaagttaacctttattttacgtaatgaccctagggcacaagaatagtgatgatggcatattgtcatgattttttttattatttaatatcttattgtgcctaatttacaaattagactttctcataggtgtgtatatttaggaaaaaacatagtacgtgtaaggttcagtactatctgcggtttcaggcatccactggggttctgggaacatattccctgtggataaagggggactactatagtgaatttctattttcccttgtatatgcagtttcttttgaatgcctcagtccttgatgtttggctcctaaaaaaaaaggaaaaggacaaaaatgaagagggttggggagagcaccagcctttaagttccttggcagttacctcagctagagggggaggggcttgcatcagtgggtggaggtacaaccacaatggctgccagcccctgcacctatatcttcgtgatcagaagtagcagtcaacagtcagaacacccattcctgatatttggaggacggggtccttattgcccaccctaactcccacagctacatataagctgctccacaaacacgtgcacagttgcctgcctgtgggagtgagggtggggtggggtcggtagctgctgctgagcaaataactgaaattgactgaaatcagccacagtttaccttactgtccaggactttttcttgaagtttgaagttttcagtatactttgagagcttcataatagttgtatgagatagattctaccagcgtaagtgttctctgggtatacagactcattcttggtgctttctactctactgtcatccaagaatcctctaacttaatcatggattcttcgtatctcacaacacatcttgtctttccatttactcgttttattttagatcctttatggaattatagttttctttatgtagagcctatacatttatagttttgttattctttgttacttatagcttttttgtttgctattgaaacgtgaccttccattataagtcgcatattatctgcatataaaaagtgattgacttcacatactttgtaaatggcagccttaagtgaatttactggtttttttggacagcattttagtattttttccgaagatggccatagtatctgcagttaatgatgactttctcacctcttctgaaatatttgtacctttatcttcttgtgcagttggattggctagtgcttccagtattaaatagtgttgataacctgcacccttgtcttaaatggatactttgtgcatataagtatagaaacaggagcatgatgcagaaagaacaagctcttcaagaataatctgcttccaggtatgtcttacagccttctgaaccttgtaatggataaggatcagcctactcctgggacaggcagataggacattcgtggagaaagaatattggatgttcctagaaagttttcagtgtgataaagcagtataattttctcccaaccttgggtattgtagaacctttcactcacgtccgtgtgaagagaccaccaaacaggctttgtgtgaacaataaagctttttatttcacctgggtgcaggcgggctgagtgcgaaaggagagtcagcgaagggagatggggtggggccgttttataaaacggcctatttataaaaataggatttgggtaggtagtggaaaattacagtcaaagggagttgttctctggcgggcaggggcgggggacacaaggtgctcagtgggggagcttttgagccaggatgagccaggggaaggaatttcacaaggtaatgtcatcagttaagggaggaacaggccattttcacttcttttgtgatttttcagttacttcaggccatctggatgtatacgtgcaggtcacaggggatatgatggcttagcttgggctcagaggcctgacagaacctgttgaggttgcaaaaaatatttgtgactcttggaacagtaacaaaaagttgttctgactttttattttctgaacctggaattgtgggactattttaaagggtataatttcaactggagacttggggagcttgattttgacttgattgcgaagcatctgtatagctcatgttgtatgtccagtttatggctttgtattatagaaatgtatttaaagcttcaaatgatgagaccatgcataatttcatggtgggcagattctttttttttttttttttttttggttttaaggagcggagagtttaataggccagacagaagggagaaggcagaaggaagaagctcccccgtacagagacagagggagggaggctccaaagccaagagaagggatccccaagtgcggtggacaccagccaggtatatatgcagaggctggagaaggtggtgttcgatttgcatagggctccggggattgggttgactaggcgcatcattcacatagctcatgaaaaagctggctcttccaccctggtcttttaatatgcaaatacatggcgccatgatgttctacgctcgtcgggattccaggaacatgtagggcaagggcaagaaggctgtgggaatctccatgtttgggtggacccagtttctaatggcctaaatttgcatatgaaaggttgctggcctggctttaacagccgtggctttacaagaaacttttctggagatgctttaaaaaatgaaaactttccaaggacccctttttcttctctgcctaaaataatttcttaataactcctacaacattcccgcctgtggagatgccacactaactgctgttagagggttttgggcaacaactccttctggctacttactgctgaaaaggggcatcatatggggaacagcaactagggctcctcctggggttgatctaaggatcctcggaagaatggcatgtccatgtgtggatcagtttgcagcaccatttggagattgattgcttctaggtgagagttacagtattgagtatacagggcccagatatcaatacaagacatataaacaagagaaggcttaaaaaaggagttaaccaattccttaaggaagactggaatgtattaaagaagaatttgtagccacccggggctgaagctggcgttttccctgagcctgtcaataattttgatttgatctttaagtacctgtagatttttctctactttactagaggtgttaatcacccctaaacccaaaaaaagtcctagcagactcagtgatagtaaaactttcatgcttccttgtcagtaactattattcctgctctaaggataataattaagcaaaatacaacagcaatggaaactctgtccaatatttcagttagaaggtgctaccgtgtgtatccctattgcaaacagtagagtgagtatagcagttcccacaagtgtggtgtagtagataatttccatctaaaattttacttgccaagataatttccctttggtggtctatgaagctttggttttattttcctaaacaaagaaaccttcgggttatggataccctacttacttttattacctggcagaatttgcaggataatttcccacaattagtatagtgattcagatttttacattacccatccctttttctttcttccaagctgcagaagattaccacttgagtcacaggaataagcagggttaatttaaaatgtaggcaaaaagcttaaaaacaattaatgagactaggatttaatgacaaatgtatgataagctttggagcaaaattttctctccagttctcatttttggtaaaagctaattgtgaatgaactttagtcttatacttggcctgattatttgcatgaagtgttagcaagaatggttatttctacataggtcttttggatggctttgataaaactcagttccacaaggaatcttagataagacctttaaagcctaggccagcaatgggtttctatcctcaaatacctgtgagttaggtgatcctctcttcttgaggtcccaagaaactcggagcttccagacctgttagaaagtgacgttctttactgaccacaggttaggagccctgtgcggggactgtgtagacaaggtatgatgccagttctcccaggggctttttattggctctgcgtgtcaagcttgattccttaaagggaaacacaccctttcagtcaaagccttggtataataaccagtttttccaattgtgtcctgttgagaaagaaaaatggattcttactgcactaatgcaaacaactatattgccataagttaagagtaattacagttagtctccaaattatagaggaaccaggtggggaaaaatgaacattgttacttatgtccgtataagagaccacctgagcaggcttagtgtgatcaacaaggctgtttattcacttgggtccaagtgggctgagtcagagaaaggagtcattgaaggatagtgggattagcattggtttttaaaggtttgggataagtggtggagtcaggagcaattttttgtgggtaagggatggatgttgcaaagtacattcacaagggcggggaggaatgtttcagagtacattcacaagggaggggagggtgtattgtcacaagggctgggaggaatgttacaaagtacattcacaaggacagggaatatcacaaagtacattatcacaaaggcaggggaatgtcacgatggcttgaccatggtgcagccagctcagaggaccttacaaaacatgctccaaattttgtttacagtagtataccttactcaattattaaaaggtcataaatagtttagaataagtttccttgactctgaaaaaccaaacaaggatcaacaatattccaagcaaaagttaaaaagttgcttaaactttttgagtgcagtccacttagttaactcttgttttgcttgatatttgtgagcatgtcagttctttaggagtcccatatcttctttctcaatttcagtgttacaatcttcaaagctattaaaaacctgcagttaaagtccttaatatagcttgattataaaccgtcttttgagaaggaacaaagcaagacaacaattgtctgcaaatgacaaaattttcaggatagctacagttaaaaacatgactgataatttatttccatggtttacagtaactttagccttaattgtgattgacagcatgtacttcggcattagaattttagaaatcccatacaattttggaacgtatattagtattatttaccgaaatataatttaaagaagattggacatcattttggcaatcttatgtgactaaacatgtcagatgattccgtctaccttttctctgaatgtttcaggggccctctgagccatccagaaagccaggcatcaggaaggacaatttccagattggcataaatattttgccaaaatggtgacttaaaaggcaaaaatctttcattagcctttactgtgacatgaaaattttgtttaaatccaaattttacccttgcactagtttattaatgttaaccccaattagtttaaatgaaaccttatggattatttcatctaattttatccactttgaccatgaggtaaaaatctttacaaaccttttataacctttttactaaagggcagattagtgccttaagaccctcttgctatgcgtttatttcaatgcttaatttatgaaaagaacatataaatatcatgggagaagacactgtagttcttctaccatgcatttcattgcaaggcaacccaaagccaattggcttattttgtaatcagtccatccctgatgggaggctcatctcccagtggggggtagggatgtttccttatcttccaggtggccaagagcatgctttctaatttataactactattagccatccctacagtgtattttctacttagttattacacaccaaagcttttcataatgtgaagtaatttgataccccccaaacttaaaacacagtagataacacaatgcaaaacagaatagagcctttgattttgagagggatccatctccttttaattcctgggatttcatgaggaaaaaaaggtttttttcccaaaacagggtctgtggcatctcctgtttttcccaaggagttccatgctaccagaagttatcttaggacctctcatgcatgcattaagagtggtaagacaaaaaatggagaaaaataattcagtcgactgaggagagcctttttccagaaaaacaagatccaagaagagaaaaacataaaagccttttaagtatacctataacttgaatatccacttttaattaagctgagcactctttaaggaaatccttttaaatcccctgttacttgactttagccatgccaagcagttaagattttcggctttcgaactttcgaaagtaacctcacaggtgaaaccaacaaggcttaatcaggtaatgactcaactgagggtgtacagagtattttcaaaattgagactgagacagtgaaagagatccaacccaagcaactccatttggtttccagcccccaagctgtccttgcccatcccaggggtaggccgaacaaactttcggagaagccgggtttacattctccagtcgaaaacaaagatgataatagccacttcccatgatatactttccacttgcctggggaccagaccaggaagctagctacaagactagaaaccttggcccaggagccatgcagctggaggctacaagattttgaccctccttaaactgctctcaagatcaggcttaagatattttgtaaaccctgcctctgatggatcagctggtaccatccaggttgactaactggattatctgattttgtggccctcacccaggaactgacttagcacaagaagacagccaccattgtaaaatggtggagactaaaacaaagtattgccacgcggttacagatcgtgttcccaaggacgtgaaacaagatggaggctgtagccaagtttgccaccgactgctttgctgggctggcttgaacagcaggcttacggagtcctgggcctgcatcctaacctaaggtaccctttctttgacagaaccatacagaaagagacatgcaaagcacaccagattgtttataactgaagaccaacctcacaaatccttcttcattaattataaatttacagagaatataaacaatgatccttattatccctttgccagtttgtgccgggagagaaaagccaaaagcccgactggtaagaaatttttacacttttgccagcatatcaggcttctgggttccctttccccctagcttaactttaagccaagcattttaaggtttggaaaattagcctttttcaggttggaagaacattataaaagagacagaagccattttaaaccgcgaaagaaggaaaaacaccatagaaaggaattccagttagggttttcaagaagtattgcctctcttcctattgggaatagtgtttcctctatttctttgccttccctattttttcttttcccttttggcgtactgtaggagacatattgcttatctccaaaattctcttctgcttgcagagctgcctgttttagctgcagtgagggcttgagttagcagcaacataacatcctcccgtgtgaggttaaatacctgagttaaattttggaaagtctctgtatacctatttcgggtcattagaaaatcagtctaagtctccttttacttgcctaaggtcctgcaatgagcagggaacttgaaggtgccccaaataagggggacccctagatgatttccctgaaagttacttttttttttaattttggggaactattttccctgggcctgcccaatatggtgctaaaagatctgagttgatcttacaacgcttgcagaggtttattagaaatgccatgctcttctgcaaaagaaaatgagttgctttctttaaagttctgaggttaaggaagttccagtgtttgagagtgcactccagaggggtgcaagctgaagataatttattacccatttagaaaaagaagcgagaataaaagcattttcttagtctccttcctttctgtatgacccagagtggaggagaagacggggtatcctctgaatgtcttaccttcccagtttctggattccggcaccttcttaaatgtgctcccccatggttgtaggcatggtcctccaagctgtggatctggatgaactaagtaatggggctaaccacatctacccaagcagccttagcttatccgccttgtgtgatttctctttgacttcctagaaccagtgtgatttgcctggatcccccctcccccagccaaaaaaaacatctggagaggctgtcacctttcgggcaaggctcctttaacggaggcaatgtgctatagattgcctgctattacggcccatgctataaagcacttacccttgaaagaaaacagttccagttaacttccgaacttaaacttcccttactaattaagtactatcttaatcggagacagaatagatgccttaaaagaacgtaggaatagaatggccgttttcccactgatgggacaatatcgggactaaaatctggctgccgaagacattttactgctaacttaaaagcataaacttccgttctcagaagagtcctagagcctgatttctgctaagtggcttagaaatgaccatgtgcttcccagagaaaccatagagagagagagttattgagtactgcctgctgtaattctctttcttttctaacagacctctttttcctaaactgtaagtattcctgcacattagacacacacacacacagggtaagagattgtggataaaaagagaaaatttggcgacagggtagatggaagagagtattgagattataggacagatttaaagttgaaatccgctgcatacttaccagtctgatgaatgaacttcctttaccggccaatgcaccaaaatgataatggttctgatgagtgaaggaacaccagggttcttggtactcatgctggcttagataaaacgacatggacacacatggaggggttttaaggagcggagagttgaataggccagaaagaagaaagaaggtagaaggaagaagctcccccatacagagccggggagctgagggggtgggggggctccaaagctgagagagggaattcccctacctgcccccaccttttttttttaagagacatggtcttgctacatcacccaggctgcagtgtagtggtcattcacaagtgatcctcctgcctcagcctcttaagtagctgagactacaggcacatgccacctgcacctggcagtggttaaaatcttaatgattatgtgggcacatgctttattcgctgatggattatttcatttttattcctttttgtttaataagatagaaacttctttaaaagctttgagaaaactattgaaaacttaagaggtgtaggcatgatttgaaatacaacagaagcagttcttttgtttttatgtatttccttaaagaagcaaagtctcactctgttgcccaggctggagtacagtggtacaatcatagttcattgcagccttgtcctgagctcacgtgatactcccaccttggcctcctaaaattctgggattacaggcatgagccactatgcctggcccagaaacagttttgtttggtaaatcaggcagcatagataccgtttgagaaaaatcatttcaattgtagctctcccctccctgccgcaaaaagctagatggctcttgcaagctgagcggtatgttagatactggtgagagaaagacacatgagcccatagctgccatttgcggggagctttactgatgagtatatagtaaaggtgtaaatgaaggaataaggaaaaatttgatgggatagtattatagtttggccgtgggagttaggaaaggggagcagtggaaagtgctgaaactaagataacctttaaaagttagttacaggtctgtggagtagacaaaatcaggccaggcactccagtcataaagattaaaatggtcagtcatctgtataaaaggccatggaagtcttggagaaaggctcagtgtaggcttagggatggggaatgtcagaaataaaatgacagaaaggtgaactagagctagaccctgtgtaccaagttaagcagttggatttaattttgtggcattgaaaagtattatatttttaagacaggactgttaggtgaagtctctatggggttgtttgcagatagtagtaaaatttattggcccaacgaaaaatgaacaaataatggaaggagaaaagtgtcatcagagtggttaaaatggagcaacgtagagatattagatttgggggtgggggatgaataaggtgagctgctttgccccctcattacaagctagttcttgtgtattgcactagtgcctcataaaaagaatcatagcaactctgagaggtaagatattctgttttgccttattttgccttctgagagtttacactgaaacagtagaagatgtgctagtgactatatctttggctcctagtacaatatttaacatttggaaaggtccatttggtagcaccttccaaagattacagaaaaccttgtaattgggtttaaaatcaaattggtatacatctcaaaccgtgtttctatttttttttttttttgagatggagtcttgctctgtcgcccaggctggagtgcggtggtgcaatctcggctcactgcaagctccgcctccgcagttcacgccattctcctgcctcagcctcctgagtagctgggactacaggcgcccgccaccacacccggctaattttttgtatttttttttagcagagacagggtttcaccatgttagccaggatggtctcgatctcctgaccttcgtgatccgcccgcctcggcctcccaaagtgctgggattacaggcgtgagccactgcgcctggcatggaaatagttatttttcataaaatacatgatttgtgttaacaggtagaaggtttaacattactgttttgaatagtttatacataggcttttaggggaatgaaaatattctatgatactataatgacagatatgtatcattgtacatttgtccaaacccatagaatgtacaacaccaaaagtgaaccataatgtaaactgtagactttgaatgataatgatgtgtcagtgtaggtttatcagttgaaacaaatgtaccctctggtgaggaatgttgataacaggaagctaggcatatgttggggcagagagtattgggaaatctctgttctccttcctctcagttttgttgtgaatctaaaactactctgaaaaaaataaagccttaaaaatttttcagttttaatttctaataaaaatctaatcaatagataaaacctacataaataaaaactatttggagattctcactaattaagagtttaaagggatcctaagattactttttgagagctgctcaagaaatatatattcattaaactcaatttagaaaaataatgttagttggcccttatccaattgaaatattagaagcattttaagtattttggtttattttcttctagtctttttttagtatcactttttttaagcacataattgtaataacattgtctataaaattttgtgtggaattgtatatgaaattgttgtatataaaatatttgtgttcacttatgttctaatatgttttcataataaaatgtaatcttcaacaatttagcagttgtataatctacttagtgggtatatcttaatttacataattttaccttgtattgattctgatttgggatattaaatctttttcatttagcacatccttggaagcttattatgtacaggcactgctcatgaatgctttttattttttattaagattttcttagattaagagttgagtggctgagtaaaaagaggggaatgtgctaaagagaatcttgtcttttgagttttttgtagtagcaggccatatagcaagcaattaaaattaataggaatttacacaactctgttagccagcatagggttgtggaaagttatggtaaattaatttaaagcacttagaagaatatccttttcaatgaataattactcagtgttagctatttttatttgctatattatattttagagttgagtgttctttttaatttgtaattcaaatatacaggtgaccaattctgaaacttctcccagtccccagacctgtatctccaacagcttgctcaacatttctacatcagtgtcctactggtgctttaaaatatggtatatgctgagcattgatctaaacaaaatctgtcatgtctttaaagtatctttattcttttttttttgagacggagtctcactctgtcgccaggctggagtgcagtggtgtgatctcggctcactgcaaccaagctccacctcctgggttcaagagattcttctgcctcagcctcccaaatagctgggactacaggcatgtgccaccacgcccagctgatttttgtatttttagtagagatggggtttcaccatgttggccaggatggtcttgatctcttgaccttgtgatctgctggcctcggcctcccaaagtgctgggattacaggtgcgcccagcccaaaagtatctttattcttccctcacacttgttgcatagtttgagtataaaattctaggttgaaaattatttttcctcagaatttcaaaggattttctccactgctttttagctttcaatgttgtgcaagtccagaaccacttactttctggtctcttgtatgtgaccttttgttcctctctctgaaagtttgcaggatggctttgacccacgcgtcctgaggtttcatgatatgtctttatgggtctgtttttatttactgtgctgggtatcattggatcctttcagtgtgaaaatgaaaatgtctttgaaatattgagttaatgatttcctcttctcttttatctggacctctaaagtgatctttagttttcacagttttttttcttattttccatcacctcgtctttcttgtcttttaactttgcttactttcagggagatttctttatctgatttacagctgttctatttgaggttttcaattttcttacattttaatttttaggagtcttttgtcttctgatttttaaaaactgataccttgttcttcatgaatgcaatggcatggtatcttttctctctcaagatattaatggtggtatgttgtttgtttttaagttttcatctcattgcataatctctaccaaattcatttaaatgtgactgtttgtctttttctttcttatcagagccattccttaaaatgtctggtgattgataactggtgttggtaatttagactagctaataaaaagcgaattgaaatgtctgtacaagttgttgggactaatcaccagtggtttttaactgtaggatgatcccactggagtgatatattgctcaacctcttaggaattccataatgcaaatccaaacaaagtggtttttaactttctgtatccaaaacttaaactgtagcagatgatgccagtgctctctccataggcctgtgtttccttcctgctgtcagactcctagtgtctgttgattctcaacatctagctcctaaggcttgttgcaaggccaccctcaccatgccagagcctgttttgccaatgtacatgccgtggaagtgtctggaaaatttgcttcctgaagacagcccttaaccaatgactaatgatatgagtaaactctgaggtgtgacctacgttaacaccagaactaccctgagggactgagctaaaattaccctctatgggaccttccttggtgtcttacccttgcttagcttccttcccttcctgtcctgtttccctacaaggttttccatagaatactttctaataaatcactttgacacaagcacctcatcttagagcttactgccaaaagacccaacttaacgataactactactaattgctcagcattctctttaattggagtgaaatcagactgaagttttctatgctgttctttgggttctgtttgtcagataatgtcatcaaacttttatattaaagaataattggttaatttctgctccttaattttctggaatgatttatgtagtccaaaaattatttttttaaagattgagagacttcgtccaggaaagtctggacctttttgaagtctggctctttgacaacattttattttttctatggttgtctattaggttgtgtatcttgagtcagatttgataattagctttcttttaaatagaaatgtgtgtttcattgaggtttttatgtttaatagctattatacaaagtgttattttttcattttttctgtgaacatgaatactatttgaattctgatttgaacaaaccaactgcgaaaagacatttttgtgctaattgagacagtttgattacagaagacagttgtggaaatttgattacagactgtgggttagatgattccaaataattattgctattttgttaggcatttagtaatggcgttatagtttttaagaaaatgttgatattttcggacaggtatacagaagtatgtagaaatgagatgactttatgtctaagatttgcattaaaatactataatcatttgaagaaagaataaagtaaatatgccaaattttgtattataattcaatctgtatgacaggtatgtgagtttttttttggttttatgcttgtgtgaagatttttgtagttaagctttttttaaaaaaaagtcaactgagttacttacgtgatgaaattagaacacatacttcttacaagcacattctctcctatccccctctccatttcagttggcaccataatgccatttttgcctaaccataacataaattaatatcattttattttatggagtttttctttctgggataataacatttctgctttgttgcataattatcacagacaggtttttctttttttggagatggagtcttgctctgtcacccaggctggagtacagtggcgcgatcttggctcactgcaacctctgcctcccaggttcaagcaattctcctgcttcaacctccccagtagctgggatcacaggcacctgccatcaagcccagctaatttttaaaaatatttttagtagagatggggtttctccatgttggccagtctggtttggaactcctgacctcaagagattctcccacctcagcctccgaaagtgctaggattacaggtgtgaaccacagtgcctggccacacacaggttctttagttttatatgggaagagattgcatgtcttttgccaagcctttcattgtatgatttctccatttgtgagttttatgggtttcgtttttgtttttgtttgttttttattattttggcatgtgtatcttatatcctgtgaccttgctgaatttactctttgtagcatttttcttttcacaaaatccttgagatttccttcacagtcacattatctacaaatctgcaaatagggatggtttcattttttccattacaatctatatgccttttcattctcttttttatttttctcctttattatactggctagaatttccagtactatattgagtaagagtgatgagagtggacatcctttccttgttcatgatcttaacgtgaaaacattcagtcttttaccattaagtgtaccattagctgttagtttttgatacttgttctttatcaagttaaggaaattccttctgtttttgtttttctgagagttatttgtcctgaatattggattttgtcaagtattttttctgcatcttttcatttgtgtgaattttcctttttagttggttaataggatgaatcgtgttgatttttaaatgttgaaccatccttacatactcagaataaactctacttggtcataattctttttacataatgctgaattctatttactaatactttgtgaaatactaatacttcattaagtattagtacttaacatgctaattcatacttttaagtatttttgtttctgtatttctgagaagggtagtagtctgtagttttttttggttttttttttgtactgtctttgttggattttggtatcagggtaatatgaacttgataaaatgaattgggaagtgttctctcctactttttggaggagattgtacaaattgatgttaaaacattaaaaaataatttttagaacatctgttagaattctccagtaaaaccatctggacctggagatttttgtgggggtcaggggcggggggtgaggggagttttaaaattgtgagttcagtttctataaataattatatggctgttcaaataatctatttcatattgagtgaattgtgatggtttatgcttttcaaggaattggtccatttcatctaacttgtcaaatttatacgtgtagagttgtttgtagtattcccttattatcctttggtatctgcagggtcaatagaaataacccctgtattattcctgctattggtagtttgtgtctcaatctttagaggctgtccattttattaatcttatcaaagaaccagctcttttttttacattttaggttcaggggtacatatacaggtttgttacagaggtgaattgtgtgtcatgggggtttggtgtatttaagcatagtgtatttaagtgtattaagtgtatttaagtgtattaagcgtatttaagtgtattaagcatagtgtatttaaccaatagatagtttttcagtcctcaccctcttccctccctccagtcttaggtagtttctggtgtctgttattcccttctttgtgtccatatgtcctctgtgtttagttacaagtgagaactaataaggttttctgtcctgtgttagttcacttaaaataatgcctgttttaaattttattaatttctgctctttattattttattccttcttgctttgggtttattgtgctctttttgttgagtcttgaggtagaagcttaaataatcaatttatttctctcttttttaatgtaaacagttagtgctataagttttcctcttagcactgcttttgctgtgccgctctattgtttccaaactgtttctttgctatttttacttccctgtgtcattagcaaaactaaactccaggaaagcagggaaaggtacttgctttttgcttttcccagtatatagcatagtgctgtgtatttgaaaataatttttgagctttaaaacttagatctcagcttggcagcttacatctgcttataaccaggaactggaagaaacacaatacaaatattccctaaaattagaagaaaactatagagggtttattgcaagtaaaattctacttaataaatttatttttgtttgttgaaaagcatatggaaaacactgtatgggttaagtctttagcagtgtgttttttgtgtttaagaatttatatagagaaacatttgagttttttaatggcaaaattaaagagcagaggcatgaatatttagtctgaaaccagttccaatctctcagcaaacattaacatcctcccagtccattcttagagcccgtggacttttcaatatcttatttgcacctcaagatttataaatagagcaaaagcggtttcttgttggacctactgatgacataaccttttaagtattccatttaaagataattttagagagaaagggaaaggatatggaaagttaatagacagctataggtgcgagagtggtgtgtggaaaaactagtgaactttaaatgaaatgggggtgaaaattccaatttaccatgttggctggctggtttgggtccatttaattaacctgtctcatactcagtttcttcatctgtaatatgaaagggatactgctatcgagttttcaggttgctgtgagcatcagaaaaaaacataaaaatttctaacatggtacctcacatgtactatatttgtaaatgtaaggtgtgtgactgtaagatttatatcactttcataaggaaaatcttttgggaaaatataaagatgtatcaaaaattattttaatatggttagaagagggaatatattttgaatacataaatgcagcaaatgaatgccataatccagagcaaaattagaagtacctgattgtcaccttggcaaaatgtggtataaagtgttaaaatttaaaaaaaaaaataactagaatttcagggctttattgtgaattacactcactgacttcccgaaagcctgaaaggaagaagacgtgcgctcatggtaaagggcattaaaatcttggtgaaagaatattcttgaactggtggagtggctgaaaaccaagcataagagaagaggttaaaggctgtatcctcagaattctctggcacccatgtaagaagaccatggagtaatatttacaaagttcttagggagaagaaagtttgtgcaatagcagacattctgaagcctgcaagaatttcagatgtggcaccgattagcgccattaaaaaaaactgcttgctgaaacccagctaacaaaaacatgatattaatgaaaaactcaaatttagaggagttgtgattaaaaaggactcttgttgagcatggaatctagtttaatgtagatccaggattaagcagtcatggaattacagttcataattcatataatgtaaactatgtacatttttaccaaataaaagcagttaacaaaaattggttgtggcagagggagtgtgtgtgtatgtatatgtgtatatatatatttgtacatgtgtgtatccatgctgatttccacatttcacagcaagaaatcaatagatagtgcctaaaattgagcttatttaatgagccctccaactcctttctgtttttttgtaaacttttcttaatttttagagggatcctttagaggatgggggtcatattacagatgtctaggtgacattcagattttttagattcctttatttcctataaattcaaataaatctaatatgttaattctttaaaaacgagatgactaatataattcccattctgtaaaactgtagggttatggtttgaatatttgtcccctctaaaactcatgttgaaatttaattcccagtttggcaatattaacaaggcctttaaggaagtgattggtttatgagacagacctctgccctcatgaatggtttaatccattaatgggttaataacttaatgggttatcatgggaagggaactgttttggctttataaagaaagggaaggccgggcgcggtggctcacgcctgtaatcccagcactttgggaggccgaggcgggcggatcacgaggtcgggagatcgagaccatcccggctaaaacggtgaaaccccgtctctactaaaaacacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaaaaagggaagaggaacaaacctaagctaacacgttagcatgcgtatccctcatgccatgtgatgctctgtgccacctcaagactcttcagaggagagtcctcaacagcaagaaggctcttaccagatgtgccccctttggccttggactttctagcctccgtaactgtaagaaataaatgctttctctttataaattacccagtttcagttgttctgttataaataccagaaaatggactaagacataatagcaaagtggttaagagtctgaattcctgattcagattgctagtgtgactctctgtgtctgaattcatctgtaaatgggaatactagtccgtactttatagtttgcagatgctcttagtacagggttcaaatgttaactgtaattacctctcctatttttgttattgctagagagaaacctgtaatgataatcacaaaatattaataattgttgtttctgggtagtaggacttgtgatgatttcttccttctaaatccttttttaacaatgaatagcataaagctgtccctttaaaaataaaattaaaatataaattttagttgtcccgggagttcttttgtatctgaaacctcagttgtcaagcttggaaatctgtacttttaaaatatcctcaagcgattctgattacacatcaggtttggaagcacttggcataaagaacttcccccacccaattcaaagaaatagtatttaagccctcataatgtgcagtgtggttaagctgtgtctttttccagtctagtctacctcaacactcttgtggacatgatttttgccaaaaatctgagtgagctttgggatgcattctacccccatgagatggctattttatcccaggagcaggaaaaaaaaaaatgggagtttacagttatttagtcataaggccggagtcctttaaattggaagggaatgtggtaaacacaacacaagaggagccaacacattctgagtgtgctgatactctgggggagaagagtaagagagtatgacaggcatcagacagcatcacaaaacattttaaagttaaaaacaattacgtaacaccaagaagtcagttttccttacattcactccaggatagatgccttgcttaaaaagtgcctcttcagctaagaaaaactgtgtccataagtacttcagtagctttccacaaacagtaactgtttttgtgttatagaagtaggcttgttctgaagctcagcatgtccttggaatatgattgagtagcatgttagtattcatagttgatggagctgggttagcacttctttaacttcagatatccatatgatgatagaaataggaattttctctggtcctgcagtccttcctcttctcagtcacagtgctttctgcctaagtggtactgaatggcattgtgactactgctttcttctccagtgccaggagcggtagactctgcagcagtaaaatactgtctttgttcttttctgagatggtgaagtggctgtgtatggtattaaggcaaaatcacagctaggacaaaaagcaatggaaaaccaagatcagtgtgctgtaaggcaaagtgttagtgagagaatcagaggatgtagagagtgacaactcagtatctgctaatgctccaggttcactgcttcaatcgtattctgcttgtcttcctccataagaaattaagagttaaaacatctttcatttacttctcttggcttcatgttttcaattcatggtactttcatatcacatacctctattgtagattgtcttgatcatgtatactgctaaaggaaggacttgtataatatcgaacagatacttgactaatcagttctctctggctgtttgaatgaaatttcaaaccaagatttctggttagagcaaggtctaatgaactggtcctcagacaatcgagatatttagaatttcagaacaatcacttaagacaggagggatatgttttattgtatcttttggatataaagattacactaacggccaacctgaatgagggaaagggggcagtagggaggcagaatttgagaccccctcatcagagaaaacagcagaaagacatggtaaacttgtttctggttttcctgtggcaaatttgattgggtgtagagagaaggatcgttgagtggggctatgtactcatcatccatgaaggcctacctttctgaacttgaaggtacagtcaggatagagcaaaaggtgtaaacatgtatctgatagtttcagatggttaatttacatctcaagatactgggcagctttgcttatactgtgctgttccttcacctctcctcttcctcttagggtttttcttcccaaactggaattacaattcaggagagagcctgaaatataagatatataatgcagcataagcatggtgtgttgtcatggcatgtcaattttacttgtagattttgggatatttttatatcaaatatgaatatattaagtatgtacttaatgggataaagacacatgaatgggtttttgtatacactttttactgaaataaatgttaatacagaaaagtatgtaaaatcataaatgtagagcttaatgaatgtcacagagaacaagccatgtaactactagttttttttgtggtatcaataagctttcctttaattactgtttgtatggtatatttttctattattttgctttcaactttataaatctatttaatatgtgtctcttgtaagctgcatgtagatgagtttatttttctcgagtctggctggcaatctttattttttaattgtagtttttagtctatttgcttttaatataatcattgatatgtttggttctaaatcaaccaccttactatttattttctatttgtctcatctattctatattccctttttttttttttttttaacattgccttgatttggggtattttcccatttcatttttttgtatttgaatttaattatattgttttactgtttgtttgtttaaagattatattagacatccttggtcttttaaaggctattattaatcagttttttttttttaaacaactcctggacagtgaaatgactttagagctcttaaactctatggatcctccttatactttttgatgccagttttgtaatttgttttaatggtaataatactaatatcttgtgagactttcaaaaaatgttttattatagccaatatttatttggatttacttacatacataccctttttatgactctcccttccttcctacatctctgaatttttatctgaaattcttttccttctgcctgaagaattagaaatagaactgttagtgataaattcacttaggttttgtttttctgaacatgtttttaaggctcattcttgaaggacatttttgctggatacagaatgctaggttggtagttctgttcttttagcactttaaaaatagttcactgcagtcttgattctgttgttgctgctaaaaagtcagctgtcaatcttattacacctttgaagtttttttttctgtccttggttttcagtagtttgactgatgtacttaggtaacattttctttttctttgtaatcttcattgggttttgtagatttttaatgtgagggttggtactgtgtcagtttcggaaaatattcagtcattatttctttaaataccacttctcctgagttatgtctcttccctcaaaggttccagttaacacttacattagaccctttcactttattctgtttttttgctcaattctttttcaatccatttgtttttccatacttcattctgcgtattttcttctgacctagctttttaggttattaatttttttcttcagctgtgactattctatgcctaatttcttaatcttgccatttaatttcttgactttattaagaatagttatttctaagctaaaaatatgaaaatcttatttgagtcttttggctctgtttctattgtctacttttttgtgtttagccgtaattttcatcttgatgcctggttgttttggacattgtgtatcaaaattttgtccatgttgtataccaaaaaaaaaaaagtcgtcatgataatttgaggttcttcatgattttatatttctccaggagaatatttttacagttaggctagggcggatcatccagtcagtggctgagatgactctaacgtagacttcagccgttgtaaagattggtctatttttgttttgttcttattctcagattgtagcctttcagagtccttgataagagcataggtgtttttcaggacctcttctcctaagcagactttggacattaatttttgcttagctttattgcccttgctgttttctctttcagaatcagtcattgtcttgaggatagagcagtgccagatgtctggtctgcctctttccttccttcttccagattttggccctactaattctcactgccttgatatcttaccagtgtcttcaaacacatatttatatttttttacattttgttcagtttttctgattgcacttggttgtactaaaagaacctagtcagccattccagaaatacatgaagttgttttgtttttattattgtagtggtgattgttggtttgtacttttgctttcacaaactatttcaaagcaattttgatttttagggttatatttcccagacctctactttcactgcccattgccctctgctgttagtggtgattaggtgaagagtttgagaaatgtaatggaaagggcgtgggttttttttttttgtttttttttttttgagacagagtcttgctctgtcacccaggctgtaatacagtggcatgatctcggtcctgcagtcctgcctcccaggttctagtgattcttttgcctcagtctcccaggtagctgggattacaggcacgtaccacaacgcctggctaatttttgtatttttagtagagatggggtttcaccatgttggccaggctggtcttgaactcctgacctcaggtgatccacccgccttggcctcccaaagtgctaggattacaggcgtgagccaccacgcccagccgggcatgggctttttaagcacacagacctacattcaaactgtggctccttctgattgtgtcagcctatatgaattaattacctgtttaaaattacctttttaaaatttctctttcctcatctgcagacgggtttagtgagaatgaaaaaggacattgaaattaaattttatttaaaatgaaataatgtatggacagcttctggtatataataaatgcttagtaaacttatttttttaattatcttgaggaataggaaactagagttaagaccaatcttttaaggaatttaatagaagtttataacttcaccatatagtaattgttaacaaaagcttaaaaagggcgtttatgtcaatgtttggttgtggggcagttcaacaggcatctgtgtcccaggtaccctacttaatctcgttaatattatagattccatccaaaatctagatcttgcagtatagagcagaggtcagcaaactttttcttttttttttctgagatagtttcactcttttgcccaggctggagttgagtggtgcagtcttggcacactgcaacctccgccttctgagttcaagtgattctcccaccttattcttaccaattcttcccaagtattcaccttattcttcccaagtagctgtgactgcaggcatatgccaccatgcccagctaattttttaccatgttgtccaggctggtctcaagctcctgacttcaagtgatccacccgccttggcctcccagagtgctgggattacaggcatgagccactgtgcctagccagcaaactttttctataaagggctaggtacggttttgtgagacatattgcctctattgtagctattcactctgctgttttagggcaaaagtagccgcagtcagtatataaatgaatgggcatgggtgtgttcaaataaaactctatttacaaaaacaggtagcaggccaggtttggtccatgggtcctcaaactgtgctgaccctagtcctccacaagctacaagtgtttttttacgtttataaaggattgtttaagaagaagatgcaacagaaaccacatgagacccaaaaagccaaaaatattttatttctagttctttacagaaagggtttgctaacttttgggttggagaaggggtggtggttgctaccagagaaaaagaagtagacttccgtactcagagttaacagcaaagaaagaaaaacaacacgacaggaagccctggatccacaaaggatcctggtgggaagaataggaaattctgtgtgcaatactgacatactcatccataccccaccccaactgtgactgtcctactaattaatctggttttatggattttccataatgtgctgttttagcagcaaatagaggggtaaactcatagataatagctaaatactgttagaaattaactttccgttatagctaaatgttaccagaatttttactccggttatgtatacagctttgattttataacatcctgctaatttttgttcttacagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaaggtatggtttactttattaagcagtaaacataagcagtattttagtctaaattttgtcatattcctgtctgtatctgttaattaaaatgggctatatattccagatattaaaaataattcttggtttgcctcaagagaagggaattgctaaaactcagatttatttagggaataagatattaattttgaattcgtttttaagtagaaatagttcagaacccatgatttggggaagggcataactattcagatttgatttgtttctgaaaatgtttttctaggttcagttttgttatatgtgtgtctttggtttttgttacttgttttggtcatagcttttgcttaagtcttgttttcctagagaaacttgaggtgtatgtaagtttcgatttatatttttataattagttaatagaactaatcttttttttcctcaagaggcacaaagaacaaggaagttaaaaaccaaggatgcgttctaaagacttcattttctcctagcctcctacctctaaccagattttctcagttgagttatttatgtgtcccttaagtgttggttctctccaagtttctgtcctttagctgtttgtctgtgtgacatcattaacccgcataattttaatttccttctatttcttactgtctttagcccagttccagacattgtgaggtgacattaacacaatgcaaaatacggtttgacagaaaataatataagtagcttgaaaacaattggaattctgggatgcagagggtccactattcagttttttctcttctcttctcagtagtaaattatttcttcaccacctctcaagcagaggttgaatggtgagatttcaaagcctggttccattttatcaactagcaaacataaacatactattacaaagtatgtcgtgttttgtgattgtttatgtaacagtaattcagctctgagcaagtgctctgtgttcctacagaacagtttggtcactgtgtatttgctctgtagcatagccacatgtctttaggtgatcaattggaggcagagttccctactaatagtaagccgtacgaggcctcactgcaggcatgtgtattagatacatacttgtccagctcagtggcctacaaaatgtggggtatgctaaaagtttgtctactcccttcagactcagcatgtgtaaattgagtctccttttccttcctactcctagaagttgctcttcctcctctattctttcttttatatggctcattaccatctgtctgtgccagaaattaagaaatcatggtaggtgcttgccttcacatgctagccaattcgatttgtcagtacattctaacagtgctgctactttaccatttttcatctcttttcctctcagtcctcagtgcatttccgattcaggccttcagctatacccatgtacctgcactcaaccaaacttcaccattccttttggtgaacttataacctattttctgtattatgtctttattttttaatcttcctctttgttctacctaggtccctatctactgctctgtaggatttattagccactattttccttcagcacattgaatcctttgttcatacctctataataacatctcttagtatttagcaattattggtttgtgtgtcaggctcaggctccctgaatggactgaattcctctgcagcaggaaatgtgtcttactcatttttttcatctcctatgccagcccatgcccagtacaaagcaattagtgaatgaaaaattatttatcaagttcagcggtggacaaacctgtcttacctgaatgaaacagattggggattcctgcattcactgttctatccattcaaggtttggtatatttgtatagccaagagattgggctcctcaaggatatgagatgtctatgctttctgactgaaagtagggtgattttgtctgctgttgtccttttggattgtgaatcttgatactcagagggacatgagaatttttattttttattttttttgagatggagtctcgctctgtcacccaggctggactgcagtggtgggatctcggctcactgcaacctccgcctcccgggttcaagcaattctcctgccttagcctcccgagtagctgggattacaggcgcccaccactacgcttggctaattttttgtatcttttttagtagagacagggtttcaccatgttggccaggctggtctcgaactcctgacctcgtgatctacccgcctcagcctcccaaagtgctgggattacaggcctgagccactgtgcccagctgggacatgagaatatttttatgttccacccagcttttcccattattccctctcagttggttaactagtatattatatgcctccattgttaatttctcataggactaagcttctgtaacttgctgtttgaccttaattttaagcatatgcttcgtcaggatactgcccagaacattgctactgaaagtcagttcatagactcattctggtcctataactaaagaatgtctgcttatttgggagtaagcagaaacttttattgtaattggagtaattttgtctgaagctaaaaataaaaatttaggacttgttttatattttagttttatttttcttataattcatttttatcctatttacacagtgtagacctcttttagaaataaaaattggcctttcaccacagatagcttgggaagtactcatctagaatctcatcattgagctcttcctctgtaccggtgctactcaaaatgcggtcctggcctgacactttgtcagctgtttgtctgcacaagataatgaggttacactaggatgtaaatcagttttacgctcactgcttacttaaatggacagttttaagtttcagttttaagctcactgcttagttaagtggacattttgattggttggttctgatagtaggcctttttcaaagtaatgtgttgctttctgttctggtataagctccttatttctttgcaaacctgtagtttaaagagcactgctctagaccatcttggaattcccatgtctaccattgttctcttctgtttttgattggtggatttacattttggaatgaggtatgtgactatcagaaagtaatctcaactcctgtgctttgaccttttaccacctcagggtacttgtagaaattcttaatagtggattattgtgaacttcaaaaatgaactgccacttcagcagcatgtctttcctgctcttcagaaactcgttcagagcagtgagaaatttctgtcagtaatctattaaaaactggctgctttcttttatgaagtgccaagcagagactatttaaggcagcatttagcatgcctatgaagcaccaggagaacttattaaaatgctgattctgagtcagtaggtctgggcctaagattatgcatttctaacaggctcccaggtgatgctgctgcttttaatcagtaaactacagtttgagacgaatttagattataatgtcaactcttactagctccagtgatgtcctagataacactgacatgaaaccaataaatcagagtgtcagttcacattaggatgagtttgctttcctttggctaaatcactaatagagggataaatagggactttgaaattaggacagtgctttcttcagtataatttattaatatttggattttacatctatgtaaataaccttttaaaatgttttgtttaatagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagaggtaagtttagaaattttattactatgtcaatacttggactgactgaattttgttgataaaaacatgttaatatgtgtatgtttctttagtaccaacaacaaggactcttccttagtctttttaaatagagtggcagtataacaaaatagatgagaacagggacatcagcaatcagcagtagtcacttagcaaatagctattgatgctgttatatgccaggcactgagaatgtagaagtaaatcacagccaatttccagttctcgtgaaccttacattctggatgaggagatatacagtaaacaggcagacttgtaaatataaaataggattttagtagtaagtgccctgaagaaaaataagccaagtaaggggatggagagtgacccagagtgggatggagtcctctggtttgggtgattaagaaggcctctcaaagaggtgacttttgagcagaaccctgagtgttattagagagcaagttgggtgaagatctgggtaaagagccttctagtcatcaggaggatttaatggaggttcagaaagacctagagtcaaatcctgctctctcacttaatagccgaacaaccttggatggacaggagccttggatgacatctgagcttcagtttcctcatttgtaagatggacataatgtacctgtcttatttagttgttgtaattacaacatagtacagcccttcacacagtaagcatttaataagccttggctcacattcctgagaattttatctaaagtgcattattttaggaagtattccagtagtacaaatatttcagaatatacattgtacttatcccctgtctttaccaaatattaatctttttgccacatttgtttcagttatttaaagaagaaaatgctatagtattgtttttcagatttttaaataaatatctttctacaacttgcccttttcacacaacattgagatttatcaatgttaattacatgtctgctgtgttcactattataagcattgcttcagtgaataactgaatgagaccaggaatcatggaacctagcttttaggctcagttctgttactaataatgcctttaggcaagtcactagttctctatgccttcttttctgtggacctaacgtataaataatacacttcatgctactactgtcatcttcataaggcaatgctttcaaatcatcatctggaacagtgattctcaacccagggcaattttgcccccagaggacatttggcaaggtctggagacatttttggttgttacagctaggaggctgctactggcatctaatgggtagaaacccactacattataaacctactaaatgctaaacatcctaaaatgcacaggacagcctcctacaacaaagaattactctagcccaaaatgtcagtagtaccatggttcagagaccctggcctagaacatctgacccaagctttaggtaatcagctttaaaaggaaacttttgatagtctgtttttctattttagtgagagtactactttggatgcttttttgatgtaaacttttcttaatatattttgaccattccaagatgacttgatcttttttccttaattctgtatccttttcccatataaaaaatttacccaaattcaagaatataaacatgtagcaaatacatccaaatgcatataagatcttactaagagtatctgatgttggatacacatacagtagtagcaaagggacatcataattggcaaatttgttctttctctagaaatttatcaaattatgttgaagaccataaaacagaattagaattcagagtaccaaaattgacccatcaatctgacattgcctgttctccctcaggagattcttacataaacccaacgtgaaactaaaattctattattatccatctatcatttagtaagttttcttccccctaaatgagtttaaatcttatacatactttttttttctatatactaattactgaaaatacagaaaatttttatctagcaagtcagggtaaaagatattctaattcatgaaagagttacattcctaaatttcttgttcagaactgactcttaagcagttcccttcccactccaccttcttagtaatagacttttcaccagagaagttgcagtgagtcttaatatggtagatttaaaatatatgtgtaattgtttacatatatatctctctacatgaaaaattgacttttctgtaggtcagaaatggtcaaatatgatctactttattcagttttatttacattattctatctgaaacatattagtacataagtgaggtagagagctcctgatttttttaaattgttaactaattattctactaccattttttaactcattactgatttaaaatgtcccccttatcatacactgtaaccttacttatagtaggatctaaatctgggatttcatttctatgccattgttctcatttgattttggcccagcaccatattgttttgaaccttgtagctttacagcagttttaagttactattctaagggcaaattaactcttctttttttctaagtgttttggcaactcatttctttatctttgcatacaaactcattaatttagggacaataacatctttgcccaggattttttgtaagtcaccttttaggtcctttggtcaagttttataaactatttccataggtatgcaatatttttgttactgttctacttgggcttttaaagacttaactttttactgatatatatgaaaacttatttgtttgattttctttttaagcatctttaaaatctggctttgtaactgaattctctatttctgatgattcttcacttgagattcttgagtttttttgggtaaccataattgtctgctagctcttgttttctaataattatagctttttacttttattgtcttttattgcataaatgcttaacagaatcctggccatccagtaaaatataaataaataagagcaatataattaatgcagtaaatcttatcaaaaatattattttacagaatataaaaattgcttccagaggtcagcaatttataactattactggtctagtccttaagtttaatatgcactggacagtatagtagccactaagtatgtgtggttattgagcacttgaaatgtggctagtccaaattgagatatgctgtaaataaaatacacacctaatttcaagaaaggtttcattaatcatcgcaaaactattgcatgttaaaacagtatgatgaactttttcagttaaataaaatgaaatttcacttttttttttttttttttacattttttatgtggctactatatggcttacatatctgttggacagagctagtttagataatcacaagttgacttatctggttatttttcctatttgcttttattctgatatttcctaaaggtgcaagagtaggttgtctaagaatctacatatccagtgtgtgtttcaaaggaaagtttagagataacagcagagaaaacgcagtggacagtttgataatttttacacactgtaagctacatacttccaaacataaattattagatttattaaatattcagtcaatatgaatcttctcttggaacttgccagactatctccctcattctttacaaagatgtcagatggagcctgaagttttgttggagtcacctggatgacaccaacattctccagataccaattctgactctaggttgactgcttaattcatctctttttctgtcttcttaattttcttgctttcttgttcgttgtattgttgttgttttattttaaactttgttctcataccaaccctattaggaatttatgagaattacataactggacaaaggtttaaatctgacctaccttagggccacctgatatgatttttcagtcaataatagctaacatttattgggcatttattttaagcaaagggtaatttacacacattgtctcctttaaataaccaccttttacaaatgtggaaattaaagcttatagagattaaataacttactcaaggtcgtatactagcccacaaaatttgggttcaaacccaagtctaggttgagagctttgtctcaaatactgtactgtttgggttgatacatatatagatgaagtgtattgggttgtagacacctaatgggcaaggctttgtagtcattgaatgccctagaggtatgtttccgagtatgagccacacaaaaaattacagtgagaaaatgaggaagagaaagcagatgttggagaaggagatttctccttgtatagctgctcctttgatttgaagaaatctcagtaattttatccgctaaagagtgtgagagaatattgtttcatttaaaaatactttccacagtttcacttggtttcaccaatttcaattggttttaaatcattaggatgtctaagtaaactattgatttcttccacaggtctagtacattaggttcctctgctttaccttgccatctttaatgtttgtattcttttaaaattagctggtcctttataagtatgtaaatattgtagctagcaatgtgctgtttattaacaatacctgtttccactacttttttagggtcctggttgctgctctgatcttgcagtttcttttcactatgttgattctacaaccatgtatgagttagaatacctcgtttatcatcttcgtccatatggttatttatacagatatcaacctaccttacctgaacgtatactaaaggaaattagtcaagcaaacaaaaatgaagatacaaaagtgaagttaggaaatccttgaaagaaaatcatgaatgaacaaaggtaatatgtctagcactgcactgaaaaaggacttctgcatttctgacatagaacactggaatcccagtgaggaattctaagtgaacattccttatagaaacctttcacatgaatgactataaactgaagctttaaatgagctgtgaagtgtgttaaaatgtgttttgatacagtaatatataaatatgtctatatatatgaggaacttgtgttttttaaatggtggccaggtagaggaactagaaaagagattttgttgcctgttttctgaccatctgtgttattgtcactgagaaactaaaatagtaaatttactaaaactacactgcaccatgttagtaataaacagatctgccttaaagaaaagaaaattttagaaagaaatattgttgctcagtgttgttaatatagctcaagaattgagtttatatttgcagtatgctataaatgatacccccctaccacacccacacacacagtttttgtctaatgaaaatgttgctgtgattatttataattggtagtatttcttccagaagaagctaaaataagactggcacttaccctgaagtgcattaataaaaccacactttaaaattatcatgggccttgactatattatatacttgattctaattagtcatcttttacgcaatctctgttgtctcttttctaaatgtgtttagccactcttgaataccattctccactattaacattaatttactcaaaccgttcatagcattctgtaaacatgtattttacatatttgttcccaaatttgcccattgttcattatgggtaactaataataaatttaatgctgtttcaggatgcttttcttataacagtgccactctcaggaattactaagtgacattttaaattgatattttaaactctttccaactacatagttatggtttatttcattctcatcctgttgggatgagaacttgtttgtgcctttcataacttgtttaaagcagagttttaaaattagtttataggatctgaggtggctattagttacagtggcaagattatttagaaagcaagattttgatgagaattaaaaacaatagaaaatgtagagtgcttaaacaaaaatgttatattttgaaagagtagatacttaatttataaataacagtctgaaggttggtgctattttgggataattgttttgctaatggataattctaacaatgcagaatacctagtcaagactgtcatcaaaaacattcacaaatgtttcattctatttttagtgactctgtttaaagagtttctgaaaggaaagaaattttttatttttattatctttagcagtactgagtgtcatagcagaatattttacagactttctatgagattatttttatggtacaaagtatttacatttccctcatgtttatcattatgccaattttacatggcagtcatgccactgactctgctatttagctaagtaatttcttttttcggagactgtctcactctgtctcccaggctggactgcagtggtgcgattctcctgcctcagcctcccgagtagcggggattacaggcacgcgctgccacgccccgccagttttcatatttttagtagagacagggttttgccgtgttggccaggctggtcttgaactcctgacctcaggtgatccacccaccttggcatcccaaagtgctgggattacgagcgtgagtcacagcacccggctaagtaatttctatttattgtgccaaaacatgtcaaaatcatgacctctttgaatggtatatttgagaggatgttcatttcattggttaaccatggactactctgtccacgtagtgaaaacatgcaccagtttttacctattatcatggtagtatcatctgccaaaatttcaaggcattcattttattctttgaacaactcttcaccatggtgtggacatgaattttcatatgtgttacttgactagaagtataaatggtttactatagatatccaaaaaccttgagatttgctcataggaaatgaatattgtgatgaatcctgggctctagagtcagacttgcttgggtttaaattcttgctctaacacttactgtttttgtaaccttgagcaattttaatctctctgtgtctcaatttcctcatcttttaattagggatgataatactacctacctcacaggatttttatgaggattaaataaatgtaaggtttttagaacattgatagggagcaataaatagaagattgtattattattctgttaccttggagtgtaagtactgcatttaagtgaatgaaaaatttgctttgaccagatactgaaggaaataagtaatagctagtatttatccaatgccaactgtatgctaggtactgtgcttagataatctgtgtataatagtgttaatcctcaaaatttgggtgttatacccctattatagataaggaaactgaggctcagagacaaagtaactttgtcactgtcacaaagctagtaagtaacagaggtaggatttatattcaaaaccctgtgtgttcattggaaccgtatcaggcttggggctattcatgtagcattatttccatttttatgtatatgatatatgacgtctgatgcattggccagtaatagtcaaattaacccagccaaattgtcacagtgattcttaaactgtggttctcacacttgcccaggatgttgttaaatgcagatctgaagaccccaatctcagaaattcaaatttaagcatggggcccaagagtatgcattcttaccagataccttgggcagtgactgtcaaaagtctggtcccaacaaacagcattaacgtcacctgggaacttgttggaaatgcagcctctctcggggcctcatctcagatcagatctactaaatcagatactctaggggcaggggcaggggcaggggctagcagttgtgtttaagcaaactctgcaggtgtctttcttatcctagtttgagaaccaatacccaacaacctacgtgattttggtgcaagtagtgtttgaaacacactgaagattactgcccaattactaagacatttttcaaaaagcatgttttaaatcagtgtagtccaggatcacactatattaaatataaagataacttaaaggatcattggatcattcattttggccaaatttttagcttctccaaagtgactaacatcagggcctacaataaaatctgtaattctccaagtttagtaattttatattgaggcaggaagggctcattaagtactaataagtacataatttattaaaaacatacataagtgtcatcaaaaaggtccacaattgttagtaaaaaaaattaaattgaagtagtaaatgctgttttataacatacatttttctgctaattcattctgttttgtgtgacctaataaagcaaaagaaaaataaaaaagcaattctccaagtacttcatagagcacataaaaccagatttcatgatgatgatgtattcactatcttttagattaagatctttgttatttggtaaatgatttcagtatggttttaaaacataaggcttttgatgtcttatgttctctaataatggtatgcttgtattttctagtgggaagttcatagataaagcagatttttgtcccagtttgctttcaaatataaatttcagagggctttttcttactgtaatgaggtatgaaaataaatcattgatcagctcttaatattttttgaatacagaattggatttgagcagtaaatttgctaactggttattttcacaattttcttgaatattaatttttcacttctttgagactgtcaaactatagttactaccaggttgatgcactgtacttgaaagaatcccttgattaaattacatctagcattttatttgccatttcaattttcagttcattagactataattctttgacagtttctgcctggtgtttattgcccttctttgtttgctttattactaacttccattttctagttactcttaaatgctgccttcacaaggttaatttggctgttaatagtgattagaatttttatcacttaattgataattttaagcctactaactagggttccctatgaaattgaaagtaaaagtctaagaataatgcctgctggctctcgagatacttgccctacttaaaaatctataatttaaaattaattctatgtctacaattattaaaggaagtaaagttatttgggttcttccactcacccttttctcaaaaacaacaacaaaaaacaaaactcattttatttttctactttatagtaggcctgacagaaacatagtgaagcaatctgggaggcaacctgtggtagattttatgctaaatgttaatgtaacctctgttgattttttaaaaatgtgtttatatataagatttgaaataaaaactttaatacaggctagaataaggaattttacaaattctctttagagcaaccaacattaaagttttagagttgaattttgctctatttcaactcccttacctctctagttttcagtttatattaagttttaataactttgcggggccctgcaaattaataatctacatgaagtatattattagagggaaactaatcttactgctaagcagtgtgttgtactacatagtgaatgttcgtgttttggaatttaaaaattatttaaggtaatggtgttacgaatggtttaaaaatgtctggtgacttgcttatttttaagtgatcaccattaagtcagaaaaatgtatttttaaatgtttcttgaagtgccttttgaacatttttaaacagcggatttaaataatgcataaaataaattgccatgttcaaagttgtttcatctgattatttttaaccaatataaaagttgtgagataaatgttgtcttttatgggtagtttggggttatttttccaaaagtttaaaattgttttcccatcaaagctatttagtttgaattggctttcataagttttactgcaatatatgtattatttactttaaagcaacaaaatattccacctctgactgagaataatatactgtaaaaaaattagaaacactgtagtctaggtaagtgtgtctagatgggtgggggtggaagaggggagagaatctcatatatttagagagagattgcttctgtgctccttggtatattttgatctatctcatacactgagaaattagtttattcaacaaatacttatgccaggcatctgctagaaatacagtggtgagcaagacatacaggatgtcttaattctagagttagaaaataagctagtagatgaataaacaaagtatttcatagagtggtattaggaaaataaaaatattatcagaacaattttctggatggggtattaaggaagactaggaagtaacatttgagcagagacttgaatgttgaataacagacattttatatacttcagaagttacttttatctatgaaattatttgctccaactatgtgttaaaaaaaaaaaaactttccacccttgcttaatcatgctgtaggtgtaagtgaaggcttactgaaatgtacactataggctaaaaaactttgtgtttttaggcatacttcatccagagctcaggtgtattgatagatttgtctgggagtttcagaatatgaataaaaatagacctagtattttatctctttctgggcaaacagttacaaattccataaggcccttgagtctagcctatatgtcttgatttttcagtaatctgctacccagtatgttattagcatgtgtgtgtgcacacgcaagcatgcatacacactgttatttggattagacagctttagaaaagctgaggagataaataccacttcatactactttagtagtagagttgtataatttaacatattcagacagctaaatattttccaaccagctgtactgataattgttaagtcattggaaagtagatatatttacctaaatatatacaattaaacctattttaagttttccaaaggtatgacttcatagtactggaaagcatacaagaagattcttgctgaatttatctccttgttaaagggaagtactctacagagctcaacatagtggtcgtcttaaagtctaataatgctgacaatatggattgttcaagggaaatttttttagtggttaagaatgaactaacatttaactactaaagttgaatgagttcagcaacattggcattctccagatgcatctgtattagtaaaacagaagtgaactttgttttgccatgagtttattactaattaacgcattttgtattgctgcctagaacttaaaactgtctctgtgttgcatttcttctacaaaatgtgctagtgtttcttgtattattatcaatattgcttttctccaggactgaaaatttgtccagggcattatatactttcttatatattgcccctgtatagtgcaggttaatacaacagcttactttgaaataacaaaatactcatattttaaaaaatgagattcaatcctagaacttaggctctttggcttttctaatgaatgcctagtgaaagattaacagtacttcatttctagaactgccgaatgatgtgctatcgtagaactaatttgggtacagtgtcttcatttttacaactaatcagtttttgactttcataagcttcaattttttttcatagaactacctaaactgcattgtctccccttctatacctctaacagttcattcttattaattttcttgtctaattgttagattgtggaaaggtggtgataaaatccagaacataggtttggaagagaagtaatatgcaacttttcctttagttctacacatgactctcttccttgtttttatactttttggtggggtgtgggtaggtgagtgtgggtatgtatatgtcagagacaaagaaaaaggatggttatgattatattttaataactggatttttaatgtaattgaagtattaaaaccactgcattttcatgttgattaggtttatataataagtggtttatttgatgaagtgaaggtaactatgtgtttagaataattggccacagatataattcctgatttttaaagtaatttttacaaacctacttgcctgacggaatttctctcttttttggcctttgaatttatagctcttggaaccttctcctactcatctctcattccatgtttttttcttttaccctttctttttcttctgattggcagcagcaagtctttagtttcttaagactttttattgcccccattctttttttttttttttaagtagggacagggtcatattgtgttgcccaggctggtctttaaacagtttggcctcccagagtgttgggattatatgcatgagccaccatgcccggctgcctctattttctatcaaaatggatgtgtttaagactttttaaaaaattgtgtatcttttgtgaacctcagttccctctcaccagcctagaagttgctgaaagaaagaagagatagcactcaaagaatcgatgcccacattatcctgcagtttcctctttcttaaggaaatgtttccttctagaacctactcagtgaaaatatgggtgcttaaatacctgaaaaccagtggggagaaaaacttaatctttatagataaaagatttcagtgttcagtattaaggcagtcctctctcacatcttaaaaatggtcactatgacctgttgaataaaatgaatataacctcagattatgtgaccttccacagcctgacctagcatgtattccctttttaaaaaattgctattccttacctaaacgccagacaatttagctccaaatcatttaaccaacatttgagtgcctactaaaagtattgagctagataatagggataaagtggcaaattatatttgttgctgtcaaggaactcaccttctattagaagcaaagtacccaaaaaagtagttgtgtgcagtagagttatactctcaggcagtgtgctaattgttttacattgcattatcccatgtaattcttactacaatcctggtggatggattatactatccactgtttcaggcttctactggggatcttggtatgtatccccccgtggttaagggggaactactgtattttgttaacctccagcactttacacaaaaggggaactgaaagtaccagatgctacatagaagaaagaatggagtgtgtgaagcaagagactcttctcgaaaggggccaatttaaatcatttcatttccatatgcagccataaccatgtaaaaacttccatccacatcattcaatggcttttatactcttaattcatattgctaagaaaacttctggcttattcttcttgttaaagtttatgaagtgtcctgatatggaggggggaaaatgccatttctatgacataagcccattaacccacccaagttgtcagaatcaagaggaggtgtttgagaaattgtttcctctttttaaacatttaacatttttcttttgtgttagtttttcttcaaaacgtacaaaaaagtacgcatcattgtatcttgtgtatttactaccagcttttactagataagtcatctttccattgaaaaagtgataagctccattattttaaaaaaaacttaaacattcattgcagatgaccatttcaaagatgaaaatttttaaaggaccccaaaccccaccaccccccaaagtaattccaattaatgcataaatataaattggataggaagctaaatagatagaaatggttttattaaagtgagatcgtgtaacaaatgctaattttaacattataatttcaaaaaaatacagttgctcttgatgtggccaaaatctgcaaattgtcctgggggcagggagaggggaatgtcatcttagcagcaacaaaattgagtgatttctttgggagggggagatggagagaggaagaacggactggacttaggcttctctgtagcaacattcagtgctaaagcagagtgaagcaaactctaccagattcttgggggaggaagaagccaagtgatttcaaatggaagggtaaattgaaagagtgagggtggacacttcttgaaaaatctagatgatgaagcccatctaaagagataaatggacaaacattgagaacaggactggtggtggttaattatttaactatgtagctatagaattatttaaataaggctatggaagcatattgaaatgttataaatcttgatatagaaaagatgattaacaagttagaaaatagaatatcaaagacgaggtaatatatacatgccctaattggttttacttttcagaatagaaattttgtaaaattgataatatatcaagaaatagggatgtaatattctgaatagttatgaaggtaatcaccaaaactgtaagcctgataactattaaaatgaaaacacaaaattaaagataacacaggccatataagagagctaaagggagaatttacaatagatgacagaattaagaccaaacatagatatgatgtcaaataaggaaaaatatgatttaacttataaatgtatgaatatacaaaaactgttggcagtacctttggggaagggtactaggattggaaagaaattcaataattcactgttttcctttttgaacttttaaaaaatcatgtttatactgtcacagtttagagaagtaaagtgggaaaaaaaagctgttggccctggctccctagggtttttacaaccagtggtgaagaatgtccacagacattcttaagcagcagtagaggtaagcaggtacacacatgagctggaaagatctcaaagctgatttggattcttttatcttgccataagaaattactttcttcaatcaagggtataaagactgctgaactagttcataatgagggtagatgaaggaggtatccatcttcaagagtggtaaatagttgacccatacaaaggaccagcagcctcatgtggacccgtcttagcatccttctctccttctactccaagggtgaagagtactcggaagttactatttattctcaaatccttgtgtcagattattttcatatctttcttagatctgttctggcttaagtcttattctcttattcatggaaatagaagacactgagccctttcccacataaaaatataggactactgatttctagagcttaaagatgttctaacgcctcgtttgaaagattcagaaacagatctagagatgttaaagtttagaaaaatgacacaaataatgccagaagtggcaacagaactcaattttcctgactcccaggttagtggtctttgtactaaatgcaatttcttatcttccctgaacaacctgagctatgtactttaacaaaattttttgtgggtacatagtaggtgtacgtatttatagggttcatgagacactttgatacagccatgcaacaagtaataatcacatcatagaaaatggagtatccatcccctcaaatatttatcctttgtgttacaaacaatccaattatactcttttagttatttttaaatacacaattaaattattgactatagtcaccctattgtgctatcaaatactagatcttattcattctttctgtttttctttgacccattgtactgctagatagaactcacatatttggtccctgccttttcccaccatttgcaaatagattctaggaacgatcctaatagttgccaggcactgttatcagagatcaaatctgtcttgtttccaattgtgcctgggacataataggatttttttttttaaataacaaagccatgtgtagtgctgcatgcctgttgtcctagctacccagaaggctgaagctcaggagttcaagtccaccctgggcaacaagactccatctccacaacaaaaaagtttaaaaaggttactatacgattactatacattgtatgtatcaaaatattactctctcccccataaatatgtacattatatatcaattaaaaggaagtaaatggtgagcatcctttcactatgaagaaaagttctccatatgccccctactttcttctgtttcatttttatggagacctctaaacaaaatgcttttctcatagatatggagggactcctaaacaggttttctgcttgagaaaatcttgatttgaactccacgtatcatacaccatcaggcaaaaaacctcgcatttacgttggagaatacagtccagaaaaagaacaaaacctcaagtgtgggcagaagattgtgtgtatttgctattagggaggagagctcaggttccttttctctacagtgaccattagacattccaaagcactgtcacttggtgtagctcagtgctcttggttactgaagcaacaagtgatctctgatgacaaaacaaaggtagggtcgtgcctaacactggtaaggagaaaactgtgtcgagttagttaataattaatttacatgtcaagttacaagttttctatcctaaaatccaaaaaaagcaacagctcttttttttcctccagtcattaaatcacccattcaacaaactttcaccaggctcatggtttgtcagctatagaagagaaaggagggcgaaacctgtggttaaggcttgcctgaaggatctcacatttgggttgggggctgacatgccagtgaacaaatagcctcctcaggactatgatagaggtatttacaaagaactataagaggactgtatattaagtgtttagggatctgagaagtttcaaagaaattgtggcatttgaactggatttaaagaataaggctcaggtacaacttcatgtgaaagagtcgatatattcacaaatttgccaaagcccagttaacttcaattcttcgagagttccagttttttcccaggtgcagtcagtgtaccatttttttctgagacccacagccattttctttcattggcatgtttttaggtttatttttcaataactccagtacccctgaaatttccttccttagatcttgaataaatatattcaagttgggcattactgcatggtttgaggataatgtctttcctgttaaaaatatttttaagtttttatacaaaggtaatgtatgtgcttggtaaaagagaatgaatataaaatgaaaagctataatctgctacagccccacccagcagtccctttgtccagccataaacagaaaataacagaactgtactcatttccaaactaaacacatcattctgctccttgccttttctgcttactgtttaataacttagagataattctttttaatagttaactagatctctgtatggatgtgccacaatttttaagccattcctctattgataattgagttggatacttttattataattattgctgcactgaacatccttgaaatgattgtgtgggtacagccataggataagttcctagcaagtaattgctgagataaagaatgtatgcatttaaatattcatagatactgccaaattgccttcttaaactgtactgtactaccttatactactactcaacatttgcgagtatattttcctgccccttttaccaaagtttttgattattgaacttactagttttatcactgcattaatatctgataattgttgatttgtacttaaggtttgagttttttttatacattggtaatttgcatttcatcttcgccagtttttaatattgaattactagggtttttaaaaatttttataaactctctgaatattggtttatttatatgtattagaactgttatgattatttcgtacttgttttttccccacacaaaccaattaatcttttcttagggctattgaattgtgtgtcttgctcacaccaaggtttatttataatatgcttatgttttcctcttactttcatagtttcattttttgtgtttatatttttgatccctccagaatttattttcttatatggagtgaggtaggaaaatggctacccgtttgttgtaatacactttatttgacgatcctttctttcaacatttattttaaatcaccattaccccatgatatttcattatcggtttgtgtataaactgtattctggtctgcttatctgcctatttcttgtgcagtacattgttttaatgatttcagattcataacacttaataactgacagaatgaattacctacttaaacatttcgtacagacactgtggtggattctgctacatatcatggcattatgccatgaatgctttccagcattactggcagaaatagccacccttaaaatatgcccctcgtgatcctcagcggttcccagggtacagtgtaatgtgtacccagaaatgggttgccctcttgcccattcctgggctgcctcctagggacagtgactccagttaacttgctgcttcagtgggcactaccatcttctgctggtgacttctgtcatcttgtttgaccctggggaaaagacttattttcctctttgttgcccacagtagagaccagactttcctgaccgttccagaataatgaaagaaagggtccagatagtactttatgagagcggccaagctccagtggaatcctctccacccttaccaggctactgctctgccctctttgctacctgtttccaggtcaccaaaggtagttcagctaccccactagaaaccttcagttatcagcacttctttagaattggagccaaattgacatctgcactaaaagaaatgaggaaggtttccactcacctaacactctggacaccctcctcccaaaattcctgctgaaccaacctctcccctgggaaactggcagtgaaaacatttagtcttttcagaggaaattacacctttactcagagaaacgtggtctggattttggatctgcagccccagtaagagaattgcctaatgatctggtatcagttagtacaatcaggcccttcatatctgtgggttccacatccatgaattcagccaatcgtggatcaaaaatattcaataaaaaataatatgacaaaaatataaacaatacagtataactgttatttccatagcattcgtattaggtattatagagatgatttaaagtatgcaagaggataagcataggttatatgcaaatactataccattttatataagagatttaaacatccatgggttttggtatcagagggggtcctggaaccagtaccccaaggatactgagggacgactgtctatttcgcagtctgtattgtttttacaagtggggcagcaacaaccaaacccaaatgaggccgcatcaggctcagccctgttcctattttgtctccctgcactaagggtttcaagcatgtcttagggctgtggtcagcttgttaacacaaatcagccttgaaacctaacagaatgttactttacaatttcctgttactatgttcctttttaaagtaagctacttccaaatcgatcttcatccttttcaaaataccaaatttcggaaatggaagggggaaaggaatgggggaaatacaaagtgaaatcacctgtattttcttagggaccctaacttagacatgaccagctatttctgagattcttaagtaaactgttttttctctctgaaagtctgacagtctctgccatgtcaagctctttatttcatgtcttatacttagacccactcaggctacttggacaaatgctcaaataagttgaccaaatgaaaaacgtgttcagaggttgagtgactcagagtgagaacaagtgaagcagaactgagtggtggaacttaacctgcgcctgaagttttgaaacacatcaagtctagtcttctgtattttaataatatacagacttagagggtggaaagagataaagtgttatgtgctcataaaatcaatttataagtgacctcatagggtcaatcacctcaagataatataaattcatgatttaatatattaatgtaacctttgctatgtattaatcagtataaatttataattcagtagtctacaaatcctaaacttagagaatattttctgaatttgctctttgattactccacgtctctgcatagaattttctgacactcactcatcaggatgtgtttataaagggttttctttcttcctcttcacatttaaatgatatagaattacccaaacttcctgttgctactgaaactgaagcaagagaagcaagggaaattgaaactgaaaatgtgaaccagcgactttacccagaagcacagttgatggcatcaatgagatcaattttttaatgaaattaaagaaagtagaggtttcagctgacactgtttttctccagactctctactatgcggcaggatggtagttgtttcctctcaacggagctaaaaattaacttcatcctatggcatgatgtattaaaatcaggagtgtttggcccggcgtggtggctcacgcgtgtaatcccagcactttgggaggccgaggtgggcggctcacgaggtcaggatatcacgaccatcctggctaacacggtgaaaccccgtctctactaagaatacaaaaaaaaaaaaaaaaaattagccgggcgcggtggcgggcgcctgtagtcccagctactcaggaggctgaaggaggagaatgctgcgaacctgggaggcggagcttgcagtgagccgagatcgcgcgactgtgctccaacctgggcgacagagcgagactccgtctcaaaaaaaaaaataaataaaataaaatcaggagtgttgatggtaactttctctttcccctctccaacaggtaatttctctcaagatccaacccaagctattctatatacacaaggtcagcaaacatttgattcattttgtcagctttaatataaatcaaaatcacacccaggaggctggggtgtggtcaaacagacatcaaatcccctattgccctaatagccagtcagtcacccccctctttcatgtgggaaagaacaccggaagcaatttgacaagtaacaatcaggcttctggagccatggacaattgctgttaactcttgactgttctgacaacattttagagctatctttcaggaatattagcctcccccattaacaaaacggggaaaagctcattcctcaaggacctcactcttcatttagttcaacagtttggatggagaagggagatgtatcttgagggaacacaagtacattgatcccattttctacctcactacattgcttgcaggaagaggcctgcaacttggttcacccctttttttttctgctttagtattttagttgggtcaaagtaactaaagagttacttacttaaattgcatattgcgatccccataatttccactgggtaaaatttagctatacactgaagcttgctgtaaacatgcaagcaagttgggagaaaatattaccattagagaagtggaaaaagaccggcccccttctccatcatcaccaatcaggtgttgagtgaaatctcccgcttactataacatattactctcacagagaataaacaccgtatctttcagtaaggatctctgacctgtcattgtgaagggaggactagccagactgagggtgtggtgaggaactaggggaagcacagacagaagaaactgctttgagaggagaagcaactttgaagtgttgcttagtccaggccctgacctagggtttggtttttttgaagtctgtcattaacccttccctcactttccttctactcttcaagtcctattacattcataggaatgactgatttgcccccaggtattttgctggtcctgggatcgcagagaggaaaagatacaatcctgcccgcaggaactcagtgtatagagatggcttctccaacttaactattacagagggctgataatacttttcagacatgtcgatccaaaatgaccaattaaggataaggacttggaagtaaagaacataactcaaagacaacaaatgcccattcaccaaagataaagccatgaactgtccagggcaaacgagctcgccttttggaggctaagcttcttgtgggaatttgtagagtttgggggaggtcactcagtaacttctgtaatgaaaagttttgtggcagccaagtgcagtggctcacgcctgtaatcccagcactttgggaagccgaggcgggtggatcccttgagcccaggggtttgagaccagcctgggcaatatgatgaaacctcatttctactagaaatacaaaaattagccaggcgtgttggcacacagctataatcccagctacttgagtggctgaggcatgagaatcagttgagcctgggaggtggagatcgcagtgagccaagatcgtgccactgcaccgcagcctgggcaacagagcgagactcttgtctcaaaaaaaataaagaagttttattggtagtatttgttctctgttaagcccatctgttgagttcttgatttcatttatcaagtttttcaattctagaatttccatttggttattttttatatttccaggtctctgccaatgtcctcaatcttaatttttatttccttaaacattttaagcaaatcattatagaatccatgttggatagtcacattatcaagatcccctattggtctaggtctattgtctgttatttttttggtattcagttacattttctagttatttttggttgaattctgtctttggcaagaatatgtcagtcaccttttgaataggatgaatgaatctgttacaccttatggaagccataaaatctatgctgccccacatggtggcaatggtgtatatacaaatgaaaatctaagaaccccactgaccttctgctgaccaacatcgtagtgaggtaaagaagtctcagagtttagcaaagtattatccttaaagaatcaaatgagattgtaaccagttcatcttgcctgctgcccagatacagccaatttgtaaagacagggaagtgcaatagagagagattttaatatgcatagagccagctaaataggagaccagaattttactattatttaaatcagcctccccaaaaatttggaggctaggattttttaaagacactttggcaggcatgagttagttcctgggtaggggccacaagaccagatgagttggtttaccattctgggtggtgccagctgatccatcagaatgcagggtctaaaagatatctcaagcaccaatcttaggttttatagtagtaatgttatctataggagcaattggggaggttagtaatcttgtaacctctgggtgcatgactcctgagtcataatttttaatcttatggccaatctgttgattttacaaaggtggcctggtccccaagatacattttacccaagatgtaatatcacaggaaaccagaaccttccactcaacctctcatacacaactggctttgttagtttcccaccacattcaagagcacctgatgccctaaactgtttaaggttgaattaaggagtgctcttttcaaactatcccaatttccatgaaaaccaaagacagcagaagacctagaaaatatttatagaattgggtatcttgggacatgaaacaagtggatacttacatatgtgaatctcacatgtcttaatatccagactaattccaccttgacctattcttacatactatctatttttctcttgggaagttttctaatactagcttagcatcagcatgtctgtttcagtgaaattaacacgttaaaatatccccactggaggtcagtgagtcagggcacatgctgctctacagaggggcccagttacaacctaaggagtagcacttcatcagagctacctcttcaggccacattccccactacctcaaccaactgctcctcagaagaagtaagatggatttgtgggaaatgatttccttgagccatttttccaaagatagtggggcattcttaaatggtattcatttgaacatggtattcatttgaactttgacataatgccattattttgtaaatgccatatcctggatagctaactatggctgacaatctacccctcatcatgactgtgctcaaatgcagatatctctagtgcatcattgaacgaaaggaatttcacacacttaagcctctctgaaattttcatctttcaattgttcacttttgtaacttttttgtggggatgaaattgacactttaaaaagaaaaattgaagcttgtgatgggattctaaaatctaaaaaatttcctttccaatcatattttaaactgttagatcgtttgcccatttattgtcaatttaacatgaaaacagacacatgtgcacatggacacatacacacaggcacatgtgttgaaggcctctagcaaggttgatgagacttgctcaactctattgctagccacagatgagcatacaggaaggtcgtaggacccaagtgtgtccaacccacagcctgtgggctgcatgtggcccaggacggctttgaatgtggcccaacacaaatttgtaaactttctttaaaaaaaattttttttaaagctcatcatctattgttagtgttagtgtattttgtgtgtggcccaagacagttcttcttccagtgtggcccagggaagccaaaaaattggatacccaatagtgcctttgagattgacgcctatggggaaatggagggagcagaattgggtggagggagaagttggaccatgaagcagtcctagcaaaggcctaagccaattcctcagggaaactgtgcagccaggatagccctttggtcttgttctactggagtctgtccttgctaccctaatatttacgagtcattggataaggaccgcccagggaggagccatgaccttggacaagacagctctcttcagctcctcttaattccctgagaagaactcagctgagggtcatcagctgccagcactcccagcagctgaagaatgggtgcctcaaacttgaagtggggactggcccacataccacagtgttccgtatagaatgacagtaaaaaaaagtggtcatgaagctcatctacagtttctgtcttcaaacctgtaatttttttcatttaggtttttcaagattatcccagaccctcccatttccagcagatttctttgtgctttgatttttggtcatttgtttgtttgtttgtttctattttgagacatggtctcactgtgtcacccaggctgcagtgcagtggtgtagtcatggctcactgcagtctcaaactcctgggctcaagagattctcccacctcagccttctgagcagctgggaccacaagcatgtgccaccatgcccagcattttttaaaattttttgtagagacgaggtctcctatgttgcccagactagtctcaaactcctgagctcaaacaatcctcctgcctcaggcttccaaaatgctgggcttacaggcataagccagtgtgcctggcctgattttcaatatttaaaaaatattccaatttgaagattgaaaagcagactaaaatagtattggcctgagaactcccaaaaaattatctggacaactacaaggtatgccttgctccaaaacagtaatttcagatctgccagaaccaatttgggcttctgtgaaaagtagaattgagcttaggaaggagggaagtgggtggctgccagtgcagtatgactggagtggccgtggaaagatttcccaggcccatctgctctgaaatcatctttattcgtgacagcttctgaactccagaagtgctcacctgtcagtgtccttcacctgtctcctattgctgtttgtcattttgtgtttaactgaaatcctaggcttgaatacctgaggccccgaacctctcgaggtcaggccagcctactattcctctatgtccatgggacccacaaatgcagcaagtgaaattgccgtcattcctgccttggttttcgcccaacataggaaatgattatacctacatggagctgcagtgaaagacatgatagatgctaacacttcacctggagattgctaaataccagctgataagattgaaggctggatgagagcctctggggaaagggttgctgaacagcaaagtggacagacagctatggtaggcagaatttctgaaaatgccctgagggacgtcccatcctaatcctcagaacctgtgaagattgagatatcacttctatgattatgttataaggtacaattaaccttaaaataaggagattgcctgcacgggcctagtgtaatcgcataagcctgtaaaattagcttttccaaagaggggcagaagaggaagttaaagagttgctgctttgaacatcgaggggaccatatgagaaggaatgtggatggcctctaggagcagagaggaccccagctgacatccagcaagaaagcagggacttcagtcttaaaaccacaagggtggaattctgccaatattctcaatgagcttggaagtggattcttacccaagcctccagggaaaagccctgacaacactttgactttggcctgtgagactcttgagtatagaacccaacctagcctgcctggagttgtaacctacaaaagcgtgagatgatgaactggtgtcattttaagctgctaagtttgtggtaatttgttgctgcagcaatagggaactagtacagtagccaagacaaacaagtctacttgtcactatttttgaaaaaacactttctttggaagaaactggaatctgcctctaaaaccatctggcatctggcataaggggaaggcggactgagatccaaaactattatgtgccggcttgagcttcaactttatgtataccaaaccatttatacctcacacctaccctctgggacgaacactattattatcccagtgttatctccatgggcttctaactgctgttcggagaaattaaatgattggaccagtaagttctcaatcccagctgtgcaccagaatcaccgcatcacctgagttttgtttattttgctttgttttgtttttaagctaatgagcttttagagagtcaggatgctgaggcctcaaccctgacccactgaatcagggaggcccagacctcttgcacttattaaagctcttggatgattctgatttaacccagatgtttggcaaccagtggtataaagtgtggttaatggacaccagcatcagttgccctcagggtggtggtaaccgctgatgttgtgtccctaacagccatcctctgctacttcacttacagcaggacctcaggtgtgctcagatggctacgtgcctggccagagggggttctcaattttcagctctagtcatgttatcacatttctctttcccaataccatcctgtgaaggttaatttcgtggagcaacttgactggccatggggttcccagattaaatattatttccaagcgtctctgtgagagtgttcccaaataacattagcatttgaatcaacagacttagtaggttgccctccccgacatgggtaggcatcatctaatctactgagggtctcaatagaacaaaaggtggaggaaggaggaatttgccctctttttcctgcctcaccccttgacctgggtcatctcatcatctctagtccttagactgggatttacaccatcaactcctctggttctcaggcctttggacttggactgaattacactgtcagaggcatttgaaccagagtgactccatcttgcataggggctaggtaaaataaggctgagacctgctgggccgcattcccaggaggttaggtgttctaagtcacaggataagataagaggtcagcacaagatacaggtcataaagatcttgctgataaaataggtcacagtaaagaaactgggcaaaaccgaccagaaccaagatgacgacaagagtgacctctggtcgtcctcactgctcattatatgccaattataatgcattagcatgctaaagacactcctaccagggacgtgacagtttatagatgccatggcaatgtcaggaattcaccctatatggtctaaaaaggggagaaaccgtcagttctgggaattgcccacccctttcccagaaaactcatgaataatccatcccttgtttagcatataatcaagaagccacaataagtataagcagcagagcagcccatgctgctgctctgcttatggagtagccattctttatttctttactttcttaataacttacttgctttcactttactctatggacttgccccaaattctttcttgtgggagatccaagaacactctcttggggtctggatcaggacccctttcttataacaccaccacctgctttcttgggtctccagcttgcagatggcagattgtgggacttacttcttagccttcataactgcatgactaatttatcatattaaatcttattttctttatatatatctccatcctactggtttctctggagaaccctaatacatttcccatctctctgcagctagaatcagccagaaacatataaggagactccaccaggagtggggagttcttgggaaagcttttgcttctgaaaaaagataaaagtacacaggagagctgtctggtgccattccttgagcatgtgagagactgtgtcaccgggagcagcagttatctgtggccataagttgagatgactggatgaaatgctaacatgttgagaaggtaggacaaaaagaaagaaccagggacactgatgacattgttgaggtgcatcaaccctagaaccattattaagagatttattatgtgaaatattattatttactgttttactacttgtagctgaaagcatttctaactgtgtacaggactacttttaaacgcaagaaagaatttctggtgttgaggactgggttatttgcattaacaaccatccaattctttgtgcactgaagtctaagtcacccacattctagggtcacctacacagatagtgatgaagctgcttctaactggtccatgttttttccactctatgatagtaaaaacaaatagaaaaacatctgcattcctccctttttacacactccctgcggcaatattggtattagacatagcagaaaataataactaagaaaataacttgaagaaaacatgtctacaagctttttgttaagaaaaaaaaaaaaacccaatctttaaagcccgtatttattatacaaataaatcagaaataataggtatatggggagaaatgggagaagagaaaggaaagccaagatagtgctcatttttcacattaattccaaaggacaaaggatgggatgggagctcgggggtttctgaaaatgctcaccacaatcagtttacacaacttttcagaaatatgttaactctgtatcagagcacactttaataatctagatatatatagagacacaatctgtttgtctaaagaagcttccagattttccatttagtgtgtcttttacctttaccataaccctgagtcatctctgatagttctcattttggaagtgattccatgcatagaaagttgtgtgtgggctccctaaggacagtagctgggtcccttttgttcattggcttacccatagcctgcagcacaatgctttgaacataggtagtattcaaccaatgtcaactacaagatcccagaagacccagaagaccccttacctttaggaatgtgtgtcttgtgaggcacctgggatattatcgctagctcattttctcagacaaaacacagaacagtgacatagttttgtaaaggtcacagggctaagcagctctctccaaatttagtcctgtgcacttttccccagatttattcccaacaatgcctgctacactctttaaaaaccagcctcagacacatctgttctatgaaaattacatggaacagagaagtaactatttcctctcagtgaacaacattctgccatttaaaaggaaaaagtgaactttgtgggttcctcttgtataattaggatttaatttccttcagatggagatgtgtaactgatattgcatattatatactgcacagtcactaatatagagagattcaatatgcattcactatgacaatgcatcaaagaacttttttttttacccttttatcttcatatcccagtttgctttgcaaaaagaattggcatttcattaaatatataaataaataaaagactattttttcaagattcactaaacaggtgttgcttaccttaaggcaaaatttttataaactaaaaaaattcagtttctgtaactgttccaacatgaaaaggactagttattcacctgagaggaaatgtcttataatgaagactttttattgaatctggattagtcccttgcccaacactaatactgacatttttcctgctgagttgcaagtggcaattcacttttggaagaatttatgggaaaatataacattattctatttcccaaccacaagttttgtttattcctcacactatatagatggtgagtctcagagaactgggggcttctttgctccttgatggggaaacccagctgtgtgcttcacgcagggctgtccatagcctgcagcacaaggctttgaacatatgagggggtgttcaaccaatggcaactgcaagatcccagaaggctccttacactgtggggactgacagcctcttattccccagtaactcctgtggtgtttccagcttcactcttacattggcaagtagggatggaacgcgctgactgccgtgtgaatgaactgtgtaccttgttacttcaaacattgaaactctgatattaaattttttttttttttttttttttttttttttttcagacggagtctcgctctgtcacccaggctggagtacagtggcgcgatctttgctcactgcaacctctgcctcccgggtgcaagcgattctactgcctcagcctcctgagtagctgggattacaggcacataccaccacacccagctaatttttctatttttagtagagatgcggtttcaccatgttggtcaggctggtctcgaactcctggcctcgtgatccacctgccttggcctcccaaagtgctgggattacaggcatgagccacctcacccggcccattaaatattttttaatgtgagaagatatacttattatcatgaacatacaagggagggatttgatcacagccgagcattgcggacatgtgactttgcgtgacttgaaaaaccctggataccaacatctgatcaagtggaaaattcatatgcctaggaaaagtagcccctgtgatgggtgaatctggtggcactgaaattttttctttaactgcattgaaaggagatgtatcaaacaagcctcagcatgttatttaattatgagatctgttttaaaatttaagtgagaaaccaggatatctagaagcaagttatagagaatgcaaaacctattcccctttaggtattcagcttgatgagccaagtgataataatggctgtagtcagctgttgttatttttgcagtatctaaggaagagagtgtagatgaattcttctcttgtgaactgcttcagttaactatgaaaggaatcaatgtgttcaatctcatccaagatttctttttgaaccattagctaacacttcatgtgtgtggatcagttcttactgatggtacctcctgctatgcttggtaaaacatcaagctttgctgcctagaatacaaaataaagaaaaatgagtagctatttgtataatgcactattgtgcacttgctgcaagaagtttgcctgcaaaaacaaataatgttctgtcttctttatatggtaacaaaaactccaccaagaaaaagatccaaaactttgcctcttccatgattttttttaaaggaattggtaagctgacacatccatttccatatagaaatgaggtggcttcccacagcaacatgtttattttgcaactagataaagtgatgaaaattaagtgaagcacttctctctttcatccttctgagagggtagccttcccttagttgtcttgggtgcccatgtaattgaagaaagaaagaatgcaaaaatattatatttttccaattctggcactaaaaaaataagattatgcaggaaaaaaaaaagactttcaagtcaggttatttccttgagagatttcccaaatactctgtctcctctttaacataccatagtcccagcctggaggatctagcttacagaattttcctgtgggctagagaagaaacctttactccctatgacagcaaagcttcaagacctgctgctacatggcagaagatacgacatcacaaaatagacaacccaccctttttttccccaaaggatggtgggaagaaggaagcagaatggaaaagaactaggaaagccaagtacagagatgatgtgtgttccaagcaccacccaccttaccccacccctgtcccgcccagcttagaggactgaagagaatgcagaattaggcatgggtagggctgcttttgtcctagttcccttgggactggtcggggacaggctcataggctgttctgcaccacccagagagaagctgtgtcacttggcagtacagtaggccaggagaagattgtggtggccccacgtggctctgtggtatttatataggatcctgcagctgctgagtctctggtgcggagcagcccagtgggggttgttatagtggcagtggggtgccctgtagagagcattacagagtgggtcaccaggcccaggattagaagtgtctgtagcccccgaggaaccgggacaggactgaatcagtcaagaagagacgagatgatgatgacggagtggccacaaagtcctcccacccctaccctatcccagatgagcccatgctgtaaccacatgaagagcaaagaaacaactatttattctcagggactgtgttaatgattcccaaccatcagcatcgaagaagaggtccggaagaatgtgaagaatgctaagtcttgtgtggagaatagaggggagcatgaagacaatccacagcctgcaggcagggacttcatggacactctacattgtgcagcagccacagaattcagccacaggtgccagctgggtgagtaccaaccaggtggattaggtccaccacccagaagatgcataaaaaaaccacacctgtccccccagatccacagaagccatcttagggaagaatcagtggggatactcaagataaaaaatgtggaaggctctttttctgtcttttttccaagagctgattattatctgaagggattgcttactaattggaactaagatttcacccagacagtgctaaatgttagagattcttccccccgctactggagatcagagagaagttcgcaacatttatagataaaaatcatatctcaattgtagtataagttaaatttgtaactattatatttgtttttgaaagccataaaagtctgcctatttacaaccaaataatgccatagttgacaattttaaaaaatagaaagtttatcttttacctagcatatgcagtagctatattcaaacatgaaaatgaacacaattaagtcatctaaatattaatctaataagaacatggtgtgaccagagagaaattatttgcttttataagaaaattttagtgggggataaagcatattgaaataactttccttttcttagagaaactgttttaacaaaatgaaaaactgaccattgcaactgatatgacaacatactttgcaacaattgagtgactcatttttatggattttttttccactagacatttcatgtagaaaaaaacaaaaacaagaaccaaggatactggagcttttttaaaaatttcatttctatcgatgattgtcttctatataaattatttttacttaattacaactcaatgaatatattttaacaagaaagccttgggaatttctgagaacttgactagcattttctacaaatggcaaagagagcagtgaagattatgtgattttagatttttctcacttttacacatcaaaataagaactagaaattgatgttgacatgaatatagttatttccaagggaaatgtccttatttcttgaatatcttggaacaaaagctaaaggagtatatattatttttatatggcaataactttaatgtgttatgaattcagggttgtaataaactctagttgtgttttcactctataattataattagttaaaaagtatcttctctcatcattatgtccatgatgcttacgtggacatagtttgagaaaaaaatgatgcaatttgccatacaattaggaccacagttcaaaattcaaactcagcacaactttccaaagatctggtacttaacttccgttcctatagcagcaactcaacacacaaagcccactgccctgatctaaatgtaaccaaaacctaatgcaagcattcatttacctctcattttaaaccatgtcttgtagattttgatagactatgtgtgttaagaagcaactggaaaagctagggcactgtataatcactgctgttgatataaaacaaatgtagtaactatgtctaaattgtaagagcacattttgaacatagaatcatttcaagcaggcattttctcatgagctatttgatcttgaaggctcagcatgtcaacattcaatacatgagctcagtgtcattccttccctccagtgttcttccagctggcagtcctgtacgtccatttgtcaatggcagctccttttccttcctcattggcagtcagtcttgctcgaaaatgttggggcctgcacccgacatctcagccttcctccctccttactgtccttgtttttgtccagttattacaccttctcacattccaatgggcaccagattcattttcattaaaggaagtaggtagtgtggaaaatccttacatgtatagcattttgttaaactgtgcattggttagagttgagcaattagattgtctagattcaaaggtagtttttactaccagatgtctgcttctcccaagaagaaagtctgtctcacagtttcatccccaggtcccaaggggtccacgggggtgtgtgagcttgcttcttgggaaaaaagacatctggagttctcccacactgcccatgctgtgcaggatgtctgggaggctctcctctgctgacttgatgcttccatttctcattgtgtctaggtcagtctggctgttcactttggtatctcagccacccaccccttcttacttccaacaagtgcatccaacagtattggatgcatataatttttttcacaattttaccaagaaatcaacaaagtactgcagcatgtttactaatactgtaaagacaagttcctcatacaacccttttccaatctccatactgccctggctcctgccagtctcagataccctactcttagacctttgtgttttccacaaggactctgcctcttcggcccagtcacctgggtcacctgagctcatggccctccatctataaccaaagacctatctgagtgccacccccttgggaggaactcctagcaaactcacacaaattttatggatataaaacttaatagatataaaaatatctgactaatggatatacatgaatttatttctgggtatgtttttggctaacaaaagaattttggattaacagcagctcctatcaggggtacttagaaaaaaacaacaaattagtcatagacaaaaggaggcagagaaagttggaaggaaaggaatagagatatgtgtaatggaatactgaaaagataaaagaagataatggaaagtaacctaaggcctaagaaccaaagcatgcgaggatatatgagtaaagagaagtactgaagagctgggatgctgggaagtaggtgatgggtgttaacctcagagtaaaaaattcagaaaaagatttgcagtaaatatggctagttatctataggattcaattttcctcttcttctgtaataaaatacttatttgtttagggcagaaatgtcatcagttcagaatatttaacttcctagacccccctttggctaaggggcagatgtgacaccagtgagatgcaggtgaatggggttctagaggctttccttccacagcaggggacaaagcctcagaaagaaaagaatgttgctatttccctctgctttctcctaattcctgccttgtgagtggtcctgatgctgacagatgcagtaggtatcttgcagccacgaggaagaaaacagcatgactaaggacaggaggagctgaaagggggatgacacgtgatttctgatgaaagccttgagccatgacattttttaaatgaaactagatacctcttactgaaatgcagagatttccagttaaatttccagcaaaagaatgaaaaatggaaattaactataaatcacttatttatgtaaaataatacgaacataatttctatttggggttctgtttttgttattgtattttagtaaaccttaaaatataagagatttaaagcttacttataacctgagtctgccaagtgttttctatttctttgtgtatggttttaagttcttcagcctcaaatagtacttcactgggtgttttcaggaacctacatctgtttggggaggaattgctatgttataatcctctaggactttgagtccaaggatatacacaccccagcaatcatagtcttatagccactaattcaattcttcttatagcttttggggtttgggtattaccccttagaagccaagttattagctgaataaggaagtaacacctccaacaatgctgttcactcagcatgtttcttaaaaaactccttgttatccgagcaaatcctaaggatatacacccaagatgagttatggagaattaattactgactcctgagaatctaaaaatggggcagcagcccaggtgttctcatcctggagtcatgctgtttcataaatgcaacttaccttaggtaaacttagtgtttatttttgatagtgcaacaagtatagagctcagacccgtttccggtgacttcctttaggaaatctcagtatatatttgttcattaatgtgcaataagaataagctttctaaaatttggacaagtagaaaaaagtggtatttctgttctttgaataaaaagcaaatgcatttaaaacacgcataatacacaagtaggtaaatttatcaaaaggaaaaagtgatcaatcctatttaaactacctgttttacaattgcaatagtttcttattcagaaatgtattaggtcaacttaagtactatttattacatcagaactaccaacacctttagtaccctgtttggaagaccgaacatggatcagatgttagtcccaccttagatatagcaaatcatttatttccattttaatagttgaaatttagaaagcaaacggacccagaggggatatgcccacaagcaggagatgaacgtgttccaaatggcagtatatttccaaggagacttacaggctttttattccaaggattggctcaatacttcattactcagaaagtgtgtttgatcaggcgagaccttcaaatttgagctcctctgtggtcaggggaatgctaatgactgtctgacagcttgtcacagacattggattttttttcttagcatctctggccagatttcctgttttctggcagctgtgctggtgcagattgccaagaggcaccatacccacaatcttgagaggattctgtttccagcaagccttcttttactgtcatctatgtattacatctctatttcaagtctctctagaatttatagtcatactgggcatttagtttcaatttgcatttgtttgttacgtggctttacatgactttttgtctacttcatgaatctgtccgatcttcccagtagatctaagtacctggaggatctgactctctttgacatagagagactccccagagaccatgcctttgatttcatttatagccctttaggacagtgtttccccctcaaactctcttgcagactggtaaatgtcctaaattaccatttaggagtggggaatagaaggaatggagtaggaagtgaaatccaagacaagtcacagtacctgttcataaaagggaggggttgctaggcaggaaatctttgccactctggtcttttctcttagagaacactacccaggactgctcatcgatcattgtcaactatttacttttacgttagggtaaaaatgaccttatatgcaagtagtagtgattcttagagtaatatatgatgcctaaacaatatctgcaggtggtaataaattagaggtgtgacagggcagtgcttcacaaatgttccagctcaaggtacaatctcaagcttgttccagcaagtacatgcccatgtataggggttaggggctttgtcttctaccttcaccattcctaaggtatttaaatccaagtctctaataacttattctggtttttaaagagggtagttgttcacatgataataatttcaatagggctgagatgttttggagcatggtagatgggcatcactcctactgaggcttgcaggcaaagaggaagacagatattgacatttctcagcactggtacatgtgctgcaagtcacctattggtcagttgtaagagcaggtgcaggacagtgtatatacaagtcaacactgggagaggcacatgtaagagctgagggcttatagcaaggcttgggcaaagcaaggggtatggttgagccagaaagtctatgagaatgaaaaggccaggggtagaacctcaggcctcagatcttggttaaatcctaaaaactactcattgtgcttctgttgcagacaatgcataggagtgaatgagacagaaagcaagaccatgaggatgactaagaagagcaagtacaacatggctgagactaagtgtccagggagttgagaataagtggcctattgtcatgtcctatataagtagagtatatggatgggaggccaagaatacaccaacaaataaaatattgaatatatcggtcaagggcatatcgagatgatcaggatgctgcctattggaatgtttatcctcccaccctaccccagaagaggagcttctcgtcttgttcaccgctgtttcccagctcctggaagagcctggcacataaaaggtgcacaatgaacattcattaaaatcaatgattaattgaactggctagtattccatctcactttcattactggagaactgaagagccagctagcctacaaaaactcattctggatgtagaagcaataagaaaacatgcattcaaataaaagcagagaatccttctaatatttcttcatgtgtctatcttttcccatccccaacacatttattttccttgacctacaaaggatctgttttgtccatgatgagtcccaaaaacagccctcaaagtggttctccccacctaccccactccactgatgctgcatcacatggtagggtgttgccttgctcctccatgcagggagcttttctcagcaccactaaggtaccagggaagtggtaactgggaacaattttccccaatacagataaagcctagataaaaagtagggtgatacataggcaaggggtagatggggccttcctagaggacactatgtcttcctgaatttagtccattcataatcaacaaaccagccctactgatttaatgcctaggctctgctgcctgactatatttagcaaagcttttgaatggcagagtgatttcctataggaatactgagttttttccagggacagatgtagccttggtacattgtctggttatgtaggatttttttttttttttttttttttactgcacttgtgctgttctccttttttcaacttatagctggagaccgttttctgctacctcaaaacctttttgaaattaaccagtaataaataagatctttctctatagacagcttttttcaaaggaataaaagaattagaaaatatggaggatccatagtatgcacgcctttggttcctgaggtcccttagatgatatggaattctttaaaaatgtagatcgattttgataacatcataatcaagatcctaagaaatcactagcatccatcagattataaagtttctgagcaattctctccccaacccccatcctgagcctaacatggtgacttgctcacagcctcactggatagatactggttagataaatgaaagcattcattaatcaatgtgatgtgaagaatttagataaatgattcctatttctctcagtctaacaaggggaaatagtccaataaacatatctgtaagtttaatagaatttgtaagttcctttgaatatttggaaatctatgatttcatttttaagacacacagaatctattatgatagagcactgaattttattcagttaggtaattttgtgcctcttatttttaaccagtttggtgtctttcttgtgcttttcactatagtattcatggatcctattaacagtaaagaaagtggcagacgccaggcatggtagctcatgcctgtaatcccagcactttgagaggctgaagcagaattatttgaggccaggagttcaagaccagcctgggcaacatagtgagaacctttttgttgttactgttgttgttgttttttaaagagagagtagagatactaggttactccgtggtgaggcttgggatggtggtgggaatggagtggaggagggacttccttcccaatgactagatatgtcttaatttgtaagacggctctctcccatgtgactttctctcctctacctatgtcaactttgtgttgggagtgttcaggacaatatgtgaatggaaaattcataaatgaatgtaccaatagaaataaagatacatgtgggtgttgctttttcactttttcaatgaagatctgatcctttggtgttttacttggtcccaatcccacttttccacaagttgtggctaaggacttgtccttgattataagattctggttgttgaaactgttatttatgcatgaaggactactcagaatatcactgtaattacacatctgcccctctgagttcttcaaaaataggaacatgacagatatgtttggaaaaggttaaaaatatgcttaatgctaaaaggaaaatgagctaaaattttcctggtattgtattatagttctatattttatgatgatctttattgcaatagttataccttgactttacaaaattctttcatgttttaacccttggtgtccatacttttgcctttgggaatatcatgcaggcttgatgtaaccattttgcttataagacaagcaaattggaccagccacagtggctcacacctttaatccaagcactttgggaggccaaggggaacagaacacttgagtccaggagttcgagactagcctgggcaacatggtaaaaccttgtctctactaaaaatacaaaaatttgccaggcatggtggcacacgcctataatcccagctactcaggaggctgaggcatgatcttttgtcaatttagtttacagggccccagcaacagaaccttgaagggtaaaagaaaagaaaccgtgttcttccctgcaatacaataggagagttcaaaggatgtgactcagggtaggtcagagatccacaagggtttcatttctgttgtcaaaataagtacagtgaaaatacctacgaaaagtaataatttagagactattagtaaatagttctttggtataaggtaatttgtcatattatttgactggggaaggaacttaggtcatcctcagctctgggatgcctacacggcaggcagattggtgctttttgcagcctcacagaagacagaaacaagcagagggcaaaagatagaactcagaaggagaaagtctagttgacagagcaggaacatcgccatcttggacaagcactgccattttaatgttcaccttcatcaaaaacctcgtaaatccaagggcatcagcctaatgactaaggtcagaatgaccataagccacaaatgacatctcttaccagaaacattccaaccataagataaacccctccccaaccagagacttgccagccccaagataacctcccctccagccagagagatgtcagccccaagataacctcccctccagccagagacattccaaccctgcaataaatttctcccccaccagaaacattccaagcctgtggtaagttctctcaccctgaacccttaaatacttattctgtaagacagaaggctcctaaccaaaaatcagccagaagcccctctcaggtttattctccaaaataaacctgtctttgacggttgagctgcttttcatgtttctttcctctttggctcttatgctagcgctgtagtgctacttcactatttttttttctagaacagctgaaattctctttttatgtagaatgagactcagggagatttgatcactttataaattttttttcaaagcaggtcccatttctttccatccctttcaacaatcctcagtgccttatataaatgacagttttctaataaatgacaatattctagcttagtagacaataaacaaaatggagagggagagttttgcatagtcttaaataatagctaaataaaatataatcatcaacttaaagatgagaactctaattaccacatattgtgaacaatttccatataattaactgttgtttaggctatagagtaactaagacagctctctggttttcctgtatgtagaaaacatattggtttggcagatgttttacttactatcaattgcttttcaatagatagtttctcttcctttgcagtgaattcaacacaatccacttaaaacaacaaatgtttattgagtaatcagtacatacaaggcaatatgttaggcctgagaagaaaaacaaaaataagcctcaatactttctcttgagaaggtaacaaaaaggaataaaatgtatgtgtaaattatgataatctgtggcagaaaaagtaagtgaataaacatttcatctgggtggaaaagtttggtcttacatttgtgatgatactagaaggtaggcaagatttaaagggctgagactaaggagtttccaagaaaagggaacactgcctatgaaaatatgaggcagataatcttgaagtgtcttagttttttcaagtttctataacaaaatataaaccacgtggcttataaacaatagcaatttatttctcactgttctagatgctggtccaagatcaaggcaccagcagatacagtgtctggtaagagcccatttcctcgctcctaactgacacctttcttgctgtatccttagatggtaaaaggggctagctagctctctggtgtatctcttataagcatactaatacctgtcatgagggtggagccttcattatctaataccttctaaaggcctcacctcctaataccatcaccttggacattaggattttaccatataaatttggggaggacagaaacattcagactatagcagagtgttttcagggaagaatgagagatgtggctgacagaaatttaagggatcacaatagagtaggactagtttatgctaatacagtagccattagctacacgtggctactcagcacttgaaatatggctagtctaaagagaaattttctgtaaatgtaaaatacataccagattttggacacttaattttaaaaagtaaaatatcacatgtttttatattgattgtgcattacaagatattttcaataatacagattactagaattaacttcatctgtgcctactttttttaatgtgcacactagaaaattttaagttacatatgttgctcatattatttttctataggataacattgggccaaattatgccaaaatttgagtatcagacaaagctccccaataacccttgctgccactgcagactcccatagcctaggccaccaaggtttcccacagtctccacagatggtgacctcagttgacagagctacatggagactgcaccactgcaccctccccataactgcagccactgcaccccaccagccagcaccctaacacatacctgcaagtgaaacgctttccccactgaagccagtccataaaatctggaaatgtttactgctccctccaatggcagacatctatgcaaggccatgagaaacatgaaaaagcaaagaaacatgacaccaccaaaggaacaaaataattgtccagttactaatcacctcaaaatggagatctagaattgtctgaaaattgattaaaaataattattttaaggtagctcagtgagatacaagataacacagatacctcagcaaaatcagaaaaataagacataaaataggaagttcaacaaagagatagaaatcatagataagccaaatagaaatcctggagctgaagaatacaattaataaaatgaaaaaaaatacaatagaaaacttcaccagcagatgagatcaatcaggagaaagaattggtgaactcaaagacaaggcttttgaaattattcactctgaggagaacaagaataaaagaatgaaaaaaagtaaacaaaccctgcaggactcatgggccaccattaagtgaacaaatatacaccttataggagttttagaaggagaaaagagagaaagagaaagatacttattcaaagaattaatgattgcaaacttcccaaatcttggaagagaaataaacaaccaaagtccgtgaagctcagaagttcccaaatagtctttacccaaagaagacttcaccatgacacattataatcaaattgtcaaaactcagaattttgaaaacagcaagaaacaagtctttccacatacggtgaaacctcaaaggttatcagcagatttatcttgcagatcaggagagaatgggaagatacattcaaaattattaaagaaaaaaatttgctaatggagaatactttaactggcaaagctgttcagaaataaaggatagataatttctcagattaaaaaaaaaaaaaaaagctcaacaagttaatcattcctggacctgccttataagaaatgctaaggagagtttttcaacaaatgaaatgaaagaatgctagcttgtaacataaaaacataaaaatataaaattcactggtaaggtaaatgtatagtcaaattcagaattctttaatactctaacgatcttgtgcaaatcacttttaaactctagcatataagttaaaagacaaaagatttaaaaataattgtagctacaaaattttgttaacaaatacataacataaaacaatgtaagttgagatatcaaaaacaaaatatggagtgtaaagaagtaaaagttgagacctcttgtgtgctatttaagtttttttatctttaaatagatggttacactataagatgtttcatgtaaaatccgtggtgaccacaaggcagaatcctgtagtagatacacaagagataaagagaaagtaaccaaagcataccaatataaaaaatcatgaaatcacaaagaaggggagtaagagagaaacaaaggaactacagcacagtcagaaacatttaacttaatggcaatagtaagtctctacctataaataactactttaactgtaaatacattctccaatcaaaagacatagagtggctaaatggactaaagaaaaaagcaattatatgctgctctcaacagactcactttagctttaaggccatatataggctgaaagtggaggtatagaaaaacatattccatgctgatattaaccaaaagagagcaaagtggttacacttacatcagacaaaatagactaagccaaaactgtcataagagacaaaaatagtcattgcataatgataaaggtgtcagttcatcaaaaggacataacaactgtaaatatgtatgcacataatatcacagcacctaaatatataaaacaaatattaacagatcccaagggaaatatacataacaattcagtaatagtaggggacttcaacaccctactttcaacaatggacagatcatcctagcagaaaaaataatataaaagcattggagcattggacttaaagttcattttacaccagccagacttaacagacatgtacagaacattctatcccaaagcagcggggtacacgttcttctcaggcatacatagaacattctccaggacagatcagatgttaggccacaaaacaaatcctaaatttaagaagattgaaatcatataaagtggtttttttaatcacagttgaatgaaaatagaaatttataacagaaggaaaatctggaaggatccaaaatatgtggtaattaaacacattcctgaataatcactagatcaaaaaagaagtcaaaatggaaatttaaaatatctgaggcaaatgaaaatggaaactcaatgtaccaaaacttatgaaatgcagcaaaagcagttataaaagggaaattaatagcaataaatgcctgcatgaaaagaaaaaagatcttaaataaactaactttacaccccaaagaactagaaaaaagaacaaactatatgccaagttttcagaaggaaagaaaagattaaaacaaaaataaatgaaatagggactagataaaccatagaaaagatcaaaattaaaaatttattttttgagaagataaacaaaattggcaatagttaagaaaaaaagactcaaaataaaaaatgaaacaggacacattacaattgatgtcacagaaataaaaaggataaaagactactatgaacaattaagtgccaacaaattggataacctagaaaaaaatgaacaagttcctagaaacatacaacctacctgaatcatgaagaaatagaaaatctgaacagactaataatgagtaaggagattgtatcagcaatcaaaaatctcccaataaaaaagctcaggacaggatggcttcaactggtcaattctactaaacattaaaaaaaaaaaaaacaaaaaaaccaatccgccttaaactcttcaaaaatattaaagatgagggaacactttcaaacttattttatgaggccagcattacctttatatcaaagacagacaatgacactacaagaaaagaaaactacaggctaataaccctaatgaatatagatgcaaaaatcctcaatgaaatattagcaagccaaattcaacagaacattaaaagaatcatacagcatgttcaagatggatttatcctgaggatacaaagatgttgtaatacatgcaaatctataaatgtgatacatcacattaacagaatgaagaaaaccaaatgatcatctcaagaaatgcaggaaagacatttaaaaaaatttattattattttatgattaaaactctcaatgaattaggtatagaagaaatatacctcaaaataataaatgctatatatcacaagcttacagcgaacatcgtattcaatggcaaaatgattaaagcttttcctctaagatcaggaataagacaacaatacccaattctcccgaatttctatttaatatagtaatgaaagtcctatccagagtaattcggcaaggaaaagaaataaaggcatccacatcagaaaggaagaagtaaaactgtatgtttgcagataatataatcctgtatgtagaagtcctaaaggctcaaccaaaaaaactgtttgaactaataaacaagttcagtaaagtagcaggatacaaaatcaacatacgaaattaggtaacattctcattctctctcactttattgcccaagctagtcttgaacccttggcctcaagtgatcctcccatcttggcctcccaaagcactgggactatagctgtgagccactgcaccttgtaagtggtttctatacactaacaatgaatgatctagggggaaaaagtcaagaaaataatcccatttagagtagtatcaaaaagcattaaacacttaggaatacatttaaccaaggagatgaaagatttgaacactgaccactacacaacattgacaaaagaaattgaagatgacacaaataagtagaaagatatcctatgttcatggattggaagaattaatgttaaaatgtccatattacccaaagtgatcaatgcaatccataaaagaattccaatcacatgtttccatagaaacaaaaaaatcctaaaatgtgtatgtagctacaaaagacaccaaagggggggaaaataagctagaggcatcacattacctaatttcaaattatatcacaaaactatagcaatcaaaacaacatggtactggcataaaaccagacacatagaaaaatagaacacggagcccagaaataatctcatatatatagtcactaatctttgacaaaagcatcaacaatacacaatggggtaagaataatctcttcagaaaatttggtgccaagaaaactggatatctacatgcaaaagaatgaaattgttcccttatcttacatatgtgaaaaataaattcaaaatgcattaaagtctcaaacataagacctcaactgtaaagctactagaagaaaacctaggagaaatcctccttaatgttggacttggcagtgattttttgaatatcacaccaaagacacagacaatgaaagcaaaaataaagaagtgggcctacatcaaagtaaaaagtttctgcacagtgaaagaatcaatcaacaaaatgcaaaggcaacacacggaatgggagaaaatatttgcaaactatatatctggtaaggggctaatatccaaaatataaaaggaactcatacaactcaagagcaaaaaaaaaaaaaaaaaaaaattgaaaacgggcagaggatctgaatagacattttttcaaataaaacatgcaaatggtcaacagctatatgaaaaactggtcagcatccactaatcgtcacagccacaaggagacatcacctcacacacgttagggtggccattatcaaaaagtcaaaaaatctcaaatattggcaaggatgcagagaaaagggaattctgtacactattggtgggagtgtaaattattacagccattatggaaaacagtatgcggttcctcaagaaacctaaaaataaaacctaaaataaaaattgtataatccaacaatttcacttctgaggatatatccaaaggaaataaaatcagcatctcaaagagatacctacactcccatgttcattgcaccgttattcacaatagccaatggaataggatatggaaataacctaagtatttgtcaatggataaatgggtaaggaaaatgtggtatatatacaataaattattattctgcctttaaaaagaaggaaatcctgtcatttgtaagcacactgataaacctagaggacattaagctaagtgaaataagccagacacagaaagccaaatgctgcatgatgtcacttaaataaaaaatctaagatggaatctaaaaaagttgaatccatacaaacagtagaattgaggttgtcagggtctgggaatctaaaattctaaaatctgaaaaagtcaaactcatagaatgtggaatctaaaaatgttgaacttgcagagacagagtagaatagtggttgccgccagggaggcaggtgagcaacggcaaaacgttggtcaaagggtacaagctctcaaaaagctctagagatctaatgtccaacatggtggctacagttaataataacgtaccgcgtacttgaaatttgctaagagagtagatcttaagtagatcttgcacacacccccattcccccaccaaaaaacaaggtaactatgtgaagtaaggaataggttgttaattagatgggggaattatttcataaagtatatgtttattaaaacatcacattgtatatcttaaatatatacaatttttgtcagttatacctcaataaggacgggggagagaattttgtagctatccactattaaagaaaatactttacatagaaatttctgtaggaaaaaaaatttgttattatgaatctgaatttctctagcctgtaactttcattttccttttgaaatgatagttctttataatggaattgttaaaaactgaaggttggttacttggaaacccagttactgagtttttttatgctgcctgaaatttaaggtacttcagcatagataatgtggtatgtaggtgtctgtttaaattagtgttaatctatatccaagaagatgcttaacattcagtacactctaaactcacacttgaaaggtgggttgcatatgaaagatgctgtactctggataattctgccagagcttcaaaacttgctatctgaatctgcacttaaagagtttcagaagagataatataagaccattttcaatagtgaaatgaatgatatgcctccactcttggatgaacagaagtgtgagaaatgaagagcctgggagcttaacaccttgggaaaagactcctaaaatttagaaccctatcttgcattcctccccttaatgaagggttttcttgtctgacaccattagaaagttagctgatctttcagtcagaacactttctcatttttcctgggaattagccttccaggcaaagtggctactagagttcctagatgatcagagtatcaggactacactgagcttacagagcaagaagtatgactgtttgggagtctgcttgtaatgggtatttgtacacctcttgatctgagactttcatgagaggttgtagaaagatgtacacctcagtaactatataccctgttttgcccaggagggtcccagtttgcacttactgtccagtcttggtttttaataacaccacttttcacttctaaaagtttccaagtttgaatgttaaattataaggatactcttttgtggtattttaaaacatatgtccacaaattatttgctatttctccctcaagagaaggagcctaattcctcacctcttgagtataggctggacttagtgaccgacttctaaggaatcaaataaggcagaagtgatgctgtatgactttggcccttgtcctaaaagatccccttgcttttttagtatttttagtacagatggggtttcaccgtgtcagccaggatggtctcgatctcctgacctcgtgatccacccacctcagcctcccaaagcactgggattacaggcgtgagccaccacgcccggcctaagatccccttgctttttttaggggggaccactcactggggggagaccagctgccatgttgtgagaacacccaagtaggcctaagataggcccacatggcaaggacctgaggtctcctgccaacagccaagtcaagcaggccattttggatgtggatcctcccgccccagtcaaaccttcagagaccacagccccaaatgacagcttaactacagcttcatgagagaccctgagctagaaccacctaactaagccattctcagattcctaattttcagaaactgaaagaatgtaaatatttgctcagcactgctaagttctgaagtattatgcagcaaaatagaatacaactacctatagctttcacacagttctcatctttagactttattgacatttactatgacaaatgaaaatgaccaaattgccctaggtctggctgagccccaaaccctctcagtatgttcatatttcagcatggcaaagcaaaaattaaccattaaattatacccaatagtagtaatagctatcactttttgggcatttagagtttcttagaaactttgctaggattttgtatagatttacctgatatacttctcacaataagccctatgaaaggtattcccaacttcattttgtaagcaagaaatctgagattcaggtaaggcaggctccaaaagttcccacagccattcattggtggaaccagctctccacccaggtctatctgactccaaagttcacactcttcaccaaacttaaaactacacactactgtctttcaacaaagaatccaaaaaaaaaaaaaaaaaaaagaacagaaattttagtgaaagacaatgaacaaatgcagagaaactttgtctgaaaaagaaaatatgtaacgttttatatgctgttgttaaaccatatttttttcaaagcaaataatacattcatatcgttcaaaagacacaaaagatattttgacaagatagcactcacctttgcccccagccacctggtgaccccttccggaggcaatgaatactgtttcttgcatatctttccaaatatattctatgtgttatcgaagaccatgcctacatatactccccaccactaccattgtttcttacgccagtgatagcatagactgtacattgtttggcacctgtttttaacctaagaatgaattttggatgtcattaagaatcagtgaataacaaagtatcctcacttttttttttttttcctctttgagatggagtcttgctctgtcacccaggctggagtgcagtggtgcagtatcagctcactgcaagctcagcctcctgggttcacaccattctcctgcctcagcctcctgagtagctgggactacaggcgcccgccaccatgcccgggtaattttttgtatttttagtagacacagggtttcaccgtgttagccagggtggtctcgatctcctgacctcatgatccgcctgcctcgacctcccaaagtgctgggattacaggtgtgagccaccacgcccagccctcactttgttttttttttttttttttacagctgcattatattctattgaattgtataacataatttatgtaatgactacccttttaataatgattttagttatttgcaatcctgttatttcaaaacaaaatgctgtgacgactaactttgcccatatatcatctctaaatgcaagttctcagcctcatagcctacactgacttgctgaaggttcagtcctaaggcattgtggactaaattatttactagctgaacattaaaactataggtactgtgttgtgatttttattgttatagtttctaatttggacttgagatctctgtggagaatggccataagccaagatagccgcttgctaggagagccctggttcaagtgtgttggtcatgagacaaaatgagaaggtgaaaccaaattgcatgaaacagaagaaatgtatgacttacatatcccagagaggttaggggtcccgatggcaggccacagaagtctggaggcaacagggagctcaaccaccaagcggggagcgagagaggagagagcacatgtggtcacgaggctttcattaaggcccattagccttcctgagggggttgtgaattgtctggtttaaagaaaacacagatgaagggggaacttattaactctggtgtgggccattaggttttatcatggccagcagctgtgggatgaggaacaagtgggctatattgtaaacaaccacacagggagaggaagttttcacctggtcgaatgcgacggggtactactgagttccagtaacttgtgttaggtctaaaatggatgcccaggcagcaactccattaaatacatttatgacagtactgaaactactggtttccttttctactattctgagaatggggtgagggcaaaagagcacattttcgtatttcttatcttaaacaagtgaataggcatttatcttctaacccactttatcagaaaatagctgatgaaatgatttgaatttggcaggcttatcagttcagttttcaatacattctcatttgtctgtgcaaccaaggaaatggtggctgctttttaatataaatacctttgtattttcctcaaacttcccccatgttctcttcttggaattcctacctgcttccgtcctgctcctcctgtaaatatgcaattatttaggcctgaaagctggaattcacctgtttcctcttttttgctctcccccggattgtaggggcaatcatcagaagagccagaagtgacctcgaaattctcattcttggttgccaggacaatgggccagctgggatgggaggctccttctcacagtatgagaggctgcactcacaccagctgctcaagtgaccagcccccttcccaacccgtccctcctacccgacacaatctcccataatctcaaggttgccacatgctgcatgactagcagactagcattcctagacaaagtctgtaaactgcagcctccagcagcgtgtctctccctgcaacagatatcaaggggttagtttccactgttggaatatagacccacactgcacatccagcagggcaccctgccccagcatacttctctgtgggatgatgggagaatggagaagacctgcggtctcttccctcgataattcttccagtttcccaataatttgtccctttttccaataaagcctcttcctaaacacatgctgtgtggcattgtggaacttgtcctgcccctgaaatgagataaatgagataaaaagagacccatcttgcctagcatatgaccggtcagtctccaaatactcctaatcctggagcggctggtttactcaatgatggactttgtaggtaaggcaaagtacagcattttttgtttctcacctctcccccttaaacctgccctgcagatccattctaagccagccctggaagaactctcaggcaaggaatataacctttctggtcactgtcacataataaacagtccattctagctgacctggctgaggggatgaggaattacaagagcagtcaatgtcaccagagtcagagccacctctgccaaccaccctcctgcggcatgcataggggaacttccagcagcaccacatcttggaacaaagagtagatgtccaacttaccagagggcaacatcctaccaaaatcccaaggcgaacagaaagatacaaggggtgagaagcagcctcctttattggataaaaccaagcctttcatacccgaccatgtcaacatgagtaactaatcaaaataattagaaggtgcttacagctgaatactgatcaagccttcttcctgttggtgagcagaaatagtatggtgagcatttccacactggtttccaaggtgtataaaaatgacaagaatgaagatggattcctgtaaatggtatatgactctccggagacatttggaatgaaatttctatttaagactggcgagacacatctattctagaatttttaaaatacttaacatggaagcaaagggatgctaccagctgagatggatccattcattcaatcacaggtcatcaaaacagtagcgtttccacctaggagttgtagaaaagcagaaacacttagctccagatgagtacattcagctttggaaagctatattacttaacctacgctttagaaatttaaaaacaaaatactttgcatttgaagttgccaataaaagagactttcaagttactttaatgtttttttccccaatatgaatttgcaattcaagcagtagcttaaaatcattcagagagactttttctctttagtttcacagaatctgccaacttgttttaaaaccagagaaatctccataagaggatctttaggtataagttttcaagaatagcccccccaaaactcattgccataacagttactgcaaagcaggatacttgggggtatatttaataaaaaacaaaacaaaaacaaaaaaaaacctgactctgaattgctgttcaagatttctgattttttatgggaagtataccaaaggtcaactttcttgcagtgttaacaagtttttacctggtttgcttctagaccattacacacagggaaataacaaaatcaaaccactgcttaataggaaccttgaataattgatagttttggtctggcttctaaaacggtcccagagggatttaaaaaaagtggcatttcttttattttggatttcctccaatctaggaattcaaactagttcttgatttggtaagtaaagaagcagttgtgatcagctacattctttgggacagtggtagaaactacagaatataaaaactaaaagcatgacaattcaaatgtattcccttctaccttttggcttaaagctatacatgattcatgttatgtgttaagtttaataaaagatgttattaaaaatttctcacatttttaagagtacttcagttatcactgttaggtgaaacaagtcatcacaatttccccactctaagtgcacgtcaattgtgaagaaaatgtagcctaaggagacatatgttctttacaaatacgaggttggaagttaaacatcttcaaagttcaatctagaataaatgacgatgcttctcgctacttacatggaagttgcatgggatttactctttatgatttcctgggagtatcagatagaccacagttgtgtcattgtagactgtagaggtagcaggtcaaagttcatccttctgtgtttgaatgtgtgtgaaatacctgtatctgttagtaaaagttatttaatggagagaaaaagtcaatttcactgcatatggaccctcaactgattataaaaggatctctagcctctgtcacctactcttcccactgcatgcatctgtccacagggctaatttttaaagtgtatgtttttatattgtgtaaattctttcagcctgtctagtttagattgtatacatcatcatatttggcattcttaccactcctgtgtgagccataagattcctataagaaatactgctttacaaaaaacaccatgctttacaaaaaatgccatgctttacaaaaatcacacattagtgggtggtcactttatttatagaattattaaagcaagtacttttttcctttctttttttttgagacggagtctcgctctgtcacccaggctggagtgcagtggcgcgatctcggctcactgcaagctccgcctcctgggttcgagccattctcctgcttcagcctcccgagtagctgggactacaggcgcccgccaccacgcctggctaattttttgtattttttttttttagtagagatggggcttcaccatgttagccaggatggtttcgatctcctgacctcgtgatctgcccacctcggccttccaaagtgctgggattacaggcgtgagccaccgtgcccggccaaagcaagtactttttaatgaactatatcacatattagtgggcagtcattttatttatagaatcgttaaagcaattgcctttttaatgaactaaagtgaataagacacaactaaaaactagttttaaaaggcacttgctttaaagatttaaaaattttaaaaactaaagtgcagtccagttttaaaaactaaagttttcagtgaaactcaaaagtctcattcaaaagtctcattataacttttcctcttccctacgtcaggcctacttcaggctgagaaatgtgtggcaaaatattctttagttttagaatcctttttttagtattgttctacctcctcccttctatttggatactgctttgggcccctacaagggtacagcaacagaagactggcaattagagagaatgggcataaaatatttaactttcttgaaaggtgtagctataatctttgttgatattcctggggtatgatgaaagcaagagcctccttggtactttgagatacctgtggtgtgatggcggtatgaagagaagcttggccctcttggccaaggtgaaatctacacacagggcaccatcaaaaatgccacaaagtcatctcttcccttatttcctggcctccaagtcattctgcacattgtcacccagtagtcttctaaaaatcagctctcaccttaatatcactctcccaagccctagacatacaggctattgttacaatttccccgaaaattcaagataccgttctctgaagccccaactctgaggtaattgcttctcctaaaataaatacaatgcatgttttttttccttatagagtcattaattgtttattatagaaaattaggaaaatatagaaaagtagaaaaaactcatatcgccaccattgtttcatgttttggtgtatttctgtccagatttgaaaaagcagctttacttttgtttgcttaggtttgctactttaaagaggacaatgaaacagagagggtaatatatttgtaattttgcatctggcttttttgacataatgttttaacgtaaatattttcctacattaatacaaagtctttgtacacatgtactgggtgatgtttaacttttttgtatttcaagcccagaatgcccttttatatatatacatatatacttttagttttgggaatcttatgcagcacgtgcaggtttgttatataggtatacatgtgccatggttgtttgctgcacccattaacccatcatctatgtgaggtatttctcctaatgctatccctcccctaggcccccaccccccgacaggccccagtgtgtggtgttcccctccctgtgtccatgtgttctcattgttcaactcccacttatgagtgagaacatgcggtgtttggttttctgttcctgtgttagtttgctaagaatgatggtttccagcttcatccatgtccctgcaaaggacatgaactcatccctttttatggctacatagtattccatggtgtatatatgccacattttctttaccagtctatcactgatgggcatttggattcattccaagtcttggctattgtgaacagtgccacaataaacatatgtgtgcatgtgtcttcatagtagaatgatttataatcctttgggtatatacccagtaatgggatttctgggtcaaatgatatttctggttctagacccttgaggaatcgccacactgtcttccacatggttgaactaatttacactcccacctacagtgtaaaagcattcctatttctccacatcctccccagcatcagtagttttctgactttttaatgattgccattctaactggcatgagttggtatcttattgtggttttgatttgcatttctctaatgaccagtgatgatgagctttttttcatatatttgttggccacataaatgtcttcttttgagaagtgtctgttgatttccttcgcccactttttgatgctgttgtttgtttttttcttgtaaatttgtttaagttccttgtagattctggatattagctctttgtcagatggatagattgcaaaaattttctgtttgtcagatggatagattgcaaaaaaattctgtaggttgcctgttcactctgatgatagtttcttttgctgtgcagaagctctttagtttaattagatcccattcatcatttttggcttttgttgccattgcttttggtgttttagtcatgaagactttgcccatgcctatgtcctgaataatattgcctaggttttcttctagggtttttatggttttaggtcttacatttaagtctttaatccatcctgagttaatttttgtgtaatgtgtaaggaaggggtccagtttcagttttccccatatcgctagtcagttttcccagcaccattgattaaatagggaatcctttccccattgcttgtttttgtcaggtttgtcaaaaatcagatggttgtagatgtgtggcattatttctgaggcttctgttctgttccattggtctatatatctgttttggaaccagtaccatgctgtttgggttactgtagtcttgtagtatagtttgaagtcaggtagtgtgatgcctccagctatgttctttttgctataggggctcttttttggttccgtatgaaatttaaagtagttttttctaattatatctgttttggtaccagtaccatgctgtttgggttattgtagctttgtagcacagtttgaagtcaggtagcgtgatgcctccagctttgttctttttgctatatgggctcttttttggttccacatatgaaatttaaagtagtttttttctaattctatgaagaaagtcaatggtagcttgaaggggacagcattgaatctataaattactttgggcagtatggccattttcacaatattgattcttcctatccataagcatggaatgtttttccatttgtttgtatcctctcttatttccttgagcagtggtttttagttcttcttgaagaggtccttgacatgccttgtaaattgtattcctaggtattttattcactttgtagcaattgtgaatgagagttcattcatgatttggctctctgtttggctattattggcatataggaatgcttgtgatttttacacatcgattttgtatcctgagactttgttgaaggtgcttatcaacttaagaagattttgggctgagacaatggtgttttctaaatatacaaccatgtcatctgcaaacagagacaatttgacttcctctcttcctatttgaataccctttatttctttctcttgcctgattgccctagccagaacttccaataccatgttgaataggggtggtgagagaaggcatccttgtcttgtgctggttttcaaagggaatgcttccagcttttgcccattcagtatgatattggctgtaagtttgttataaatagctcttattattttgagatatgttccatcaatacctagtttatcgagagtttttagcatgaaggggtgttgaattttatcaaaggccttttctgcatctgttgagataagcatgtgttttttgtcattggttctgtttacatgataaattacctttattgatttgtgtatgttgaaccagccttgcatcgcagggatgaagccaactgatcgtggtggataagctttttgatgtgctgctggattcagtttgccagtattttattgaggattttcccatagatgttcatcagggatattggcctgaaattttctttttttgttgtgactctaccatgttttggtatcaggatgatgctggcctcataaaatgagttagggaggagtgcctctttttctattgtttggaatagtttcagaaggaatggtaccagctcctctgtctacttctgatagaattcagctgtgtatctgtctggtcctgggcctttttttggttggtaggtgattaattaccacctcaatttcagaacttgttatttatctattcagggattcgacttcttcttggtttagtcttgggagggtttatgtgtccaggaatttatccatttcttctagattttccagtttatttgcatagaggtgtttatagtattctctgacagtagtttgtatttctgtaggatcagtgccatgtttcttggaggctttgctcattccttttcattctttttctctaacttcgtcttcacactttatttcattaagttgatcttcaatctctgatatcctttttccacttgatcgcctcggctattgatacttgtttatgcttcgcaaagttctcgtgctgtttttcagctccatcaggtcatttatgttcttctctaaactggttattctagttagcaattcctgtaaccttttttcaatgttcttagcttccttgcattgggttagaacatgctcatttagctcagaggagtttatttcccaccttctgaagcctacttctgtcaattcatcaaactcattctccgtccagttttgttcccttgctggtgaggagctgtgatcctttggaggagaagagacgttctggttttttggaattgtcagtctttttatgctggtttttcctcatcttcatggatttatctacctttggtttttgatgctggtgactttcagatggggtttctgtgtggatgtcctttttgttgatgttgatgctattcctttgttagttagttttccttctaacaggcccctctgctgcaggtctgctggagtttgctggaggtccactcccgaccctgtttgcctgggtatcaccaacagaggctgtagaatagcaaagattgctgcctattccttcctctggaagcctcgtcccagaggggcacctgccagatgccagccagagctctcctgtatgatgtgtccgtcgacccctgcagggaggtgtctcccagccagaaggcatgggggttagggacccacttgaggaggctgtctgtcccttagcagtgctcaagcgctgtgttgggaggtccacggctctcttcagagctgacagccaggaacacttgagtctgctgaagctgcgtccacagccaccccttcccccaggtgctctgtcccagtgagatgggagttttatctataagcccctgactggggctgctgcctttctttcagagatgccctgccaagagaggaggaatctagagactcagtctggctacagcagctttgccaagctgcagtgggctctgcccactttgaacttcctggtggctttgtttactgaggggaaaaccgcctactccagcctcagtaatggtggatgcccctccccacaccaagctcaagcatcccaggttgacttcagacttctgtgctggcagcgataatttcaggccagtggatcttagcttgctgggctctgtgggggtgggatccactgagcaagaccacttggctccctggctacagccccctttcgatgagagtgtacacttctgtctcactggcattccagatgccactggggtatgaaaaaaaactccttcggctagcttggtgtctgcccaaatggccacacagttttgtgcttgaaacccagggccctggtggcataggcacccaagggaatctcctggtctgcgggttgtgaagaccgtgggaaaagtgtagtatctgggccagagtgcactgttcctcatggcatagtccctcacagcttcccttagctaggggaaggagttcctcgaccccttctacttcccaggtgaggcaacaccccaccctgctgcttaccatctgtgggctgcacccactgtctaaccagtcccaatgagatgaatcaggtacctcagttgtaaatgcacaaattacccaccttctgcattgatctcactgggagctgcagaccagaactgttcctattcggccatcttgcccacgtccagtccctttactttaagtttatgagcgtccttatgtgttaggtgagtcttttggaggcagcagatggttggtgaattcttatccattttgccattctgtatcttttaagtggagcatttagggcatttacattcaatgttagtattgagatgtgaggtaccattctattcaccatggtgtttgttgcctgtataacttggttttttaaaaattgtattcttgttttataggtcctgtgaaatttgtgctttaaagaggttctgttttgatgtgtttccagaatttatttcaagatttagagctccttttggcagttcttatagtgctggattggtactggccaattctctcagcatttgtttgactgtatctttccttcatttacaaagcttagtttcactgaatacaaaattctttgctgataattgttttgtttaaagaggctgaagataaggccccaatccctttttgtagggtttccgctgagaactctgctgttaatctgatcgattttcctttataagttacctggtgattttgcctcatagctgttaagattctttccttcgtctcaacgttaagtaacctgatgacattgtgcctaggtgattacttttttgtgatgaatttcccaggtgttctttgagcttcttatatttggataactaggtctctagcaaggcctgggaagtttttcttgattattcccccaaatatgttttccaaattttagatttctcttcttcctcaagaatgctgattattcttaggtttggtcatttaacataatcccagacttcttggaggctttgttcatattttctaatttttttttctttgttggattgggttaatttagagaccttgtcttcaagctctgaagttctttattctgcttgtttgattctagtgctaagaccttccagggcattttgcatttctataagtccatccattgtttcctgaggttttgattgttttttatttatgctatctatttaattgaaaatttctctcctcatgtcttgtatcatttttttgacttccttaaattgggctttgcctttccctggtgcctccctgattagttcaataactaacctcctttttcaggtaaatcaggaatttcttcttggtttgaatccattgccagtgagctagtgtgactttttgggggtgttaaagatgcttgttttgtcacattaccagaattcgttttctggttctttctcatttgggtagcctctgtcagagggaagatctggggctcaaggctgttgttcagatttttttgtcccatggggtgttcccatgatgtagtactctcctccttttcttaaggatgtggcttcctgagagctgagctgtactgattgttatgtctcttctggacctagccacccagcaagttcaccaggctctgggctggtactgaagtttgtctgcacagaatcctgtgatgtgaatcgtctgtgggtctctcagccgtggataccagcaccttctctggtggaagtggcaagggagtgaaatggactctgtgagggtccttaactttggttgcttaatgcaccatttttgttctggttggcctcctgctgggaggtagtgctttcaagacagcatcagccatgatagtatggggaggaacaggtggtgggtgccgtcctagaactcccaagagtatatgccctttgtcttcagctaccagggtgtgtagggaaggaccattaggtgggcgcagggctaggcgtggctgcctctactgtgtcatgcaggttgtcaggaaagtgggggaaagctggcagtcacaggcctcacctagctcccactcaacccaaagggctagtctcactcccaccatgtgcctgccccccacccccaatagcaacaagtctgtttccaagcaatgggcaagcagggctgagaacttgccccaggatacctgcctcccagctgcaaaagcaagtagggcttttgtgcttcccctacctgtgaattctgcacaccggattcataccctcccccaggttctggccagaagacttctcaatggcttcaaattgttacaaagttcagctggaggtttccttcttcctgttcccttttcccagtgcctctggcagcctgcctcaaggacccctgtgaggcaaggcagaaacgacttgctagggcaccaagcgagcccacagggcttttcccgctgcttcttctacgcctgtattttgctcagctctctaaattgactcagctccgggtaaggtcagaatcttctcccgtgacctagactttcaggtttcccagtgagggtgtgtgttcggagcagatgattcccctttcctactttcacagtttgggcactcacagtatttggggtgtctcccgggtcctgcaggagcaattcgcttccttcagagggtctgtgggttctctcagctttcccgatttattcctgcagtcattctggagcagaagttcaacaacgcgagcctccacatgctgctctgtccgtccgagtggtagctgcaattcctacttccacattctcacttgtcagatcaaaacttttcttggggatccacagttaagcagagcaacagaactggaaaccacttctctgatttccaaactgtatttctcctctttcttggtattcaagcttaaaataaaattaatttttcagtcattcattcacagttgagcactttataagaaagttcttagtaagcatctattgtattatccctagaaggacaaattattttatgcttacacaaaacttttttttagagatggcagaatggggggaacaggtgatggtagagtataatcccagaataaatccccatgcccccttttttctgggactctgatcattggatttccactagtagcggaaaattattaaatgatctgttctatgccagcttggggagagacagactctggggaatcctagtctaaaaagtgaaaagggcagttcttgactaagtcatttggcctatcccaggtcccgtgccagcttcccttctacacgtatgtgagattgatggtgtaggtaaacagcaatcatcatatcctaacctgcatgtctacttaggattcggcctggaatccaggaatcacagaagaaaggtagctattgtaccactctgtgcctcctagcaggcctaggcatgtgcctagtggcctgtgggtaattattactctttcatggaggtgctaatgtaaacccttctcattgcctggcagtcaggctttccttggaatccagtggtcaggaggaactgacactcatggaagatggccacaccgggaggtagaacactgaattggagtcactgcattctcagggccttcatttccttacttctaaaaagaagagtctccttggactcttttatcttagctcatgtagtcacgaggaacaaatttctaaagcacttatcttaagaggggggttaatatatagctagacagaaactggaggtagaaagtcagagagtgtggcgcaacttcaggaaccatcctcagcatctatggctgtatctccctctctgtcactgcgttggtctcctctctctctctctcctccagcttccaaggctgccccctgcatctcttctgtgctcagataactcctgcttgaacatggctttcagtggccctggccctgattccagtacgctgctttgttttactttgaactccactcaccaactgattagttctctgtgtgtttcttagttcccatttccaagaaaaaactttgattgacccactgctgggggttgaattgcgtccttcaaaaagatatgtttaagtcctaacccacagtacttgtatgtgtgaccttatttggaaacagaatatttgcagatataatgaagatcagttcatactagatagattagagtgggccctaaatctaataaaactgatgtccttataagaagtggtcaaattttgacacagaaaaaaagatgcataaggaaaatgccacatgacagcagaaacagagattggagtgacgcatttaaaagccaaggaaaaagaatgattgttggcaaacaccagacactgaaagaggcaaggaaagaatcttccctagaatgttttgagagaggatggtcctgctaatacctcgatttcagacttctggcttccagaactctaagagaataaatttctgtcattctaagccccccagtttgtggccatttgttacatcagtcctaggaaattaatacatgcagcttatctttcggtgtcaggccagcctgggaacttggtcacatagggttggacactcactctttacccactcagacatggccaagagcattagggcagtattttccaatcagggccacttaggcagcaacgctgtaaacagagcagtttccttagaaggaggcctgagtgtgggtagatgtttgttggtgtcatctctccattagcaacaaggtggcttttgagttacctttcatttctgcccaggactgtatgccatctctggctgtttcccatcccaaggaacatttttgttagccaatgcattgttttaaatattaattattttctcacctgtgattcctcagagagtttcttggaacaaaaggcttgttggctactgtccagacctattctagtccacaggtgagcccagtggcagtgccacccacaccaggcagctgcatgaggaagaatagttctgggccagccttggaggcatattcacctggcacagccagagacaactacatcttaaggagaaataatgattttacacagaaaattaaatagagccaacattcatgccaagtgaggtaaagaaatgaagagaagaaggtccatggcctaagggtttgagagcttgatggacccaggtgccaagaatgaggaagacaacagtttaaaaccaagactataaattatgagcatatgcattattttctctttctgcctaaatggtgtgtgattccagggtggatcttgtgtatctcagcacagagtagacagcctaagactctattcctatagatgctttttttttttttgtgggggatttaacttcttcttaatgaattaatcattttggtatattagaactctatatttatgatggtagtcctgaatatttgtatctttttttaattgatacataataattgtacctatttatggggtacatgtgacattttgatacatggaaaccatatacaatgatcaaatcaggctaattaggatatctattccctcaaacatttgtgatttctttgtgttgggaatatttcaaatccataataataattaataataaattattgttaactatagtcatcctactgtgcaatagaacacctgaacttattcctcctatctataactttgtacctgttgaccaacctctcctcatcctccctgcccccatcctccccagcctctggtagacactactgtattctctacttctatgagatcagcttttttagatttcacatatgagtgagaacatgcaatatttatctttctgtacctggcttattttacgtaacgacctccagttccattcttgttgctgcaaatgacagcggcaaggattttattctttttttgtggctcaatagtattccattgtgtatatataacatatttcctttatcttttcatctattgatggacacaagttgattccatatcttagctattgtgaatactgctgcaataaacatgtagttctgaatatatattcaagaaactaattattaatttaggaacagaatcatagactataaggaattggcaaggtttcctagggtttcgttttgtcacttttctagatatatgctttcttgtgaatttaaatattttgttttcatcaatgtacaagtaacctatgtagtgtagcgattcaggatgaaatcttattttaaagattttttcacgcctgtaatcccagcactttgggaggccgaggcgggcggatcacgaggtcaggagatcgagaccatcccggctaaaacggtgaaaccccgtctctactaaaaatacacaaaattagccgggcgtggtggcgggcgcctgtagtcccagctactcgggaggctgaagcaggagaatggcgtgaacccgggaggccgagcttgcagtgagccgagattgcgccactgcactccagcctgggcgacagagcgagactccgtctcaaaaaaaaaaaaaaaaaaaaaaaagattttttagtgtctgatgccagtagtgatttagaattcggtttttttcaaccaaatctctgctgaagttctgtccatcttagtgcatttttttttctttcccagaaactccagctttgctaagacttagaattgtcacttcttcaggaaagcattgtttttcctcaccctggttcctctatttaaacaacactctgtgaaatctgtcaaattataggaatatcttccattgcctgctcatacactcacgagaaaaccttgggaaagattcctacctggagccaaagactccttggcactcactttcagcgacaatttgtttatctggaaagcaggtggcattaacctacctctaattattgtctgtgattcttaagcaggtaccacaagatctctctaccacctcctagagatagccgcatatctacaaaagatgggagatggtagatctgcaaatttcctgttaagtcccactatttagaaagagtccttgcttcctttcaatgttttaacttttaaaatatgggaaaactggctatatgttgcccgatagatttgcatgattatggccctttggggaaggtaataagaatgattgcagcatttttctttctgccctcacctcccatgtagacttggttatgcccacagagatttgactatgagtggaggacaactgtggcacttggggttatgaaaatccattgttgattgttaggcttgagctgcatgtataagcccatgtctaggatctggcccatcactgcactgactataattctgcctccagtctacagaacctgagggtggcagatgacagcaggtgtgttccatcattggcacccacactccacaccctccacaggctctgcacccgtgtcagtcagttctctagctatagctgtacctatcttttccaagggcttttgagaccagtgacccacaataccagtaagcccttctgatggaggtcctctcttgtctttgatttcatcatcatactctcttggattgattaaatgagcaaaggacattccttgcatggatgaaactggtcctctagctttgcccatgggttcttctcctatcctccttattagtggtggcatgtggaaagaaaaggtgcagttaacattgaatgagatgatattctagaaacatagcaattacagctcaaagagttctagagaagacatgattggaagacatgttgttctacatttatggtataaaattccaagtgataaatttaacataaccagaaaatgagttttcattcactttttttccgcataatatgggtaagacttgtacctgtggtcattatcaacaaagcatgttaacctttaagagagactttcaaagccaatattcatgggcagcatgatggatgatgccatgtcatgagtaatgatgtaaccaatattacatcagtggtatcaggaaactgcaggagcaagaatatctatgaatctgtatttgcttcaatacaaacaagttctgaagagccatagcattgtaagaaattagccagtagtggtgcaggtgacagtaaagaacacaaagagatggttcctggacctgaacaggtagagacattacaataaatatttttgtgtgctgaatggacaataaacaaatctgatagtatctcttttctacctattactttaaatcttcattgatagataaataactacctcacatgggtccatgaattttataatatatttttaatcaaattgcttatatagactggaccttgcaaaaaaatttttgcctagggcctcacacaccctgtcttcattcatttttcttgagagaaagaagtgcaacatctgctttctaggagtaattctttgggctatgaccttgatctcataccatccctttactcattttgtgtgtgtgtgtgtgtgtgtgtgtgtgtgtgtgtgtgtgtgtgtgtgtgtgtatgcttggtctctccctctctattgcttcttttcctcttacatttatgcaaattctcctttttttcttgaccttccgatttcagtgagccaccataaaacgctctttcttttcactatcacacttattaaaagaataattcacagcttcttcacccatctgtattaagttcctgtaatcacaggttctacctccattaatgacccattttccctttctctctttaggctctgttcgtgtgtgttcttttatttacacttaattcagcattgacctcttttctgaacacattctgaagatatgcatttccacctgccaacctgacagctccacccttatgatctcatgatttatttaagctaaacaaacttaaaattaaatctaccattgagctccatttcttattactcccatctcccaccctcacctaaaatgctacttctggctttcttattttgatggaggttatggatttcttgggagcattttttctacttcccttttgagagctttttttgtatatgttttagtactcatttactactcttcttttgctctgttcttcaccaagatggctggctgataatattgatcgtacattaatcatcatttctgctttctctattagagataacggtgatacaggaaaagtttccattgaattctgagatatgtcttaaggaaaactcatttaaaaaaaacagcaaaaaaaccgcaccttttaatgtatgtctctgtagttcaaaattaacacaggattgaaagttgaggaaattaaggaaatccccagaaaataggaggaaaagataaagaaataaaaataggatgaaaaaggtgaggaacgtgagagaataatctaggagtccatgatatctctaacaagagaaaagcgcagaggaaacaaagggagggatacttaaatgaggagatgcaagaccctcctaggctaggaggtgacctcaggtttgggactattaccaacagctccctgagtgttgttgcgcttcacgtgccacctggatcaatttagtcacttggcagatgtcagtctctttttagagattatctctagaatcaagtagaggcagttcagagtcattaagtcaaccactaagtcagaaaactcactatgagatggtaaaagaatgaagacaaatctcagactaaatcttctaaatttaatgctatataatggccaagcaggcacaaatagttctgcaacaacttgttggagtttgggagaggacttgttgctatgccttgaagaacactggcagcatggctaatgaaagactctgagccaatgtgaccttgcaggatgagaggcctggtaggcgactcagatgtatggtgtggggaggtcatgggggagaatgcaggctgcatctcccgggaatcttccatttggagcccatgggcacactgcctcagattatgccccaataccacattataatgacattcataagttgtagtaaatttatacacttgtgcaatcatcacaattgagctttcgaatatttccatcacctccaaaatttccctcatgctcatttgctgtcaaccccccttcccatctgctttctgtctttataattttgctttttctagaaattttaggcaaacggaaccactcacaatatgtagttgtgtctggcttctgtcacttagcaaaatgtttctgaggttcatccatgttgctacaagtatcagtagtttgttctttcttattgctgagtactagttatttatttatgtaatttatcattttttttctttaatagatcttagtttttgtatcctatctaagaaatctttgtctatcccaagaccataaagatctttcctatgttatcttctggaagctctctagcccaagctcttacattaggtctttagtgcacagtgagttgatttttactgtatagtgtgaggtaagggtctaagttttgtttgtttgcatatgtatatcatattgtgctgcataaaaggttgaaaatatttttcaacattgaattaccttggtaactttgtcaagtatccattcaacataaatttatttctaagctctttattctgttcaatttatctatatgtttatccttatgacagtaccacattgtcttgattattgtgactttacgataagtttgaaattaaaaaatattttggctattctatgtcttttgcatttccatatacatttttggatcaacttgttatttctattcttgaaaaagcctactgagattttgattgggattgtcttaaatatatagatcaatttggggagaattgcagccttaacatgacagagtcttccattccatgagcataatatatcttttcgtttatgtatgtgtttttcttccacaatattatactgttttcttgtacagatcttgcagttttttcattaaatttattcctaagtattttattctttttgacgctattgtgaatatatttattttcttaattttattttcagattgttgattgctagtttatagaaatataattcatttttgtacagtgatcttgcattctgtaatgttgctgagctcagcagttacaatagattttatagattccttaggattttctatacacgagattatgtcatctgtgaatacatacaagtttacctcttcttttccaatctgtatggctttacattccaatcagcatgcctttacattcttttcccctccttttgcactagctagaatctccagtacagtgttgaataaaagttgttagactggatatctttgcctttttcctgatcttacaggaaaagcagtctttcacatttagtatgatgttagctgtaggctttttgtagatgtcctgtgtcagattgaggcggtttcctgtattcctagtatgttaattgtccgatgcttttttctgctactattggaatgaccatattttttatctttattttattaatatattgtattcattgatttttgaatgttagcttaacttgtactctgggatacatctgttcgtttctaatgtatagttctttttgtattttgctgggtatgttttgctaattttttaaatcaaagatatttgtacctatgttcatgagcctggttttcttttctttattttatcatactttaagttttagggtacatgtgcacaacgtgcaggttagttacatatgtatacatgtaccatgctggtgtgctgcacccattaacttgtcatttaacattaggtatatctcctaatgctatccctccctcctccccccaacccacaacaggcccccgtgtgtgatgttccccttcctgtgtccatgtgttctcattgttcaattcccacctatgagtgagaacatgcggtgtttggttttttgtccttgagatagtttgctgagaatgatggtttccagcttcatccatgtccctacaaaggacatgaacgcttctgtattcatttttatgaggttagtattagcctgatcccaaagccagataaagacatcataagaaaagaaaacagaaggatatgaacatacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggacgtggagaaataggaagacttttacactgttggtaggactgtaaactagttcaaccattgtggaagtcagtgtggcaattcctcagggatctagaactagaaataccgtttgacccagccatcccattactgggtatatacccaaaggattataaatcatgctgctataaagacacatgcgcatgtatgtttattgcagcactattcacaatagcaaagacttggaaccaacccaaatgtccaacaatgatagactggattaagaaaatgtggcacatatacaccatggaatactatgcagccataaaaaatgatgagttcatcattagctatcccagaagcattgtatattacaaagaaaataaatgtaaactagtagaatttcagatcgcaaccacagatagagaagatattttgttctttggggtaaaacttttgaactccttagctcacacaaatagatgatgctgtaacctgcctatttataaataagtctcatcctgaatcaagaatggcagctagtcaggcaagccagagggagaatgtaaaaggaacatttaaaccccattacctgtgcacttagacaatctgctcatgtccaattattctactattaaatgactgtgcatccaaccaaagagaaagcttcaaagtagataaatagattaattcacagacttcaagggtaaagaagcttgtttgaaatggggttttcttacttctcaccatcctgtttggagtcttattcacactgagattgacatataagggaaccatttatgaaactgcacaccagcagaccatatgtcctaggaaacttgcctggatgtcacattgtgaggggtcttccacatgtctagtgatataagcactggaaaaactgagcccaagaacaagacttggttggaaataatttggcgtattaattgtataattctttttttttgagaagggatttcgctctgtcacccaggctggagtgcagtggtgcaatctcagcccactgcaacctccgctttccggattcaagtgattctcgtggctcagcctcctgagtagctgggactacaggtgcatgccaccacgcccggctaattttttgtgtttttagtagagacggggtttcaccatgttagtcaggatggtctcgatctcctgacctcatgatcctacctctgcctcccaaagtgctgggattacaggtgtgagccactgagcccggccaattgtataattcttattctgtccatatttttgtttcttcttaactcctccatcccccattcctgctcatagtattctctgtgtgtcattgtttcagagaaggtatgtggaaggttggagactttatgcacttcctagaaactgaagccaactgagtagattaagatatgagggaaagaggcattgtggggagatagactgagaagatcaaggtaagaaaaagataccccttggcttgaagagaagagagacctatggtcttggatgagcagagccatgcttctgcttcagaacattgccctaagaaggtgatgaggtctcagggacttactgctctttgccaagtctaggtggaagaagtcacagtccctaggattttgagccacagcaccagaaagattgctatggtctaagagtagaatggaagtaaaccaaaagcccaggcgtgaagctgccatacccccagggacaatggataacattttcttggacataaaattgataaaccaaagtttatgcagctccctctacactaaatcagcactggaaacttgacattatccaggcaggaggactgggaggtgcctcaagtaaggttgaggtagaatttactgccaggttagcttcatgggaactcagaatgaaaggcaaatgaatatattttaaaagcagatgaggtttcttgtctacttgactttgtggctaaggtttatttcaatgggcaggtacattcttctctggacacaaactgcaaagcttgaggctttgggagtacagtgggtttctcactggaaacaattttgatacaggcaaggaaaggaggcagtctacaatcagggtatacttttaaggctactggccagtcaattaaaagagcagttccatcttaaggttttgctacctttggagtaggtagtggttgggctgctgtgatggacaggatgcatggagagccttctccccgtcacatatgttcaccacctcctgtcctagtccctcaaaactgctcacaagaagttcagacatgtggttcttgcttttaagcttttttaaaagatacttataaatccagatcctgtacaattttaagcttttaagatctaagattcaaaatataaatcattaacaagatcttaaccacagcgggtggtgctttctaacctcccatcccaccgcaagaatgttcccttggaatggggaggggagggagcagaggaaagcctcaccagaaaggacaggtggggtagacgtagcatcactgaggctgacatggggatgccaggtggagtgacaaggaagaagtcaggccttagccagagctcccagagcagtgactctgtagaagaagcccctgacagaaatctccttagaaaaaacaaatgaccagtgccctggaaagctggctttggccatcttccctatggaaaccaagaccaatcagtgttaaagagagaagtgataacaaccaagagaatctgcccggcagaagcgttcctccctgctccttaccagtcacagggcagaaaaaggggtgtagaccattcctggtcaccaagctagcctgtgctggagggggatggggggaatatgaagtttcataaattaaggttttcatcaaataggagattgaaattttataaatgaacaagactgaagtataagaatgtgaataggattgtcttaactaaatacttgtggagctaggttgagatactaagttatctgactgttaacagctatagatggggaacagagggggtgagggtgggtcgagagagcacagttagcagcaagttttagaaaaataaaaattagattttgcatatatacccgtaagttgagcttcttcattcaaaattattatgtttacaagcaatataatttcttttctgcccttgtctgtttttttcttggcatgttatctgtatctattgattaattaagggttctttacagacttaggaaattagaatttggtcatatattggtaaaatatttttcccagtttgtcattgtgtgtcctctatttgtcattaatgaattttttcctgaagtatttttttatgtaattaatttgtcattattctgtggattctggagtttgtatctgatccagctaagagctttcctcaccctaaaataatagcaaaaacagttgttaattgtaatactttcttcccatgtttgtaaatgccgttttgagaaatccgaacaaacctttaagacagagcatcctctgttgctttgacagcaatgactcttttgtaactttttcttccagcatttttccactcatacttgggtatttttctccctgtcactgatgttctgacttgctatggatcactgacatttcaaggtcttcttcaactactgtcatctggctaattgcctatttctcactttgccatttgaatacactggttcctactatatgcatgaacacttctcacaatcactccaaatctctgttcaagaagtggcttggtcagaaagtctatcgtatcttcattccacctgcaagagttggtttgatgtgaagaacccagtctgttcctaaaattcaagatcagcagcagcctcagtgaacataatgtttcctcatgtttcttgggcttagacttgcattatattttcaatgccattttgaagatgaacaatgcctttccattccactttccagaattttcatctcctgctggatagggattatattgctgaaagtcagcagtacttattgtaagatgtaaggaattagcattaaaataaatagggcatgttatgtctttcatcagaggatttctattagggtattgccagcttgatccacctgtctcttgggatttctctgtgggctaaagaataatgttccaaagcactatataggcctctctaagaaagactcaaaaactatgtcataattactgtctcctaaaggtttttttcctctattatgaattcactcattaattcaacagatctttactgagcacctactatacaacaggcactggggataaagtgttatacaaaattaaatccctgctttcattgagtgtacattctcatggaaaagacatgccaaaaaaaataagttaaccaatatgtgccataatattagacagtgataggtgctatgaaaataaaatcatgctgagtcagggggtgaagaacagtaggcctgacagatggtcatcagggaagacttttctgaagagacaacattggaggcaagacctgaatcaaccgagggaaagagcaatgtggagatcatagggcaaagcattccaggaacaggaaacagcaacgcaaagttctttgcagcaatatgcctggtgtatttaagaaacagcacgtgggcccgtgtcgctggagaagtatgaacaagggaaagaatggagacacagataggataaggaagatcttataagccagatgccagtcttcaagaggactatttcgtatgattaaaataaagagatgattaaagtatgacttcacaaatcacatttattgttacacaaatagttttttttagaacaaatctcacagggaatactctcaaatagatgaggtatgttaaccctataatcagtgagttccaatttcatttagagttgaattctcatagtctagttgctcagttaggatggaaacaggcctttgtggatgtaaagtctgatcagttttgagacatccctttctctaagaggttcttgggagacacagcctgaccaacacaggggagatccatggaacatgcaaggttcctcaatgctagagagcagtgacagcgtagatggggaaggctcagatgttgacagagatggctcagatgttgacagagatgagccctcccacagcctgagctgtcaaacttctgtcaaaaccttgggtatgtatgtgttttggagtccagtagttaaggccaataactcacatatgtggtctgataaggtgtgacacataacattcttgcagggaatgggattgcactccattcttttttctttttaattgtattcctcagagatccttgttctgattgacttccattttagaaggctcactctggctgtagtgtgaggaattgaatgcagaagggcaggaatggaaacaaggagagcagttaggaggcacaggcccggcaagagatgatatgacagtggcttgggccaggaatgcagtaccggacggggtgagaggtggtcagattctggagatagtttgaagggcttgcattgggatgagagaaaacgaaaaaagtcaaggatgacactgaggcttttggcatgaacctgtaaatagtaatcatattatggagatgaattacagtggcggaggaatccgtttggggctaaattaaaaatttggcttttaacacattagtattgagaggccgattaaacagctaagtagagatttcaggcagacagtaaaatgagactagaaggttgaagacatggctagagataaaaattggggcatataagaagtatataggctgggcgcagtggctcacacctataatcctagcactttgggaggccgaggcgggtggatcacaaggtcaggagttcaagaccagcctggccaagatggtgaaactttgtctctactaaaaatacaaaaattagccgggtgtggtggtgggcacctgtaatcccagctacttgggaggctaaggcagagaattgctcgaacccaggaggcggaggttgcagtgagccaagattgcgccactgcactccagcctgggtgacagagtgagactccatctcaaaaaaaaaaaaaaaaaaaaaaaaaaaagtatgtaaagccgtggggctggatgagagctccaggaagaaaacatagattgagaagccatctgagacctacatcctaggtttctctggtgctagaggtcaggaagggaaagacgatgtagccaggactgggaagaaatggccagtactgcaggagaaaaccagatgatttcctggaaaccaaggaaaaaaataggcacttaagaaggagggaggggccaggcacagtggctaatgcctgtaacctcagctttagaaggccgagatgggcggatcacctgaggtcaggagtttgagaccagcctggccaaaatggtgaaacgccgtctactaaaaatacaaaaattagctgggcgtggtggcatgcacctgtaatcccagctactcagtaagctgaggcaagaatgcggaggctacagtgagccgagatcataccactgctttccagcctggatggcagagtgagactccatctcaaaaaaaaaaaaaagaaagagggagggatcaactgtttcaaaggctgccaagcaattaagtagaattaaacctaaggattttccactgcatttggctcctctcctccctgtttcctctcattcgatagaatagatttattcctagtggctcttagggccagtcttccccagtttggggagactactattgcctatagaatattttttccctcttccctactcatagaccctacttttatccagagtgctcacatatccacctcctctgaagctagaaataaccatatggcacaggcctagccagtgagaagtaaacagaaggcatagagcgcggaatttggaaagttctttaaaagggagtaactcagtggcaatgagagcttgcttcccttagctcatcctttttgttccgcctggaacatggatgtgacaactggaaatacatcctgacaacaggaagactatggatacttcctaatgaaggtgagcagggaagctggaaggaacctgaattattccatcatggtgtggagcctccaggacagtcctgaactatttaccttttgattcttttttcatggaaaaaaatacatatccccaatttgtttaagatactgtgatgcatttgttttctgttatgtgacaactgaacataatcccaagtgacaatgctagttgtgtggtctttacccatggctctcctggccaaagcactcctgtcatcccacaaaacagaaataacgtggggttggagatggcaggccatgattcctgggccatctctgctagtcctatacagcggtatgccttggtcatgttgcttgaacaatctttaaacttggctttctttgcctgtaaaatggctgtgttagaaggaccaacccttgaccttcttttatgactttacattttttccttacaattaattctcttgttggttatcaatgaattgctccggtcatgctgcttgagcctggatgaaatcaagactgtaaaaagaaaaaaaaaaaaaaaaaaaaaaatccatgaactacaataaaaataagctcctacaaaacttgatctccaaaaatggaaggcttcattccttttagtgactgcctggtaaagcaagaaaacacaaaagcaaaatttttgatcataagtgaaaagtaggcttgacacatttaaaggcctaaatttgaattacaaagtctaaaagtatttcaacattgtgggtaacttgtacaagtgtgggttcgcataagacttcagccataactgctggagacactggtggaaccccccagccccctagagagtgggctggcagaatcgtgcaggtcaacgtggatgagaactgactgcctggctcaagacccatgcctcgggtcagtgaggctagctttggaacccaggcagagggtatgtgtgtgtgttgtagagggttaaaggaaggcaaaggagaaatgaaaagtctaagaggaggaaagacgggggaaagtgttgcctctcaaagagaatgactttcaaagtgtcatctacaaacactgatagttagatctaaaatgccagcacagaatgtgctggttaagagtagtgtcaattcagggtccagtgattttcctgctggaaaccctccaaaggaatttgagacacagaggaagaacagtcctggcccgggcagaactgcttatgtcaatgtcaatgttcatatttgcatgaccgaaaacacacccagggcaggttagtcatgctcggggctattgtctgatccagccctgtcattctcacactgtgaaagagaagacttccacaacaagttcactggggcgaaacgcttaaagttggttgacagcttcagctggggccacttgtgtaggagcccagtcagtttgatcaatgtagctgagttggctctgggctctgtcatagccccagctgggttctgtttaccatttacttctgtgggatatcagcatatgcctcccaaaaatatgaaggaatgttgagctgaaggccattaacaggaaatggacgcaggcacactctctgcctttcctcttttttcctaaaagcaggatgtagatttacaaagacatgtatatatgaaatatacatgttaataaacttctgtttgtttttctcttctgaatttgtcttttgtaacaggggtcagtttcaataagaacctgttgagggttattatttttaccctacagttcaaacattttggtttttttatacaacgatgttgtaacttattgggttttttcttatcattaggggaggaatggtgggctcttgggtctttctatatctggtaaaggagagccacgtggttatggttcagtcccaagcaatatcatggagtccccgggacaaagcagcttgcaggcatgctctgtgggttcatggttgggagcttgtgacagcttttcttgtcaaaccctgcccagagctctttccacttcgaaaaagaggccccaggaggcagtgtcttagctcaaaggcataactggtcaacctaatggaaggacttcagataagtggcaagtagatggaatagatattttaaggtcacagaggacttgccaattcctttatatcagagaactgacggggtttgggacatgctacccccccccccaaaatatgacaccttgtgccagtttattaccattcgatcatgccattccttcatcctatcacatttcctccccattattcactcttcctcaaacctaccataaaatacactcagatttaataaaacttatactcagctttagtaaaactcatattaaataaatgtgttgcttttttcttcgtataggagtctcagccattaacctagggtgagcagagaaaaaggtacttttcttctcctatagaaccttggaacctgcttcatttctatgcctgaactttgtaccagctgctgatgttaccttgggctcagaaaaataggtaaagggactagagacaataggagagagggaaaggatggccctactgggagaagaatgaggcagtaatgtttcagatcaccaccatcaaacataggcctgaagatcctacccttctcccatcctatccctgcccccatcctatctccccctgttaactgagaattttttattcacccattcaactgatacaaattcattggagcacctgttatacacaaaacaccatactaaattctgggatatagtgagcaagacatataaggcacttgctctcagaagagatagtaaaaagtaaataaataaacattgtggtaaagagtcactgcaggagctcgtcacgtttgagctgagatctgagaggtgaagagtgaaccagtcatgcaaagagctgtgaaagggctttctagggtgagggaagagcaagtacaaacactctgaggtgggaaagagccttgactgtggaggcagagaaaggttgccagtgtggctggagttcacgggagctgaagtgggaggcgtatgaaagactcaggtaggcggcaggagccaagtcacattgagccttgtcttgcaggttttatgagaggccatggaatgattcgttgtaggagaggggctcaatctaatttagatgaataatggccacagtggtagctgtgggagaatgtattgtgtattgggcctggagggaggatactggagcataatgttggaaattgaggaattcctccctcagccttgctctgtggggcttcaacagctgaggagaaaatcaaagattggggaagcatacattcttttcttccccatccagaattctcttcctagttcccaaagatcttgaaggcatttattttcctcagtggttattgtgtcttttctgctggggggatgtgcccacattcttttcactgtctgttgaccaccatctgctgccgtctggactctcataactcccctcctcccattgctgctactttctgtccaactgctgccaagactgtctagggatgggagtgctgggatggatcttacctcatgattggagagatttcccttgacaagactgtctcagactcaggccagagggtgctttaaggtcattactagttgccatatggaatacctctttcagtgttctgctgttcggttgtcctgtctccagttctttgagtggctccaacccaagccatcttctacttccttctaaaaaccaacaccctagagttacctcagcaagtattatattccactcacttattcccatcctgctgtcaacctgatccagtgtgatgctgacctgagaccctgtggacttgacttttatccttggaaatgaacatttgtggaaggtgtttctgctatttgagcatcagcttttcccactgacccctgacttggtctgtccctcccatctctgccactaaaacagcctacagccgatccctctaattggcccctgattccctgtgagaaaggcttgacaacttccttggatgcatcctctgcccaggtgagtgaccccaccctcctggaatctgaccatctaatctaaagttgcctttgccctttctcccaggagtctgagaatgtcctcatacaaactggactcacagctggccctgatattctagaatttctaggcagacatgaaaattagattgaagctgtgaccttcatttcacacatataaaaagaatgtgtgaggacctatgactaatgaaagcagcctcatttcttcacagtcgttttccaaataccactaattgccctatgctttcaacgcaaacacagagtattactcaaactgccacagaaatgaatgagtagagagtaccacacctgggtcactagcacatcttgaatgacaaggtttctgttctgctctcttgacatcctacccttggaagtgacaagattggagtagacactggctcagggatcgtttcctccctatctgccctctacatgtatcctatcatctagatttccagcactttcttctttgctacctgaaagaatctaaccaataacatgagtaaaaagaaccagactcggtagaagcaaacatgactatcttgctctttacaaagccaaatggttgatagacttccctgtatgtgggagagagaaaggaaattctgacccaaataagttagaccttttctgtaggatgccagaagaagctgagattccaagcacatagtgttttggtttcgattttggaagaattaaagaagactcagttagtaattggaaggggacatgaggaaattgagaatagaaaaccacatggataaggttaaaacaaatcccaaatccatttaaaaaaaaaaaaaaacacaatgtcccattgccatgagaaaatgaatgtaatgagtgtttcagtgtattgtctatgtacgatgttgttgtaaagccattttaatgtgttaggaggtattttactctcttcttgattgggtcactgaagtaaccgtgaatagcaatgtggtgcatagaggcagtgtggaaagggcgctgggcccacagcaagaagacctggattgtgtaccatgtgaggacaaaaggccacataggtctctaaccaatgatataggttagatattatgtaggaggaagacaaagacctagagactgtgcagcgttctgagcagtgagcacttgaagatgtgccccactccagagatacacactgatacatttgtgatattcaggggactaaaactggtcttacgccatggcaatcctcgtctcttacaggacattccttctcaggaacatccaacctactcctacacagagaaggcttttggcccctcactctgcaaccaggtggaagtggcaaaacacttggtgggccacccatgcccaccgtcaccaattacattaattcttacgaaggcacttgagttccatcttttttttcctaatatattgatgtgctgtcattctcaaacctaattcttaaggggtctgaaattactgatgaattagaagaaattgcattgtgaaaatgacagatgagattcagtattaacataaagaagaaatggtgttttacaagtaacagtcaatgataattgcaaaacaattcttacagcattatgcatggaaatgggtataaatcctagtgaatcttatcttggatacctctacagttacggtttgcaacttgagaacacaggactgaagagggcttatctggatcttaagattgtggaaaagaaagctaggattttgatgaagtgtagatttaaaattctaagccacttggttctaggtcatatccaaggtctaggttacacattcaagagactgcgtgaacaactcttgaatctcaactctgctttaaaggacaccctgttaaacagtccaaaagtaaacgcagtattgcgagtagctactgctatctgatgcatatttctgaaatatttcctatatgaaaagaagttgagtttctgtttcggtaatttggctggctggagtcaaccaaacccataggtttgactcatagctgatctacctttctggatacctgtatcccaggaatgaactggaaccaaaaaggctggaagttattgtttcttcactattagactctgaggatttaacaaaccacagaatggtcagcaccctgaggctgaaccagaactgaccagcccttgggagtgggctctttgtgaaggatcctacctggtcagttaccccattcccagccaccctgaccaataactttggcagttaaaacaatagcaacctatttattgaaattagaactgttttggggtagttactttcctttataattagctgtgtgactagttagattaactcactaaagtgactagctgaaaatcactatgagcaaatcattttaacttcaggaactaagttctgatatttgtaaaataaaagccttggactcagtaacaattaataaactataaacttctattaagatttatggtaagaaacataaactttaaacaatttaggatattaaccattaggggaaaagtctaggtcttattcatctaaaactccctatttcttaaatgtttctactaagtcaatcttggagttataaagatgcctaactgatagagcaacttttttggatttccttaataatagggaatacacatacttcatgaaaatccccaatattgtttacattagaataaaatttaagtattggacagaagagtttagattacaagaagaattcatttaaatagcacctgacgttccctaacaacagtgattttatgaaacattgtaattgatttgccacctatgtgtggatctatcctaaactgactcctttagtttgcaggttcgttggggattcaatgtcttttacttctttttcagtctcaacaacagctaattcagtactctaaatatagtcagcattcaatacaaatttaattattgactgaatctaggctgtcaggggaaaaaaagatttgctacttgtttggacatgtctctctgattcaatgccacttttgccttaccagctaatcagtcagtagactaagggtggtgcatttttgatcttcccccttaaagaaggtcagtggctgaaaatgagatccagagtgattacattagaaggattttcatgtgtactccatcagggagattaaatgtccaggtgcctcccacgtttccttttaggacttgttcttagtcttcatacttcaagggctcaagagcagcactgacacgcaacatattcattgtccatccccaattacgttctcaaaaggtaactgttacatattgtattagagttctccagctaaacagaaccagtaggatggagagaaagggggctcgagaggaggagggagatgggggagagagagaaggaagggaagggggaaagggaagctggtaaatctaaaatttgtagggcagcctggcaggctggagacccagagaagagttgatgttgcagctgaagtgggaaggaagataggaggcagaattccgtcttcctcaggagacttcagttgtttctcttaaggccttcaattgtttggatgaggcccacccacaccacaaaaggtaattggctttactcaaagtctgctgattgaaatatccttagatctaaaaaacatctttatagcaacatctagaccaacgtttgaccaaacatctgggcactgaaatctgggcaagttgacacaaggaattaaccatcacacatatcaaaatgggacattttcatcattccagttatcttttgaaagttctctgatttctttcactatttaaaatattctccaaataacaaacagttcgccaatgctgataattcttttttttttttcctttttctgtttttttctctctttcataagacagggtctcacttggtcacccaggctagagtgcagtgatgtgatcatagctcactgctgccttaaactcccgagtgcaaaggatcctcccacctcagcctcccaagtagttgggactgtaggagtgtgccctcatgcccagctaacttaaaagaatttttttttttataaagacaaggtctcaccatcttgccccggctcgtctcaaactccagaggtcaagtaatcctcccaaagtgctaggattataggcgtgagccactgcacctggccatgattttctaattacagaaagaaaaaaactttctatggtctttcactgcctccttccaccaactcctacttcagattttgttcattttctccataagtattatacattggtgcttaggagacaaagaagagacatgggttccaaccctcaaaaagcctgtagtgggagaagaatgtgcaaatgattgcagtggtgtggggtttctgctcaggtgtttgatagaacagtagaggaagtaaaatttaataagcttattagcatataggtggtgcttgcatacacaagccctgtttgggctgcacataccctcattgtacaatggttagaagtatgatttccccaggagctgagtctaagggcatgtgaccataaaggtttataaacaaactcatcatctcaaccccgtcgcccccgtatacactcagctgaattagtttagtctctcagtaacatgtgttgcccaaggagatgaaatttacctcaatggcaacttctctttatgtctgcttaaaactttacatttctcttctagcattttgttcattaaactccagattttaaaatagactctataggtacatctgtagttgatggagctgagtctgaggatggagtggacaagagtgctgacctgtgtcactgagaccaaagcaaagcctcttttctcacagcaccatggggatgtgattatacagctctggcactagctcctcagagccagcaaggtattaaacaagcccagacttttcactaagcctttgtcccccaggcactgctgagaaaccactgccaacaggaattgaattctaggaaccagcatgccaagaaacacacctcctggaattttgagcatttgacggaggtctggcaagccctccttcttcttattgatattagtagtagggagggggcagaggggcttgtggatagagactggaaattttcaaagatgtccagttctagaccacagatagcatcttctgtttttagaactgagagccaataccatcaatggaataaggaaagttattattggttttgccccttccagatttaagagggtcctgtcctcttccaacccaaaagcctcctgccacttctctttttttctttgctcccaggtatgagccccatttattgtctcaggccaagatacaaaggtggagaaatcctgcattctgcccaaagtgtgaagggctctgtgttgtagatggtgctgctgtcagtgggctgcttcatgttcttgacccacatgaaagaatttgagagtgagtccaaagtaaaagcaggcaaagacatttattgcaaagcgaaaggacactctgcaagccaggtcaaactgggttccttgagaataagacagtcccctctgacattaggaaatctcatttatggaaagcttatgtgattattcataagagggtgggaatgagcctggctgttggcttaagcatgttgcaggtggtctcctgggcgtgcatgtgcaatgctatcacatatatggcatgtcttcttattagcatcttaattctctacccaggagtgtgttttttactattataatgagcacaggtcatggacactaatcatggtcaaggacactaatcatgggtttctgtgcttgtgcataatttggggattttcccttctgctcttcgtcctgtctgctgcaggatgtcctaaccaaagctgcagatgccgtttctgcactctcaagcggtttgttttctccacctgtttggcaagtttgtttcccttcaagtgactctatgaccatcttatctaacctatctctgtgccagatatgtctgtaattcctctctgaaatattggaggaaggaaacagaactaagtttctcgattatccacttcacatgcttaaaattccagtgcgccattagatcctagaatggttcagagtgagagttccagagaaaatggaataattaagcagcaaagcccaggcatataccatttaataaagctacaaaaaatcctgagattctgaaagtagaagaaaaacatttggcataagacttattctcctgctttttaaaatgatcctcacattttcaatatattctgaaattaaatgtttcattccacttaaatgacttctgcatattaaccatcagtctggggcaaattttgtgtttcttttcttatgttttatcctcccagctcctgagagcaattacattggctcaagtatttgaaaaatcactcaaattaaggaattgcagtccctcctattcttcagtaggcaaataagaaatataggatcagatccatctctccccataggcacatctcatgggaatcataatcagaaggatgcttccggagtctttaatctgagcaaggggtcctggtggggtgatggaagtgtccactggcgtcagtctgtgacagcctgatgtctctgtccacagcagggatgaatctggacaccagatggggctgtgacctggtatgccccatcctcctctgccagaacaggatgggtgccaccatgtgcagttttaaagtaaactgaaaaccagttagttttacagatatttgagaattgtgaattatctcttgaatcaacataattttgcaaagccatagttaataggattgagttgctgcacaagtgcttctcagtggtccggaatcaacttgtgtccaaaatgctgcttgatgttgatgcaggaggcagcatttcattaggccagaaggaaatgctgcaggtggtatcatgtatatgtagatttaaatcataagaattagagaaagatgaagtaggaaaaattgatatgggaaaaaacagaattagaaggaggtgagaggcaggggagggaagcaaatacgtcttttaagaggatctgtttttgctggaggtataaattgcctcccaaaactatgcctgtgaccacaggttcctgacaaccggttaggcaacacaagcatctgagtggagaaacaagccatgcgtcctaatctgagattaactgaacagtaatcccttgggcaagttgcttactttctgtgtatttttcatccataatcccaagataacaaatatttgcaacgtagaatgaaaataaagatcaaactttgtggctcaccatgatggtatccagccaaaattactagttgttattttctcagctccattctttcttctccttttttctttcccattaggtattgaaaactacccatttatttttcttagtaacaccaaaaacttaatttcaaattggagtcagcccctaaagcaagccaaccaataaccaactaaatacaccaaaattgttcagaatatgtcataacattcacttgtgaatttcttcaggctcaagcattttggtcaaagaattcggaagtaaattatattaataagtactatgtcctaggttatatatccacagcctggcttggatttagtccaaccttgctagataggtgttacttatctcatttcacagataaagaaagcattttggtgggcttaatggcctgcattcttattgctagtaaatgtggaattgtgatccaaactcacatctgtctaacttgaacctccttcctgtgtcaaaccttcttcccttaatgcctgataccacttcccaatggggaggagtattctttgaagaatcgatttgggaacttccttagaaaaatgtaataacttccagtaaacttgctctgcagacacatgtattatatgattaacaggttggactgtctagttatgcaatctagggcaaatttcttaactgcacctaagtttcctcatctgtaaatttaggttaataatggtaacctcacaacaacaaatgaagcaataaaacagaagagaatattcagaaatattctacccatgtcggctcacctcttttgggacagtcacttcaataaatgggactcagttaactggatagcaatatggaaaaaaaatcacttaatctctactttacaccatacctcaaagtcaattccaaatggattgaagatttaaatatgaaatacaaagcaataaagtttttaacaagaaaaatatttaataccttagaataagcaaatatttctgatttcttatttattttatatttcggggtacatgtgcttgcttgttacatgagaatgttgtgtactggtggggattgggcttctaatatacccattagccacgtagtgaacattgtacccaatagggaatttttcaaccctcatttccctcccacgctcctcacttttggagtcactaggtctattgttttcatctttatgtccatgtgtacccattgtttagctctcacttataagtgagaacctgtggtatttggttttctgtttctgagttaggataattgccttaaactctaactatgttgctgcaaaggacataacttcattctttttatggctgcagagtattccatggtgtatatatagcacatattctttatccagtcagctatcgatggacacgtaagttgattccgtgactttgctattgtgaataatgtaatgatgaacataagagtacaggtgcctttttgatataataatttcttttcctttgggtagatacccagtagtggatttttagttctttgagaaatctccatattttttccatggggatgaactattttatattcccaccaacaatgtataagtatttccttttctctgcatccacgtcagcatctgttgttttttgactttttagtaataaccattctgactggcgtaagatgatatctcattgtggttttcatttgcatttctcttacggttagtgatgttgaactttttttatatttgttggcttcttttaagcaaacatttcttttttttccaacttttatttcaggttctggggtacatgtgcaggtttgttacatggaaaaattgcataaaatgacaaatgatcctgtcgtgcaggtagtgagcatagtacccaatagttttccaacccttgcccccctccctacctccctgctctagtagtccaccggtctgttgttttcatcttcgtgtctgtatgtattcaatctgtactcaatctgcagctcccacttagaagtgagaacatgtggtatttggttttctgttcctgtgtcaattcactaagaggatggcctccatctgcatccatgtttctataaacaataagatttcattcttttttatggctgcatagtattcatggtatacatgtatcacattttctttatccagtccatcactgatgggcacctaagttgattccttctttgctattgggaatagtgctgggatgaacttgcaagtgcacatgtctttttggtagaacgattttttaaaatatatacccagtaatggggttgctgggttgaatgggagttctgttttaagttctttgagaaatctccaaactgctttctatagtgggtgaactaatttacattaccatcaatagtgtataagcattcccttttctctgtaacctcaccaatgtctgctgttttttgactttttcataatagccattctgactggctactggtgtgagatggtatctcattgtggttttgcttgtaagcaaagatttcttattcttaaacagaagaggaaagtgctataatacaggaaaaaactgacaaatcgctctataacataaataagactataagattaagatcatgaaaggcattattaacagactgaacaggtaatccacagaatagaagaggatttttgcaatatatatataactgtttcaaatccaaagtctatagcactgtttaaaagcatactgttatgaaaattaaataaattaaggcaagtttagagtaggatttggcacataatatgcattcactcggtatgtgctattattattattactaatcagaacaaaagtctaggaccctcctgttttgaatttctgttatactgccagcctttgtgtgtcaggtttttggtttggaaaacataatcctatagtaatgaggcaccaggaaggcaaatctgtagcctggaattcaaaatacaggattgatttaacgacaggatttgttttcctgatttaaaaacaagaaaaataacatgttttcccaatatttcagtaatttattattgctaccaacctctatgtgctgataaggcataaagtaaggagttatgttaaaatctgaattcagctcaaagagcaaagcgtaaggacctcatgcctactcctgcatcctttccattggcatcaccaacatctcccagttctcttggccctataggacctccaagccccacagaacccgccatccaggaggctcttccatgaggcctcactctcaagccagtctgaggctgactcctttcagaggcaccagagtctccccatacactttatatttgatatatcctaagtatctctggaaggaggacctttaagttctcatatccaccaaaggtcttcgaggactgattctcttacagtcttgcagtccccataagccatctcctattatcagcaccctctgccccaagtacttccttaactcaaatgacttccatttctatgtgaaaactcctccagaatgctaccttgttgagctcatgatcactctttcctcttcaactacccactctcatggccttgccttaaacattgtcatcacccgatgagcaactgttcctctgaagtaataaatttaggcatcccactcttaaaccacaggctcatgttcttccaattgtctattactcatccaacccaaatttatatattaaagtcctaagtcctagtacctcagaatatgactatatttggagataagacctttaaagaagtaaattaaggtaaaataaggtcacacgggtaggtcctaatccaatatgatgggtgtccttataagaagaggagattaggacatagacgtgtgtgtacggagagactgtgtgaggacacagtgataagacagccctcccagccaaagagaggcaccttagaagaaggtaaacctgttgacccttggtcttgaatttctggcatccagaattttcagaaaataaatttctgttgtttaaaccacccattctgtagtatttgttacagcagacttagcaaactaatgcaaccaccttccatagttccttctctttcagtctgatttgtgttccatgatgcatgcaccactctttctgctttcttgttccatcatccttccagtttgctggcctggcaaaatctcaacctcacatgaacataacatttgatcttgtctaggcctgcatttaagcagctgaatgtggttggagaaaattacaacagcatgttagctgatgaaacgttaaagtcatacgtgaaatctcaaccaggcatgctacttccctggttaggtttctttccatatccatagacatcctacctttcctcctcttctcttgctcttgacaaattatcttgcctccttctcaatgaaaaaggagccatcagacaacaacttactccacctcttaccatcaaatcaacacacggctctgctctacacccatcttccacttttgctgtagatcatatgctttccctctacctcaggaacttccttcttttgatgatcccctctgtcccatatcttcaacctcttcctctatgcaactccttctgaggatcatttaaatataagcaagtctatttcaataaaatcaaatataaaatctaaccttcattccatgtagtacattgattgcaaaaaatggccccaatttttttcttttttaaataatttcaacttttattttttatttttaattttcgtggggacatagtaggtgtatatatttatgaggtacatgagatattttgatacaggcatacaatgtgtaataattacaccagggtaaatgagttatcctcaacttttattttggattcagggggtatatgtgcaggtttgttagatgggtatgttgtgtgatgccgaggtttcacatatgaatgattctgtcactcaggtagtgagcatagtacccaataggtagtatcttacccctcggcccctccccacccatgctaggagtccccagtgtctattgttcccatctttatgtccatatgtacccaatgtttagctcccatttccaaggaagaacatgcggtatttggttttctgttcctatattaatttgcttagggtgatggcctctagctacatccatgcttctgccaaggacatgacatgcttctgccaaggacatgattttgttctttttatggcttcattgtattctgtggtataatgtatcacattttctttatccagtccactgtagatggacacctaatcgattccatgtctttgctattgtgaatagtgctgcaatgaacatacgagtgcatgtgtcttttttatacagtgatttatttacctttggatatatatctaataatggaactgctgagtcaaatggtagttctgttttaattccttgagaatggaattgctgagtcaaatggtagttctgttttagttccttgagaaatcacagtggttgaactgatttacatttccaccagcagtgtataagcattccttttcttcatagcttcaccagcatctgttgttttttgtcattttaataatagctattctgacttgtgtgagatggtatctcattaaagttttgatttgcatttctctgatgatcagtgatgttgagcattttttcaaatgtttgttgaccacatgtatgccttcttttgagaagtgtctgttcatttcctttgcccattttttaacttgttttttgctttttaagttccttatagattctggatattagaactttgttagatacatagtttgcaagtattttctcccattctgtaggtttctgtttactctgttaatggtttattttgatgggcagaagctctttaattaggtcccattgtcaattttcatttttgttgcaattgcttttgaggacttagtcataaattctttgccaaggccaatgtccagaatggtctttcctcagttttcttctaggatttttatagtttgaggtcttacatttaaatctatcttgagttaatttttatatatggtgaaaggtaagggtccagttttattcttctgcatattcttcagttttattcttctggctagcaccagaagaactggcattattcaagcaccatttattgaatatggagtcctttccccatggcttatttttgttgattttgttgaagatcagatggttgtaggtgtgtggctttatttctagattctctactctgttccattggtctatgtatctgtttttgtacgagtacaatgctatttaggttactgtagccttatagtagtttcaagtctggtaatgtgatgcctccagctttgctcttcttgcttaggattgctatggctattcaggctctctttttgtttgtttgtttcatatgaattagttttttctaattatgtgaaaaatgatgttggtagtttggcggcaatctgtagatagctctgggcagtatggtcgttttagcaatattaattcttttaatccattagcatggaatatttttccatttctttgtgtcatctctgctttctgtcagcactgttttgtcgttctccttgtaaagatctttctgctcctttgttagatgtattcctaggtattttattctttgtagctattgtaaataggattgtgttcttgatttggctctcagcttgaatattattggtgtatagaaccgctactgatttttacacatttattttgtatcctgaaactttactgaagatgtttatcaggtctaagagccttttggtggagtctttaggggtttctaggtatcatatctcagtgaagaaagataatttgacctcttcttttcttatttggatgccttttacttccttctcttgcctgactgctctagctaggactttccttattctttacatctacttatgtgctttacagtgagactgtgtagtttctcctaccaagaggtcaatccccttctctttaagctgaattttggctgactttgtgacttgctttggccagcaggctgtgacagggtgatatgccaattcatgatgaggcctcaagagatattgcagacttctgctctttcttagaaccctgccattgccttgtgaactagcatgctggattatgagagaaacatggcccagttacctgaaacacccaagccaataaaaaaatcaacttccaaaactctgagtaggctcatcctagattagccagttctaagccgactccaaatgcacgagtgagcacagccaggctcagactgacagaaacaaccaactcattcgtagatatttgagtgataataaatgctgattgttttaaaccactgagttttgaagccatttgttatacagcaatagctgatacaccccatgtctactttcatcgaatccaatcttttgcctcttaattcccagctaaattaattgaaataacatactactcttggtctcttcacttctttacttcctattcactcccttaagtatcctagtcttgcaccagccctaacactcctctaagactgtttttgctaaggtctctgtatctgtcctgttgttcaattaagtagacacttttgatataaaccttaccaaaccttttagtagcattatcaaaattgactctcctgttttggctttcgtgctgaggcagaatactgttctgactctcaagtcactccctctggggatcctcggcagacttctctttgattttcaatgctctgccattactttactgttaattgggaaatgtgtcctagagttcttctctttccactttacacacctttcctgggagatctcattcattcattttcttgcataaaacttctcttttacaatctgattactattaaaaaagaaaaaaggcacattatttaatgaccacatgagaatcaccatgctgtgttgtccaccaaatttgactacttcataggtggttaagaaatagtacatactggacgagaacatgtaagaaaattaaataaattcttctgggcttgataaaattaggtagacttttaggtcatacaaattgtttctacatgatgatcaggactagaaataacatttgtttatttcatgaaagtctgaatgtagttaagagaaataacttgaaaatcctgcacaaatgttgatttgatagtccttacattattgtttttgtttttgttttcattgagacaaggtctcactctatttcccaggctggagtacaatggtgtgatctcggctcactccaacctctgcctctcagattcaagcggttctcctgcctcagcctctggagtagctggtattacaggtgcacaccaccacgcccagctaattttttgtatttttagtagagacaggtttcaccatggtagcatgagctaccatgcccggcccattattattttttggtaatacaagttttaaaaattatccatcccaatatttttgaaaaccatatcaagaaaactcctgtttgaactttccagtgttcctggtgaagtcaattgtgctagagtacataggaaaacctgctaacctggcccaggtcaggagtgtgctctcatctgaatgaaattcttgggactacttaacattgttattattgatgtctaaactttccagctcactgtgtcaagattttcttgatcctttcccatacatgacagcctcttcagtgagctccttggctttcctgaaaatgtaacctcttagcagggaatgatgcggccgtaggcaattagctcaatgactcctcactggctgccttattaatgatttgcacttagaccaagcactttgtactaggaattgccatttcccatctttttttttccccctaagcaagatcttgattcatctctaatctgtgttttttatacttatacctgcattactgccggggtactttcgggctcaccttgacatacagacgacatatcctttctctgaggccatctataatcatttgcaaactctggggaaaagaaaaaaatgtacatttgcacaccaactgggcataacctcttaccttggtaaatatacctttataatgactaggaagacctggtttgaatttagaattcttagactcttcagagttccatccaaatgcagccacatggggagagatgaccccagctccaggctaaggtccaagcccttctcttttctaccacattctgtacttacccatacagagccatgtgcatgcataggtagacagtcatcacctctgtgtgctgtccacaatccttgcaacactgccatttggccacttaaggccagaacaggctctggaaacaagcttcagaccatttcaacagaaattatacgactccagacacccagtgtatgatgtagaaggaggatataattatttgtgcccgatctctttttttcctctgctcagcatcaccagagatgtgtcaattttattagtcttttcaaagagtcaacttcactgatcatatctattcatgttttctatttcattgaattatgttattttcaatttactttttagaattatttttgctgatgcttttatcatctcattattttcttttttaaaatgtatttccctttttaaattttttagagacaaggtcttgctctgttgcccaggctggagtgcgttggcatgatcatggctcactgcagcctcagcctcgaacttctaggctcaagtgatcctcccatcttagcctccggagtagccaggactacaggtgtgtgccaccacacctgacttcttattaattttcagccttttttgctattatacagttttaccacttaaactatccttttaagcactccttcaattatctctctctaggtatgtagtattgattttctaatttgtatttgaatttttaatgactcatgaatattttagaaatgtgtttcttcatttatatatgaggatattttagtgaactttttgttgatttctagtttaactacattgttgtcagagaaaatgctttgcctttgaaatttgttgaacttgctttttatggaccagtatatggtccataaatatttacattttgtaaatatttcatttatacatgaagagaatatatattctgcagctgttaggcacagtgttcaatatacttccatttcatcaaattacttaatcatgttatccaaatattctattgccttaaagatttgtgtgtgttattctttcagttacaaagacagaaatctcccactgtgattttggctccgcctatttctccttatagttcagtccctttcactttatatcttttgaggttatgttattagatacatacaagtttaaattattatatcttcttggtgaatcaagacttttatcattatgaagtgaaatctctatctccaataatgctcttttgccttcgtatcactttgtctgacttcaatataactacaccaacattcatttggttcgtattagcatgttgtattttgtccatatttttatttttactcttcctgtttgcctgttttagatttgtctctggtaaaagaatgtatagttagatatttttatccaatctattactctttgcctcttaattgcaatgcttggtctgaatacatttaatataattatgaatacgttttggtttaaatccaacattttgtgttgggctttttatttatctgataggactaacattttgttttgcttactttctttttttagattaattacttttatctttttcctttctttttccatctactagatttgaagctatgtcctctgtttctattcttgtattgcttttcctagaaattccacatgcatatttcacatatcaaagtctaaagttaaccaacatcttcatcttcagaccagaacattagaatatcttacctccttttactcactttggatttatacattaccattgttttgcattttaattctttttaaaacatcatattatgattattaatattatttgggcaatgttcatttatttttacatacatatttatcaatttgtttgtcccttaatttttcaggttttccactgggaatcattttccttctgcctaaagaatccttttttttatataacttatttagagttttctagagttgacctcactctttttcatcagtaaatgcctatttcaccctcataccaggaaatacaattctaggtgggcaattactttcttccaaaacatgaaagatactccttcactgtcctttagtttccactgattttattaagaagccagttgtacatctaaccgctccttcttagaggtaatctctgtctgattttaaaatttggtctcgtctttagtattctgtagtttcatattatatatatatataagtgtagatttttcaaatttatcctacttaagattcactgggattcttgaacttttaaattgatatcttttatcagttctgaaaaatttcacatggtatcacctttttaaaattgtctatgcctcatgcccccttttttccttctcaatctaaaattccaattaatctcagactgctcactctaacttccatgtctcttaacttttcctttatatttttaatctcttcatctttttccttgctgcgtgctagacaaggtcttctgaatgattttccagttttctctcttccactgcacataatcggctgttaatttatgtgttacttattttaaaatcaatttcatggggtataatgtacacataaaaaaatgcactcacttcaagtacgtagtttatataagttttggcaaataaagatgcagaatattataatatatgtgagtacgtccattccagctttgttatgcttattctttgccttgtatatttttctcatctttttactctgaacatatttctctttctatatttaaagtgcatttatgggccaactgctgtgattcatgcctataatcccagcattttgggaagccaaggagagagtatagtttgaggccaggagtttgagactagcctgagcaacatagtgagacttgatctctacaaaaaaatcaaaaattagttggacatggtggtacatgcctgtagtctcagttactcgggaggctgaggtgggaggatagcttgagccctggagtttggaggctgcaatgtgctatattgtactactgcctccagctgggtgacagagtgagaccctatcttaaaataaaaataaaaaaaaaaataaaggtgcaggtgcatttcttaatttcttacattcatgtttcttacattacatatagtttagtcttgccttttaaaatccagcctgacattctctgtcttatgattatttagtctacttgtatttaatgtagttatctataagtttgaatgtatgattgtccttttactatttatgttcttattattctcattttgtagagacagggtctggattgtaagtgggagccactgcacctggcctattgtctcattatttgtcttgtctggtttttgttcattttttttcttcttttcctgcctccttttgtattaatgaagtaatttttagtgtgccagggtaatcctctaatggctttttagttatatttctttgtattattttttaatagttggtctagtgattataatatgcatttttagtttatctcaacctacttatagttaagattgaattacttcagataaaaaacagaaaatttgcaacaatatagtttcatttacctccatccactttctttgtgctattttgtcatatatctatatagatttaaattccaaaattacagagaaataatttttgtattgtttcacatcatctgtcttttaaatgcattaagaaaagtaagagaatttttttctaaaatgtgagaaattagcatctagtgggtagaagctagggatgaggctaaacatcctataatacacaagacattccccccagcaacaaagaattacgcaaccaaaatgtcaacagcaacaaggctaagaaaccctgcattaaactgctgcaatctgctggaaggctgaacgcttttttctgacaaacctgtcaatacatcatttagatgctccttttcatttttagtcagatataatcagattaggcaaaattgagttattacagcgcaagatcaaattgcaggtgcacaaccaaaagaaaatggacaggagaaatgagtttggccaagaaatacacatacacacacacacacacccctttcgcctgaagaggtgtctgtgtgttggcgggggtggggggcgttctcttttgtgtgatatacttgctgaatttgcaaaagcagcaccatattatgttattttattaacaaccccttaataaagtaactagaaacagcaaaataaaataaaatgtgagaaatcagaaaatggaaaagctctacctattaaaagttacatgatgttgtttgtattgagagaaaaataaaagtttctcatgatggaagcagaaactttaaaaaaaaagcatacagaatataatggaaacctattcaaggcttttaatatgttcattattatcttgtgtttggtggctcaggaaatcaaattataaaatccaagatcctgtactacttgtatattatttttacctacatagttaccatttctggtgttcttcgttccttccagtagatccaaattaccatctggtataattttcctttaggtaaaaaacttcctataccattttttatagtacctatctactggaaaataattaccttcagtttttgtttttttgtgtctttttttaaaatcttcattttaaaagaacagtttcactggtatcaaattccatcttgacaggtatttgtcattcagcattttgaaaatgtgaaaatgtcttccagtctccattgtttttttacaagaagtcagttgataatcacatttgttggtcccctggatgtaatgtgtcatttttctttttgttgcttctcagattttctgttcattcttggcttttagcagcttgacaatgatgtggctatgtatgttttggtgttttggtttttgtttatttagcatattcaccctgcttgagattcttagctccttggttgacttaatgtttttcatctaatttgagattatctctctgttttcacatatagactatttttcatcatccacaagctccttgatgtccctttgcagtcattatttttttggtagaagggtaccctattaaactcctcatttcatgtgatcctgagctttaaattttgccttttttatattcagaagctactaaaactaaagtttaagacattctgaaataacaagtatttggtggcaaaatcagctctagtgttctactatttgctctaatttcccattttcccttagattttagccttggaaccccttaatatctcattagctagttttaatcattttttttttaagatttcagagatcttttaagaaatgtattcaactttcttcaagaaattagttgttttcagcataaggatttgcccaaataaagtagtcctgcatatcgctaggaatagaagtctctaattttaaacagattcaaaatgtgtgtattaataagaatctatatttactaaagtactcattctaaacattctctctaaaatgaagataatctagagaattagaaaagccctccctcttaaaggcaatacaatgttgtttgaattagaatgaaaataaagatttctcccattgtggaagtagcaactaaagaaaacatacagaaaataccagaaaatgactcaagccctttaatatgttcatgtctattttatattatagttgatggttcaggaaatcaaatgataccattgaatttcctatagtcattgatctgagagatctttttcaaaataaaataatgaaaaattcattcattttggaaactcatttaagctcaaggtaaaacaaaaataagctgaaggaggggcagtatttgtactaggaaaagggcttaagaaagatattcattaatttgaactaagttctgggaaaaggaagatagcaaatatatcacgagaaaaactttccaaattgttatgccaacattccacttaaaaattatttgccagagccttttgatactggaaggataagtattatctatagggtcaagtttcaaagctttattatcttaagatatttaaaattatttttctttatcaaaccagataaatcaattgcaacattattttagcagacatgaattaagaaacctgactttcatttcttaataccagaaggcttttttccatggagtgatggatcttgattcagatgaattataatgtccacactagcaaaaaaaacaatgtatatgagctttcaattagtatttggccataccaggcagtgtaaggaaatgactgatctccttcttgtccctggtgcatgagccctgacttaaaatacctgttacagcctcctttgaatgacacagctccctttgtcattaagcaaatcaattctttcccagtgggtgggttaatataattgcaagcctctaaatacccagaacatagctctttcttcttatgtctattctaagaaaaatggctgttcatattttattgctatatttctaaaaatgttctcagtctctaagtggctccaagaaaggggaatactgcagtgtccaacctaagcagttcctctctcttctggctacctcctttttgcaccagcatttcagtcatttctctcagcccaacttcactgccccaggttgcagttagttaacatcttatttgtgctgttagtaaataccactggagcaaaaccatttgggagtcaaacaaaagggagccatttctggggcaaagatgaggaagactttatcaaagatattttaactaaatcttatatagtctgtaggagactgccatgtggagaagagacagaggaaacagcaggtacaaagacacaaaggcaaaaataccaaaaacaagcccaacctaatatgtttgggattattaagcgaaggctggagctgaaacataaggtgtggaggggatgctgaaacaggatgaaggctggattgtgaaaggcattatcagccctggtaaggaagttgagcctcctcatgtaggcaatgggggaggggggtaatattttaatctgatatgtatcttaggaagaatatttctaatgattctatgaggcattaattggcatggcaactaataaaactaaggagaacatttaaaaatagcagaagtcaacatatagaggaggaaatagatttgagagatttctgaggtctaattgacaggactcagtgagttatagaaagggggaggatgataacagctgaaggtaagcttgggaaattggatacattttgatgccgttaactaagacgaggacaatgagagtaaagttggagttcagaaggacttgcaagtatcattggagcgattctagctgctctatgagttacgtagtgtaagggggaggtgaagagctccatccatctctcaaaactccagcttctccccttaagattaggagatgctaatatgataatcagattcaggtcaccaaaggagacacatttacccctaggtaggggcagtgtcaattaaaatgccaagctcataagagatctccagtctctggtgagttctagcacactctcactcgctcactctccctctccctctcctcctacaagatacttttaaaaacatttaaaagctttattgagctataaatgacacacaataaactgcatatatttaaagcgtacaatttaagaagttttgacatgtatatatctatttattttctgcttcctatttcattagtttctgctcttttttttttattattcgctcttcttttctcatttcttaaggtggacgcttaagtcattgatttgagacctttcttcttttctagtagacatttggtgctataaatttccttctaagtactgctttagcagtatcccgcaatattttttaagagtggcacaatcatagtccactgcagacttgaactcctgggctcaggtgagccttctgtctcagcttctccagtagctagaactacaagcacctgccgccacacccagataattttttaaattatttttttagagatggcatcccactatgttgcccaggctactcttgagctcctggtctcaagcaatcctccctcctcagactcctaaatagctgagattataggcatgagccactgtacccagctactaattttgatatgttgtgtccttcttttcaatcaattcaaaacattttaaaatttcctctatggtttattttttgacatatggaccttaaagtagtctatatagtttagaaatatttaagagttttccaaatatattgtttataattgatttctattttaaatccattgtgataagagaacatactttgtatgatttgaattcttttaagtttattagcacctatttacggcccagaatacgtagtctatccaatacttcatgaatcttgaggttttccagtctggctggtgtgacaagcactatttctatcccagtattagcacctgctccctctaatcctttcagttggttctgttactggctttgggtagtttcctcacttgcatgcacccctcagtacttagctgaatgctcaaggtgaaccctctgcagatctcctaagttttctttctgtgaaattcctttctttacagtactcttccttcagaattctagctgccttagtcttcctggactccagtattttcccgtccatcctggaaaactgccaggctctgacttggtgtcccctttctgtgctatggcctggaaactctctcaaagcagtaagctggggccatcacagggctcacctcactttctttcctgcctctcagggatcactgctcttccttgcctgattttgcaaagcatcttttcatatattttatctgtttttggttgtttcaggcatgagagagaatttggtccctgttacttcttggtaagtaaggaagtaaagaagagaaagaaaatgcgaggtagggagagagtaagggagggagtgaagaagggaaaattccaaagggaaatgaatagtgctctcaaaaagaagcaaatagttcagtgtagctgaattgaagaacaaatttaaggacatggagagagataacctggaaatataagtgacagagaggtcctgaaaaaccttgaatatgatgctaaaaggtttgccctttatcttaaagaatatggagggcccttaacgcatttgaaggaggaaaataattggatcagaattactgtaactccacagtactgggcagataaagattggagaagaggaggccaatttggaagccaggtgcaatgacagtctcagggtggagaggaacaggaagaagtaagatagaccagacccactgagcaattggatatgaggagtgagggagatgaaaggttcagggatgtttctcagaggccagctgcagtcattggctgggtgactgtgccattcacagagagatggaatacagggactcctggtgtacagtggaggtggagagtgagacaagacatatgtaatagacttggcctctaatctttagtataaggaaagctaagataatgctccaaaatttgaagaagcacaattttagtcaatctcactgtgtttgtcaaccttttctaatagtaaaacacataatacctcagaggcaaagtctataccaattccaatatttatttcttagaagattaaagatgagataattacttaaaggcaagagttgtttttgttttgtttcattttccagcagggagatgttctgttttttgttttctttcctttttttttttttttttttaaaaccgctgaaggcaagtctcagcagtgatttattcttaacggaatcagtttgagaaaaatcccaagttgcagatactggcaaaccatagcactccttattaagacgtacaaaaaaaaagtatccaaatgatactttggcataataccaacagatatgccaagaaggaaataactggaacattccattagcatttacaaataatgtcaagaaactgagtgtgaagtttaagggcaaatttgaagggtggtgaaaataaaatttaagcttctagtcgatttcagagaaaaatagagaaagtctttgctgtttatgcaatccacaagtctcaatttacttattgatttagaattctgactatgtaatttctcagttttgttctactgccaaactagagggatattttgtcttttattgacgtggaaaccatctgaggtggaatccataagagtataagaattagaagaaggaacattctggtttgttcttctcccccactttagtcaccgaaaacatccttacaagccagagggcacgctcagaattagaggataggatggtaaaagagccatggaaacaggagaagctgcagcagcagccagaatgagaaaggatatattgactgtcttacaataataacacaattattatgattggctttacaaggtcagagtaggaggccagaagccacagaagacatccagctccaattacagcaacagaaggcagtgttgtctaagaatgagctgcccttggcagagataataaccttcctgaaaccccaagaatgcccagttgcttggggtgtttgtctaaaggttacaatagcaatagaggggacataggattggaagactccaagatttcttggtaattctaagagcccatattttcttaacttgattaaaacaggctttagggattcctaatttttggagtctgatgtgactttaaatgaattagttcatttaaatgaaagattttttcaaaaattactaatttatgtaaaatgatgagtacatatagacattaaatcagtccaatattttaaaaattaaaaaaacaaaatgtcatgtgtgtgtgtatgtgtgtgtatgagtgagtgtgacatatgacttggggctataaaccaaaaataaaattccaaggcccccctctaccatctgaatggacactcctctcagtcaagggcattccaaagttaacctgaaaaactagttcaggccatcatgggaagagggagccatacttgtctcattctactctctttccttttggaattactgatagaacacactctttaagtctgaaaggaaatatttacaatctattctctctgaagcctgctacctggagacttcatctgcatgacaaaaccttggtctccacaaccctcactcattgatatatcccttctctcttagtctccttttaaactagtgtgggttgttttttggtttgtttgttttctgatctttttctattcccgtcttgcaagtagctcattatttctgtaatgacttttatacaatgagttcaatttttaatttattgagttcttcttaaatgtaaggaactagggatacaaagataaacaaggcatgtcttcgctcttaagtagctcaaagagcaggcagaggacacagctgttgtggcagattgaataatggccccagagatgtctgctccccaatctctcctgtatatatgctaccttacatggcaaaagggactttgtagatgtaactaaactgaaggactttgaggtagcaagattattctggattattcaggtgagcccaatctaatcacatgagtccttaaaaggagaaaatcttttccagctctgctcagaaaaccagaaggatggcagaatgtgaaggacccaacatgctgttgctggctttaaaaatagaggaactatgcgccaaggaatgtgggtggcctttagatgttggaaaagacaaggaaatgaattatccctcagatcctccagaagaaacacagccctatggacactttgattttagcccagtgagaccttcatcagacttctgacctacaaaattataacataacacattgttgttgtttaagccaccaaatctgtagtaatttgttatagcagcaaaaggaaattaatgcagatgtgcctcaactaagagcaaagtagctcagcctgacgtcagtgtgcagaatggaggcataagccaagggctttgggtccttagtgttgggagtgagtggaccacgtaagggaaaggaaaaaaatctcgggacctccccaaattcttatgcaaaaggaaaggtgaagcctggggctgagtcactgtattactctcttccaaatgaatagctgttacattgtgcatcagccagatccccatggaaaagtaaaaggcattaggtacctggagagcactgcccccaacagatcattcataggtaaatcctttcctggcctcccacaaacaaggacatgccagttgtaactataggtctacaatccaagtctagttcctaaactgaagtctgttcaattccacactgataacattgattacaagtttatcttcccaggtgcagaacaaagacaagagatcaatctttcctccacctacccagagacatctacataattggctcttgcttcactctctttttctcttcagaccttcaacttgtcttgtgtaaaatgtagatctactgggcactaatgaaagacacacaggaatataactatttgcctttctgcctagctgcccctcttcctgcatgccttccccactttacagaaatgtataaatactaaaccttctgaaagcctcttcaaatgggtgttttccctggatttgccctaaagttggcttaataaacctcgatcattgagacctgtgcctcagccactcattttggttgccactcaattggtagagatgagagggtaccacaaagaaagaggccttcaggttgtccttgcagtattaagatgtggtcagtcagggaagaaggagaaggacactgcagacaaagggacaaacacccaagtcaacatttacaacatgcttccatatcagttttctatgtgggcaaaattgtgaaaagcttgaacaagaaatgtaagtactttttctcccgtcaaaatagcagcctagatactctaaagggtccttctactttccaacaacaatatagtgactgatacctatgttttaatgcactgtgggcatccaggaaatgagaaaatacccatagctctccatcctacaacaaaaaatatggtaaaggctatttctataactcatacccattttcatgcggaggacaactaaagaagataaaggagaaaaaaaaattttttttttttgagatggggtcttggtgtcactctgactgcaaccttgacctcttggactcaagtgatcctcccacctcaggctcccaagtagctgggactacaggcacccatcatgatgtatggctaattttttaaattttttgtagagatggagttttcccatgttgcccaggctggtctgaaacttctgggctcaagcgatctgcccaccttaacctcccaaagtgctgcgattacaggcatgagccaccgcacctggccaaaaaaaatttattttaagcacctagaaattaccaatgttactggaaaaggggtgtcaacccagaccacaggagcaggttcacagattgtgtgcagtaaagaattcagggcaagtatcaaagtatagtgaaattaagatagtttattagaggctactcttattacagagtagggtgtcctcaaaaagcaacaggaggaacgcccctacctaaaacttaatacttgcttatatagggtattagagctaaaaataatgtgctttattataaaggcttgtgatcagcttgtgacaggctattagtattgttattctcttctgcaactattgatttcagcaagaatctatgagtatattattatttctaatgtgaaactctaaaactaagaatgctttttgttcttaaaatattgggacacttccataacttctgagtcttacttaattaattagcaccattaacttgttcccttaaccataaatatcttgtgaccaagagtacctgacttcctgggaatgtaacccagcaggtttggctttatgcagccgttattcaaggtggagtcactctggtttggatgcctctgacaccaaagagctaataggctcctaagaagttacctggcacgaagatggttatctagtgaggtggagccagcactcagagtcacttttgtcctaaggacatttctcacccaagaaagatgactgagatgctgacaggctgagcggaataaagaaggaacaaaagtgccagccacaaaaggaaagatgggtaaattggactgcattaaaattgagtttgttaaaataagaaaaaagtaaaaagacaaactatgaagatattagcaacacaaataattagcaaagaattatatttcagatacataggaattccaagaactcaataaggaaaagacaaacaatccaataaagaaaatctttcctaattataaacaggtatttcacagaagcagcagcacagagggtaaataaacatggtaaggtgtcaccagagaaacgtaaataaaaataatatactggccagacacagtggctcacaccccaaacactttgggaggctgaggctcatggatcacttgaggccaggagttcaagaccagcccggacaacatggcaaaaccccactcctactaaaaatacaaaagttagcttggcatggtggcaggcggctgtagtcctagctactcaggaggctgaggtgagaggatcacttgagtccgggaggtggaggttgcagtgagctgagattgtaccactgcaacactctgggcaacagagcaacactccatctcaaaaacaaatataaaataaaataagataccattttatacctatactagcaaaataaagaaatctgataatactaaatgttgataagaatatcaagcaatgggaacttttatatgcaactggtgggaatttataataaattggctcagacacttcaggaaacaaatgggtatgatatactacttttgaatgtttacatactctgcaacccagaaatcctacttttggggaatataccccagaaaaacactgatgtgtgtgtaccaagagacatgaataagagcattcacagcaacagtggcagaatactgaggaaaatgaaataggagaacttaactgatcatagatgaggcatattgtggtatattcacacaaatatacaaccgtggaagtaaatgaacatgtatgaattataatgcaataatctagtgagttgtagagaattacaaattatgatggaagttttttaaagctcaaaaaagctaaataataaattatctagagtacatttatatatcataaaatatatggattagttataccattgaatgaaaatagttagttgcagaagactagcgtatgacaccattgacaccatttttgtaaaactgtaaaataagcaaggctaaatatttattgtttggcaacacatagagatatatagagttttacatgtaaaattacctataaatgtcaacagcacattgacatggtaaatacgaagttcaaaatgggatatccctggcatggaatagagagctgggatggcggagggccacacgggaagctgcaatagaatttttgatgtttgcttcattctctaggtgatgtgttcactggtgttcatcttatcatgtttttaaattgacaagcatgttacatatacaccacagaatactatgcagccataaaaaatgatgagttcatgtcctttgtagggacatggatgaagctggaaaccatcattctcagcaaactgtcacaaggacaaaaaaccaaacaccgcatgttctcactcataggtgggagttgaacaatgagaacacatggacacaggaaggggaacatcacacaccagggcctgttgtggggtggcgggggagtggggagggatagcattaggaaatatacctaatgttaaatgacgagttaatgggtgcagcacaccaacatggcacatgaatacatatgtaacaaacctgtactttgtgcacatgtaccctaaaacttaaagtataataaaaaaaattgacaaacatgttgcattatcttttgtagtatcaaatattacataatacaattttaattaaataaaaaaattatacatatcattatttctgccaagatggctattcttccatctccttcttccgtgagtgctcttttttgcactgttgaattgaatgagggtagacctgatagaaggagaaagtattttgttttttgtttttgtttttgttttgagacagagtcttgctgtgtcacccaggctggagtgcagtggggcaatcttggctctctgcaacctctgcttcccagggtcaagcgattctcctgcctcagccacctgggtaactgggattacaggtgcacaccaccaggcctggctaatttttgtattcttagtagagacggggttttaccatgttggccaggctgttctcaaactcctgacctcaggtgatccacccacctcggccttccaaagtgctgggattataggcgtgagccacggcgcccagctgagaaagtgttttgtaagataaaatatgtggccgggcggggtggctcaagcctgtaatctcagcactttgggaggccaaggcaggtggatcacgaggtcaagagttcgtgaccagcctgaccaacatggtgaaactttgtctctgctaagaatacaaaaattagctgggcatggtggcgcatgcttgtaatcccagctacgcaggaggttgaggcaggagaatcgcttgaacccaggagcgggaggttgcagtgagctgagattttcccactgcactccagcctggatgacagagcaagattctgtctgggggaaaaaaaaaaaaaagaaagaaatatgcaagtgctgtctgaactcagctcagaactaatgctcttcccagacaggatcttgcaaaagtattataaaatgacagagtcaattctccgttactctccattactcgcatttcaatttggtggctcacttttcagtgtgaatcctgtctttaatacacactgttcaagagtggatgccaacttcaagtggttcctggctgtcaagggccttcccattccactccataaaatggaagggcccactgacatattttaatggaagggtataaaaaccttctttgttttaacatacattaaacacttgttaccaaacatgttggaggaatacaaagtgacagtctgtgatacatttaagtaattgtaattcagattggtttctccctattaccactttcagggcaagtgaggcaaaaatctaactaccctcaccatcccgactcctatcccagcactcctgcgtaaacatttacatcatttctaattctcacaccgaagtccttcctatcacctacatcttgctactgcgagggacataaggaggttagggaggtgagtgggtggaggtatgggcagggacaggggtaggggtttgagctgacatagtacatacaacaggaattaaaggaatcagaatcacattgcaggttgtgaagtagatagagtctgtgtattgaagttacacagctctaagtctaaatcctcagctctgaaactttttagttgggtgacagttgacaagttactaaacttctcagagcctcagctttcttacctatataagtggttaataatatgtacatcctagggctgtagtgagaattcaattacatgtataagttgtaaatactcagtatacactcaaatatagtgctgtatttgtattgggtgaatatgtggaaattagggagttctatgcttttgatagagacaggccaatttacttgctcatccttgaatgcaggtttcttgacattccttttcactgttgaatctatttcctgagccattacagccactgaaccaaaatcgggcacaagagttgacctgtttgtcataataccatcgaaccacatattcaccacagtttccaggcttcaaggcttccaaacatctaggatctagagtgagaaaaggaaaatgtgtcacggatttttcttatactgaagacatgaaaaataaaaactgtataaagttatataaataaactttattcttcatgcacactaacaaaccaagaaaatatggttctaagtaagtgaaagaaggattccctaaaacccaaaatatttccctcaccacctgaaactctgctactagatattaattcttttgaaaacatgaaagtttttgatcctcatgaaaccacattaaaaatgtttatttccctgaaagcctaagtgagacttcattggctaatacttttgtggggattagaaagacaggacttctttcatttacactggatttgatttacaatcaaattaatatttggaataaaaaatatttccactttctgtacacatttcctcccattctgttcacagaaggcaccactatgatcacatgcaattgcccactatcaaaggaaaactctttaagttacaaaaaaaaaaaaagtaaaatgaaggactgtctttatattacaattatagttttaaaagagcagctcttgcaggacactaaaaacgtgatacaactttctaacgtcatattgtcttatcgtagaaatacacctactataagaaagcataggacagctgtaacaataaagccacattgtcctaataaggttcctttaattatggaactcctcatttgctaaatccctttttattgtttggtactctggagtgccttgattagtatttcctacttcaggaagtgatgccaaggtgggagaagccaaaaaacacacaaaaaatccccaaatagataattgctatctgggacttatatgtgataaactttattttgcaatagctaaaccagcactttctcttccttaaacattttcccagatttggggtatggctcggttcatttattttctcaaacttacctctaaatctacctctactatgaagactccctagaccaaatggaaatgagccatagatttctactacctctgcccttaaaaacaaaaccaaataatatatattgtgtaattcattttaaagataatctaaacttttgagcacaaaaattgtctctcatgttctgcagaaaatatgtacataataatacattttctatagatattaactccatagaaaatatgttaatgaatcagaatctagattttcgcttgtttctctttcctgtgcaataaaaggatcacaaattcaaatgcctacatgtgtgaagggcacatgtaagacaatagggagcagtacggactacggtaaacaggagaatgcaatcccctctaaaggcattcaaattaaaataataaataagaactttgaaattcttcatagaccaaatttactccacagttttcaaattctacatatagtccagtgaaaactatattttgtcctgcttgtttagaatcataacattttctctctgggtaaccctgtgccttcctcacattgtagatacagtagcagattggcagatctctctttcctttgtgcaccaaatctgtgcacaagactgtagaatcaaaatgggacttggagttctggtttacctaccctctgccccatccacaggggtgctgagcagtggcctgggggtggtggtggcctcagatgaggtagtggcaggcagatcatcagcccacgttggctctggagccttatcatcttcatcctggtctctggtgacactcaactacacaaaaatattcacattttgtgtttctgataatatcaagtaaaaaaaatactagtttgcttttgggaacatataaagactagttcagccatgctgtgtttccctagctctctgatactaactatttcaaataaaactcaggaaataatgcccctcctctgtgtcatgcatccctcaatacccaagttgtggattttcccaccacttggtgtgggtgtatttctgtgtacacacacatatacacacatacacacacacacgcagcccacctccaggcacagatttttgggtgctgggacatccaaagcagatgtgaaagatgcaaagttgagaggagtttattttcattcttagccactgctatgagaaaataaccactcatttctttaacatttttatggcctttctccatttcctaacactagacgtcttaacaatatattccaaaatatttaccatgaactcagtcaattttgagattgggaattagggtagcagaagacaataatacagctgaaataaaaacaatagtggccactttttgattgcttacccaaatctcagctgcagacacctttgcctgctctattatcagaccccagctaataccaaatgctgtaggatgcttaacatataagatgctctaagaaatgtttgatatctaaagaacaaaggatttttgtttcaaaagcaaattttctggactaaaatttccaagtttcatccaaatttatgatatataacgaaacaagaaaggcattttactttttttttaaaaatagtgcctttatagtagaatgatttataatccttgggtatagacccagtaatgggactgctgggtcaaatggtatttctggttctagatccttgaggaattgccacactgtcttccacaatggttgaactaatttacactcccaccaactgtttaaaagtgttcctatttctccacatcctctccagcatctattgtttcctgactttttaatgatcgccattctaactggcatgaaatggtatctcattgtggttttgatctacatttctctaatgaccagtgatgataagcgttttttcatgtttgttggctgcataaatgtcttcttttgagaagtatctgttcatatccttcgcccattttttgatagagttttttcttgtaaatttgtttaagttctagtataaagacacacgcacacatatgtttattgcagcactactcacaatagcaaagacttgaaccaacccaaatgctcatcaatgatagactggataaagaaaatgtggcacatatacaccatggaatactatgcagccataaaaacatgagttcatgtcctttgcagggacatgggtgaagctagaaaccatcattcttagcaaactaacacaggaacagaaaaccaaacaccacatgttctcattcgtaagtgggagttgaacaatgaaaacacatggacacagggaggggaacatcacacaatggggcctgtctgtgggtgggggcctagggcaaggaaagcattaggagaaatacctaaagtagattacaggttgatgggtgcagcaaaccaccatggcacgtgtatacctatgtaacaaacctgcacattctgcacatgtatcccagaacttaaagtataataataaaaaatcatgtcagtcattcttgacaattaccaggagctagacaaatcttttatgggaataattatattcttttgcaaatttttccttggattccagctgtatgcaattgaatcagtcattcacctgagtcctgacacttggttatttatccttgcaagagtttctcttatttgtttgtttgcatttttatttatttaaatagtcaaatctgtgactgagatagttttttatgcttttttacccagggatcctggtatgctgtcatcattaactgccgtctgccagctaagctgttctattgcttttgattttttttgtgtgtgcatgcatacatacacacacaagagggaaaaagtaattagtactattactcatgtatgcgtattttttacagtgattaaattactatcaggtgacttagagcaaagatttttccatttggattggtcattagccctatataaagggcacacaattcaaatacaataggaaattttcactgtcccctaaacacaacttttggtacaagtggagacaaaactgtggattacttgaggttcctctttctttcagaatgatcctgtatgcagatacagcaatttgaatgtgaacttttaaaaataatcattatactagagaatttaaagctagaggaaaactttcttggtcccttattttcttttttattttttatagagatagggtctcgctgtgttgcccaggctggtctcaaactcctggcttcaagtgatcctccacattggcctcctgagctcagcaccgagtcccttattttctactggggggaatacaaagctataaatgattaagaaactttccaaaagttattggtaagctagtgacaaaccttcaggaaaaaaagtactggttttttttgcctgcatgtatttggttttaagcaacaaataaaagtttgaggagtaagtttatcaaacataaaagccaactgacattagtctacacttcagatatacggtctagaaggtgagactgttccattgaagaggcgggctaagcagcacagttttcttcaaagaattaactcagcctttaaatctttaccttgttcaagtcctgagtcctcaaaagttatattttacctcttctaagcttaggaatgtgtgtttccattctcaatcacataatcatttggaaattttgatatctgttaacattactccacagattccaagacaagcaaaattaactttaataaatgaaaataatttcatcaattttctggctcagtgagatgtcagattatttcaacaaatgcataattattacggcttgctatttttataatttccttaccacaaaagcaagcatgttaactgaaaggaattttagaaaatgtggatatcaaaaaaaagaaaacagaaatcagaagtaattctacctcctaaagatagtcattgttggcattcaggtatatttttccctagtcttttttctaggtgcatatccatttttttgttgttgttgttgttacaaaaaaatactgtatgttcagttttctatgctctatgctattttaaaaaatatactatattatgatcattctatatatttcaccatgactctataacatttattattattattttgaagacagagtctcgctctgttgcccagcacgatctcggctcactgcaacctccacctcccagattcaagcagttctcatgcctcagcctcccaagtagctgatattacagaggtgagccaccacgcccagcctcctccacatttttataaccttgtcttccactactcccagaatatctggtcaggacctttcattccttcttcctctctattctgcctcaggctctcaatatcaacccttccaccacagcctaggaaaagttggtctccatccgcaaaaccttctccaataacccagtcagtactgattctccccttctagatgatgcacagtaccttctgactcttctatactcagtgctgattgtgtagaatttaacctttagtcctatcctattgaagagtaacagaatatgcctcccaaaatatgccactttggcacattgattattttgaactgaaggcaattgagaatcagatataagctcatttgtctaaatgcaggacatacattcgtaaaggaatccctcctcagaaaatcagggtaatgactcgagaggagtctagacccttacttagcccagagatacaccagaggactctacataaaaaactattcactaatccttatcttccattaattcacccatatgtttaccttcccaccatctgctgctgtagaaagtcctttcccattgtcgtcactcctctaagctctattgttctttcgttaagatgctatataagaccaagttctaaccacccctttgagctactcatctccatgctcctatgtgtatatgctacatgttaataacttctgtgtgcttttctattgttaatctgtcttttgtcagtctaatttacaaggccttacctagctaataaccctaagatgggtagaggaaaaaaaaatttcctcccctccactatcttgtataatttcttgtttcctatatataaataccacttccctgataaaagaaattatcttttttctttcttttcttctttctctacctctttttttccatagcatagaataggcaaaaagtatccattaaataaattcacaatgggttaatctttctgttacactcgtcttcaggttgaacttaataaggatatgcaaagagcgaaagagaaagagataaatttgcattatttaattcctctagactttaacgtcatcatttttcaaataaaaaaaattaggccctaacatgacttccaactctaaaagttggatttaaccaacacaaacgactggcagaatacacacccaattcacgatagtgattgcctctggagagaggaggaaaaagagctctggagggaaaaagctaggactttatctgaagcaagagtgaatgaacaaatggaaacattggttacttctgggtggtgagtacgcagtcaaatgtttgtttctattcttgttaataaatcttaaatctgaaaacacaagcttgcctgtcaactctgcacatttctactccagccacactggcctgccttggaaaagaaggctagctccagctctaagcagggacaccatagtaaaaggcacaaatgagttgtctagggacacctgagagccgacacctggagtccagggctgctccgtgtagctggacaagcagacgtgttatcaccattctctttcagcctttgagctgatctttaaggggaggaaaacagactcagtgcagtatcccaagaacatgtatgcatgagctaagaaggattgctgaccaggtgccacatccaaaaggtcttttgctttctgatttccaaacattttccttgaatttattacccagaattttgcatatattacaaagtcttcaaatctgaacacatgtctgctctggatgaatgctaatgatcatctgcattagtgtttgtgttaagacttagcatattcccaggagtgtgggtcaaaatttctccaatttggctctggggattctactgccactgggctccacagccagcatcttcaaattgtctggcttctcaggagtccttcttgattgattctccccaagaatcaaacacacttctttgtcaggtctctctgcactcaaatacttaaactgaaggttacttatttgcattttaaagttactggggcctttaggaacaccttgagtttgggctgcacctctctggattcactgtggctttcaaaaagggtgtaatgcaggattttgttctgtttaaacctctcatacattagtgcagtaaaatagcctgcattctggctttacccagtaaacatttttgacagctgtaatcatatacttttagaacaggaagaacattctagtaacattctttaattttacagatgagaaaactgagacctcaggaaaataggtgattcccctaacatcaggcagctatgagatttcatttctaagatgtcattcatcatgagatataccataaattttaaaatagttttgaaaaaagaccacacacattaaatagatgcatcccaatttcagaaataataaaatcgaaaaactacagactttggagtcaagagaatagtccttagcttcagcaatgagaccacaagccaggtttcctgacttccaggtctagaatatttcttctagatcagttaggaatatgtttattatttttgtttttttcctcttccataacacaggtgcatgttatattctgagggtaacaagtctattagaagcaataaataatacttgtacagcaaccttttgtagtgatactaataattagttgttacgcagggttttatgaagaatttgaatgtttttcacgatcacggtgagagaatgctaattttatttttcgctaagaacatattttggtagaaagaagaagaggaaggaaggacagagttaggtgtcttaagggagtgacagaagggacaacagtgaaaaggaagagacaacaaaagggaaatggtacttctgagatcattgtttactagctttgcagtattgcctagggtaggctcaggaaggatctgagaataggaaggttgtaacagattcattttattttaaatgtttggatactgtaattatacttattaaaggtgggtgtgcatgcacagaggcataaatatgttcttgtatgtgtgtatgtatatactatgtgtgtgtgtgtgcgcgcgtgcatgtctgtgcagtcaagtgctgcataatgacattttggtcaaccacacacatacatgacagtggtcccatccgattataatactgtatttttacccttttctatggttagatatgcttatatatatagatacttaccactgtgttacagttccctacagtagtacagtgatatgctgtgcaggtttgtagcctagaagcaataggctaaactatctagcccaggtgtgtagtaggctatactatctagatttgtgtgagtacactctatgatgttcacacaaaaacaaaattggctagcgaaacatttctcagaaagtgtccctgtcattaaacgatgcatgactgcatgtcaaagatttaaatgtgaatagaaatgcacgtttgttcaaactaaatatcaataaggaaataattgtttaaaaattcagttttgcattggtgcttctttaaaaagagccagaatgagaaagcctagagacaagaggcactatccgagaaggtcaagttcattgcaaggtcccactatctgggtcaaagttcccctagagagacctagctgatgttcagtttcccttcatgtggctcttggtgttataaatccagagtattttggttgtatttttcttacgtcctcccctccccagctactagaaagcttcatatgtcctagtctgttaatgtcatttgtctctcaaggccatcaggcttcctgggatgtgatacagagggatctgttcttacttttcctcattacgtgtcataactgccttggatgtccctcaggcacctccactttacatggtgcaaactaaactcactattttcctttaaaaaaaaaaaaaaccaccctgccttttatattctccatctcagtatatagtgtttcaatccatctcatctccatgctagaaacctgacagtcctacccaaacccctccctctccctcacctccaatcctttcaatcactatatcctgttaattctaccctagaaatggcttttcaatctgtgcctcctttttattcccagtgcccctgccttctttcagggcctcattatcattttcctggactatcacgcctcatatctcagcctccagtctcctcacctcctcctcctaggtatgtttcacacagcaatcagggttattctttctgtgaaccaaatatgactatatgattcttgcttttaaaactcctctgctgtctctgcctgcctggcctatagatgaagttcaagctccttgccttaatacattaagacatttataattagtccttaaattacctgtccagctttagctctcatcactctgccacccacaccctaggctacaattagactgaatttgttcaactttcttgaaatgccatggcactttaaagactccctttgcctactgttttttttgttttttgctaggaatacccttccccctgctcttctcttgaaaaactcctagttattcttaaaacttgactcaatgtcacctcctctgtgatgccttatgtaatgaactaaatgtttatgtccctccaaaaatcatacattgaaacctgaatccccagtgtgatggtatttgaaggtggggactttgggaggtgattaggtcatgagggtggagcctttatgaatgggatcaatacccttataagaagtgatgtgagagatgagctgtctctcagccatgtgaagacataacgagaaggtggctgttcacaagccagaaagcaagccctcaccaaacaccagattttagacttcccaacctccagaactgtgaaaaataaatatttgttgtttaagccactcagtctatggtatttttgttatggcagccccaacagactaagacactttcccattactcttccctgaaattaattgcatcatctctgtgcttccttcatagctctggctaaaattcataatgcatcttgtacttacctatctccctgaaaaaatgtgagcttctctcaggcaggagccatgtcttaagagccacaccatctatcacagcagttaataatcaatacatgctattggaattcattggtattaatatagcaaaaaatgtgattcagtgattataaggagggctcagtttaagcatcaattcctggatgaaacctgagcttgctcttgtttaggaaggctttagaaagggatgttgattgactaggagagggacaaagtggtaagtcacacaaacaggagaggccccagtagcggtccatgctcaggaggagatagactgtgtccattattgtctggaatttactttaaaatgcacaatatagatcagggttggcaaaccactgtgggccaaatctgagtcactatctgttcttgtgagtaagtttcatcagaacttattcatactcattcatttaagtattatctatggctatgtttctacttcaaacgcagagctgagtaattggaacagaaatcaaattacctgaaaatccaaaactattcagtatatggccctttacagggtttgctgacacctggtatagaccatggagtataaatgtttgtgttaatttcaatctgcaatttagtagaatctattgccctgactggaattacccattttgcagttggttactatttaatcaaatagaaatatgttagaggcctttctgcacttttgtgaacaggatacgagaatctagtgagttctatagcctgtgcccttaggaatggtatcctaggcctgattcctgaatggccctgagtccaactactgatccgaatgttccttagggccttagtctaagtagactgttagctgaatcctgatgttagaacactgttgcacatgctcatgatcactctttcatgtacatgaaggcttcagaaaagggcaatgcaaggactttactgagcttacagaacaggggcatgactgttatgtgcctgcttgccagaggatgtccatggggttaatagaaatgggtctagacttgcccaagttgcaacttggtggagaagagactatagcactcatcggtaactaaaaaaggctcccccattttctccttaaaaaaactaatatttgcccataatctgattggctgaagtcagttcccagaagcttgctatgaggacagtcacatttgtttcaattgattcaggaggtggttcttcacatactatgtgattgaggagctctgaaacagagcatctactttgcaccatatgcatatatagcctccctcacagtcctcactcagagcacaggaggtggaagccaaatgagcaaacacatggcttggagtgtgggagagtggccagttgggcatatgcgtatttagaaaagacatgagagggtacaaagtgggaagcagatgcacagacgaagagggagagttgtggcctggtatgaaaggcactgcacagcatggcaactaggtgaattcagagtgttgtgttaatctgtttcagcatacatggttactttgatggtaataggagtataatataaaaatattatcagcaacatttaataaatacttataaaatatgcaagtttttaaaaatatcctacaaaacctaatgctatttcagaactggaaatctagagtcaagatactaacatttagagccaaggacctaaaaatacacgtgcctcagctgattcttgacaatgcagggcagaatgatctttgatatgaaacagagagaatacaccattttaagctcacaaagtaagtgagacagttacttactgactcagaaatttctttttgaggctctggagtagattcactgagttcttcccctgacatcccaaatccaggttgaggtgacgatgaaccaaaaatttgaacgagataggaatcaaaatcctcacaaattttttgaaacaatttttgcttcagggtgtcttttaaaaaagaagtagaaaagagagatagtagaagcaatgaaacaatacttaaaactcatttaaaaagatctgcactctccttaaaatatgtaatttcccattacttgaaatcaactgctaagttaacgaacttataaaagcatttttacatcctgtgtaagaggtcatctaaaataatatatatgacacaaagaggcaaaagaatgacttgaatgtatgttcatccaaagtgtctctgttcaacgtgaatcactccttgtcaagagctagcctcacccataataagttgaattggcagctacctctggttttaaggagagcaaatggccagccagttgcaaatattctttacaggctgtaacaaattactaactccagatataatgataaagctcttcaaggattaaaatataagttggctctgaaatgtctttggctattctgacacattcacagctgggtgagattgaatatatcagataaacaaacccaccagtcagccagcagggtactgatgaagtagaaccctaggttagaaagctctggagaaggtgagaaatagcaaaaaagtttctgagaatggtatgctttccttagggccagtgtgctggtacacggcataggcagggcatgaggcactgatgggctgtgcccagccacatcagactccactcccaggtgggtgaaggaggaaggatgaagccaaactgaagcctttcacttacttcacaaacttgccaggtacaggcctgccagaatgaataatcggtttccaaagaattgggataaattttattataaagtcatactgaccataatttaatcatagcttaaattagatcaatgtcctaggatggctcattagtaaatatcagttaatgtgaaaggataaacttagcatagagaagcccatcagattagcactggctgtacaataaattctatttattttttatttattttttgagacagagtctcgctctgtcgcccaggctggagtgcagtggtacaatctcggctcactgtaacctccgcctcccaggttccagcaattcttccgcctcagcttcccgggtagctgggactacaggcacacgccaccatgcccagctaatttttgtatttttagtagagacgaggtttcaccatgctggccaggctggtctctaactcctgacctcgtgatccactgtgcctggcattgtacaatgaattttaaaaggttgttctttggctgggcacggtggctcatgcctgtaatcccagcactttgggaggccgaggcgggtggatcatgaggtcaggagatcgaaaccatcctggctaacacagtgaaaccctatctatactaaaaatacaaaaaattagccgggcatggtggcgcgtgcctgtagtcccagctacttgggaggctgaggcaggagaatcacttgaacccgggaagcagaggttgcagtgagctgagatcacaccacagcactccagcatggtgacagagtgagactccgtctcaaaataaataaataaataaataaataaataaataaataaataaatggttgttcttttgagataaattcccgatatcaacctgtttattcatcattatctgctttcataaaaacagagaatagaacatcccctctaattaatcccagttacttgcatttctcatctctttagatgaccataacttttttttcattcagcaggtacttcttaattcattttgatttcctgactgttttctgccttgctgttggcttgctcgatcccttattttagttaggtaactttctgaacattaaccaatgttagcaatactcccaagtcctattctttctctccattcctgtctgttgaccatggactctagttaactccaaggccaactcagcatttattaacccttaataaagacaagggattgtaccctccaaactgaatgatattaaacatttttaatcttctggagtttacgtgttaccatttaatgttggcataagccttattagcctccagatttttctatttggtcaggacaaaccagtgatatggtacttagaggaacaacataaatgcctttcccctgggccagatagccttccttaccttgcagggtaaagaaatcatcaaactggtaaacatgctctgggtcagtagcaattagattcatttctttgtggaatatttcaaagttgggatcatttttcttcaccacccctatcacaaatatctccacattggtgtcactggcattcttcaccacctctgtcagtttctctttatcacgagaatctgtctgtccatcagtgatgaccaaggccactttttttacacctggccttgcatcttcaaacatgtcgttggctgcttgcagagcagtggctgtgtatgtgccttcccccagatactgcatgttgtccacagccaacttgaagtcatccttgctggagaactgcttcaaattagccaccttctccaccttatggctatagttgattatgcctatgcgggccgtggcaaggtccagagcaacccggtcagccatagtcttcacaaaatttttaatgatctgaaagttctctggccccacgctttctgagctgtcgatcacaaacaccagctctagtggagtctctttgcatttgggcccacaacctaaaagatgaatgttgagagagaaaaattgtgggaatgattgacatcagattgttgaggggaggggagaaaaagtcaatgatgaacctgagacctaaactattctcttccttttctgtgattgtgaaaatacctgacagctgtctccattctggtttctttttttttttgtgagacagagtctcgctgtcgcccaggttggagtgcagtggcgcgatctcggctcactgcaggctccgtcccctgggattcacgccattctccagcctcagcctcccgagtagctgggactacaggcgcccgccacctcgcctggctaattttttgtatttttagtagagacagggtttcaccgtgttagccaagatggtctcgatctcctgacctcgtgatatgcccgcctcggcctcccaaagtgctgggattacaggcgtgagccaccgcgcccggccccttctggtttctatacttgactcttaaaaaaaaaaaaaaatatatatatatatatatatatacttggaaaaacaccgtagttgataaaataataaatacttatgtgctcgtttcttggattataaaataaaatatttttaaaagagttaggatgccctgtggatgccgtcccaataacattcctcttcctctcccagagaggtaaccaccatctgacatttgctctttatcatcccaccattgtatttaatctgaatctgaaagctgatatttcagtcttcaaccatagccttatgtgaaaattgaaatttgctcaccaggctggccaatggatgaagtaatgggatgaaaaattgtcattgtggtagaaggattgggaccttaaatgtacacaggaacagctatccctaactactctagttgatgtctccagtcacccacaatgacaactatggcagctttcacgttatcaaggaggccagcagtacatccatgctatgaaagcttttgaggggagtaatccccgagaacactagtcaatttaaaaaaaccttccatttaggttgataaacaaccacttaaagcagttgccagagtcatcaggaaatataaattatcaggattctgtttctttattcatatcttcctgttgttcaacaagcctgccacagaaaaccatcaggaaatcatgtgctatttttatagggcttctagaacccagaagccatgtctagattggtctctcactagagagactcccaggctgcttcttaggcccagcagtcttttagggaataagctggttctgggattctctgtatagaaggacaatatgcctgcctctgaccactttaaacccagaagattctcccatcattattccattagtctcttgtcttttggctaatttctttacttcctctttctggtaattctaagtctaccattcagtcatggaagcatttagtagttgtgaagcaaggtgaatacctgactctgtcctcccacctttgggactgagtacaactcaaaactctactcagaaagaattcatggcttcgggaaaaacacagacattctaatcaccagctaggctggactcaaataccagtttggctcttgtagtcatatttcctttgttgagtttttcgtctcagctcaggtaaatgtcactgaatacaaacgagcactgtgctaacaaaaggcccggctgcctacataccctaggctggcaccttcacatgccttaaccagcctgggaagatgattttatttccttacatcaggattcccacagtctctcttactgcttcctttcagtttccatcgacttttcaaatgagcttcacattttcccgctagctatataatatacatctggacgaacacattctgtcaccagcacagtacatagtggggctgatgctttaaagtgatgttttttccttgatcaaatcttaccacatatttctgtaataagtttgataatttcttctttctaggggataaaaagaaaaatgtattactatatgtatgactataatatttttcctagagccataaaagatatctcattacaatcagcactggaccatttgatttaatccttccactgcagaaaataaaataaacaacacagaagtcaaaagctgactataatagaccataactaaaatgcgtttgagctgtgaaacttaacagctgagacttttggaattcaaattgcaactgcagcatttatcagctgtgtgacctcgggcatttggtgccctaacagtatctgtgtctcagggctatggtatggattaatcaatgttatgcacacattagcacagggtctggcaactttaacatacctacggtgctgtggtgctatatatacattcagttatacaatttaaaccacatgtgctgagcaaccaagacaagccgcaatgcctacagagaattcattctatgctgtattttctcttctttttctgtactagttcctgatttttcaagtcctctcttcagcttcttaacaccctcactttggctcttctgtgacatttccccatgttcctgaacgcccttttcttgtcctgctgcccacaagctccatcagaagggcctgaaatgagctgggtactagaaataaagctgccaatgcccttccctgtgcagtgtgtttataagtaactacaatgagactagagaaggcaggattccacatttgccaaacacttaaagctaaaagagatgattaacagaagcctagatctcaacaggaaggaccagtggacccaatctaagaaaataaagtttaacaggtgcaaaagtaaaatttttaagaacaaatctataatgtcaaatcgaggtggaggtgatgtagcctgtaacatggcttaaaagtagaatatgtggggaatattcatagtattttaatttaactttttaaactgtaaactaagtaaaagctaacgattccaagtggctatttaaaaagaacatctactgcagtgctgagttatataatacaattctacaaaatgagagtcaacagtcttctttttttctaggccttgtcatgcttttccgcatttaaaaaggcatttaaaaaaatccgaaacaagaacatgtacagaaaggtaaaatgtatgtatttatatatttatattaagtatatctagaaaggggaaatatatgtatttatatatttatgtttaattttttataaacggagaaaatacaccaagttttatggttataatttgtcacctaatactatattataattcattttccacattattaaggattctgaaaaacttgattactgaaattgaatgtgcggccatttaaaggctctgcgatacacactctcacactgtactttagaaaagttgtgctaactgacacctccaacagcagtatataagaaaatctgttttattttagccacacaatactggctattattattatatcatcactgtcaattggtagagcaaaatctctcattgttttaaattacacgaattaaattattcatgaggctacatttcatttcatatgcatgtttccaggttgtattctcttgtgcaatctgtgtatgttctttgtcttatctttttctatgggaatatttgctttttattcacttataagagcaatgcatgtatcaaggttagattttaattttgcaacatattttgtggcataatcaggtttaaaatgcttgaagttaccatatatgtaaattttttcttcatgttctttgcatttaagtgactggaagagttcattccttccactgaaatcactgaataactaccttggctacttggtgccaatgatgaaggcatcatatttatacccctcaaaggattcacagtccaggaagaagcagacaaacgaagactttcataagtgctatggagagccaaggaaccatctcgatctgctgggaattcctggggcaggaaactgaggatgggactgtggtccaaggaggcagactctgaccaggctgggacagggaaggggagcgttcaggcaaggtggtcggccttctgtcagagcatactgcattacagtactcgagtaaacttatgaattagggcacatagcagaaacaatgacaagaaatgttggagacagatggactcttgaagacctttgtgtcatgttgaagagtgtgaactttctcctgggcagtgggactcacatgatccctaggcagagaagagctctggtggaacttttatttaagagagatgatcatagcagccagtggaggggtttgaggttcctcaataattcacgcaaaaaaaaaaaaaaaaccagacatcagaaggctgtggtagtagtaatggatgaggaggacaggcctggagggacattccagaagaagaatgaggggcttggtgaataactggaagaaacgatgagggaaagaaggagtctaagaggaggcaaatgacagtggggccatactctgagagaggcaggagtgggataggggcaggttgggagctcatgaagatgactgagcccagcttgagtctggctgagtctcatacgtctataagacatccacctagagatgtccacgggcagccaaggatgtaagatctggcgcttgggagaattgtccgggcaggaggcagatttaagaaatgccaatgtacagttggctgttaaaacagggactaaaagtaagattgcctagaacagggctgctcagcctttttgaaaccggtgtgtttctccttccccacatttgataaacacattctttctgcttaaaataaaaacactattttttcattcactatatgctttcactgtactatagaattagccttttcaaactatatgtccccctgcctttagtggctacattccctgagagtttgaagacagggaagactggggccagacaccgggaaatgctaacaccgaagtgacatgtggagaaacagagtcttttcaaataattttatgagatgtattaaaacatttagtgccatcaatggcatttgcctcttaaaagaggagtttgttagtctgaaatgaatctgcacaattgatagctattgggggatacattcgatcacagaaaggataagagggggagaggaaagaggccttctgagaacagctttcatgggggagcagcctgaacttggtatcagacaggccacctctagctataagggctctgctacgtgccagctagatgactttgggcgtaatgtccaacctgacttgtgtgtctccatttgatgtggagatactgtctacctcatggagctgtcatgcagattaaaggtgggatcttaggtaagagaaggttatggccatcagcctgtcaccgtcttcttgtaccacaacccactagtcctacactgcatgggggtttggccagcattcatgctgtgaaccagtcctcatttccaagctctgtccaaatcccctgaaaccacctgctgtttggccacttcttggctgggcccatgcatccaggccagtgcttcagctctccaaacctgtggccatttcaactgagaattctggaattgcatgcatccagagtgtggcatagaggaacatatgtgcatgccctttggccccaaggacttctaacctggaggaaggagcgcagctggagaaggacgagggttccagagcgggggcctctaaaacaccctgcagtactaggtaaggagcctaacatgtactgatgtacaggagcctaacacagagcctgtcacacactaaattctcacttaatgcaaattctcttttccttcactcttctcgtcttgctagtctcttcttccagaatctagaaaaccaaagtcagcagaatgatgtccctacttctaaggtctctgcctcttggttgaaaagcttccactcaagagataaagcctatcctgccctcaaacaccatcatacaccattttgtctgctctggaccccgagaccacatcttctatcatagcatttatcactccgtaggtgaacatctttgttgtctttctctccaccaggctgtgagctctctcagttccaagaagtagcctcactctccactatttccccagtgcctattttggagcctgatccagagtaaggtttactggatacatccaataaaggttggtgaaatgaatgaatgaataaatgaatggagaaaggaaaccagtccctctccccacgttgggacagtagggcaggtataaacctacagggaacgttcctctgctcatttacatacactctcccctgctacttttggggagaaattgtgcatatgtagctacttcatctactatgggcatctttcggggtctgacttgtggtggggaacaacaaagagaaaaaggcagacagcccgcagaacacatgtgcagttctgttggtcacatgcccagctctcagctcttgccttcaccacctgaactgccactccctcacacttggatgttcctagtacatcgaatcagccccgctagaccacaaccctggaaaagtctaacaggaaaaaaggaaaaggtctgtgattttcctcaaccccagaagacagattgccttcaaagcagaaaggaagaatgagactttgccttccactcatgagactttaaagagtcagttttctgttcttaatggtgtggggagaagaacagggaaacgtttatagatgctcagaaaatacttattgaataattgaatcaatatataactataatctcaattttgtgattgctgctcttctcagagcacttctaaaggaactagttcaggaaaaaagagtcctcattctaaaatgagacgaaccacataaattaaagtcatttggtaatctggcttttttgaaacagctcacctccttgttggccagtaacagcagtgtgatcatttctaccaagcatccgagtggagtagtcacacacacccaccacaaggcaggacaaggttttatctctcccctcatagtcagattcaattacctcatgcatctaagccaacactgggctggtagtagttgatctcatttaaatagaaactgggattctgcatccaaaaaattcataattctaaagctaaagcatgaatgcaacaattttgcaagcacaaaaccctcaattaccctctagaatggatactcactgtaagtcctaggtctcctttgggtccttgtaaaccctacttagtggaagaagagtaaaagtcaatataggttggaaccagttagagtataaaatcacagtgagacattaaaaactacttgcctgttttcctggagatccaggctctccaatttctcctttatcacctttctttcccacatcgccccgttctccgtgctctccctttacacaatagggtaaaatgataggttcagaatgtgaatctaaaagccagataagaaaagctctataatttggttatctgcaactggcatctcttgaagaccttcagttcttgtttatacaaatgcagtatttgaaaaaaaattgggggtaacttatttacatcccatcagataccataatctaattcatgatgaaccagaggtctcagagtgaagagaccttgagatataataccatctaatcggctcacctttcaggacatacaattattacacaatttaccgggtacctgagttatctggtatctcctacatggtatgttgtaagtatgttgtaagataactaataaatcctttattagttatcttctgagaataaagaaaatgagatttttttaaacatagagatgggatctcactatattgctcaagctggtcttgaactcctggcctcaagcaatccccctacctgaagctctcaaagaaaaggacattttataaagtgaacctatttataggtagacaaagcaatgcacgaggattttattttgagtggattgtttttcttctgagagttgtaaggggaagagtgacacatatatgagagttcttccaaagttaaagttaagctattgcgatcctaagcctaagcatttctctaagatcctgagacacttaccttctggcctgggaggccatggcccattgtgccctttgggcctgggaagccttgtggtccttgttccccctacataggatatgagaaagagatgttctattaatttcccaggatagcttggctattctttgggtcagaaacacacttacggtttaaaactgcattatagtattatctaaatattaggggaaatatatatatatatgtatataaatacatatgtgtatgtgtgtatgtgtatggctcaatggtttgctagtaagtgtttaacaactaagactaggataggagtgagggctctgatttatgccatttgcctatttctgtggtgtaaatactttcactgtggctaattcaagctatgaacacatcaaccagttcacacataacagatagctgctatttcagctatggtagtaaaggtgggttccatcttctttacatttttccatgttttctggtatgttaaaaaacacatgttattggctgggcacggtggctcatgcctgtaatcccagcactttgggaggctgaggcaggtggatcacctgaggtcatgagtttgagaccagcctggccaacatggcgaaatcctgtctctactgaaaacacaaaaattagctgggcatggtggtgcgcacctgtagtcccagctatgcaggcgggtgaggcagaagaattgcttgaacccaggaggcagaggttgcaataagctgagattgcaccactgcactccagcctgggcaacaagaatgaaactctatctcaaaaaaaaaaacagaaaaaaaatgtcattttagtaacggggaaaagagtatataacagcatccatccacaattaatgccaagttattgtttatgtaattccctttatactgttagttccatctctcataatttgtagcaacattcaggacttgtttccagatttctccatcacattttaacattatttcttgccccacccaaaccacacagtttccaaggggtttcatggtgttgagcatgaaacagaaacaatcactagcaagtatacaaagtcatagttctaatgctccttggatcttatactcaatccttatttgactctggataattattagtaatgagtctctggcaaaggcttgaaggaccacgggctcctcgggattgatctgtggttttcaaaactatcctgatcatccccaccaagatcattggcatgcttgataaaaattgcatctcccaggcccaacctcaaaccaactaaatgagaatcacaggtgaaggtaaaggcaaaatatgcattttgccataagtctgctaaagcttgagagccactactccaggaggcatgatgggatttacgaggcactcctggaaggggccacagaggtttgcttggagaccattacaactttgggcacctcaacatccctaagcctcctttaccttgttcattggctgtcaagctgtttcaaatcaaaagggcctattctcttttaaattgttataatgaaatatttcaaaacaaaaatcatatagaataaagtaaacacctatctaccacgttaaaaaataaaacagatacaattcaaacctcttaggtactcatccccaatcctatttctctgagagaaaaaatctctatctgaaattcatatttatcattcatatccatgtttttatgctttaactacatttcaaaataatacatcttttttttgttgtgtgtgtgtgtgtgtgtgtgtgtgtgtgtgtgtgtgttttttttgagacagagtctcactctgtcaaccaggttggagtgcagtggtgtgatctcagttcactgcagtccccacctctcaagttcaagcgattctcctgcctcagcctcctgagtagctgggattacaggtgtgtgccactatgcctggctaatttttgtatttttagtagagacagggtttcaccatgttggccagtctggtctcaaactcctgaccttaggtgattcacctgcctcggcctcctaaagtgctgggattacaggcatgagccaccacacctggctgatatttttaatattttaaatttccaataaatgatatatttatgcatccaattttttaaaaaaacctcaatattatctatttgaaatttgtgtgtgtgtgtgtgtatatatatatatatatatatgtatatgagattctaatttgttgatcgtctctctgctataaagtatttcattaaataactgaatacaacttatccattagccttctgatgcacatttaggttatttccaatatttctgtattaaaaataatattttaagaatatccttttatatgcctttgcacacttgtatacattcctaggaggaaactcttacatcgaaacaaatattatataaaatggtacaaaataaaatgaacacagcacagattctctgaagctgaactaaagggctccatttttcacacacccatccctaacctctcacggcacattggcttgactgaactctaaggttctttttattctcttacatgtgtttctaaactgtttgtaggtatggtgttatggtattgcctccccagttcaacaccagaggacttaaaataagttctttacaggggtgagattacagagaacttaattcactgaatgtcttttcactttggtatctcttgagccaaacccagtgcagtaacatactgggcccactggaaatgggtatgcagtgttgcactacaatgtcttgggcccacctaaggaggctcacccagaagaggagtgcttcctctgttagttgcttagagggaacaagtagggatgattggtcttctttattcagtttaaagtcagaatagaatacagtagtccccctttatctgtactttcatttcccatggttacacttacccacagtcaactgtggttggaaaataagtgagtatagtacagtaagatattttgagagagaccacattcacataactttgatgacagtatattgcttatagttgttctattttattatgtgtttgttaatctcctactgtgcctaattttaaattaggccttattataggtatgtgtatatagaaaaaacatagcatatttagggtttggtagtatccaaggtttcaagcatccactgggaatatcggaacatatctcctgcagataaggagggactactgtaatcttttcccaccaggaaacttgatatcattgggagccccagaaccctggataggaatttgtaccagttaaataaaccctaaacattaaactgacactggcattccaagatgaaaattcaatcaaaaaaaaggagaggagaaaaatttgtcctgtttccaaagatggcactcccaacataggtgtcatgaagatgaataggtgggaaagtgtagataacacagaacagcctcatgaggctccctgcaaaacatgctctaataggagtggatctgcagcctgcttctgaacatgaaggttagtggggtctgcctacatacagactagcagccagcccccagagtgatatgcaggactgcaggcagctacctgcctgaggttataccatcttcttctgttcaaatcaaaaggaaaacaaacgcaaatagtataggaacgatatctcttaagaaagatgtcttggtaaatcacactttggtataaatttgttttctcagattttttgtggaggtgaatgaggacattttcattcaatgaggtacctggtagaaggtttgggttgcaagggagatgcgtcagaccgctgtacctaagttagggggtacagttggccagggataagacagactaaaggctcatgggagaacactaagaggaaatccatggttggctttgtctcagcctgaaaggacagaacagtgtgataaacagaggagctgagactgtggtgtgatggtgaattatcgctaggagttatatgtttagacaaagtgaatccagaaagaatgccatacctttctgacaattactcagaataattatttcttttgcaatatttcagattcctccagaagatgtccaatacatgttcatgactaactagctgcctttaagaaatgacacaatttcctaatatagctaaaacctactgttgtaaggggaagcatgacacgtgcctgagggaaaaaacattagagtagcaaattatcttgttagggtaatgttcaggaacttcttttgcattacttcacaatgtaagtattttctatataactgttaacactatagatattccaggcagctagatttccctataataaaggcaattcattttctttttaatcactagtttcccttcaaaatacttaaaggcttcctataactttcagagtagactatctagctaaaagcctttagcaagtaaatccatgtctgatcttggcagaggtgaatgctatccaatcagacttttcaatgtataagtctcaggaaaatgataaacaatgatttgagtgtgggtcagaaacaactgcaggaaacaacctattttattggaagctataattaaatctaaatttcaaaccctggttaatcactatatcaccacattagatgggtcctgataaagaagtgatcattttcatttttcagatgactgcttgttctctgggagagaaatttctaagaataatgcacatctacctgaatgtttccattgatttatttgtgcattactgatacgtcaggaaacaatgatttttctttcgaaatgttttctcagtaaggtgtggtaagaaaaaaatcaaatttatagatgatcataaaatgtaaaatggacatctggcttctgccagtgtgtagaaaagtggaaaaaaatgctactctcattcttaaagccccaacaacaaaaaatgagaactaatctgtgaagtcacagcttttcttgaatccatcatagagctgtggttgcagggcatcccgccaattcagcatctaaggaaagtcaagatccttcaaggagacacaggcttggaaattcacctacctggtggaggtgccacatgttatacaagctggtgagaatttagctaaaatttttaacaggatgctaaaggctgagtgtgggatagcaggaggggataggacccctgggagctgcaggcacaagagaaaatcacagctactcacagactcttctcagggactttgctggtgctcaagagaaagactggggccaggactagggtcaggagtaggcttcccttgtggtgctagcctgggaagggaagcacaggtcccacaggtcgcagtctgtttgtgctgctataacaaaataccatagactgggtggcttataaacaacagcagattatctctcacagttctggaggctagaaagcccacgatcaaggaattggcaaattcagtgtctggtgagggtccatttcctggttcataggtggcaccttcttgccgtgtcctcacatggtggaagggacaagacagctccctggggcctcctttataagggtgctaatcccattcctgaggacagaggtgacctaatcaccaccccaaggccccacttcctaacgccatcgacttgggggttaaaatttcaacatatgaatgtggggaccatatgaattttcagaccacattctgtttccttttgaaggaaacagaataaaccttgcaagaatgaatcctgggcccagatctttagagatgccctactatttgtggagggtcaggaaaccacgcccagaccattagatgcctcctcgtacgggtttgctggaacacataaaactgcatactaaaaagagtaaattttactgcatataaataatcctttactaaagaataaaacaatactttaaaaagttaaaaagaattagataaacacttggcaaaatttaaatgagttctatagattaaatagtattatatcaataattttctgatgtttattattgtactgtgttatataagagaatgtgcttgtttgtagcaaaaatactgatgtattaggagtaaatgggtaccaaatctgaattttactctcaagcgttgcagaaaaataatatgacacagacatatatatatatatgcaaagtgatatagcaaatgtggtaatattaacatttatagaatctgggtaaaggatatataaaaattctttgtattatctttgcaactttttttgcaagtctgaaattatttcaaaataaaagttaaacattaatacataaaatgaatgcatgaataaacgtaccaagtggttgcaaaaagatgtcagctatcactgctgcagcggctaaagcatatgagtatacaggtactttgcctactcaaagtttgggagcccaaaggctaaaagaaaatcaaaagacctaaaacaaagctgcaggtgtggatttctccctacgcagaaacagcttctgctgtttgaattcaggaggcttctactgttaccagaagcctctatacttccctaggatttgtattcataccaatttcagttcaatttttttaaattataatttctggggtacatgtgcagaacatggtttgttacataggtatgcatgtgtcacggtggttagctgaacccatcaacccatcatctacgttagacatttctcctaatgctatccctcccctagccccccaccccatgacaggccttggtgtgtgatgttcccctccctgtacccatgtgttctcatttttcaactcccagttatgagtgagaacatgcagtgttcagtttcctgttcttatgttagtttgctaagaatgatggtttccagcttcatccatgtctctgcaaaggacatgaactcatccttttttatggctgcatagtattccatggtgtatattgccacttttctttatccagtccatcattaacgggcatttgggttggttccatgcctttgctattgtgaacagcgccgcgataaacatgtgggtgcatgtgtctttatagaatgatttataatcccttgggtatatacccagtaatgggattgctgggtcaaatggtatttctggttctagatccttgaggaatcgccacactgtcttccacatggttgaactaatttacactcccaccaacactgtaaaagcattcctatttctccacatcctctccagcatctgtagttttctgactttttaatgatcgccattctaactggtgtgagatggtatctcattgtggttttgattggcatttctctaatgacagtgatgatgagctttttttcacgtttgctgactacatatatgtcttcttttgagaagtgtctgttcatatccttcacccactttttgatggggttgtttttttcttgtaaatttaagttctttgtagattctggatattagccctttgtcagatggatagatagcaaaaattttctcccattctgtaggttgcctgttcactctgatgatagtttcttttgctgtgcagaagctctttagtttattagatcccatttgtcaattttggctttggtcgccattgcttttggtattttagtcatgaagcctttgcccatgcctatgtcctgaatggtattgcctaggttttcttctagggtttttttttaaggttttaggtcttacttaagtctttaatccatcttgagttaatttttgtataaagtgtaaggaaggggtccagtttcattttctgcatatgactagccagttttcccaacaccatttattaaataggaaatcctttcctcattgcttgtttttgtcaggtttgtcaaagaccagatggttgtagatgtatagtgttatttctgaggcttctgttctgttccactggtcaacatatctgttttggtaccaataccatgctgtttgggttactgtagcctcattgtatagtttgaagtcaggtagcgtaatccctccagctttgtcctttttgcttaagattgtcttggttatgtgagctcttttttgattccataagatatttaaagtagatttttctaaatctgtgatggaagtcaatagtagcttgatagggattgcattgaatctataaattactttgggcagtatgaccattttcacaatattgattcttcctgtccatgagcatggagtgcttttccatttgtttgtgtcttctcttatttccttgagcagtggtttgtagttctccttgaagaggtcctttacatcccttgtaagttgtattcctaggtattttattctctttgtagcaattgtgaatgggagttcactcatgatttggctctgtttgtttgttattggtgtataagaatgcttgtgatttttgcacattgatttcgtatcctgagactttgctgaagttgcttatcagcttaaggagattttgggctgagacaatagtgttttctaaatatacaaccacgtcatctgtagggacaatttgatttcctctcttcctatttgaataccctttatttctttctcttgactgattgccttggccagaacttccaatactatgttgaataggaatggtgagagagggcatccctatcttgtgccaaatttcaacgggaatgcttccagtttttgcccattccacatgatactggctttgggtttgtcataaatagctcttattattttgagatatgatccatcaatacctagtttattgagagtttttagcatgaagggatgttgaattttgtcaaaggccttttctgcatctattgagacaatcatgtggtttttgtcattggttctgtttaggtggtggattatgttacttgatttgcgtatgttgaaccagccttgcatcccagggatgaagccaacttgatcgtggtggttaagctttttgatgtgctgctggattcagtttgccagtattttattgagaatttttgcattgatgttcatcaggaatattggcctgaaattttctctttttgttgggtctctgccaggttttcatatcaggataatgccggcctcataaaatgagttagggaggagtccctctttttctatggtttggaatagtttcagaagacatggtaccagctcctctttgtacctctgttagaattcggctgtgaatctgtctggtcttgggctttttttgcttggtaggctattaattactgcctcaatttcagaacttgttttggtctgttcgaggattcaacttcttcctggtttgggcttggaagtgtgtatgtgtccaggaacttatccatttcttctagattttctagtttatttgcatagaggtatttatagtattctctgatggtagttggtatttctgtgggatcagcagtgatatcccctttatcattttttattgcatctatttgattcttctctcttttattggtccagctagtggtctattgtgttgatcttttcaaccagctcctggattcactgattttttgaagagtctttttgtgtctttatctccttcagttctgctctgatcttagttatttcttgtcttcttctagcttttgaatttgtttggtcttgtttctctagttctttagttgcgatgttagggtgtcgattttaaatctttcccactttctcttgtgggcatttcgtgctataaatttccctctaaacactgctttagctgtggctcagagattctggtaccttgtatctttgttctccttggtttcaaagaacttatttatctctgccttaatttcgttatttacccagtagtcattcagcagcaggttgttcagtttccatgtagatgtgcggttttgagtgagtttcttaatcctgagttctaatttgatttcactgtggtctgagagattgtttgttatgatttccattcttttgcatttgctgaggagtgttttacttccaattatgtgctcaattttagaataagggtgatgtagtgctgagaagaatgcatattctgctgatttggggtggaaggttctgtagatgtctattaggtccagctggtccagagctgagttcatgtccaaaatatccttgttaattttctgtctcgttaatctgtgtaatattgacagtgctgtgtaaaagtctcccactattattgtgtgggaatctaagtctctttgtaggtctctaagaagttgctttataaatgtgggtgctcctgtattgggtgcctatatatttaggttagctcttcatgttgcattgatccctttaccattatgtaatgcccttctttgtcttttttgatctttgttgatttaaagtctgttttatcagagactaggattgcaacccctgctttttttttttttttttttgctttccatttgcttgataaatatccctccacctctttattttgagcctatgtgtgtccttgcacatgagatgggtctcctgaatacaacacactgatgggtcttgacttgttatttaatttgccagtctgtgtcttttaattggggcatttagcccgtttacagttaatattgttatgtatgaatttgatccggtcattatgatgttagctggttattttgctcattagttgatgcaatttcttcagtgtcaatggtctttagaatttggtatgtttctggcattggctggtgctggttgttcctttccatgtttagtgctcccttcaggagctcttgtaaggcaggcccagtggtgacaaaatctctcagcatttgtttgtctgtaaaggattttatttctccttcacttgtgaagcttagtttggctggatatgaaattctgggttgaaaattcttttaagaatgttgaatattggctcccactctcttctggcttgtagggtttctgcagagagatctgctgttagtctgatgtgcttccctttgtgggtaacctgacctttctctctggctgcccttaacattttttccttcatttcaaccttggtgaatctgactattatgtgccttggggttgctcttctcgaggagtatctttgtggtggtctctgtaatttctgaatttgaatgttgtcctgtcttgctaggttggggaagttctcctggataatatcctaaagagtattttccaacttggttccattctcaatgtcactttcaggtacaccaatcaaacgtaggtttggtcttttcacatagtcccatatttcttggaggctttgttggttccttttcattcttttttctctaatcttgtcttcatgctttatttcattaagttgatcttcaatctctgatatcctttcttccacttgattgatttggctattgatacttgtgtatgcttcacgaagttctcgtgctgtgtttttcagctccatcaggtcatttatgttcttctctaagctagttattctagttagcaattcctctaaccttttttcaaggttcttagcttccttgcattgggttacaacatgctcctttagctcagaggagtttggtattactcaccttctgaagcctacttctgtcaattcgttaaattcattctcgatcagttttgttcccttgctggcgaggagttgtgatcctttggaggagaagaggcgttctggctttttgtgcttgtttttcctcatcttcatggatttatctacctttgttctttgatgttggtgatcttcagatggggtttctgagtggatgtccttttgttgatgttgatgctattactttctgtttgttagttttccttctaacagtctggcccctctgctgcaggtctgctggagtttgctggacgtccactccagaccctgtttgcctgggcattaccagtggaggctgcagaacagcaaagactgccacctgttcaatcctctggaagcttcgtcccagacgggtacccaccagatgccagacagagctctcctgtatgagatgtctgctggtgggaggtgtctcccagtcaggagacacagggttcagggacccacttgaggaggcagtctgacccttagcagagcttgaacgctgggctgggagatgcactgctctcttcaaagccagcaggcagggatgtttaagtctgctgaagctgcacccacagtctccccttcccccaggtgctctgtccgagggagacgggggttttatctataagccccttgctgggctgctgccttttttcagatatgccctgaccagagaggacgaatctagagaggcagtcaggctacagcggcattgctgagctgtggaggattccacccaattgggacttccccgcaactttctttacattgtgaggggaaaagtggacctctttctccacaccaaatttgagcatcccaggtcaacttcagactgctgtgctggcagtgagaatttcaagccattggatcttagcttgctaggctccgcgggggtgggatccgctgaagtagaccacttggcaccctggctttagccccctttccaggggagtgaacagttctgtctcgctggcgttccatgtgccactggggtatgaaaaaaaaaaacactcctgcagctagctcggtgtctgcccaaacagcctcccagtattgtgcttgaaacccagggccctggtggcgtaggcacccaagggactctcccggtctgtgggctgtgcatactgtgggaaaagcatagtatctggaccagagtgcaccgttcctcatggcacagtccctcatggcttcccttggctaggggagggagttccctgaccccttgtgctttccaggtgaggcaatgccccaccctacttcaactcaccctctgtgtgctgcccccactgtctaaccagtcccagtgagatgagccaggtacctcagttggaaatgcagaaatcaccagccttctgcattgatctcactgggagctgcagaccagagctgttcctattcagccatcttgccagcctgcaatcctatataagctttctataaatttgattttatagtatgggaaactaataatattctgcactttgatattcttacttttcgtaaggtttatttaacttattcttaaattcatttgaagatgtgttgaaagctgtattttctgctgcagttgctgaggttggccatgacaataaggaaattcaggatgctatagctatggagggtcagttcaatcttttaaaccagcaggattgtccacttggacacagccagtttgtaggtctgatgctggttatctaccccgagactgtgaattctatctacacatggataatataaatgctaatggagaagtaggacaccagggctggacagcaagaaaaggaatcttttcccttcctgtttgagttcatgccttcccaaggttcctttgtcatctcataggtaataatagaggtaattatttataacacactacttatttctaagaagagataggtattttacatttacaaaactgtactaggaggttcactcttaaggagaaaaaggaatgagctgttcttggatttcggcacttgctcattgcctcagactgaaatgtggaagttgagagaaaaaaacagctatgggctgggcatggtggcttatgcctgtaatcccagcactttgggaggttgaggtgggagaatcacttgaggccaggagctcgagaccagcctggccaacatggcgaaaccctgtttctactaaaaataccaaaaattagccaggtgtggtggcatgctcctgtagtcccagctacttgggaggctgaggcaggagaatcacttgaactcaggagacagagttctgcagtgagccaagatcacatcactgcactccagcctgggcaacagagtgaggctccgtcttaaaaaaacacaaacaaaccagctgtggtacctgaatgggattttggcccaaacccaggcttaattcagtgaaaacatttcaccttttaatctttcatctttgtactcttttcattttactattaagttgctttcttccttatcattttccaacttttgcaaaacgaaaaatggctaactaaggccaataataatggccagcatttctagctcaaacagaagcttgggtttctcctccattaagatttgcagtcctgtgtgataaatcagagagacctggttacacattacaaacaaatgaaacttctggctaaccatcagttatagtcaattggaacatggttggttgagagcacttgctgtaaaagctctgagaagaggaagaattttactttagcacaaaattttctttgctgggatgcaatcatgcaaccatatcaaaagtttaaacccatccccactactttttcatggcccccaaaacatcccagaataaataattttaccattctttcctctacttctcttctagtttgcctgtcctcctttctaattacgttattgctaattaggaaccgggggaactgtacattttgaaagtggtgtgtgaaagccttctgctaggtcaaataaaacagccaggattaagatgttgacttagtgggttaataacagttaacaagacgcagtgacctacctgaatagtcaacaagtatttggcctggaatccacgaactacctttgttttgaaagggatcattttctgctttgtgagtacagctaattcacttgagaaggtaaaggtatttctcattagcctttctagtacataaaattatacatattgatagaaggaccttatccagagaccccctagagcaacccagtggtctgccatttgggtattgatctccttccccctgaagttctgatcctaattctcctactgtaaccagcaactgccatttattgtgtgcccatgtgcaaagaattgagctcatatactcatttaatttttgtgataaccctgggagcaagtatatacatgataaaaccaaggcttcactaatactttcactcaaatacaaagctggcagtccctccgaacaaaggctttgctggttttcattccctaatactatcttggtgtagagcagaagccaggcagtttccccttctctgacttgataatcagcagcttccagtgttttaaaatccttttcctttgtgcaattcaatccctctaacttaatgtcccatatagatatgttaacattctctaatggggactaagacggcctaatgcttgttcaataaagcaccctatttggttgggaacagaatcaatgagtaagttacttgttatcaggcaagccatttgttgaagtgtaggcctggctcatttggtacctggccagaatacaatcctgatgggcttaatggaacaaaaacatggcttcattatatttgattttcattcaaatggtgatctagttccattgtgtctggtgaaaggcagagaaatagttgaccttttatagatgcagggactgattttgagtctgttcctaaaaacagtttaaaacctgcaccatttgtacctcttcccctgtctccatggccctcaatgcagggcttttgttaataacctaagcactgtcagccatgtacagcaagggttttcagaacggctcccatggaaatgtccctgtgctggaccaagatgctgctgacattaatactgatggctatctgttttctattgctgttgtaatgaattgccatgaatttagtggtattctcttacagttctggaagtcagaagtctgaaatcaatttcactgggctacagtcaaggtgtcaacagggctggtttcctctagaggctgtaagaagagaatctatttccttaattttttcagctgctggtggccacctgtattcaacagttttcctccatcttcctgcactccagtctgtttccatcatcacgatgcatcttccatagtctcttctccttttgcctccctcttataaaggacattcgggccttatattcaaggcccacccagataatccaggataatctccccaactcaggattccttctgccatttaaggtaatatgtactaattccagggattcagatgtggacgtctttgagaaccattatttagcttaccacggtggcttttgctctatttatacaaaaagtaagataataattatattgtctgtaatttaccttaatacacttccatttagatcatatcatgaatatgtgtatgtgcaagttaacttaatttgcactctagggatgctaagttaacacttgaaatagcgtattcagtagtccacacttctcaggcgtgagcttcaactattgctatctggatttgctccatagggataagtaaaacaatttatctttgatgaaataaggaatgtttaagacatgtggtagctagaaatgttgtacaggtaccttaccccctacacaaattgggcataagagtgaggtccacccaccagccaaacagagcacctaattcttgagctccattcaaaacaagtgcctcctactctcatcgcataatgaagaatcccttcacctgacgtaactaaaaggttaattggtcctgtcatgagaatatttttgcatttgcctcagagtgttcatttcatgcaaaatgctttaaaatatattgaattggacctttgaccaatcttttagtaaaagtgtttatgcctgcttataataaatagctgaacacagggtagaattctgtgttcttataataaatagctgaacacagggtagaaatttgttttaattgaaacatgccatctgatagcaaagctgtctaggaggaagcagatactcctactgaattctattcttcagaggccattcttctgatagtcatcaaacagaatctaacaaataataaatatccaaattggcttagctcagctctcaatacttacagtcaaatgttctccatttggagattgtttcctgcaatcattttcttaaacttttagtccttgcttccattttttctgtttataacgactagcaaatgataaagtgattggacaagtagcaaatgaatatttgccaataatctcagcaacagtcaagccacttaactatgttgattgcttcatggatacatgctcacaattttgattttctatccaattcacagaatttagtcctgttttctgacaatgaaattgttcttagtttaagtcctagagttaaatacatggataggtcatagtgcaaagggtgccatggctttgaggggcttttccagttggactcagttgcatacattaacttgtcctgccctcctatctaaacagctatctgtaaaacctgccaaatttcatgaatgcctcacatggcatttgaatatattcacactacaagtgataaatacagagagacagggttgcctttatgacagttgactctgctagagacaaggatgtctcgaatgctgtctttgctggccatctgcacgatgcagtctccttgtcctcctgagtgtttagtggtttgtgtgtttagatgtcagtttgcctttaactactccgatgcctccgttggtgctccctgtatcctcgaggtaggtttctgccagggtcccttacttttaccttcatgttatccttagcaatcttgtccacttctaagaccttagtcatagaatctccaattctctagtccacagtctcagccctgtctcttagatccaggtgtaacttcatatctactttctacagttttccatatgctagccatttcagaaccaaatccatcaaaatacaccttagccacatctgcttttcactcttggctttcctttctccactcacccctcaggctcaggattctttttgtgttctgacctctgtgcttcctgaacaccctcatccagtctgtgggcaagtcccagcctcccaaacacatccaagaagtcttccctgatcctccctgacctcagccaagagtgacatcttccatatcaacccacaactttcttagagcgtgtgtctcataacaggcttggatgctcacatcctatctgtcctacttattataaactcccaaagtggaggcatttctccttattagcctttctaccttcagagtgcctatttcagggccctgcatattgttctgagctagaggtaatggatgtggaggttggccatctttttggtagaagatgcctagagatggtgcatcctaaattttgtcttgtttagcctgggttcctctcaggttgataggaagcaaatttcatgacaaatttttggagttcaatatggaaaagaaataataaaatagggatacatggaaaaatgcgatccaagaattcgttatgtgggtcaattgaaagaagtgtttacaaccagattctctgggcctggaatctggagctgagtctagggccactttattaaaaaattctgcggcactgtcatctgagacagttaaataaagcagataagggagtaaccgcaagttagaaaaatactacacttcatttaagcagcattctgctgactgcataggccacttcagcagagctgccagtatgcaatgccagccagaactgctgacctgtgtggccacagctgctacaatagcagcaggaatggggcctccaagcaaagcattcaatccctctgtatatttttctgaatgaaaggattccataaaaggttgtatgcttttcagattactcttctcttttccatttatcagttcattaacagacaagaatggacccagaagcagtgaaagggcaaagcccccttcatgctgatttaatacttgagtaggctaaacagtggcccctagatatccaggtccccatccctggaacctatgaaccctattatccatggaaaaagttaaggattgtggcatgggtgattatcctggattatccatgtgagccctaaatgtaaccacaagtattctaagagcaaggcagagggagatttgacagacaggagagaagaaggccaagcaatagaaaatagggtgaagcagagtcagacagaaaagatggaaacccttggctttgaagatggaagaaggagccacgagccaaggaatatgaggaatgtgtctatagaagctggaaaaaactaggaaatgtattctcccctagcagagtctgcatggccaggtgcccttcagaatgttgtagaacgcattctcatgtttggtgggaggggatctgaagaatccctttcttatttgaaaaatcaagcacatgcctagcaactccttcctctttggcattacagattttttgtctgctggattgtttccagcagcatacaacatataataatatctcccagcttaaaaaaaaaaaaccttccttaatcacacatattacttcctctataactccatttctgtacttctttttcacaagtgttgcctgtatactttgtcttcacttctttcttatcattttctctttttaaaatttcttattttaaaatcatttcaaacttacaggaaaaaattacaagaataatacaaatatttcccatattccctttaccctaattcatcaattaagactttccattttttttatttctccctccctctcccctcgtcccataggacgtgtgggtatttgggtgtgtgtgtgtgtgtgtgtgtgtgtgtgtgtgtgtgtgtgtgtgtgtgtacagctcttgtgaaagtcaccaatgacttccaggttgtcaaatctaatgatcatgtttcagttctcatctaatcagcagcaccaaaattagctctctgtgaaatatttcctcacgtggcttccaggacacctctttcttttcattctgtctaccccactggccactccatctcagccttctttgccaggtcctcttcatcatacaaacttccaaatgctggaggacccagggcccagtccttggatttcttctcttctatgtatactctcactctccacacgtcctcatccagtctcaagactttaaataccatctataaattgttaaataaaatttatatctcttgtcctgacctctcccctgaactccagatttctatccccaaatacctactcggcaggtccatttaaagatttagctgtacatgcccaagtctgaatttctgatttctcaacacctacctattatataaagtccattcttcctattatatagagtctcccatttcagaaaatggaaatttcacctttccagtcattcaggtcaaaaaccttagttatcctcgacttctttgtctatattataccccatattcagtccagaatgcaaccaccccttatcacttccaccatcaccaccctgcccacaccatctcctgcctgcactttggcaatacatttctatcttacttatttgtttttgtccccttatagcccatttgtcacatactgccacagaaccatccttttaaatcatgattaatatcaggtcactcctctgtgcaaaacccttcaagaacttcttatatcacaatgctcactgcattccaaattgtcactgacgttcctcaaatatggcaggcatggattcttattccaatccctaattgagaacccccaaaatttattctatccattgcctgagcttctactccacttctaaacatgcaggattcaatgttaagagccaggaatgcagagtacagaaggacaaataacaatgctcataagggaggctttttgaaaaaataagcaaaagcgtgtagtgacgggattctcccaatgggtgaggagttgccctaagtcttcctttaattcatactttaaaatctaccatcaatacagctggctactctgggaaactgttttgcacattgactgagattactaagattagttccagctcacaatttcatcatttgaacatcaaggttaaacatcagaacatttcgcttcttcccgtcaaggcttgttgcaatgtcattatcttatgcaataagaagagataaattataaatacctatattctatggctcagaaggagtggattcattttagtgtgtggtatatggattcaatcttactagttcccaatcccacctcatatattactctttgttcaatacttttatctcaaatacaattcattgttcaattagcaaatgagagactgcatgtagtaattgtatcatatttaaagaaaattgctttgtacaggtatttagagaatcaaactagggagatacagttctcactatgagatgagatgaaaacgttgacaccagttctatcaggcactaaataaatatcaaggcaaaacactaaacaagaccaacttatcttttataaagtaaagggacaacagactcaatccataggtccttattttctcccccactgtatgttttgatattttcttgccaaatggatttaagggaatgtggatggagacttcatagaatctaatctccatgcgtaggggctttagctgtgatagtcccttctatcttcagcacttaccacagtacccagcacatagatgctcattaatatttgttgaataaatgctctggaagatgggcaagattataaatactgaggaagactacagacaggactcatgttttttccttggatagctactgtgtatccaggtgtatgttaggtgctcagtatacacaataaacaagacatctactatctcacagtctggtggttagataagaaatgatcactcatggtgtgagaagtgctatgatgtggactagtcagtgtaccatgggagcacaggcttcaagagacagggaaggcttctggaggacagactatctaatatgagccctgatatgtaagtcaacctgttgaagttggggtgaaagggatctttccaagaagagggaacagcacgtgaacaagcacctggcccaggaaacacagctttcacggggaagtgaaagactttcagtacaatcagatcaaagccgaggggaggagaagacttgaggatgggtacctagatcatatgtgtatactagtttttgaagctgatctctttgggtatatgtcataaacttaaagaggcttctcaacgcctcttttgacttgttttcttgataaatacagaaaatctttttaaattataagatggattttttattttatactcacactcacattttactgtggatgaaggtttagtttattaaaaagtacattccagaatgtttgttaatggccaataacagacagacacttccttactggacattggtaaggaagtcagtaaggatgagtgctacttttcttaaatgtatgtactaaacctggtaatgtgacttataatgtctcagcacgtaatatttatagactaaggtgatagaaaggatggattccaccattgttcttgctaaatgcataatgaaaatattcatctagggacaggattgctacatatgctacagtccagatataaaatacagttttgtatggttcaatagcttataatttagtgggtagatttgcaattagatttatatacctggcatcaattttgtcataataaaatgttttccattccaggtctcagcttttagacacaagccactagataaaaaccttttcctaagaagttaaatgtatgtgaactagacttttgaatgccatttgtaattgcctggttgcctgcaatagctttcttggtgcaatcctggccctgttgcagtgtattctcagcccaagagtcacagtcatttttttttaattgcacatcaatcttttattagaccgatcaggaaaaaggatttagtaaacttacgctcaaatgaacactgggcccatgtggcagggccaagcaaatagaacatggttcagaaatcagtcagtgaaagacacaaaacaaggtgggggagggattctaaaacacacagcaggagacactcctacccctcagaggtcaaggagcttatatgtggtctgacttactctttgaaagagtgactgcccccaggagacagttactctttcaaagagtaagtcagaccatatcatgctgttggtcgaatcccagcaaatggctccccatttcactctgagggaaagccaaggacctaagaaggcctatgtggctataggcccaccccaaattcactgctgttacctccctgacctcatctgcatccacactagtctcttttctcttctttgaacatgccagccaccctcctgcctctataggacctttgcacaagctcttccctcttcctgaaatgttcttccctaagaaatccacaaggctgtctccctcacctcctccggtctctgctcagatattatctactcataaggccatccactaaaattacatcacacacttctaaccccctaccgtgctctccttgatttgccatagcagttttcaccttctaacatactatataatgtttgtatttattatatttattgctaatagaagcaatatccacaaagtctcatttttgtctcttttgcttatgatacatcccaagcacctagaagacagactggcatacttacatatgttcagtgaacattcatttactattttattttaatttttttgacacagagtctcactctgttgcccaggcatgagtgcagtggcatgatcacgactcactgcagcctcaacctcctgggctcaaacaatcctctggcctcagcctcctgagtagctgggactacatgcatgtgctaccatgcccagctaatttcaataatcatttattgaataaatttctgaaataaaactttgtacaactagcaaggattgactagtggagccagtatccttcactttaagcagaaagaagatctgattttaaaacttgtatatgaactaatttcctttatatgtaaaacaaaagcagattctattttgaaggacatattagcattattcatctcacaaccctggcaaagagtgtgtgtacaccgttatttaagtatatacatagcaggaaaatatagcaaatatgattgttcacaaaatcaccacagtatggtaatttaagatagattgacgtctgtggaagatttatttctttctaaaactggcataataatcacaatgggaactattaatacatcaaatttcatttttcaaaaccaacagaagccagttggggaacttttggaagactagtattctaatggattaaaaatctattttctgctttgaaatttaagaggtaccatttaaaggcataattgcatatgccttttataaagtcttataaaagctcactgtctttatgccaacaaagaggaattgtaatgaatgtgttaggactactctctaaatgtcatctcctcaaatatgaattcacaggaaaagctgtccatttccaagacaagcttccttgtagaaaccacaactagaaagcatcaagtgtctcatttatttctaatttaattattaatctaagagggccatggaaactgtaacaatattgcataatgattggctgatctagtgacaggcaatgatggagtaaggctcctccaccttagctctttaatatattaatatgagtctttaaaagtaggacctagatcagatcaatcaagaatttactaaatatataccctatcatggggcaaaaccaaagcatataaaagaaccaacagacacaatacccttagctttattcatgtcaaacaagtacattcacttttattgcattcattgtgatcctgctgctttatagtgataatttgatcacaaaggtatcaatttaaaaaaatcaaatccagctgtaccaagtaagtgcctacctgctaggccaaccatgtataccaacctgtgagtgaacactactgaacttccactactgaacactaggatttagaaaagaatcacttcacaagtttagggttctctttaataatggaatccaataattgtttgttgaattaaagtatatatgaatgaatcattttgtgggtctaacagtattactgcaggtggagcttggtcatcacccaccaagtagcctccatacattcattcaagtgttccttactttgcttattcattcaacaaatatttattaagtgcctactatttgccagatactctgctaggtgctgggaaggagagggggataaaagaaacacagcctctgtgctcacagaatttctttttactttgagaaggcagataatcaacaaagaaagaaatattttcagataatgatagtgctatgaaaacaataaaacaggataacatgataaaatgatggagaatggggtaggggcaggatagtgtggtcaagggtggtctctctaaggacataatatcggagctaatactgtcataaagagaaggaaccagccatgtcaaatgccaagatagaagaaacaataatgcaaaggctcaaaggagtgaatattgtttttgaggaacaggatgaaagccaatgtgctctgattgtattgagtgagataaagtgagatgcaagataaagtcaacaaggtggacagcatccagattacaacataccagattagtggttttctttctttttttttaatctttaaaaaatattataggaataccttagaagctttttaagcaaggaagtgatatggactgaattctttttctaaaataatattctacctatacagaatgactatgtgggttttaaaaaatcaaatagaacttctggaaatgaaaaatgtaactgaaactaaaaactcaatggactggttaaatgacagatttgatacagctgaagaaagatttaatgaactggaaaatagaatagaaaaataacggccataatgtaactcagaatgattagattgaaaaaatatatataaaaaagatatgtatagattgtagagaggaaagaactaaaacgtttaactaattgaagtttcagaaagatggttagtggggcagagggggaagaagactaggtcagaagcaatctttgaaaatataacacagagaattttccagaaatcataaaatatactagtccacagaatcaggaattctaatgaatcttaaacaagataaataaaaagcaatctacatctaaacacataatagtaagaatgcaaaacactaaataaaaagagaaagtatcaaaagccaccaaagaaaggataaattactgtgaaaggaatagactgacagataacttctcgagagcgataatggagactaaatgacagaggaaaatctttcatgccctcagaggaaaaactgtacttgaaattctattcttaggaaaatatcttttaagaagatattaaggaggaaaaaaagatactttcaggcaaagtaaaatggaaaaaaattgctctagtagacttttaccaaaaaaaattctaaagaatacaatgcaggcagagagtggtttcaatctgggatgcaagacggattaaagagaaagagaatagtaaatacatgaataaatctaaataaacagtgactatatccaaaaataatattttgggggcttaaaaactgattaaaatgtaaaacaacaatatcagggtaaagtaaacagaatttaagtgttagaggattaaaaatagaacaccagtaaaatttaaccaaaggacagtaactacattaatttcagataataaaagactttaaggccaaaagcattactaaacacagggtcctaacgaagtcatcacaaccaatatcctattctcttttcttctatttctttttccattttcttcttaattccatttctgtgtctctctgcctccatttctcttcattttaatactgtttgttcttctcatttggctttcttagagcagggtaggcactagttcctacattacagccgtgctcatgattcccgctctgacaatgtgaaagttgttctgaagaactgccgctgaagaatttttgcaagatcaaagacaaattgctctggggctaaatatctttatggactgccaatttgagccacaaatactcaaaccttcattatctttcctttgttagagattctgtaagtaaccctgagcaggtaatttacttcatttcccctcacttcttataattaaaacaaaaagacttatctgcaactaggtaaggaaaggtgctgatgataaaaaaccaacaattgtaaagttcttaaggtgtttgtaagagcaataaaaacctgtttagattacatactatgcactaatttgtcacagaggattgcagtacaaaaatacatgtccttcaaccagtcaaacaggaaagaacttggtaagtctttgaatgtatgagaagtgattattacagccccacccaagtgcagctacacatgccagcccagatcctgctgttgtttttccttgtaaagctagcattgatttcaaaaggtcactaaatgcaactcctggattctgaagaactgtacttagggaaaaagaattgctctttatgtaatacttctatcttataaaaaaaatagattatcaggaaaaaaagacctcactttatatacctcacatctccatgtgtcaactttaaatttcaagatgcaaattaaaattttgagtgacactttgtttttaagaactcaaattgattagttttctctctctaacatttattctgatttgattactccctaacgcatgattacttcaagtaggtcgtgtgaagagcagctctgagtgatttgggagatgttgtttaacatctctgtgccttacttttctatagcctacctcacaggatggtgaggcttgaataaaataatacatcatatttagagagtataatatttccctacctctcatcaggagcccaaagctctaagtactaaaaatacctcttaccttgctaaaaggagatggagaaaaatttatactagtaacttacttctgaccaaccactgatgggtaggaaaaggataaaatgccttttataaattttcaacaatgaaattcatgcgctataaaggtggtaggagcagctaagagtaacttattcatgtctttcacttgacttggttttatatggacagaatctgttacaagaatgaaaaaataaatatatgatgtctacatctttatatattagacagatatgagtaggtgggtaggaggaagggagagagaaagaaagaaatgaaggaaaaggagagaaaaaaaaccaatttaaaccagcagcatgtgtaccataattataaattatggactactatagcatgatgagtagttttagtatatgacagttcaaatgaaatctttcacatgattttctaacttttggtgatattttcaaatctcctttttaaatattcagaatcagcacatggtactgaacaatgtcttatctttattaccaagtcagcagccatttttatttttcttttggaatttggaaactatagtaaaccttgaggtagggcaccctatttaattcaaaaacgtgatttcaaaatttgcttttcctttttgtttcatggcagtgtagggagtgtggtatttcagcaaatctgtgactgtcactgtcatcacacagggccttgttcatagcaaataggcaagaaatataagccggtaataatgatgattcaagccccactcaattgagagcctaaagttttcattccaaatctgatttggagaattggctattaaaaaggaaaatttaataaggagattgaaagaggaaaacagcctactatatcctcagattctgatttaggaattattttttaaaaattatcctttttcttaactggcttgaaggaatgaaagcaacttggtccaggaggaaaatgaaagcgtgaactagtaagtgaaaaacacaaatggccacagatccagcctcagttaataaatgcaaatgtgccctgatgtgtactaccctacagagaatactgtggacttttgattttggtttataacccaggtaattgtttacaatttggttttaaaaataataaaggtatagagacgctttcaatgtctataaccaggtttgtagattttgatcaccaagataattttaagccacaccctcgaccccctgccacaattgacttggcaggtataatcctaaaacaccaaactattcaaaacttgaggcctctcatgtggtctcgactcctcctttttatgaagtggagtcatcgtgtgaatttcaaaattacaataagagataagtcacagaggttaattcaaagagagtttctggtgcactcaaacacatcgtctatgctatgccgttaagtggataacttattgtttctattactttctgaggtgtgttcaacttgaatgcagtgattttactactaccaagattggttttgtcttccttttttttttttaaatgctgttgtttatttgcagtcaagaaggagaaaaaaacctttaagttcaaatgccaaagtcataatattaaaatatatgtgtgttgctctcttcataattaacaccattgtacagcatggttatgagtttagaagatgaaggaaaaattcctcatgtcaatactttttaacccttctgcaggtacttacaacttagtgtacttcaaacccatctctgacttttttaataaatgagattcctttttcccccttaagttagttaaatttcaacgaataaatcgtttctatttggccttcaagcatggcaattttctgtgctgtaaaaggttcattctaaccacaaatctagtcaagtggattctggaaacactttcaaagcaatcaggtcacaggtaggagccaggcagaaggttggcaggctccatgtgagatttccactacagaatcctgacattctttcaaacattatcttttcttgtaaagggaagccagaggtagcaaagacacctgattctattaaaagagcccttggagtttacagaaacacagttactgtggcacaactgagacaaaccaaaagaaatcttcctaagaaatgacattaatcttaagcacagagtcaagaatcttataacgttccacattatgccccaaattcctgaatcagagagctttggaggaagaagcaattttctggctgtgcccatttatgctacactctgcaaggtgagctgacccacccatcttcacacccctgtttggtctcaaatgctgctggcatcccaagcaatcacccaggactccaaaccttcccttattctccttcaggagcctaactgctactcctctttttctcctgaaatcaggctctttgtgccagctttgtccccctcccctgatcctttcctgctcatctctccccagcctttgaatcatggtgctcctactaaattccaggtgtccctcattctctggccctggctttgctatggacatgaatgaactttcctggtcctaccaaaaaccccaagccccctccagctctttggcgagttctcagcctgtctactgacaatttctaagtcatccatgagtaatactgatgctgtttgaaataagaaagaagattatcaatgctctaagcttctctttttaggataggataaaataaatgacgggctaaacccagtccttataagcccaggtgtctgtgcccacagtatcaggagaatgacggggcattctggaagttgccatggagaccaccatactttctgttctcttctggaggcaccaatatacttcagagcaaaaaataacttaaaatttccatccttcctagaaacaggctaaattatgaatggcaatgattgttgactcttcaccaaacctctggttccttttcctcctgggcacacagcatgactacctttccaagccactttgcaattaagtacagccatgcaactagttctcaccaataaaatgtgagcagaggggatacatgtcaagtcctggccacgagtttatgaagcaggtataccccttctacatgctccctttttgcctgctgggtgtaagtgataaagaggcccagccaacagaagaaccataaatggaagacaaggttttctaaaattctgtgtggaagaaaatcacccaccaaccaggaacacacacattggacggttatgtgagcaaaaccctctactatgtttgaaccattatacatttgggtgtctgtttggtattggagcaatgtctacactaactaatgtaaccaatatattatgcttaagagcattaaatcacttgagtattagaattctaggccttgttcctggaaaatacaagagggactagcgaaagggaagggaagcaggtggaaataataatgtgaatagctgcaaacattttccatatatataaccatgtattacatgcattacacatactatctaatttcaatcattcctcacaacaactttaggaaacagtactgtattatcccattactcagatatggaaactgagggagagatgaaatactcaggaagtggagaagccatgattcaaatctgttgactccatagcccacactctggtggaatatcaactctgtgtcctagacattttatacaattttttctttttaacactgtgtaaaataagccttattagccccattttaaagattagtaagctgagattcaacaaagataaatgatttgtctaaggttacaactagaaaaaatcgaaacccagattcaggccaagatctgactggctctaaagccactgagaaatgagtccctcattctctttcccttacaccacagaggtcagaatacagatggggggagatatcatgcagaatgtatttcactctatttatgggcttcagatgtctcagaggttgatctgttaggcctgtgactgtgtgaccactgcagtcattactatttgccagttttggggaccccagggtttctgttggatagaggtcaccaaattacccagcctgtcattgaggctattttttaaaactgataacaaacttgttaggcatggaatagtcagtccctcctttgctatagccccataagaggaattctcagccaggaagttgccatgtagaccaccatactttctgttctcttctggaggcaccaatatacttcagagcaacaaatgacttaaaatttccatcctccctagaaacaggctaaattatgaatggcaatgattgttgactcttcaccaaacttctggttccttttcttcctgggcacacagcatgagtacctttccaagccactttgcaattaagtacagccgcgcaactagttctcaccaataaaacctgagcagaggggatatgtgtcaagtcctggccaagagtttatgaagcaggtataccccttctacatactccctttttgcctgctgggtttaagtggtaaagaggcccagccaacagaagaaccataaatggaagacaaggttttttaaaattctgtgtggaagaaaatcacccaccaaccaggaacacacacattgtactgttatgtgagcaaaaccctctactatgtttgaaccattatacatttggttcaaatgggtgggtgggtcagtcatattcaagcctacaggaagagcaaaaggcagtggcatagaagctaattctctcaatgaataaagcatttatgcataggaagagttatagtagagccagtccacaaatctacctcacaaagtctttaaagtcaaggagggctaccaggaattgtgtttatataaggacttctgggtcctctgaaaataagtactaagggaatgtcagggctgatcaggacactggaacggacttaaacaaggatggagatggggaaactggcataactcccaattagaaatgaagaatggggagaagccatccacatctgtctccgtgctttttaacctgggtggtgcaccctctgatcacatccctcctggcctcacaatggctacttggcatataaaggaattcctccaggtccagacccattccttctcccttctgacttaatctgtgggacttctgatatatctggagtctatatctgggttactgctggaggcttacagtgggacaagatggcagcatcatataacttcctggcctgtgacatgaacctgaaagtccaaggccattttaggatcaaacagccacagtcccatattcattgatccaaacaacagacatctgtggttgggaaaaagcccaaggccctgaaggagctggagttccacttcagggcagagccagttgggccagcagaggaatggcaggaggctgccatggtactaaataaagaggggcgagcccatcgtgctctcagggttttccaggaccagagctaccacagcagcagccctgggtggtcccagagccccaggaaaggccggggaaagaagttcccagaagatcatactcttccacatagagaatcaagagaataggaaggggcatggaaagagaagcccttctactcccacattccttccagtcatgtccattcattctacaaatggtagccagagtgagtctcttccaaactgatcagatcattcttctctgacttccagttgctcctaggattaaggccaaactcattacttggcctataggacctcacaagggccctgcctactgctgtaatctaaattcactccattgtgccatcctctatactctccagaactcaaagtttaattattttatagcctgtaaattccatgaggactaagttcacatatttttactcactactttatactagcacttggcttatttgcctgacataggtgatgctcaatccgtattggttggtcagctgaatgaatgaatgactggctgaagagccaatattctagcaactaagttaggttgaagcaaatcacttgtgattgcagctacaacccttatttctcccataagtggaaggggatagagagacagagtacagttcaggcttctgtgttaaaggttaacagcaacaaagctttccgtcaaaggctactaagcacacacacctgcaagcagatttcactgattcaaatgctctttggaaaggggtaggaaataagtcaacaaatgaatgtaagaaatgaaattttactgttcctatatccttgaaatgactcagaagaatgccaccaatttggtttttcagttccctcccttttgcagtgatggtatttcgtcggtgcaaaagtaattgcggtttttgccacagtcaggaaaatgagatggaagtcctgagggacgaacctctgccctgctaccaactggatgccaggcaatccaatatgtctaaagaggtttttctggttgttttgtttgttttttgagacagagtctaactctgttgcccaggcaggagtgcagtggtgcgatcttggctcactgcaacctccgcctccaggattcaagcgattctcctgcctcagcctcctgagtagctgagattacaggtacgcaccaccatgcctggctaatttttgtatttttagtagagatggggtttcaccatattggtgaggctggtctcaaactcctgacctcatgatccacccacctcggcctcccaaagtgctgggtagttttctttttttgggaagacaaggtctcactctgtcatccaggctggagtacagtggcactatctcagcttactgcagcctctgcctcctgggttcaagcgattctcatgcctcagcctcctgagtagttgggactacagacatgcaccaccacaccaagctaagttttgtatttttagtagacacggggtttcaccatgttgcccaggctggtcttgaactcctgacctcaagtgatctgcctgccttggcctcccacagtgctgagattacaggcatgagccactgcacccggcctagagaagttttatgagtgagccttagtcagggctcactgctaagcagcatcaggctacagccctaagtgaaggaaaagcttatctcatttctgataagatgggatacgtggcagttttgattttggtgctttcctgtgatgggaggcttcaggacctggtttcacccaggatggagtttagacacagcataaccctgagggcataaggagaggcaggaagccagataagttatagtcggtaaggattaattaaacacaacccaggtgagaatgaggaagtagttcccagataacaaagtggagaaaaccggccccaggcctaaagacgtggcagcaataacctaacagcatgtgtgaactgagctcatgttggtgacaggacctgtggtttggcataggtttattccctaagcaaactcatgcaaaactgggtatacagcactaccaccttctaaccacagaatttaaagattaagtatgagattggtgttgtttatgagaaagcagagtgttgctgtattttctttccagggcttgtacaatatgggcaacatgcctatttggcctttgcttagatactcagcccgagagatgaacaacagttatttagaagacctgctgtagaagctctagacattgtgtgataaaactggagatttaacacacattctatgagttctgctcttgactaagcttactctctctacacagaagtaggcagtttaatttcaacacaggattttcacattatcttaagctcctactgtctcctactgactaagaagttctgctatttgaaaaggagtttattttgaatgttcccacagttttagaatcaatctcaatcatccagaggtgaataactcagtttcaaagcttaagcatggtaaaaatatatatatatataaatgtatgtaaaataaaaaaccagcttatgacgggggcagcagtggaatcggaaaaaaagagagtgaaccgataagaacaacatcatcaacatattagaagcagaagagggaattttttagaattacatagtaatgtttagatgccaaatttgtctactgagacatgagagaccctgagagtcccagcatgctggacaagcttgttgctgctgacgcagaagcaaagtgacatgcagatggctatgaattccagtaacacagactcagggcctagaatagaggttctcaccttggctgctcaggagaatcccttggagagctttgaaaaccacagcactcacactctactcccagagattcggatttcgttcctctgggaaagggcattagtactatccaaaagctccctaggtgattccactgtgagctaagattgggaagccctgggctaccatggaggatacaggtgaggaaggtaagggaaggagggagggggagggaaggagggaggggggagggagggagggaggggggggggagagagagagagagagagagcaactgagtataaattctccattcaattcacaaagaggggaaagcaacaaaccatagaacagttcacttttgcaccaagcaatttatataatgtttagcatttgctgaagtattgtactcataccatttttacacttccagatgatgtctctaaacactggatgccatttaactgcgaggctcacaataaatctatttcataatagccatttttgcgttatctacaacctcttctcccaatcactctggtgaaatcagaggtgactccagcacaaccctattcacttactttaattccctgtgatccatagccaggggggccaggagggccaggcaagcctttctgcccagtatcaccctgttagaagatggggagaatttgaagacaaaatgtaagaagatcgaagaagaaacaacgttaagtattactactctcagctgcattcttacttcagtctgaccaggactttcatgctgcctataagctacttcctattttacttagagtgcttccccaatatttttaaaccacagaattctatgcaaacaaaaccttaaatataatccaaataaaaattaagcagtaagcagagccgctgggcctaagcagaaatggaggcccagggcctcatctgcttgggcccccttcactgccctaccaccaagctcaagaacaccagggctgccctgcaccacatatgaaaaccactgacatgtggctccacatagccttaagatgttgctccatttcaatataaggtgtgatttcactggggttgcacttaaagatccagtggatatcaatgtccaaatttttaggaaaatgtgtagatgaagctataagcaagtgtagcatttcccagtatctgttcataaactgagcccatgtttctttggaaacacttcgtggtggaataagattggaaaatagcatgcgctttcccttggagatctccagtgcacactaatatagtagactaatggctctaacaagtcccacagtaaagaaattagtgtaacgttgcttatcccagaagttcctaaattaacactggatggaagaagccttcagaagtgctgggttaatataagttattgtataagtcagtcttttactttccagtattaaaaaagcttgactttttctgattataagaggaatacctgcccattgcaaaaaaaaaaattaaacagaaataaagatgacatgaacaagaaaaatagacccatcttcccatcacccagtgataatgactactaacatcttggggggatcttcatccatttaaagtgatctagaaggttcaaaaatagcataccgccaaaattgagttgagggacaaaacagagataaactgagaatcttggtaattctgggatgctcagtaaaatctttgactcatacagccttttccctctcctctctgagaatgggctctaattcacttctgtgcattttcggcatgaatataccaattcaaaatttgaatttgtggtgggtggttcattgacatctattttccctattgaacatgcttgctacttctttaccctactttcgaacaaatcaaagaaagttgttgagcaactgaatgaacaattaaaactaggtttctcaaactcagcactattaacattttgagctgagtcactctttctgatgggaggctgtcctgggcattgtagaatggttggcagcatctctggacttgatctactacaaccaaaaaatgtccctagacattgccacatgttctctgaagccagggaagggaaacaaagtctccctctttgagaaacactggattaaaagaataaaaggatgaataaccaccaaactgaaggagacatagaaaggagggaaactgggccaaaagaagttgctctcatcttctccagggacaatcagtctagacccttgtactgacaccctgccagagtagctgtggcacaaagggcacaatgacacattagcaggtgacctgttaaaaaagccacctgaggcacctctgccaaagtaaagatgtgcttcttgatgacggcacagcctctaagaaacccagaaatgttctgagcactttgcagttaaaaagaggctgacttgctcatttcttttgggggaagtgaatggctttataaactcgaatgttctattttactgaacgttcacctgatatgaaaaataagacgtttcatcagtcaccaagaaaaaaataagtcaacaccaagacgaacacttattatgaagttactgttcacttgtttgtcactgatgatatctgaccctcacacaaagcactgagctgaggactcacctttggcccttgggttcctacgccccgaggcccagaaggacctggagggcctctgaccccaggctctccctgaaaagacacaacaaataacaagttactaattttttaaagactttatgtttttttcaatatatatattttaatatcaaaaacttcttgaatgtgactaaggtattaattgaaccctcttctcctagatcacttttctattaccacctaggcaatcttcaaaccaacagatccaggtccatttcaaattaatcaagtcaattaacttcttggcaacattaacttttttcagaaccctcttctctagaatttggaaaagtaattacgagtattgtgaatagaggatggaagaagagacaagaataaaaaacaaccattaagaaatataatcatatcctgaactagttgcttttatcattgtatgcaacaaagattatgctatttgagttatgatgtttctgccacctcattaactggaactgcagggtaaactctaaaaaggattttcagcttcactaaggcatgacagcttcatagctggcaactattaccagaaaattggtggtacctgatgagggtaggtgacgccctgtggcaagacctactagagatgctaatgatgggaagaaggagagaaataaaaattgcttcattagccaccttctgtattcccaagactatgccatgtatgttcatatatgttatttgatataatttagtactcacaataatcttgcattataatgatgtctagtttatgtaacttctctgaacctcggtaaattcatcacatatgtagaaaataatatctacatttcaaagggctcagaattaagtgagacaaagcttgtaagtgtttctatcatgatttttaccacagaataggcacttggtatatgtcagctccactcacctattttattaaagtggaagctaaggtttgcccaagtctgcacagctattaaggtgcagggctagaaggatgtagaaaaacaggaaccctcataattgctggtgcagccactttggaaaacagtttggtggtttaaggttcaacataaatttgccaaatgatacagtcatttcactcctacatatacacccaaagaaaataaaaatgtatgtccacttagagacttgcatatgaatgcccttagcagcattatacataatcatccaaaactagaaacagcctaaatgcccatcaactggtgaatggacaaagtgctgtaaattcagcaataaaaaggaataaactatgaataaatgccataacatgaatgaacctcaaaaacattattactgatgaaagaagccagatatatgattacatttataaataatacccagaaaaggtaactctatagaaacaaaaagtagattagtcactgccaggggccagggacagcaacatggattaactataaatggtcgtgagggattttactggggggataaaaatgacctaaaactgatttatggtgatggctgtatagcttagtagcaaatttacttaaagaaccattgaattttatacttaaaaaggatgaattctagaatgtgtaaaatatgcctgaataaagtaataaagaaaaaaaagaaccagggtcaggctttgaactaccacccaagacctttagccttaggtcctgttttgcccatatcctgttaccagctaaacagcttccagcttccaacactgcaaaaaccataaattacaagaaatgttgaagttgttcattcagaaaaacagtccatcttttaatttactttctacttataaactctaaaatacttccagataacccaagcccttaaaaggacgggggccactttaaaactgtactttattactgacttaattcttttaatatctactttcataattatgtatttctattttgcttacagaccacttttattatactgtctccatctgttccacttagtacttagctgcttctaaggctacgggtgctaattatctctttaacacctctctcctactgactcccatctttgagggtccccaagttcctgccagctgaaaggatcactccaacatcaagggctccaagtagagaacatgaaaaccctgtagtacatacatttccattagcactcctttcttgagtacctatgaagtactttcaaagggagagtgtgtaagttcactgcctgaagttctccaactacacctgactgattcatacactttgctacatcttaaaaggacatgtcttttctcttccaaacattttgacactctccaacaaaacaagtcaagcatagttaagtaaatcttacccaaaatcatcgaaagtttcatcaaaaataatactcctctttgctcagtcaccccaacccaccccagatttggtggcttcctctcattcatttccgttcacctgtgcccttccaagatgaggtgaaaaggttaggaaggatatggccaggttgggcgcagtggcttacacctgtaatcccaccactctggcaggccgaggtgggtggatcacatggtcaggagtttgagatcagcctggccaatgtaatgaaacagtgtctctactaaaaatacaaaaattagctaggcgtggcggcaggcacctgtactcccagctactggggaggctgaggcgggagaatcacttgaacccgggaggcagaggttgcagtgaaccaaaaccacgccattgcacgccagcctgggtgacagagtgagactctgtctccaaaaaagaaaaaaaaaaaggaaggatatagccagacaccatgtgcctcctgctgtgatacattagagaatacaccaccctacctatcaatattctggcctagaaaaaactgaacctggatgtaaacacgtctcttgacctaccagctttgagtgtccccaagttcctgccggctattactaccagcttacagtaatagacggaagagggagaaacacgttacacaacaccatgaggatatcatcagcaaatccgcaagtacaaataacacatacactaactgcgagctaaaaacaagggaggagtctactttgattaagagagatttaagagctatttcaatcaaatgcaatgtgtgggcatgatttggatcccaatccaaacaaaccaattgcagcaaatgggtaagacaagcttggaaatgtgaatgctggatatttgctatattaaggaattgttcatttgttttaggtttgataatagtattgtagtcaagtttttaaaaagagttcttacatttgaatgacaaatgctaaagctttatatggatgatgtctgaggattgcttcaggataatgtggtgaggggaggagtgaagaatatagctaaaacaagatcaactatgtgttgataattgttaaggaagtgtgatatgtaaatgagagttcatttcactagtctttccacttttgtgcatgcttaattttcataattgttttaatacaatttttaaaaatccataaacaatatccagcaaaagtctctccagtgaacctgagatagtgttgctgtaatagacccccttaataataattcatgattttaaagatattaaaactgggcaaaggggaggagcacacaggtagattcaacatcattagaatttacatctgtcgtgtgtattcttgggatgtaccaaatgttacataattttttttttaacatagggatacggagagaaggcaagatttttttttaacaaagtagtatgttttaagaaaaaatttgacactgtagtatttaattcatgattttttttgtgtgagaatgttagctaaaacctcccctcaactagtattaattacactaatacccacacatgggaaagcaagcgggaaaagcagttaaaataggtccatagtttacctcaggccagccttgtcaatgctcagtgttgctattcattctctccttcacagtctcccttattcacgtccccctaaccctcaacctttgggagtatctgaaggccaactgcagtaggacagctgaccctgtagataccttactgttctctctgtcccgcagcctcagccaatgaatttaagatgtgttccatgtcatctgtggtccttcagtgttcacctaaaacaaactgtccatccttatccatataattgttgacatatagctatgtttcacatatctaaataatcttttgtatctttcaaactacgggaaaataatgacttatagcaatgcttttgtgaatctaatagactttaaatcaagtcttaacgttctgcagatattagaattggtctgtaacacggcatgagagttgttcctcagtgtatatgtaccatactttgatagatgggaacattaggcatttaatgatctgagaatccacagaagtagtgtctctccactatggtggggtctttgaaaatgatcttttgtggttccatgggccgtgtgtccatgttaggccaccacacctggtaaatgtgagcaagagaattgcggacaggtcttgcttggccatttgacggcactggttttgtcataaggcagcaccgtaggtacctaagaagtgcgttgacctgtgatattttcagatacacagtttattgtcagtggatacagcaatattcacaaataaaggaattacaacaggttgtcgcatagctggacatagcttcccacgcaacagctgagggttgttggagcctgcagagggagcccttgtattaggagataatgaacagacgtgcgagcaaattctagagtcgccattggtaacaacatctatcactttcctaagatgacagtcttagccttacccctaacccctgcacccactctctcaaaagaagaataacggactgtttagatggcataccacttcctcttggcccgccaaagggattctagatgggagatactactttcattttcacaggaaacggccaaattcaggactgtctgcagtatttgtgcatatgaacttaacaaatgattcagtgaagaccacctagaccataaccttgcagagtggataattttaactcctttaaaaatacacatcatcttatgatggttctaaaactcacacattgaagctttccctttttaaatgaaagaagaaagaggagagcaaacacattcattcattttctcattagtaaatcttcactttggttaatattaaaactattataataaataataaataaaaataatacttattaagtttattatgcagcaggaagttttcattcattatcttacctgatcttatcaacatcaacttattccattttacagataaggaaactgagctacagcaggatacatgacttgccaaaaaccaggcagtctgaagcaattcaaacccaggtatgactccagaacccatctcccattttgatgtggactgggactagatgcaagacgctaacttttccatagactttcttccagctgtcatttaatgcaaagacctcggctgtttggctgtgaaactgtaaaagtcctttccctacatcgccagtcacaccctctcaaggagaagaacatcctggattataagattcatcctgtattacacaggtcccacacgacctgcacaagaatccagccctctaagtcttcccgtcccattttccctccgttgctaatccttggttttgcggtttactccaatgtgttaattgacttcattccagatctcctacctataccagttcttaatctctcttcttatccatcctacaatgtgtgtgatttggcagcgtgatgcataaaatggctactaccactaattatatttgaatttgttaggattcataaagatgttttacatacattagtctattaatttatcataataaacctgtgaagtaggcattattatcccaaatcacagataagaatgctaagcctcagggagactaaacgacttgctgaggtcacacagctaataagtggcaaggtttcaaggtggagcagtgacaaggaaacaacccattataccttatgagttttctaaaaatatcaatataatatttgaggaaataatcagcccattagattattttcctcccccttactcccccacacactaatgaggctttaatcatactctctccctttgtgccagctaagttgctgccactctttgagaagaaggtggaagcaagatatacttgttccaaaagtgatttcatgctttttctactttggggacaataaaagcaaattaaattcactgtgaaagaatcagcctcttaaggatgttccaaggaatggtactctaaagattctgctaaatgatgaaactgaggaatgactgggttttaaaataaggtagaagtcaaagtgatgatagcagctgccttatgtttctttctttctggtttttaaataaaattaagatataactactccaactaccacaaacataggcagaactctggaatgaattacataattccacctatgtcatgtgttaggacctctagaatacctcactcgtggtagccagaatgtcaatggaagttttagaggcttttttctaagtatatgcacatattggcaatgtgtattgattattgaatgaccgttgtcatatgactcagtcatttctcaatgacaccctttaatatgaataggaagatagtaccaactgtcagcatgatcatcatggggatgagaaaataattatacaaatgctagaaaacaaacttctcaaattgctacatttcctctcaagtattttctcacctttaaatttcaaattatttaaagtattttcaattacttgaatcaatttatctcctaaaactttaatattcaccccaaaacagctgtatctcatagtccctgacaattttaaaacttcttattttttccttttctcaaaatcatctcatcaaagatgagcaaatgatggccttttgccaagaacttcactggagagcaagagtctttcttatttagcttggttagaaaccttgaaaacataaatattgatactgccccttacgacagtgagaagagcaggctgtcttgtactaaaactgaatataattttccactgggagaaagttcctccaagtctgcatgatcaaaaataacaatatgtttatggtgatgtgggcaatgaatgttaaggggatttaccatgtgtctccagggctgaaggaaaagtacgtacatactcataagaagagaaatacaaagctaggaaaacagcaaggagagatgaaagcaatattcaaagtcatgaggtggactactagagtgcagctcagattttagagatcaggcatataactgcattggggagtaaccttgaatagtcaccttttcctggtcttggatatgaccctttctgaaacctctgggtcaaactgcctagggtctaaactttgtatggctctggctttaattagttctgttttgggctgattgtccaggctgaagcaattttgcagtcatattatagggaggtggctttcttcaagtccactttggaattacatgcccttaacttcattaagtctgtatcctaggccagccctccttgttgggcactgttcaaaaatggagttccttgtccagtctatgtctgccaatggaattcacacattcctaatgcatctctgtgtgaatcggtcctctgttccaccaatgcctgttggtggagtgtacatatgtgagccattgcagagaacagaggggcaattcagatgctgggaacatttttagaataatgatactcagtggaattccacatagacttgcattttatggctatgggtcacttttgtcaaataaagcatgtatttacaatactcaaacatttaaagttactgaaaaatatttaactcttttgggtttggggtttatgcttctctttaatgtttatataatttaagttttgacaatagaaaagctaggctgaaaggggaaacaatccaactgcacacacaaaagagtgcctagatagaagacggacagcataggagattgagcatctgtggatcagggtaagtcatgctttctgctctgatttattcatccatttagtttttcattcattcatccatatccatagcccctctcatatacaaaacaaatgtagtatcaaaaatgtttctattgtaaagagacaagttgctcaaccttctggttcttcatttcttcatctataaaacagggggactgttaaaaatgtcataatattctggaaatatttaggtaatacataatcatgacaatgataatagtaattatacctgtaataacaacaacaatccaacaagtcttttctgccaacagacttatgccaacaacttgatggttaagaggtcctaaccccaaatccaggttagatctcctctgtgcaaagattaggctaagttcaaccactccaaggctttggagcgggtcatagctttttctgtgatgatccagctccctgagagggcctgaaaaaagctaagagacgggcacggtaggctgtacctgcccttagtgaactcaggagagccacgtcttatattccttttctatgaggccagaaataaactcttatatcagagacatcaggaaatcagaccttatgctacatgtaccttacaaagctttgggggtgaaaacacaggaacagagttatctgcagctcctcgaagagaaatgagacgtatggcatgtttgccctcaaaccacaagaagtgcccttaatatctaaggctccagagaagaaaagcaggctgtgatgagtggggcttggagcttggcttccccatcaacgagccaggagattggatccaggagtgaggacactggatgagcacttcccacttagcaagaaaccaaattatcagttcctcttcccagcatgtttcaaaggtgagtttaaaatctatatctcctctctccttcaaagttgtagtttttacaagaattttagaaatatctcagaaggtcttgccgaatttgaattaaattcaaggtaattgtatccagaaggacaataaccactgatgttgcagggaatttttccacttggaaaagagccacggagaaccacaagggtgctagatgtcagcaactgctttttatatgttttgaaacacagaagctttgagtttaatgtctgtgtcatatgctaaacacatgtgaccttaactaaacagcaccaaaacccaccataaattcatcgtcaaccttaatggtttcctcatttcaaaacacatttgttttgtaagttaatgccttaaggccacaattttaaggcgactacacaaagcttaaatgaaaaacatatcaggatccatatggctctactaccacacacacatatatacagtttcactgtcattttaactcaaaaggggagaaattttgcacacatttgggtcctgtgcttccgctgccatggacaatttttggtattttcagaatttcccgtactttaccaagcaagaagggcaaagttaactggaattatcttcctttctttgccagtttctgtctatgaatctccctctctctctctctctctctcacatacacacacactctctttctctctgtgctctgtgtgtgtgtgtggggggggggatggtgtgtgtgtatgcgtgtgtgtttccagaagttttcttcagaaaaaaaggccacatagaaattttgaagcccctgtaaaaaaggagagatgatttttaaagttacttagaagctggtattttcttttagactttcctttattttcaagtttatgatccaagttcccttgattctaagaccagctcaccctcctaacatctccttccagggctagagaaattctgaacaacacaatttccatgggaagagacaagaagcaatggaaggaaggaaaagcaggtgagagggaggcgtgcagacaggtaggtcctacctagtactcttctcccccgggctctgcctgcagctggaagcaaaccatggactgccgcttccactcagccttccgcgtgggctcactcagacaatgggagtttcacttaagatacatcttctggcagcatattagccatttcaaaaaaaacaataggcaagatgaagttttgaaccctttgtttcttacctttttccccctaaaatgtagacgaaggcaaatacaggggacttttggaggaaaatggcatatgcaatcatttagtaaatgttttagtctgtatcttagataatctgacacagtgaaatattcataagaattgggttttttatgttctttttttttgaaatggagtttcgctctgtcgcccaggctggagtgcagtggtgcgatctcagctcactgcaacctccgcctcccgggttcaagcaattctcctgcctcggcctcctgagcagctgggattataggcgcccaccaccacgcccagctaatttttgtatttttagtagagacggggtttcaccatgttagccaggctggtctcaaactcctgacctcaggtgatctgcccacctcagcctcccaaagtgctggaattacaggcatgagccaccacacctggctagttttttaagtgttctttatctgtgcctaagtgcctgtatttattattattgctcaatgtaaagcagtaacataatcgtataatttaatataacatcatgtctagttatataaaaaattcataataatctactctgtgaaaatgtaaatgatcatctgtttccattggaatacacatattctagtatatatttaacatattttatttcatgttttattttacatagaaataagcttctacttccctaaatattcaatatacaagtttttaccattgtttcactcacagcgtaagataatgaggtttacctattgaatttctctattttttttaattttaggattttgacaggtgctatgccttaaagaaaaaagaatacatcagtacccaaatttggtgcagtttattgatacagttgaggcttattcaaggatctgatgtagtcctgagtcagaccaagccagatccttcatcgaagcacctcgggtttgtcctgtctgtacagtgtacacagcacttccagatacatcctcattggactctcatcattacccccagaagcagaatgtggcagctatcaagattcccttttaaagatgaaatttagtgccatgggtctccaatcttttattccacctgggagagggcaaagaggcacttctaaattttgtggcaggggcaaaaaccaaggggagaagttggcattaagcacgtacaacatcttttctctctaatgacctggaaacattcaaaaaagtaagtagatatatttcaaaggaaaaattctccctttagggtaatattgatcatttattcattttccattcattcaacaagttgtagagctcctactgaatggtacacctagttctggtgacatgaagttaggagggaacaaagcaagaagcctgctccaggaaaaccttcactctcatggaatatgcagagaaataaatgaggaagatgatctcagaaagtgatacacgctacatggaaaacatacagaggggttggggtagtaatgctttctgtatgggtggtcggggaggtgacatttgagctaagcttttaataatcagccatcctggcgagtccctgatgcaggaatgagctgaagtagggcaggccattttggctgaatgtcggcagccagggagaaatgacagaagctgcagtcggggcatgaaggatcttcaaggccatgggaagtgttcaaagtctgaaagagaagccaccagggtgtttctaggaaggaatggtatatgctctgatttacggttttaaaagaccactcttcctgctaagttataggaggacagaggtggaacagagggaagaccaatgaagaggctatttttacagcccacgtaagagatgacattgtctgcctggcagaagcagaaagaaaaaaaggagccagagttgagatatattttggcggtagcattgacaggatttaccaaaggactaggtgtggaggaaggagaaggaaaggaaggaacaaaggatgatgcttaatccttctggcttgagcatggaagagccatttgcagggttatggggcaaaaatcaaggatcttattttggattattttaaattagagatgtttgtgagaagcccaagaggggatacatggtaggaaattagatacatgagaccagattttaagggagaaaagataggtatttggaagtcatcagtgtgtggacagtggttaaagccatggggctggacgagagtatctagggaaagagtatggctagaggagagaggagatctccgacttgtaccctgatcttggtataagaagaggaagcagcaaaggaatgcgagttgctatcagagaaggaggacccaaaccataaagttagtctacatgttcagattagttccccaggaagtctatagataagggcaaataactttatcaattatttcagacacctctactcttctagctgataaaaaattttatttttaccaaagtcacctacctataggtgcactcttagaagctagtacgttgcctactttaaagtcttacctttgctccagtgtctcccactccacgtaaacccatcggcccagggggtcctggtaatccacgaggtccctgagatgacacagtaagggagggagtgagcatccttgtagtatgcaacactcaaaaaggagggagggaagaaaaaaatgtcccacttacaggcacaccaggatagccatcacctttgagtcctggagcacccactggtccccgagggccttggacaccctgggtaaattccaacatcagtgatatcatgagactcaactagaaaacacctggtcaaacttaagcataacaccaactcaatatgccaacggtcgatttctaacccgggagttagaaaatgacttattgctagtactttaattcttaaaattataaatttttagtgcatcgtaaatcaagaagaagtataaaaaagaaaatttattaagcacaatgtgagaagagtagaaaagaatacatagcaaaattttgagtgtgggataactagtttcctattgttgcgttaaatctattctcttcattaatggggcccgaattatacggggaataaataaacccagatgaaaataaaaacacattaatttttcaaaaacaagttatgaagggatagagtttgtgactcatatcttgagacctagggaaaagttgtaaatattgttttacagtgatgaccttaggcatcaaaaacttttagtaacagcccttagtctcctacagaaagagcagggaggggtgattattgtcctttagacaacagagttttctaagacttgtaactgtctcacaaacagcaatcagaaaatttctgactcaagtaaaacggggggagagaaaaaaattaagaaggatcttttagaagattacctacaagtggccgggtgcggtggctcacgcctgtaatcccagcactttgggaagctgaggtgggtggatcaccaggtcaggagttcaagaccagcctggccaacacggtgaaaccccgtctctactaaaaatacaaaaattagctgggcatggtggcgggtgcctgtaatcccagctactcaggaggctgaggcaggagaattgcttgaacctgggaagctgaggctgcagtgagaagagatcacactactgtgctccagcctgggcgacagagcaaggctctgtctcatttaaaaaaaaaaaaaaaaaaagattacctacaagtccattacacttttatttaaaacttgtaatacttctttttacaacatattccactgatctgttacaccgatctgttgttgatgactcttacaacagcccttgtcaatatgcagcccttgttttgataaagagctgctcatgttttaaaatatttatggtttttctttatattgggaggaaactctaacaacaggcagacctttgttttgcaagaatggagaaagaaagtagcaggactcttaagaactttcctcatatgcaaacaaactcggagatcaaattgccattattccaagtgaaaatactgcccaaagtccaactctcaaaaactattctcaactatactccaataaatgaataattgactgggaacaggggaaaattttttatatactctttaagcaatcagaaactttattttaaaaaccaagaatgcaacagctgttatttcctattaaatctaaaaggctgtttttatgtggttaaccttcttaagaatgatcatctttaggaaatatgtggccacttataaaaatttaacctactattcatcatcaacaaaaactcaaggtgattttttaaagttgaatgagagaaaggaagcccatggtcttcaggacaggtaaatttgggtgtattccaactatggggaactggtcacttctcagaaccaattttttatgctattccagttacatttaaggatgaagctctaaacatctgcatatgaaacttgtcccaaaataagttttccacttatctccatgtttacacaaggagagggccaacaacaaactaaagcagtaacagctccccggttgaattaaaaggaaaagaaaattggaatcaaaatttacttttcagtttttatttctacagtccaaacttagaacaaattgtcagcagctgctcttgtttaacgtctgacaccacagcggaggggaaaaccatgcaaacactcacagtttacaaacatcctttttatagagatctttgtccttgctcctgcaaaaatctcaggtagcttgttacttctattattaacaggaaatatcaaggagcaagaggaggagcaggtttttattttggactccttaccatatttttatagatggaattttgccacttggcttttctgtactggattcaaggaaatgtcctacaaagttatttacttcaaagtgtttctctcattcaatagaaattagggtaaaaatggaaacctagtattttgaaatcagctttagggggcatctgggagacccctgaagtattacataaaatgaaattaatgtgctaaatcttccgtcagaccttcaaaggtgtgtatgaccctcccaaaactgaaaaactaatgaactagggaagaacaacagaaagagtatcattagagtccaggggagtagcaaaatgattgagtgaagaggcaaatatctttaaataccatcacctataatgcctaataatcatcaacagaaaacaggtgaggcctataaactctagcagcacatttaattggattgtattcctattgcaaacagaagtatatgtagagagagatgtataaatcggattgtgaatacacagcttcaatctatcaaaattgtcatgcaaatataattgatcaaggtcatagctgcagttttcaaattagaaaatttgctattgtccccatgagctgtctatatagcttgtgtttctaaagagagtggtctacatagtttgggttaccttgggatctgtgggaagtagacgaacaattcgtccaagtttgcccaagattttcccagttttagcccggaaagtcatgcgttccaggaaccccttcaatcccgggcaaactagggcagctgtcactctagcagggaggactgttaaagcaataaaaacaggagaggctcaagattctccctttacctttaaaaagaaccactccaatttatgtcagtttttatacaacaggttttgcatcatattttatttaaaaaatgactccatgttttcttcttttaactttgaaggtcatcagtttagtacttgaacccttttatctagataagacaacttagtatgggagaatataagcaagtttcaaagctacgtaacaacatgctattgattttaaaagtgctaatgatggggccctgaagcttgtcctcataaacagagatatgctggttgacacctaggaatgctatacatgctgaattttgctgtggtgctgggtatagtgtgaggaggaaaaatggtgcttcgttgccatgaaaaaccagatatgattacagaaacctggtttcttcttatttgtctttccctttgaaataactcaaaaggataaataaagcaggaaatttttattcagcaaagcttccaagcacacacgcttttttggacaatgttttgcagaatagatacttcagccactaatatgtaaatgaagaggccagaggccatttaatgccttgtatcactgacagtgcaaaagagcatttttcaaacaattgtctaatcagcaaaaatttaaccataagagctacttttccccacaagtatgaaaaataaactatgtgattgcttgtttttttaaaaaaagggaatagctatattcttacattttagttaatcaatgtagaaacctcacaagtagaaaaatcaacttatgcattaaatctaccttcatttatttcagatacagaaaaacaaaaagaacatgaataaagcatacctttggtcctcgaatagaaagtccaggttctcccttaaatccaggtatcccaggtcctcctctatctccctgtacatttcaaataacatttcacaggctacagttgtgcgagaaatcacaagcacacatagcaaaaaaaaccattggccactctgtaaagagcttaatctgtccatctcagaccttgagatagtatattcttcaaacatatttgaggggactttcaaatcctaagtaaataacacctgtcagtaaagactattactgctgttgggagaaagtccattgaaataatatgtggcaattcagactcaaatatttcgactttaagaatggctgagaatgctcttaaaattgagtgaaggccaggcacagtggctcacacctataattccaacaccttgggaggccaaggcaggcgggtcacttgaatccaggagttcaagatgagcccggccaacatggcaaaaccccgtctctactaaaagcacaaaaattagccaggcatggtggcacatctgtaatcccagctatttgggtggctgaggcaagagaatcacttgaccccaagaagtggaggttgcagtgagacaagatcgcagcactgcactccagcctaggggaaagagtgagactgtctcaaaaaataaaccagtcaaccaacctgagtggatatctcttctgctaaactcttcaattataaatcctggtagattcttctgaataaatgttctaaattcttacctgcattagggtttaggatttggaagacgtaatgaagggtaaagtgacaagcttgggaccaagagcacaaaatctggtttctagtcttaactctgctgctggctgtagtttgcttatctgtgaagtttcagagttaaacggaatcatttctaaggctcttccaaaactaaaattctagttcactggtatcatgatttttttttctccaactgccaaagggtcaagaaaaagaaaataatctccaagaatatatacctttggcccaggtggtccaggaattgatgttccaggcattccaaaagggcccataatgcccggttcacccttaaaaagagcaaaatgctcactacatttcaagcagagaaagcacatatagagacaatattaagaaaagtacagaaatgtctgcagatttttaaattatgttatgacctctatctgtttcaaagaccaatgtgaaaataatttgagcatcttttgtaaccactgctagttattgactagtaagatttcagtgcttttaaataactatgttcaattaatcactgaatgttaggaacattttatctcttgtgcagcctcttattagctaataaaaattatgcaattcatggtgcttcctttttgtgttgtatgttgggaagctcaaagagaatttttttttcaatatagcaattatcttcagcaaatgttttagggtgtacttctaggttataactcttttttctttgttgttttattttaatgaccaaaggtaaaatagtcttccattccatgttatctcacatcctttttaagaagtagaacccctatgggctgggtgtggtggctcacacctgtaatcccagcctttgggaggccgaggctggcggatcacttgaggtcaggagttttgaggccagcctggccaacatggcaaaaccccatcgctactaaaaatacaaaaaaaaaaaaatagccaaaattagccagacatggtggcatgtgcctgtaatcccagctactcaagaggctgaggcaggagaatcactcaaaccctggacgcagaggttgcagtgagctgagatcgcatcactgcactccagcctgaccaacagagcaaaacgctgtctcaaaaaaaagaacccctatgattttaaaaaaatgacatttttaatagaaaattttaaacatttagtgggggagatgtctaatatttagagtctcaaagactcaatctggagcaacaggtaattctcctgttccatctggatctagacaagtgattctcagattttagaagcagaggaattatcaggaaagtttggtaatgcacagttctgggttcaaactccagagattctgattcaatagctctagaggttggggcccaggattacgaaattttatgaagcacccctggtgaaaaacactattccagagcaattgtcaccgcacaccgcaaggtgttccaaatgacccactgggatataaagaaaatattacaacttgtctctatatttttatctcatcaattaaaatttcatttatataaattcataacatattagtatgatagcttataaacagaaattacaattaaaaaattaaaaatctgtggcatgtgatcaaaattttactggaggggtttataatcaaaacagtttggaaactacttctctacggtaggtgggccaaatccagcccacccccttgttttgtacagccttgagctatgaacggctttcacattttcaagtggtcattatacaaataactaaatatcttccattttgcctcttgggccacaggacctaaaatatttactatctggacctttaccaaaacaaacaaacaaaaaacactgtggagatgagtcgtggagaatgagctgtatctatgctatgtctaaacatgaccctctaggttttcagactgctgactactcctgcctccgtctgactcatgtcctctgaaaattcaattgcatgagcttccttttcagtcatcctgcttcctccagcagggactccatcagtcagattcaccagtgatgactcctgcccagggccgtgttcatcttcagagctgaagcctcccgctgtattgattagccaatacaaccaacaagctgagcacactggcccactgagacccagttcttgccaaggcatgtatgtgccagtccttaaatccaaacctggaaggcaatggcacaggacatgacaagaatcgggaaacacaaaaaaaccccatccaagcctttgacaaaggaacagaacatgaacctgttaaaattcttcactaaaaccaaaggaaaatcaaaattatgtctctagatttaattttacttcttttttcaaaaaaagaggtcaattacttttataccatgaaaagtatcatggagagtattaaaatacaggtctcaaataccctgtattaaggggtgattatgctttaacatatggcaattcttcaccttcatctttaaaaacagctttatttcaaaacacagaaaaatgttcactttgaaatagagtaactaggacataaagactaatctgttattaatactaatacaacacatctgttacatagtggcacttctcataatgtgcttcctgaactccctgcagcacagggcatttacttgagaagcacagattcctgggctcactcaccactgaatccagagagctgaggatggtaacaagaaatctggatttgtaatcatccccaggtgataccgatggacactgaatggacactgaagtttaagagtcactggtgtacaggtgatgttttgtatctgatgttgtcagcaccattttttaaaaatgtgctttttaatcatctggtcctaaaatatactccttgtctctttctcacaattagtatctttctagagacatgaactctcttacgtttgcagtttctgtttcctgacacattcaaatgaccttaatggtgggtctctgaggctaagtcaggacacatacttaattgctcacctcacaatccccttcgcttcttcctcagcactgtgttatcaacaatttaccaggacatagatcccctacttcccatttcaccatattgatttttttctctgaataattcgatgtattcaacacttactatataccaggaaatgtgctaagtgctttattaactcttttagtcttcacaacaactctgtgaaatagagcatatcgttatcttctttctataattgaagcgacttgctccaagaggttcatggcacaggaggatgcaatcagccttccaaagaagagccttcatcatcactgtgctgcctctcactctcaggcttttgggttgtttagcaaagcaagattatgaagaactgatagctcctatggtcccaattttatcccaacttctgaatatttggttgttactagagaggactgacagacaaattaggaacataagtatttctatgagtattacatattttatgcaatctattccattctattgtggtctgggaatagtatgttttctataggtttcttattttggggtatttgttttgtacttgttgggaaggaaacaaggaatccaattttcagtggaaatttaatactatattaaaaccagacacaatacaaactcctcaaagcgtaagtcagaatacaagaaacatacctttggtccttcgggccctggaagtcccctctgtccttgatttcctttgctccctttcttgccttcgtcaccctaacaaaataattatgaaaatatagattttcgtatggtattagcaacctcccctaatctagcaaggaccatagcggagccggattctcgactaataccaattttaaagtggtgtgccctgagcacagctcaattgcgcaggattcgtcaatgttcttgaggagatcagatgacttcagattgttcagcctttactatttattcaatatgatttgctatttttcaaaaatctaagttttgtatctttcttttggaacttttgtttgaatttatagttcattttcacccttggtctattaacagatggttctgagacattcacagtttcagaaatgagtactatctatgctttttcatgctgtttttcaatttttctatttcaggtttaaaagatgaaatgagacattttaaaaatcacagccctatttcgtcctcactggggagtctaattctttcccccaaaagagaccaatagttttattggcaggaagatgcttgagcattaacctggggcagagctaggaactgactactagatgttgcccagcagggttgtgtaaaacagtgctctcccaaaagaattcctttaccttcaaaactatctttcaactagggttcaactgcaaggcgccatatccagggatgtacacagctcaacaaacgaaaaaaaaaaaaaaaattcctcgtggtctgcagctgaggctatttaaatatttatactataaattactataccatggtttttaaagttgagcaacagaatcacctggagagcttgttagaccacagattgctgggccctccacccagagtttctgatttagtaggtctgcactgaggtccaaacatttgcatttttaacattcccaggtgatgctgatgctgctggttcagggaccacactttgagaatcattagactatactaaggtcatcagcaaagcaggcactttattaagaagagatgacctcctgtagaatccacagaggtttccatggtccacactaatgtaaagcagtggcaccggtgtaaaaaaaaagagttgaatgtccaaatatcttatatcattatcacttaccagtagagacaaaattcaaccacaactctttattttcttccctccactaccactaatttaggttattgacctaaatcaccccagaaatgaacagcaggaacccaattacatgtaataaatcgccaacactgaaccatggtatacctgggctatgtaacatgttcctaccactcttctccaataggctttcataagccacaagtcacctcaagccacaaattcagtagcctctctttccaatgcacattcttcttgccttattggtggcatctgataccacccattgctttcatcttgaaatcctttctcctcagtatccctaacatgctaccattctgcctattctgtagagttgttgttctccagctacctcacaatgtggggtttaaacctcaactctcttccttagagacattgttcattctcacggcttcaattattaactccaagcgcctattttccaaaaacacatcctaaaaacaattctcctgaatgttagcagatcggcatttctaaaagtatatttcacgtgatgatgttatcccctccacctcacccaaaaaggatccccgagactggtaaatcaataaacaaaaatgtttaaaagcctacaaatatatttaaatttcatgtcctcacatttaagattaaggattcaattttagtgagtatgttcacaagacatcaattactattttagtagaattatgaacagaacactaatatgtatacaaattttatttttacttgacttgtatataatccataacaatctttacatgggaattgataactacacataaaaatagaaagaagcccaggcgcggtggctcacacccataatcccagcactttgggaggctgaggcaggtggatcatgaggtcaggagttccagaccagcctggccaatatggtgaaaccccatctctactaaaaatacaaaaattagctgggtgtggtggcacacacctgtagtcccagctgcttgggaggctgaggcaggaaaatcgcttgaacccgggaggcggaggttgtagtgagccaagatcgtgccactgcactccagcctgtgggacagagtgagactccgtctcaaaaaaaaaaaaaaaattgcaggaagacctggaatcttaggggctataggttatgtcactagttgtcttatcctattgatgaatttgtatagtctcatcttaacatataaaaatgttattcaactagcatttctacagtggttaaaatagatttatgccaagttgtgaagtgaaatggccattcaataaagtgatatttcttattgcatgagattttataaagaaaatttatggactgtcaaatctcaacgatgtatctcaaggcttcttttccttcctatgtgttttttaaatgtcaatctgaccatttattgagaaaacgtgtgtcaaactcttctctatgctgggtcttacaatagacgttaggaaaataaaagtgaatcatatacgcttgctgtcttccaaaagcttccaagacagtattcatacttttaagccagacataaacacattgacatagtaagaataacaatcaaatttcttctaagttggctcctcagtatgaggaccagaacacaggctgcttccaccaacactgtcatttccataccttggggccaggctgtccttttccaggtggtccttctgggcctcttgctcccggaagccccgcttctccctagagaaaatgacactgatgtgttagctgaccctccagtagacagactgtacgtatcatcccaccttgtctccttttatcattagtggattcagctgagactctccaaaacacaccataccttcactctagtctcaaaatcaatttggaagtttataaacttgaaataaagtaacatcaaactccagtttaactcagagcagctgcaatatcatgaaaaagtaatttatcagccaatttccaaagcaataagctcattttcttttggctcttcattcgcatttggtagattttttaaaaaacagggaagaccttcagcctttccatctgctgtttttttttttttttttttttgctacttttactgaaaaatgagtatttcaaatgtcaacacaaaatacttcaggaaatctttacaaaggccttatttcctgtatgcatttacagacttgcctcttagggggaggcggggggagtggctttctcttaagtttaaattaatgtgctttctagaaatcctgaagaaactaggccataaccaaaacaccagacagaaggcagaggatgtgagacactatctcagcctttgaataggccactccttctctcagggagaagtggaaagggacatttgggattgtgagatattttttcttaaagaaactaagtttgtcctgaatggttttattcgagctcctgcaggaccaagatatcagtttggttcaacagttcctactccagtaatacgaaaaacttggtgttaccttcttccctgcagctccatcttctcctggtactcctggttgtcctgggagccctattgagcctggctctccctggtgaatgaacaaatattttatttccctaaagttcatacctccattctgaggtacttgcaattggatgtatcttacagtgtctgagaaaagcctccgagaaatctcattagcaattaatactaaactatttgatcttgggaagctacttaacatccctaggccttagtttttgattctatttttatgggctgaattgtgaccccaaaaagatatgttgacatcctaactctttgtacctgtgaatgtaaccttaattggaaacatggtctttgcagatttaatcaagttaaaatgaagtcattacaggggggccctaattcagtataaaaggtgatataatttggctctgtgtccccacccaaatcttatttgaattgtaattcccagtgttggaggaggggcctggtaggaggtgattgagttatgggggtggacctcccccttgctgttcttataatagagttctcatgatatctggttgtttaaaaatgtgtgtgtagcatgccccacttcactctctctcactctcctgctcctccatgtgaagatgtgcctgcttccccttcaccttttgccaggattgtaagtttcctgaggcctccccaaaagtcaagcagatgccagcatcatgcttcctgtgcagcctgcagaactgtaagtcaattaaacctattttctttataaattacccagtctcaggtagttatttaaagcaatgagagaatggactaatacaacgggtactataagaagaggaaaatgcctcttgaagacagacacacagggagagcaccatgtgataagagaggcaaagactggagtgagcgtctgctaggcaaggcatgccaaggattgacagacaccctgagaagctaagatgagaccaggaagcaatctcccttacaggttttggaagaagcataaccctgcagactgattttggacttctagcctctagaactgagagacaataaatttctgttgtattaaggcactcagttcctagtactttcttacatcagctctagaaaactaatataaaagtgaaataacaaatttgtgccctaacaacacttccagctctaatattcagtaattccacttgctttcgagttaatttacgattagtaataaatcctttaaaatgttcaggaaaaaaatatgctactttcaatcagtttaaagcatctttatggcatttattaatagcaacaaaatggaaaataattgaaagcaacttcaactaacctaaacaagccagtgaaaaaaagcacagtaaatctaacactaagtagatggaatgataaagatgagagaagaaaataataaacttgaaaacaaaaagtaagaagattcataaaacttaatgccttttttttttttttgagatggagtttcgttcttgttgaccaggcttgttcagtggtatgatctcagctcaccgctacctccgcctcccgggttcaagtgattctcctgcctcagcctcctgagtagctgggattacaggcatgtgccaccacacctggctaattttgtattttcagtagagacgggctttctccatgttggtcaggctgttcttgacctcctgacctcaggtgatccgcctgcctcagcctcccaaagtgctgggattacaggtgtgagccaccgtgcctggccagtaatgcctttttaaaaactaataaaagtaaataaatttctaataggaatgatgagaaaaaacctagaataataggttttttaaaagatatcaataaacaatatcaaaaatgaaagacataactatatatatagtaaaaatgttttaagtcatagaaaattggtgataattttttcaaatgtattggaaaacaataataatctttgagaaaaatatgaattatataaatgctgtaaaaagaaatgaacaagctagataaaccaataatattaaataaattgagtcagtgattaaaagtctctactttctctctctccaagatcacaagcttagttggttttacagtcaagacttaccaaacttctaaacttttgaagaacagttattccctatcttatacaaacatttctaaaaaaaatagaaaagagggacgtctacctaatttattttatgaggcttataaagccttttcaaaaacaattatacaatggcaagacaagaaaacaaaattatagaccattctccctatgagacatagcacaatttaagcttccaatcaaatgctttaatttcttccagtgcctgtacaaagtttccaggtcataatgcagggattgagaaaccagggcaagttcaggcatctctctaaggagacaaacatgcatctgggtgaaccaaggtatcaaaagttcacagagtagattaccagaaagagttacacagagaaaactataagtatctgctgagcatccatcttgagtattcagctgaatattgctcagtacatgtgtgtgaagaaactacccaaggccaggaaaacaaccaacttaaaggattagagagaactgacattgaaccaggaatagtgcctatttctactggcaagaaataaaacctcacaattctgagggcataaattggagttctaaaaagggtcttacctcaacagtgggaaaaaattaaccctagactaaatgttgctgtagtcttacctaataaaacttaaaagcaagacccaaatgggtcaatctgttttcaagtaactaaaaaacatccaagaacaaagctcaaaatagaggaatacaaaaatatccaacacaataaaaggtaaaattcacaatgtggggcattcaataaaaaagtattcagcctgtacatgcctgtaatcccaactactcaggaggctaaggcaagaagacagcttgagcccaagaattcaaagcaagcctaggcaacatagcaagaccccatcttttaaaatattaatattaataataatatttaatttaaaaataaaaaataggcgttcaaaaaggctgaaaaatatagcactttgtgttgagaaaaatcaatcgattgaaacttatccagaaataacaccagtagtagaattaggaggtaagaacattaaaacagttattatgactatactccatacagtcaagaaaccagaggaaatttaaagcatgttaaatagacaaatggaagatatatgaaggatacaaattaaaattttagatttgaaaattatgatgtatgagataaaaaacactggacagaattaaaagctgattagtgtcatggaagaaaagattagtgaactaacacatatagcaataaaagctatcctaaattaaacacagagagaaaagagactgaaaaagaatgagcagagcaccagtgaactgtgaaataacctgaaacatccaaatagccaggccaacattactaaagcccatctctactaaaaaatacaaaaattagccaggagtggtggtgccgcctgtaatcccagctacatgggaagctaaggcactaggatctcttgaacccaggaggcaaggctgcagtgagtcaagagcatgccactgcacttcagccttggtgaaagtgagactctatctcaaaacaaaaataaaatccaaagataagtaacactggagttcctgaggtgaggaattgctatttcaagaaatactggccaaatattttccaaatttgatgaaaactataactcatagatctaagaatatcagtgaaccaagaataccaatgaacttcaagcacaagaaacatatctaaggcacattataatcacaccactcagaacccatgatgtacaggaaatctcaaaagcagccagagaaaaaaagacatgttgtgtagagaaacaaatataaggataacaacacatttctcatcagaaacaatgcaagtgagaagacaatagaacaacatcttaaaagtactaaaaggaagaaaaagcaactgcacactataattctataaccagaaaaaataataagcaaagattttttttttggaagttgatttggcaatttcttggaaagctaaatgaatacctaccttctgacctagccatttgacttctaggtgtttacccaagaaaaataaaaacaaatgtccatacaaacacatataaaaatgttcatttataacattttatttatgataaaatttataaaaatttataaaatttatttaaaatttttatttataatattccaaatctggaaaaaaacaaaatttatacacaggtgaatggataaataaattgtggtatatccatataatacaatactattcagcaatacaaaggaatgaactgttcatatatatgctacaacatggatcttagattttgctgcattaaaagaagccagaaaatatcatatagtatataattccataaaaatctagaaaatgcaaactagtctatgatgacaaaaaacagatcaatggttagcagataattggaaagcagatctgtgggaagcctattagtgaacatagaagaagttacagagggatagaaggacagatggtaacttctgagggttacagaaatatttatcatcttgattgcagtaatgattccaagggtatacacatatctcaaaacatcaaattgtatactttaaacatgtgcatttattatatgccaatcagataatacagttattaaaataaaagcaaaaatcctgaataaaagattagtcagttgaatgatcatcataaaaaagtacacataatgaattgagtttatctcaagaatgcaaggatggtttgacatctgaaaactctgtaaatgtaatgtatcgtattaacaagttaaaagtggaaaacaacacaattatcttagtagatgcataatttgataaaatccagtaatcatttatatttaataagtaacttttggtacaaccaaaaaagaaggaagcttccttaacctaatgaagggtatctatcaaaaactttcagcaaacatcacacttaagagtgaaattttagaagcacttcttttgaagtcatttcttttaaacattgtacaagtgatcctagcagtacaaaatgataaaaaaaaaatcaaagaagagctaaaaaataataggcaaaactttatattcagacagtatgattgtgtacatagggactgaaaaagcaagagattccacaaacagatttcacagggtggctggatacaaaatcaacatgccaaaaaacaaaacaaaacaaaacaaaaaaattctcctatagacctatactagttagttaaaagatatagaaaaaaaattcacaattataaaaatttcttcaaggtatctggaaataaatttaactaaaaaaatacaagacctttatggagaaaattacaaatattttcttgaaaaattacagctttactctgtggtgtgaaagacttgctatttaatctgtagatttagtgcaaaccaaatggggtatcctgttaaatatgacaagccaaccctaaaacatgtatcttagagtcaataataaccaagaaagaagatgagagtatttttccttttagatgacaaaatatattataaacctattataatcaagacaaggaggtaatagcactgagagatataaatagacaaatggagtagaatacacagctcaggcactgatactcaaaatatggaagcttcatatatgaaagaggtggtactgcaaatcagtgtggtaaagatggactattcaacaactgattctggggtacttgtttatttatagtaataaaaaatagatccctacattgacccatacacaaaaataaattccatgtgggttaaatccctaaattttaaaaacaaaacactaaaattttcagaaaaatgcataagaatatctttatcaatctcaggtcaagaaatgttttaaaataatattcaaaaatcacaaatcacaaagggatagaaatatagaatttaaaacttctgtatactaagaagtactctaagtgaaaaaaataagtcagagcctaggagaagatatttgcagtttgtataacacagtaagatatatttgtacacacttcatatttgcacagatttagagaaaggaacatcatcgcctactgctagcaggaaggtaaactggcacaagcattttggacaagattttggtagtatcacaattgaagactcgcacgctctatgatcttcccattctacctctaactgtctatcttctacaagtcaagaaacttgtcctccaacgtgtgcaaaaggaaacagaatgtttgtggcagcattgttggcaaaagcaaaaagaatgacaagcaatttaaatatccaccatcatgaagatgaataaatataaaatgagatattttcatacagtggaatactataacgcgattaatatcaatgaattagaggcatacaaaaacacaaataaaacataaggctgactataaatatattgcagaatgatatatcatgtaaagtttaaggacacaaaaaaagtgatatatggtttatggataaaaatgtgtgggaaattataaaaacttcaaaagaatgataaacaccaaattcataataatgattatgtgtgaggagagaagggagggcagtgggattggggagtgccagcagggaccttcagccacacctacaatgtttcttttaaaaagtctagagtcagtgtggtaaaacattaacatttgataaagctgggccgtggaatacataggtgctctttgtattattctctgtatggtgagtatatttgaaatacttctttttttttttttaagatggagtctcacttcgtcgccaggctggagtgcagtggcgcgatctcagctcactgcaacctccgcctcctgagttcaagtggttctcccgcctcagccaccctagtagctgggactacaagcacgcatcaatacgcccagctaatttttgtatttttagtagagacggggtttcaccatgttggccaggatggtctcgatctctcgaccttgtgatccacccgccttggcctcccaaagtgctgggattacaggtgtgagccactacgcccagcagaaatacttcattttttaaagtaagtttaagattgcacgtcataagtagtgaaactgagatttaaacttgggtactctaacggctgagccttactatatcgtatattgcctctctgcaattgacatatatataacataatatgtttgtatacatacatacacagaggcatatattacacatatgtataaacatatgtcaaacttggcacttagtatactgtgtagcacatggaaaccatgtaaaaatggcagctattattactatattaatacttttttatcctttgtaatcatgtttatgtatgtaacatgtatattcttcttagacctacatcttatatattcttctaatactcaaatgctcgtaagaatatgacaacaacagaacaatggtgaagttgagcgctcaactggctctctagatcctatataacttcaggatgacttatcgaaactgtgaagggtaaactaagtattcgttcatttattcagcagtatttattgagaatctatcatgtcccgaaagctggggattctataataaaccaagataaacaaagtgccaccctagtggagtatatattttagagcagcactgtccaagaggaaaataaagcaagccatacgtgtaattatagcttttgcagtagtagtagccgcacttaaaaagtaaaaggagcccattatgtagagttagataacacacacagagtctgtaaggcaattggatataaaggaaaccttatataatgttacataaagtatcatatcacttctgagcagcagtcaactcacctttggaccttgtactccaattcccactggtcctcgagggcctgtaggtcccatttggcctacttctccctagtaagaaaagagtttaatacagcagcaaagtgaaaataatatattcctgctgttgatctcctaaaacctgtcttatatcaacaaagtaaaacagtttcatgtgctcaattcatatatattgcctgaaatcccttcgggggatggatttgcaccagatttggaatatatatgtaaatgaaaaatgtacataatgtttgatgtatatatggtctgacttaaaatataggccacatagcatattcaaaattgattttaaggagccccttgtggagggtatctggaaaagataggcagttgcattctagaacaactaaaattggcacaggaaaagccaaggtaactgctgatcaagagcaatgtcataagcagagaacgcaactcaagctttcaaggcaggccccaaatcaaaactctcaagaatagtcagagtggtccattgagcagcttctcacacggacagctctagggagtgtgttctaaggtgaatagtctcagagaagtattttatttatttaacaatgattcatgattcttagaagcaatattaaggataactagttaaataagtgccatgctcctcctcaaggaaaaaataatagttccaatctatgagatagtttgattcccaagtaaataaaacatttttatttgttaggtcatttctgaccccatctctttagctaaggttttagtagttgcacctactgtcagagtggtggtgagaatgaaaattagccaacctagagagacacataaccactggttgcctctattaatattactgtttgagttggtagaataggatctcataaataaaagtaacaaagaaaacaacaaatgaaaattgtgtaaataaagctttcttaaagcataaagaatacatattacattttctaaattgtcaggaatatcagtaacattttgcattaagtagagatctctgatttttaagttcattctacctgctgtcttcccttgcactggcactgatcagaaaacagcaattatactatagatatattaaactccgctctcatttacaaagttaccttggaaccaggtaagccctgtcctgcgggcccttgtggaccaggtggaccaataggaccttggattccctttaaaataaaattttataaaatagtgttagtgaaatgaagtagtttcaaatcctctaaagtgaaactttagttcataccccataataagttacttacactcaataagcatttgtggagtggggtgccaggggctgctagttaaaccacaatttgcattcttccctatttccatattaatagaaattttagctggcccgtatatctgcctagaataaagaccacgtttctcagtccctgttgcagccaggcgtggccatgtgggctagattctagccaatgggataggaatgaagtgatgtgtgtaactcctggttcatgctaaaagaagaggtatgccttctccttcccttttcctcttcttcagtagctggaattaagagagggtggccatccaggatcatgcagatgaggaaagcaccctcagtatggcagactatcaagaccgattaatagaggcagtagtcagttgattaacagaagcaatagtcagtagataccaaactgaagaaggttcaaacacttgactccctccttcacaatataaaggaggtttttatacatgggtataaaaaaggatatgcacatatgtgtacatttgtatatgtggttgtttatttttcactctatttgtaaaagatctgagttgatcaagcctccaaatatttaacaaaaatctgtgggccatttaagagagattgtaaacatgttgctggaaacagaagttccctcataaacacatgagggaaaacattcatttttatgagagaaataggaagatctaacataacaagaattcaatggataaacacatcaaattaaagaacattgaataactgcatagacagaggttaaatttaagtagaatttatatcatttgtcttaaaaggtaaataaattcttttcttgctcagatcattttacaaatagagatctcatttccaatagagatcagctctgtaaggacacatctacctcgaaatttttttttctttacaaaaagaagaaaagggggtaagaaaatgaaagaagtccgagacttttgttttgttttttttcccaagctgaagaacaacaacctccaccaaggaacagcattaaaggcgacaggaagctgtaggtaggaggtccagaattcacaggccatctgaacagacttgtcttcgaacctcatatttagccccatagtggtcactcagcaccaggagcactgcaagacccaagatgtgacaacactgtccggccacttttgggataagtaagcccctgctaaaaccaacaaataaactaaaaggcttgagaatgtcggctggtataatcaaatgatgatatttgagtagcccaaatgtccagctcttaattattatctaaatatttatttatacatttatcttggcttcttctgtaccttaagattcctaatgtgttagactaggacctctgccaatggcaagggaatggaaaaaggagtcatatccaactttgctgttgtttggactagcaagaaaagtaataataataataaattagcagccaattagaaataaacccaaagtaaatctcaacaatgacaccggaattatctcattttttaaattcttcccttctcccactaccctagatacagaaactagatacagaaagcactattcattctttaagcaatagaataattcaaaccttactcataaatcttaatcaaacctgacctgccactttctaaccaggagatatttagcataaaactgaatttgtgggttgctttgattaataaggctgcgtaagtatatggcaaacaacaaagtatatggtaaacaaaagactacatggtaaacaacagtagagagtactgttatactatcttcacattatttagatttatcacaatacccagattttccaaaagttatcagaagattttggaaatggttctaatcacgaatgtagacattcttacagatctttcttttcttctcaccaagaggggccaggtgtcatttataaattatatctgtgttttgcttctattccagaagtttgccccttaaactaagtggttatctctgatcctggtccaagttttaactataatacttttttaaaaaatggatatgtggctagttagagtggttggtagggggataccactctactccattgggagagagtgggatttaattttcacaaagcttcaaggagaaaaaaatacacaaaccagcaggtgagtaaactattgttcccaaggggaactaaaaatattgcaccaaaacatttaccttgttaattaggttttaatgttaaaagtcacagcatcaagaaacacactacttattttttaagcctttggaagttctaaaaaataaaatcttctcatgaaaccatcttatccttccctatattcacttctggacttatactccactgcaattaactgtcaaatatactcatagatgtttgcaggactggccttcaatgaagaccaggattgggctggaatgttctgcactgaagggaaaggaagaatgcattaattacctgttccccttgactcccgattccagggatacccattggtccttggggtcccacaggtcctatatccccctgcacagaaaataagccaggaaatataacaataaaataaaatcttattatttcatactttgctaacctggaattgggctgtgttaaaatctatctttatactataaaaaaaattcaacatggaaaattataaaactttattttattcctttaaaagtttataattcaaattccccaaaatagtaaatgacatttttgctattcagtctaagttggtgagcatttgtataggcttatatttatcaatcattttctcacaaacaaaatttcctgaatagttgttatgacacaaacatttcctgctaagattgtaacagaaatatttaaaagtagaaaattcataggatataataaaaatagaatgagagataaattgaagaaaaatatttttaaattttctaaataccctttccctccaaatcttattgaaaatgcattttgaaaatgaagaaatgatctcaagtgaatgcagcaaaattaaacagccctattttcttcttccatgaaattgagaaaacaaaattaaagttaccagcaagaagaacataattcattctttctgtgtctttatacaggtgtttgttgagtgcccattataagccagaaagtgttccaaacactaggaaaacaacagtgaccaaaacagctcaaaatctctgtcctccattgagcttagattttagtaggggaaacaagatggtaaacaagacaggtagataaaataactagtatgttgaataataagtgtgaaggagaaaaattaatcagggaagagaagaggcagcgatgattttggttaagatgtccagagatgaagtcactgacgagagggaatgagccaggtagaaacccagaagaaaagcattccatgcagagaaacagccaaaacaaagatgatgcctgacatgttccagaaacagcaaggagacagtgcgggtggaaccatctccatgagggagagcggtagacaatgaagtcagagaattatggcagtggagtcaggtagaaggatcagtggggcctttgaggccactgtaaggacttggctatcctctgagtaagttaggaagccactggagggttttgagaagggaagtgagagatctgacttggtttttaaggccccatctggaagctgtatggagaacagactgaagggggtctgcatgagagatgatggggcacaaaccagaatgttgagagtggaggtggtggggagtgctcaaaacctggataatgttgaaggtagagtgatgggatttgctgaggactgaaaggactcttggcagaatagagttgtcattgactgagaagaaaaagcctgagagaaaagcaaggtttgaggtggagggtgatatcaggagttcagttttggacatgtttagtttgagatccctaaaatgaacatccaaatggagatatcaagtaggtgggagaggcctgggatgagaacataaatttgggagccctcagtatataaatgatattaaaggccataattgagtgaatttgccaagtaatagaaaaaagagatggtcccaggactgagccctttaagcactccaatcattagaggtcagagagatgaagaagtcacagcagtggagactgagaaggaagcagccagagagaccaagtgaagagagtgtttcaagaaggtgagggatccatctgtcaaatgctaccaacagggcaaattagttgatgacagagaattgaccgctggattgagtaacatggttaacatgctcattttaatggcagttgtatttagactacattagggccgcaaaacttttaaacagttggatagcagatactttgggcttgagggtcataatgatgtctctcgtaattgatcaatgctgctttggtagtacaaaagtagccatagataatatatagtgaacaagtatacctgtggtctcataacattttatttgtaaaaacaggcagccagctcaacagttggccaatgtttgagctaaataaatatgtttttatgaagaaaaatgtatcatttgctgggcgccgtggctcacgcctataatcccagcactttgggaggcagaggtgggcggatcccctgagatcgggagttcgagaccagcctgaccaacatggagaaaccccatttctactaaaaatacaaaattagctgggcatggtggcacatgcctgtaatcccagctactcaggaggctaaggcaggagaatcatttgaaccggggaggtgaatggtgcagtgagctgagatggtgccattgcactccagcctggacaacaagagtgaaactcttgtctcaaaaaaaaacaaaacaaaaaacaaacaaacaaaaaaaacaaacaaaaagaaaagaaaaatgtatcattagatcaaactttatataacattaaatatatagaacctgcactaggagatgccctggaatacactacttagtgctctatcaacctttgatctacataaatattacggaaggaaaacataatggaatccagttctggctcagagctggactattttgattcagaacttgatttcttatgcatcagatattgtgcttaatgctttacatcctttcatttatcctcacaacaacccctgtaaagtggccatccccatttttcagatgagtgtaagtaactcaccccaggtcacgcaactgttagacggcagaggtgacagtcaagtccaactcatagccactagccaaaacccaactcatagccactagtttgcaaatatttgttaaacacataagagagggtccctttttgtgcagtgttattgacatttaaatacctgtgccataagtacaactttgttttgtaccatttacatacatttgagaggccttatcagaggcgtgtttatattatcacttgaatcacaaacatcaagccctctgaatctagtgttatatgtaaaagaacaggaaaggaagaaaggaaaaagaagatggtattgagggaacagcagataaaagctttgctatgtaataatatcctgatacttcagagtgatttctttgcatgacctccaaatgtaaaaataacatgcaccatgtcccaacaccacctgaaaaagttaatttactgaactcataaaacaatggttctgttgtattcagttctcgctgctccaaaggaagaaagagcaactcatgtattttttggagtattttggagttgctgtacagccagagctaagagattgaacaaagaattgtattgcatctaaaattcctatcactcactatttatttctgctatttaaatacaaacagctagaagagataactaccagcaaataaaaataagtcattcaagattgaaacccagcacttgagataatcatgaatatcaattgttatcctaatataatatacaatataattatctgcttaaaggctgatatataaatgactccaaattgatatgagttctctgcttttttatacatttcttatatccttccccctctggcagcttcacttccaatgctctttatggctgtatcagcctctagtagctcctatcaccagctccattcccatttctaatctggtataatctgcagctgttttaaagaaaacaaatagccagtgagaaagagaaaagcaatccctaacaacgaggagctgacctgaccctggcaagtaggccgtggtgtcaaacatgaacaatttgacaaatcatcaagatcaaacaaggccaccccatgactgtgatggaccaagatgaaagccagactactccataattatatctgagcacagacaaaaacagcaaacactatataaaaccctcaaattatcaaacatcctccaatactggctaaaatgagtgactgctacttctatcagttatgactcagcctaactccatttgtcccaacttctagatgagattcattaaatactcaatcctaaacttatccccaactattgacaacattaaatccagagcccatccctgatttcttaaatgcttcccaaaatcacctaacacaagtgcaaatcctatgaaatatctttcatcctcttcctgagtcactgtaggttcatcgtatgtggtcttccttccttcagagtcaacaagccttgctaaaactctggatggattcctgttggtccttgctggagggcatcaacactagttttcttaaatgagttttctgattttaacctgattttaagataatatttttgagtgggagcctagggatggatatacacttctataagaaggtcaagtcaatgttttttgttgtttttttttttagagatggagtcttgctctgtcacccaggctggagtgcagtggtgcaatcttggctcactgcaagctccgcctcctgggttcacccaccattctcctgcctcagcctcccgagtagctgggactacaggcgcctgccaccacgcccggctaatttttgtattgttagtagagacaaggtttcaccgtgttagccaggatggtctcgatctcctgacctcgtgatccgcccgcctcagcctcccaaagtgctgggattacaggcgtaagccactgcgcccggccaagtcaatgtttttaacaactgttttctttactaagaagaaatgtctttcgataatgtctggattcaaagctgctttgctgatggtagaagtcactggatgtcagaacccaaataagtgagacattacaataaatagaaataacctaatttctcagatcataactcatcctacataataacacaccttgcatatactagatttggagatcatcgtggacaggaggcaggactagatcgcagctcccactcggatggaaagaacagcatgtggaggctagcactgtgaacctttgctctagaacgactgcaggaatacatttggaaagccaagaaaacccacggacttgctgaagggaatggattgctcctgcaggacctgggagacatcccaaatattgtgagtgcccaaactatagaaatgggaaagggagattgtccgcccctgaacacatacccccactggggaacctgaaggtctagattatgggagctgagtcaatttagagagccaagcgaaatacaggagtagagaaagcagcaggaaaatccctgtgggctcagtgggttccctagcaagccatctctgcctcacatcactggggtccttgaggatggctgccagaggcactgggaaaagcccacagggggaaggaaacctccaactgaattctgtaataatttcaacagattgagaagtctcctggccagaactcaggaaagggcgtgaatccagtgtgcagactccacagacaggggaagaaggaaagctctactgactttcctagctgggaggtgggaagcctggggcaacctctcagccctactcacccactgcctggaaacagactcagtgttgttgggagggcacggtgggagtcagaccagcccttcagtttgcactggagctaggttaggactatgactgctggctttcccccacttccctgacaacctgtatggcacagcagaggcagccattatcctcctaggtatacaattccattgatctgggaacctctcccttacccccacagcagccacagcaagacccacccaagtagaagtagagtctgagctcagaaacacctagccttgctcccgcctaatggtccttccctatccaccctggtaactgaagacaaagggcatatactcatgggagttataaggccctgtccaccacctgttccttcccatactaccacaactgatgctctcttgaaaacaccacctcccaggaggaggccaaccggcacaaaaatactgtactaaccaaccaaagctaaggaccctcacagagtccatttcacccactggagcaggcgctggtatccatggctgagggacccacagacggttcacatcataggactctgtgcaaacagcccccagtaccagcctggagcccggtagacttgctggatggctagatccagaagagagataacaatcactacagcttagctgtcaggaagccacatccctagaaaaaggatgagactactaaatcaaggaaacaccccatgggacaaaaggaatttaatgacagccttgagccctggaacttccctctgacagggcctacccaaatgagaaggaaacagaaaaccaactctggtaatatgacgaaacaaggttgtttaacacccccaaaaaattacactagctcaccagcaatagatccaaacaagaagacatccttgatctacctgaaaaagaattcagaaggtgagttattaagctaatcaggaaggcaccagagaaaggtgaagcccaatgtaaggaaatttaaaaaatgatacaagaagtgaagggagaaatattcaatgaaatagatagcataaataaaaacaatcaaaacttcaggaaacatggacacacttacagaaatgcaggctgagcacggtggctcacacctgtaatcccaacactttgggaggccgaggcagatggactacctgaggtcaggagttcacgaccagcctgaccaacatagagaaaccccgtctctactaaaaatacaaaaattagccgggcgtggtggcacatgcctgtaatcccagctactggggatgctgtggcaggataatcacttgaacccgggaggcagaagttgtggtgagagctaagatcacgccattgcactccagcctgggcaacaagagcaaaactccatctcaaaaaaaaaaaaaagaaaaaagaaagaaatgcaaaatgctctggaagctctcagtaatacaatttaacaagcaaaaggaagaccttcagagctcaaagacaaggttttttaattaatccaaacaaaaaagaataagaaaatatgaacaaagcctccaagaaatctgggattatgttaaatggccaaacctaagaataattggtgttcctgaggaagaagagaaatctaaaagtttgaaaaatatatttggaggaataatcgaggaaaacttccccacccctgctagagaactagatatcaaaatacaagaagctcaaagaacacctgggagattcatcgcaaaaaagatcatcacccaggaacactgtcatcaggttatctgaagttaagaagaaggaaagaatcttaacagctgtgaggcaaaaacacctcactaatgtttaattgtaattctttaataacatattatatcgagcactaaatggaacttttaagttttataaagagtatctacaaaaaccctagagcagaagtaataataatgaactgttgaaatctttcctgtataggtaacctataaaggaaaacctatcagattaacagcagatttctcagcagaaactctacaagctagaagggattggggtcctatcatcagcctcctcaaacaaaacaattatcagctaagaagtttgtttccactgaaactaagcttcataaatgaaggaaagatacagtctttttcagacaaacaaatgctgagagaatttgccactaccaacccagcactacaagaactgccaaaaggagctctaaatcttgaaagaaatcctggaaacacatcaaaacagaaactctttaaatcataaatttcacaggacctataaaacaaaaatataataaaaaaggtatataggcaaaaaatagcacagtgaatggtacctcacatctcaatactaacattgaatgtaaatggcctaaatggttcacttaaaatacatagaattgcagaatggataagaattcaccaaccaatctgctgccttcaagagactcacctaacacataaggactcacttaaacttaaggtaagctgatggaaaatgacatttcatgcaaatggacaccaaaagcaaccaggggtagccattcttatatcagacaaaacaaactttaaagcaacaacagtttaaaaagataaagaaggtcattatataatgataaaaggccttgtccaacaggaaaacatcacagtcctaaatatatatgcacccaacactggagctccctaatttataaaacaattactaatatacctaagaaatgagacagacagcaacacaataatagtggggcacttcaatactgcactgacagcactagacaggtcatcgagacagaacgtcaacaaagaaataatggatttaaactataccctggaacaaacggacttaacagatacttacagaacattctacccaacaaccacaaaatatacattctattcaacagtgcatggtaccttctccaagataaaacatatcacaggcaacaaaacaagcctcaataagttcaagaaaagtgaaattataccaagcagtctttcagaccacagtggaataaaactggaaatcaactccaaaatgaaccttcaaagccatgcaaatacatggaaattaaataacctgctcctgaaagatcactgggtcaaaaatgaaatcaagatggaaatttaaaaattcttcaaactgaatgacaatagtgacacaacctatgaaaacctctgggatactgcaaaggcagtgctaagaggaaagttcatagccctaaacacctatatcaaaaagtctgaaagagcacaaacaaacaatttaaggtcacacctcaaggaactagagaaacaagaacaaaccaaacccaaactcagcagaaaggaaataagcaagatcagagcagaactgaatgaaattgaaaattagataaatgaaacaaaaactggttctttgaaaagataaattgatagaccatcagcaagattaaccaagaaaagaagggagaaaatccaaataagttcaattagaaacgaaacaggagatttacaactggcaccaaaaatctaaaagaaatccaagcagaaatccaaaagatcattcaaggctactatgaacacctttatgcgcataaactagaaagcctagaggagatgaataaattcttgaaaagatacaaccgggggaggagccaagatggccgaataggaacagctccggtctacagctcccagcgtgagcgacgcagaagacgggtgatttctgcatttccatctgaggtaccgggttcatcccactagggagtgccagacagtgggcgccggccagtgtgtgtgcgcaccgtgcgcgagccgaagcagggcgagcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccccacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgagaagctcgaactgggtggagcccactacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgactttgaagagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggttatcagcaatggaagatgaaatgaatgaaatgaagagagaagggaagtttagagaaaaaagaataaaaagaaatgagcaaagcctccaagaaatatgggactatgtgaaaagaccaaatctacgtctgattggtgtacctgaaagtgatgtggagaatggaaccaacttggaaaacactctgcaggatattatccaggagaacttccccaatctagcaaggcaggccaacgttcagattcaggaaatacacagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaaaaatctcactcaaagccgctcaactacatggaaactgaacaacctgctccggaatgactactgggtacataacgaaatgaaggcagaaataaagatgttctttgaaaccaacgagaacaaagacacaacattccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttagcaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtggacttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgccgaaggtaatttacagattcaatgccatccccatcaagctaccaatgactttcttcacagaattggaaaaaactactttaaagttcatatggaaccaaaaaagagcccgcattgccaagtcaatcccaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatggaatctaattaaactaaagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactgtattaagaaaatgtggcacatatacaccatggaatactatgcagccataaaaaatgatgagttcatatcctttgtagggacatggatgaaattggaaaccatcattctcagtaaactatcgtaagaacaaaaaaccaaacaccgcatattctcactcataggtgggaattgaacaatgagatcacgtggacacaggaaggggaatatcacactctggggactgtggtggggtcgggggaggggggagggatagcactgggagatatacctaatgctagatgacgagttagtgggtgcagcgcaccagcatggcacatgtatacatatgtaactaacctgcacaatgtgcacatgtaccctaaaacttagagtataataaaaaaaaataattaaaaaaaaaaaaaaaaaaagaaaagatacaaccttcctagcttaaatcaggaagaattagatactcttaacagaccaataacaagcagtaagactgaaatggtaattttaaaattaccaacaaaaaatgtccaggactagacggattcacaacaaaattctaccagacattcaaagaattatcaatcctattgacactattccacaagatagagaaaaagggaaccctccctgaatcattctatgaagccagtatcatcctaataccaaaaccaggaaaggacataaccaaaagagaaaactacagaccaatatccctcatgaacatatatgctaaaatccttaacaaaatactagctaactgaatccaacaacgtatcaaaaagataatccaccatgatcaaatgggtttcataacagggatgcagggatgggtttaacatacgcaagtcaataaatgtgatacaccacatgaacagaataaaacaggctgggcatggtggctcacacctgtaatcccagcactttgggaggtcaaggcaggcagatcacttgaggtcagaagtttgagaccagcctggtcaacatgatgaaaccccatctctactaaaaacataaaaattagctggatgtggtggcgggcacctgcaatcccagctactcaggaggctgaggcaggagaattgcttcaacctgggaggtggaggttgcagtgaactgagatggcaccactgcactctggcctgggcaacaaagtgagaccctgcctcaaaaaaacaaaacaagaaacaaaaatcacatgatgatctcaatagatgcagaaagagcatttgacaaaatccagcatccctttatgattaaagctctcagcaaaattggcatacaaggagcatacctcaaggtaataacaaccatctatgacaaacccatagccaacataatactgaatggagaaaagctgaaagcattccctctgagaactggaacaagacaaggatgcccactctcaccacccctctgacacatagtactggaagtcctagccagagcaatcagataagagaaagaaataaagaacatccaaatcaataaatagaaagtcaaagtgcctgtttgctgatgatatgattgtttacctagaaaaccctaaagactcctccagaaagctcctagaattgataaaagaattcaacaaagtttccagatacaaaattaatatacacaaatcagtagctcttctatacaccaacagcaaacaagccgagaatcaaatcaagaactcaaccctttttacaatagctgcaaaaaaaaaaataaaatacttaggaatatacctaaccaaggaggcgaaggacctctacagggaaaactacaaaacactgctgaaagaaatcatagatgacacaaacaaatgcaaacacatcccatgctcatggataggtagaatcaatattgtgacaatgaccatactgccaaaagccatacacaaattcattgaaattcccatcagaataccatcatcattcttcacagaattagacaaaaacaattctgaaattcatatgcaaccaaaaaagagcccacatagccaaagcaagactaagcaaaaagaacaaatctggaggcatcaattacctgatttcaaactacactataaggccatagttaccaaaacagcatggtactggtataaaataggcacatagaccagtggaacagaataaagaacccagaaataaaccatcatacttacagccaactgatctttgacaaagcaaacaagaacatatagtggggaaaggacaccctattcaactggaataattcagctggaataattggcaagccatatgtagaagaataaaaccggatcctcatctctcaccttatacaaaatcagctcaagatggatcaagaacttaaatctaaaacctgaaactataaaaattctagaagataacattgaaaaaactcttctagacattggtttaggcaaggatttcatgatgaagcatccaaaagcaaatgcaataaaaacaaagataaatagctgggacttaattaaactaaaaagctttttcacagcaaaaggcacagcaaaaggaacggttagcagagtaaacagacaacccacagaatgggagaaaatcttcacaatctatacacctgacaaaggactaatatccagaatcttcaatgaactcaaacaaattatcaagaaaaaaacaaataatcccatcaaaaagtgggctaaggacatgaatacacaattctcgagaagatatacaaatggccaacaaacatgaaaaaatgctcaacatcactaacgatcagagaaatgcaaatcaaaaccacaatgtgataccaccttactcctgcaagaatggccataatcaagaaatcaaaaaataatagatgttggcacggatgcagtgaacagggaacacttctgccttgctggtgggaatgtaaactagtacaaccagtatggaaaacagtgtggagattccttacagaattaaaagtataactatcatttgatccagcaatcccactactgggtatctacccagaggaaaagtcgtcattatacgaaaaagatacttgcacatacctgtttatagcagcacaatttgcaaatgcaaaaacatggaaccaacccaaatgcccatcaatcaatgagtggataaagaaactatgatatatatattacagtgtgtgtgtttgtttatatatatagtgtgtgtttatatatagtgtgtgtttgtttacatatatagtgtgtgtgtttgtttatatatatgatggaatatatatactgtatactatatatacagtatatatagtgtgtatatagtgtatatatagtataacatatattatagtgtgtttttatatatatgatggaatactatatatatactatatactctatatatatatggaatatatatatatatatatgtgatggaatactactcagtcataaaaaggaatgaattaatggcatttgcagtgacctgaatgagattggagactatcattctaagtgaagtaactcagaaatagaaaacaaaacattgtatgttctcactcatatgtgggagctaagttatgaggacgcaaaggcataagaaagacacagaggactttgaggactcggggcaaaagggtgggaagagggtgagggataaaagaccacaaattgggttcagtgtatactgcttgggtgatgggtgcaccaaaatctcacaaatcaccactaaagaacttactcatgtaacctatcaccacctgttcccaaataacctgtggaaataaaataattattttaaaaaaagaatatactagatttataattaaccagatacctgtgtggcatggttgtcatgtatacagttcagaaatgtacatacataaagaacaatgacaattttattggcattgtttccagtgtacaccctattatacagtaccttctcccctttgattgacaggccttgtaatccctgtgggccagttggtccttcagaacctttttcaccctgaaagtacaagggagggatatcaatgcaccaaccaaaatctgaattttaaaagagtttacattacaaatactatgaattgtgcttcaaaattattttttaaataaagcatccaaagtcactgtttactacaaatgggtaattctaattgactctgagatttgcaacttgcaaaaaatacattagtcataacacttaaacaagaaggaagctatccaagcaaaacacatatgtagcatccctgaagttagaaaagagctcagttcccaatttaaacaaaaatattctggaaatggatcacctaatcaatcacatagtataactaactggatcaagtctccttttccttaatattgctgaaactgggtccatcacacaaggaaaatttatttctcgtactaatatgtgaactaatacttgctaggattagattattacctttttttttgtttataaacattcattgaaaatttatgtttaaaagaattcatggaaaatcttcttagatatgctcctacagttacatgacgtaagtgaacagctctgtccttaatataacgtatattgtcataatacttcatgcatttttatgaaaaataaaccatataataaatcagaagcagcattcatttaataaatttattagaaccaagagtaaaatcaaagaacatttacaaattagccccaaatagtacatacagagaacacccattggtctgactagttggggaatgaaatattctgattctgggttcttctgatcattaccacagaatataactgcatatacttgatcctaaagcagcacggaacacgatgtgttctttctttgatgagatagaggtcaatgcccatgagctattacatacaagagtatcaataaagtatgataatacctcatataatataaaagtatgttgaacctgtcactatgaaataccctggaatattcttcttaatgtttcacatattcatttctcatttatttctttctctttaaaaaacacagattttaaagagaaataattctatttgaatttttcagattatttgggctacacataaatagaagtagaaatttactaagtgccaaaaaaatctcaaactgtgtattacaaaactttcggtgatgtcatgccaagttgctgacctgtcttctgatagtgatactgtgattagtcaaaggtgttagtaatatccctttatccaacatattatttccattatcatgacaaattaaaatgtgttcattaacaagggcgtcttttaaaatttaacccagcagtcactcaaaactaaggatgaattatttgtttttatctaattgttttccctctagtagagatttaggattctcatagataattgaatatcgatcatggtggaagaagctgagaatgaaatgcacttttagagcatgaggccatactgagaaggccatatcttagtcacctgatggaatgactgatgtggagggtctcagacacttagaaagcagcatgtacttctccgggcagtatgtgtgtatatgcatgtgtgtgttttttggggagactttggaaataaaggaagaaggactccaaaatgtatctttacgtactctgaaatgttgttgatgctgctcattttggaaaacactttttaacatgcccttcagcaaatgtgccaaagattatatacaaactgcctatatcaggggacagcaaactacagcccataagccaaattcagcccactgcctgtttttatattataaatatagttttattggaacagccacattccttcatttatacattgtttatggctgctttcaagctacatcagcagttaagtagttacagcagataccatatggctcacaaagcctaaaatatttgctatctgcccctttacagaaaaagtttgccaacctttggtgcagaacaacttgagctccaagaattacataagggaaatgacaggaaattctcaatggctagttaaaaaggaagtctttcataacattttgtttctgtagtaaaattttctttcttattatattgatggcagtactattacagattggtttcttatctgtgtttcacgaaaaaagctgtgagcaaagaattgccatagctacactcgatgatttaacttctgggcataaggatgttatttatcactgtggctttaaatgactacaaactactttaagagatttttctaatttcatatgtagtaattacatgaagtagaagtctttcaattacttatttgtagttccaaattttactgtattttcgcattacagggaaatttacatattccttcattaaatggaataaagatggtcagaaaaataattaacttctaaaaattggctaggacacatttttaaaatttgtaattcacgagcatgtaagacaaagcaccttttcctggtacagaaggtattgttacctttggtcctggaaatccttctccgggtaagcccctctctcctggtactccctcaggaccacggggaccctggttaggataggagaaaatgaggagcaggaggagagagaaaagggaaagaggagtgatgaaaaagaggaaagaggaagaaagagaatggttatatttcagtttacatgccaaaaaaaaatggatagttggatctgtactaaacatgtacaggctttttctactttattagttcctaaatactatagcataataactatttacacagcatttacattgtattaggtattgtaactaatctagagatgattcaaagtataccagatgtgcataggttatacgcaaatactatgccattgtgtctggaattggtgggttcttggtctcactgacttcaagaatgaagccgcggaccctcgcggtgagtgtcacagttctaaaaggcagcgcgtccagagtttgttccttctgatgttcagttgtgttcccagtttcttctttctggtgggttagtggtctcgctggcttcaggagtgaagctgcagaccttcgcagtgaatgttacagctcatataggcagtgtggacccaaacagttaacagcagtaagatatacagcaaacagcaaaagaacaaagcttccacggtatggaaacggaccccagcaggttgcctctgctggctagggcagcctgcttttattctattatctggccccacccacttcctgctgattggtccattttacagagagccgattggtctgttttgcagagagctgattggtccgttttgacagggtgctgattggtgcgtttacaatccctgagctagacaccaaagttcttcacctcccagctagattagctagatacagagtgtcgattggtatatttacaaaccctgagctagacagagtgctgattggcgcatttacaaaccctgagctagacacagagtgccgattggtgcattcacaatcccttagctagacataaagattctccaagtctccaccacattaactagatacagagtgccgactggtgcattcacaaaccctgagctagacacagagtgctgattggtgtgtttacaaaccttgagctagatacagagtgctgattggtgtattcaaaatcccttagctagacataaagatgctccaagtccccaccagattaactagatacagagtgctgattggtgcattcacaaaccctgagctagacacagggtgctgattggtgtgtttacaaaccttgagctagatacagagtgctgattggtgtatttacaatcccttagccggacataaaggttctccaagtccccactagacccaggagcctagctggcttcacccagtggatctcgcatgggctcgcaggtggagctgcctgccagtcccaggccctgcgcccacactcctcagcccttgggcagttgatggcaccaggcgctgtggagcaggggccgtgctccttggggaggctcaggccacacaggagcccacggcgggttggggagactcaggcatggcagtctgcaggtcccaagccctgccccgcggagaggcagctaaggccaagtgagaaatcgagcgcactgccggtgggccagcactgctgggggacccagtgcaccctccgcagctgctggcgcgggtgctaagcctctcactgcccggggcggcagggccagtcggctgctccaagtgcggggcccgccaagcccatgcccacccggaattctagctggcctgcaagcgccaggcagccctggttccacccgtgcctctccctccacacctccccgcaggctgagggagccggctcagccctcggccatcccaggaaggggctcccacagtgcagcggtgggctgaagggctcctcaagcatggccagagtgggcaccgaggctgaggaggcgccaagagcaagtgagggctgcgagggctgccagcacgctgtcacctctcaccattttatacaagggacttgagcatctgtggattttggtgtctacagaggtccttaaaccaatcccccatgaataccaaggaatggctaatgactgtggctctgtttaaatttttagtgagaatccttctagtcaactcaatactgatcagtagaattgtagagctacgaagaataatactcccattgtattaaatactcgttccatttgattggcataaaatgttctattccactgttctcaaagtagaagaaaatggaaattaaatgatgctttgaaataagaattaagaaataaattatctgaggaaatgctaaaaatctggaactgtgtggcccagagaaggatgcagagtgatttaataatttaattatcaggggagtgctgtgaagaaatcatcacacagctgttttaaagcattaagtgctgtttacatgtgtttcaatttctgtactgataaatttggattaaaacttgaattatttcaggaactggttgaacccacaggcagttttatatgcaaattgaaatcttgataggatcattaaggggaaacatgattttcaattgcaatgattcaaattaagaagttcatgtaactattgctcaaaaagccactaggaaagatgacttctcacatgagttaagaaaaacacagtctcgggctttgaaatggacttgcagaaaatgtactaatggaaaaataaaagagtaatagtgaggttttcatttaaatcaggaatttttaaagacaataatttttctctccttttcttcttggccagaaggtaaaaaagtagtaaaggaacttacaacaagaatcttagaagaagaaaatgaagcttttcctctgatgaatctaaacaaataattaggcttcacttgccagagaaataaacctatgatggaacaaagtctgccaactttcctgcaagttcctaaaccagcacactacagacactgaatgatgtttgggcttgagatacagtaatccagggtgatttaagacgcttttctcctcaagcccagtagcagaacgaggatgcagcattatactcatcagtgactgatcatagttatagattcataagaaaaagatctgtttttcagtgtttaatttttttgtctttccctaatgttttatattttacaagacaatcttctttagtatttatgcatactgattttgtaaataattaaaagaaaaagctaacatctttttcaatttaaattgtaacacttaacagaaacctagcttttaacacttccaagaccttaatgaaagcactaatatccatgacagtttattgtacgggcagagcaattagctagtaggaaaataaataggagcatgaaaattattaatagattgcaaactcaaccaaattattaatagattgcaaactaaaccaaaagtgccaagccaacatcacatactttaacaaagaaaacacatactttaacaaagaaaacactgacaaattattttttccctaataatatgacaaatgaaaaaaaacacaatttatattaaatgtaaggaagtatttttccagttcactcaacttttttcattcatccaacaaagatataccaaacttctagcaggtaaacggcattgtgctaggttctagggatagcagacaaaactgctccctgtctcatggagctgacaatattgcataatagttaaaagcagattttggtgtcatttgtactgaggttcaagccccagctctgctacatagtagcagtttcaccttaaacaagtaagtcaatctctgcaaagcacaacatcctcctcaaaatggttgataataatagtatctacctcaaccacaagtgttcatgtaaggattaagtcagagagatttaaatcttttacagattaagcactcaataaatatctgccatcattatccaaattattttacttgagtcctgtaattgctaagaatgtcctttcatggaagtttttacaaataaaagcagtctctgagtgaatgatttaaattaaacaatgtgtaaaaagcatgctgcactgaataaacactgaatcttccttcattctctgcacttctagagtacgttagctaaactggaggtgaaaatattggatctttaaggagccaagtattcaaagctgctgagaacggagagttaatgctcatggacagtcttttaggagaaaaaagcagtgatccaaagtgtaattactataaaccatcagagtagtattccacgccatcagtatattctcaagtcttccagttaaacactcagcatggacgatgatcattagccagagaagagaagtagaaggtacttgggttaaatggttatagtttaatttattaagatagtaccaaaagattatttttaaaagacagaaatccttctattaaaaaatctcagtgtcctttctaaggccatgagaaccaattacaactacgacatacttacttggcttctaacgaacacctctaataaaaaataaataatgaaggaatctaattatcagttaacacagcctgatcagtgaaatgctttatctgagacattaacgatgagatgaaatacgattgtccattatgttcatcttattactttccgtagtaatctcaatagtgttaataatcaatacaaatgctttcaatatgcattgcaagcattagagataaatatgctaataataatagtaactgtccattatcttcaaacagtgccatctactttattttttaatctcaaaataattatagttccctttcagggttttttttttaatttacagtgctctgaataaccttgcataaaaaacaaacagatcaccctgacagtcttaaccaatttaatttttatgaatcagttacatctaccagaccagcacaaaactagtggtaatcacataaagatgacagatgacagttcaaaagtaggtctcggagctagaatattaattcaatctatcagcagatttatattagtgtggtagtgaaaagagagtagtactaaatacgaaacacttgaaataattcaggcaaagaaacaaaagcaaaggactttcagtagaatctttgtcagccctaagataagtctttaccttacttctaaataattcaaaaattcacattgttggctgagcatggtggctcaggcctgtaatcccagcacttcaggacgctgaggtgggcggattacctgaggtcaggagttcgagatcagcctggccaacatggtgaaaacccatctctattaaaaatacaaaaattagccaggtctggtggctggagcctacagtcccaactacttgggagggtgaggcaggagaatcgcttgaagccgggaggtggaggttgcaatgagccaagatcgcccaattgtgctccagcctgggggacaagagtgagactctgtctcagaaaaaaaaaaaaaaaattcacatcattgatttttttataatgacattttggtgcaacattttgatacattatttaggaactttcctacctttgttatgattttagttcccaattaagtataactctgtaattatgacttggaaagcaagcaagcaagcaagaatttcatgttctggtaatattgttaaaaactctcaactacaaacagttagaaagacaggtaatatacgttttttaagatgaattttaaaggcatggaagagtccaaagaagataagagaaattgcagggttcaaaaagagagaatcaaaactcgagaactctagcatataagttaagcatcttaggtaagcatctaagctggtgctacagctgtcctgaatagaaaagtgtgtttgtgtggtgggaagaaggctaggaaatttagagggaggaacagcagcaaagactttggctcacgcaatggaaaatgaagacagaattataactgagagactgagattcccacaaacttagacagacagtctccaacttaagatgggatggttcgacttaagatttttggattttacaatgggttggtcagcatgtaaccccatggtaagtcaagtacctccttatgacttacaatgggcttatggtttctactgaatgcattgcgtttgcatcctcataaagtaaaaatatatatataaatcaaaccattgtaagttgggaaccatcttcggtgttaccaacactaaatgcattttcaacttacagtattttttatttatgacgggtatagtaggatgtaactccattgtatgtcaaggagcatctgtatatattcaatgaaagaacaaagtagaaaaaagccatcccatcaacacagtggtatgaatgacaagaatcttgtctgcttggcttgggctcataatgactaaaaatttctaccatggtcctgtgctgtgtatgagtttatgatttcaattgacattatctaagtggttcatgaacaccttagtcaagacattagcatcaaggaaacccctggagtacaaaagagatacaaacacaaactcctctcaaatcctaagaatgcttaggattcacaattaaagcccagctgaaaataactcagatggaaaagtacaaaacataaaagaaaataactcacaatgaataaaagtaaactaacacaacgtaaacttcctcaagaatgtcaaataatagaataaaataatagagacaaaaaagaagtactttaaatacttaatggtcttatggaaataatggaaaatacaagaacagtatagtaaaaagataataaatatagttaataaaaggcagattttaaaaaataactaagaatttttaaaatacttattaacttaaaaatacaatgaatgagttaagaacattttataacatgatgaagataaatttgtgggttataagttagatttgagaaaattatccaattgcaaccaaatatctagtaggatttcttgataaatagaatggggcaagaaaatatttgaagaaataatagctaagaacttttttaaactatggagtcctcagattcatgaaacggtaaatctgaaaaagtatatgtgaaaatatactcacatttatatgcatcataattcctctacaggaaatctaaagaataaaaaaaaattgcaaaagcagcctaaagcaaaaatgaattactacaagaaattataaacagactaaagacatggaaacagaaaccatggttgccagcagacaatggaattagtacacaatccagactgcaccagctaaactattcttacaaagcaaactaaacaatggcatttcaaccaaaggctgaaagggtttactgctaacatatttttactgaaaacatcttctgaaagaagtatttattgaaaaaaacaaagaaatcagccaagaagaaaagagaaatttaggaagctatgtcaactaagaaatgggtaaatatatgggtaaaactatacaaatactgacttaaaaaagttcaaaaataataataaataattttggtaggatgaaaataaagtagaactaagtcaataggaatgatactctgaaggtggaagaaatgattgaagtaaaagtgtcatatggtcagtatatttttcaggagtaggtggcaatattgatgacatttcaaacttgttagtcaagaaaacatgttaggaatcaacctaaatgcccatcaatagtagactggataaagaaaatatggtatatatacaccatgaaatattgcacagccataagaaagaatgagatcatgtcctttgcagcaacatggatggagctagaagcgcttatccttggcaaactaactcagaaatccaaatactgcatgttcttacctataagtgggagctaaatactgagaacacaaggacacaaagaagggaacagcagacactggggcccacttgaaggtggagggtgagaaaagggtgaggatggataaattgcctatcaggtactatgcttcttatttggatgatgaaataatctctacaccaaacccctgtgacatgcaatttacctatataacaaacctgcaaatgtacccctgaacctcaaataaaagttaataaaaagaacacatattaaagtttagtaaccacaaaaaaagaaacaaaatatgtaaaaatatatacaagtatatgtacacatatatagatatatacataccaagttgtgcatgtgtgtgtatatatgcttgagatatgtatatatatttgatattttgcccaatttctaattcgatttttattattgagttttgagaattttttttaaaaatgtattcccaatacaaatcctttgtaaatgtgtagtttgtgaatattttctcccaatcagcagcttgtctctttatacccttaacagagtctttcacagagcacacatttaccactttgatgaagtccagttaattactttttagggggggatcatgtttttggtgacatgtctaagaaatcttcatcaagcccacgatcctaaagattttctcatatgttttattctaaaagttttatagtttttacattttatatttaaatctatgatccattttgagttactttttgtataaggtgtgagacttaaattgaggttaattttttgtgtttgcacagataaccaattgcgccagcaccatttgttaaaaagactatgtttcctctattggattgctttcacaatctgttgactatacttgtgtaggtctgaatctggggtctctattctgttccactgatcatatttctataatttgccaataccacacagtcattgttactgtacctatataataaatcttaagaccagaaaagttagtataatttctccaagtgtattctttttcaagttttttaaaagctattctagctcttttgcctttccatattaattttaaaatagccctgtccaagtctaaacaaaatcttgctggggtatcaaaaacatttgcactaaacttttacatcaatttgggaagaatttacatctttatgttgttgagtcttctaatctgtaaacatgcctctaaatgtattaagtattctctgatttctttcatcagtgttttgtagttttatacaagccctatatgtgtcttattagatttctacccaagtattttcttttttagcaattaaaaatggtgttgtgcttttaattttagtttctatgtgttcattactagtatacagaaattaaatagattttgtatgttgatattgtaccctgtgaccttgctgaactcacttgttaattctaggaggtttttgtatagatttcttggggttttctatggaggccatcatatcatctgcaaataaggatagttttatttattgtttttataccaatgccttatatttctttttcttgtcttatcgtgctggctggaacttccaatatgttgaataagactgatgagagcagacatctttgtcttgttcctgatcttagagggatgcattcactctttcactattacgcataatgttagctctagatttctcatagaaattgaggaagttcctcctctatttatagctttctgagagtttctatgagagatttatcagcgtttattagggttttgagttttgccaaatgctttcctgtgtcttttgatgtgatcatgtgatctttcttctttagcctattaatatggtgtattccattgattaattttcaattattaagccaggcttgcatccacaggataaaccccacttagtcatgctgtataattctttttatatattgctgaattctattagctagcatgttgttaagaatttttatgtctatattcacaagggatattggtctgtagttttcttcttatgtatgtttagtattttgttttggtatcaggggaaaactggcctcataaattaagttgataaacgtttcttcctcttctattgtctgaaaaagatagggagactttactgtatccataatgttttatgttttttaaagaaaatctaaagcaagagtagtaaatgtactaagtataattgtctacctggcggaggtttaccaactcattctctatattttccaatatgcttaaaatatttcattatttaaaaaaaaacattttaagaacgacaatgaataagtgacactcattcttaagtttagtgctgagtttggaaggtataaataatagcaaagcacaaagttctttggaaaaaacaatcatcaatctatatttaaaaattttttacgcggggcacagtggctcacgcttgtaatcccattactttgggaggcagaggtgggttcatcacctgaggtcaggagttcgagaccagcctggccaatatggtgaaaccctgtctctacaaaaactacaaaaattagccaggcatggtggcgggcacctgtaatcccagctactcgggaggctgaggcaggagaatcatgtgaacctgggaggcagaggctgcagtgagccgagatcatgcctctgccctccagcctgggcgacagagcaagactctcttaaaaaaaattaattatgacttatttctttgacattttcagaatatttccagctctgaaaatcatagacctaaggagaacccaatcttttaattttatagaagttaaaatttgagacttcgctaaattaaatacatccacaagttctttgatattcttcataagcgggcaaaatctttttctattccactcgaatctgagctggtcctatacttactttagatgtcacagaaatgatgctgtataatttctgaggctaagctttacatgatgagtggtttctgcctattggaacactcctgcttggattcaagctgccatgttgtgaggaagcccaagcaaccactgtagctgcccatgtggaggagaaatgaggtctctgggcaacaaccctagctaagctcccagacaacaacctgcaccaaactgccagccatgtgaggccatttttaacattgcagccattttagcactccatctgacttcaagttataaagaactctcatgtcaacccgcaaaatcataaggaataacaaattattgttttaaggcacttagtcctgaggaagtttgttaagcagaaacacaaaaccaaaatagagaccaaaataagttagtggtttatctttaatggtactatctatttagtggaaactaagactagatcactgatctctagatgattagtccagtgtatttttcttccatataatgctctcttttttgaattagtatgttcagacattagtgaaaagcctaaacctaaataatatgttgccatttcactcacagagtgcagtaaggaagtgtatgtttctgtgaatatacacatgtgaggaactatgcagtgcaaagacaacttcaaagaccagctatccacaatcagttgtttttatttgtacctaagtgagtcagctactatttttccctaggagaataatgattacttgaaaagttaacaagctttatataccagaataatcatattttattcacttcctctccaaatgtcttttagtagaaatttttttcttctccaacaacagtaaacttcaaaactacataaaagagatgctgtgaataacgcaggtattatctgtctaccattatcaatcctagctttagagcatactcatggattagataatgagccaagtccttattctcagtgatttttctcatggttacaaagaaatccattataaagtataaacattaggcttgagtccagatcttcctagaaaattttaacacatgagaactcttttcttcttgttcaagttgattcatcttgtaagaagttacagtaaaagagagttggtgtaaacatcatatatatttacacatatacatatatacatagttctatttcaagtgttgtgaaaaatagcacgtggatctggttctcgcatatttattttcatttgttgctcgtaaagatgcaaggtggttgggaggctgaggtgggtgaatcacctcagctcaggagttcgagatgagcctggccaacatggcaaaacaccgtctctactaaaaatacaaaaaacattagctgggcctggtgacgtgcacttgtagtcccagctaattagaggctgaggcaggagaatcacttgcacccaggaggtggtggttgcagtgagccgagatcatgccactgcattccagcctgggtgacagtgagattccgtctcaaaaaaataaataaataaaatagatacaaggtggattaatctgaccatttatcctaaacagaaagaacaagtaaaaactatatttgtccttttcattccatctagaatttttgctacttactggctgtccaggctcaccaactccaatgggtcctggagctcccggtcttccttcttggcctctttctccctaagagaaagaaataatagaatgaaagcttgagattttaaataaagaataaacatagcgcaaagttctctcaagatttcaacaaggataaatagcgaaatagacaaaatgttggttttcataaaggtaaaaaattctagaggaagagaaatagctcgaatttaagtgaacaaattaccctaaaatgtttattatctcttcttgtccaaatgtaattcagtattttcagttttcacaaaatattgtgtaagaattggcaggacagactgtgtggcaatgcaggttggttacagagctgactaagctgacaatgtgtgtgctgtgccctgccctcttgccaccatccaggaatgtcaccccttccttgtccccactctatcctattcatctctcctttaagctcttttcagacttcatctcctccagaaaacttctccataactctgccagcataaactccacctttcctggagtctcaatgtgctcattgttgaaatgctatacatggggatattcaattacattcaaagtacactgttttgtactgcttgctattttaatcctgcatcaaagtcttattgtcacaaccacttggaaaagccattcaaaataggcacttctgctttattaatatgtcctgcataatgtacagcctcacaggatggacgttccttccttccctttctagttctctacaaatctctctgccaacattgacctattcattgccatggcccttctggtttctgcccctttatgcttattcaatgtgaaccatgattgttgatgtgttaagttgtttcacttcccaataacatatttgcatgtgaatgtttaaagtccatgaaaacaacagaactacatgtaccttggcaaaagggtgggtatttggagacaagtaagtttttcattccaacaaaattaaaaaatacgttaattattcttgtggtaactgcccctgacaagcacatttctgtgtccaagcacataaaatgaagtaacttcaggaagcctccttgtgtctattggatttaggccaaatggagttcaaatcatggctcccccaggccctacaataaattcaacagtcatcagtgggcaaaaagacaagtatctttaccttaataccttgctgtccaattccaggagctcctggagaaccataaggaccaggaggacctggctcaccctggaggaagaaatagtgacatcagttatatgttaggtcgactcaatagtattgactaagcagcttttagatgtatggttttgcaataggggctttcagagcaacaacaaacctgtacatcgtgcctgccctcaattgtttacaactcatttggaaagaaaacacagacccaagatcaaattatccactaggcacagtagtcacaatatctgggtccacaacactttcaggagcctgcaaatatgttccaattgtaattttttgattcaaaataaaaataaacataatgactatataacaatgaatacagcttgcattcataaatataattttttaatgtgtttatggaggaaggggcccacaaagtcaagtgttttcaggatccataaaaggcataacgcagccatcactcattcattcacaaatctttaagtgctctggaagacatattttgtttcctcccctgcggctgtcctttctcagctttccttccctgctgataaacccccaattgagtcagtcagtgggcagctgttctttgccctcagaggtgtaggatgaatgatcattggcctaatgcaagatgggaatctcctttccctttgtcactgattcatctcagttggtcacatggctcaattctgacaaacgagatgtgaaggaccttactggatgcaaaggagaaaactgcctctgtctcttctttcctacatagagatgtgataactgtcttgtaactatgaggcagcaatctctaggacaaaagccagctgctgaagaggcctggctcctggataccctcaatgagcaactgatccagtcctggactacctgccttcaaatattctgtttactcaacagcaagagttctcatgatttaagccactattattcaagatttctgttactcaaagccagagcattttgaaataataatagcctatgatgtggcaagcccataatagaattcaggcattttagaactagatgtgaccattgcactcaaacccctacatttcacaggtgagaaacccaagtcccagagagattacctggccagcccaaactcacacctgaataccactcacacagttacagctctttaggtctctccggctttaagccctgtggcatgatgataggggaaggggagtggctattgaccccaattacccatttcataatattatttttttctgtttatcaaaataatatgtctcattgtagaaaattgtcatatattaaaaagcatgcatgcaaagaaaattttaaattacctatctgtaactattaatactataaaatttcggtgtatttccttccagttttttacattcacacgtgtacctttaatttatgctaaggaagattgctgaacactctttatgtttcagctaatgaatatttgctattaaaaatttcattcaacccaaaggtttctctcttcatgctttcactaaccaacagtaaaatgaaacaggaaagtgaaacaagccttctctgagatgaagggagataaaggagttttcagaaatattaaagtctcaatttaccccagaagcttgtgattttggaagggacacctaatgaccagagcaatgttctgtggatatagtaaagacattgctttactataagaagtctgtaaccgatgtggtggctcatgcctgtaatcccagcactttgggaggccgaggcaggtgaatcacttgaggtcaggagttcaagaccagcctggccaacatggtgaaacactgtctactaaaaatactaaaaaaaaaaaaaaaaattagctgggcctggtggcatgtgcctatagtcccagctactcgggaggctgaggcaggagaattgcttgaacctgggaggtagaggttgcagtgagccaaggtcacgccaccacactccagctttggcaacagagtgagactccgtctgttaaaaaaaaaaaaaaaaaaaaaaaaaggtctgttgactttgaccaattgcgaaagagaaccagaagggctaagaagggtcagagtcaaaccagctccccagaagatatgcccaggctcagggtgatttaaaacaaaggaatcctgcctcaaaatgagtcatccacatttatgatcctttgatatttaagtggattgaattcaaaagtacttactgtgcatgctgttgagtacaagtcagtctggcaaatattttttcccttaaactcctaaggttgtacttgtttttctatattgattaagttttctgagcagccagttgactgacattctcattttacatgtttttagccatggaatttatatatatatgttacataatatatgtaacattatatatacctgttatataatatatatacatatataacaggtatatataatgttatataatatatataacattaatatataatatatatatatataccattaaaaatacaataataatatctacccactgctgaatttgtctggctaaaaaaaatacaataataacaatacaaggccctaaattcacttattctattcattttttatcccttctatatgtagcattggttctgtaatgggtcagaaggcatctaaattatatatttggtagagaatttgaggattttttgagtagtggaagttctgccctacttggtacttatctgatgtttgatcagaaacaaaccaagagcccaggttggtgacaagaaattggtttggtcattaccttgaaatgtatggatcaggagaatcaagagtagaagcagctctcttaccttgagcccatgaaatccctttagccttagtcaagtaccaagagcagctgagcaatatcttaatattgctttacaaggcagttgcagggatctgaagattacagagggattgctctcctttacctgaacacagccccttagcaatgtagcttcacatttcacttgcttaaatttatttctcgggagcctggtatctcaaggtaggatccacaaaacagtattggcctatagctcatgtttattcccttcccatttcccctttttctttcctacagagattcctgaggtagtaaagaaagtggtcctgactctaaaatatgctgtctgggtaaaaacaaaacagggagggaagagtcagcactctagtcagaatagccctggtaagacggcaggcatgattcctttcctgttaatattcctaccccagcccttagcaacacacacacacacacacaaagacagagagatggcatgcccaaaaaattgcatgcccacagtaattatttctctactttactttcatttgccatcagagccatttaccaacaggcaagtataacaaagaggtctgggttaaaatcagtagccccagaaagaatatgtttctcattacctccatgtgagtgtgaatgtgtgtgaatgtgagtgtgagcgtgtgtggaggcagcaaaaagtttaggtaaaccacctttgtccttttcagaaattaagaacacccatactatgggcttcaagaggacaggaagccaatgtttaataaaacctgctatttatcagcactgcccagacatgttacatacattatctcatttaatcttctaacaatcataggaaatagattttggggtttgggtttttttttcgaactcctttcctcaaatgattgttctgtcttggcctcccaaaatgctgggattacaggtgtaagccaccacacctagcccttcatgcatggagtcacagggaaaaaaccatggctttgaatcatttggtcttgtagaaccttggttctatcatttactaacaattttagcttttgcaagatctccatatgcaaaatgaggataattatatctgccttgtagcattgttgagaggattcaagatattgtctgcaaaacatctaagtcataaccagtcacacaacacctgtttaatatgtatagatttaattgttattcaccagaccttttttgagcaccaaactaataataggtaaataacaatttatgtctataattgaatatcaggttacctaatcacagacataaatcagattgcacctgcactttgcagaagcttacaatctggctggagagacaaatcaatataaaataaaatacaagcatgtgaattagcataataaagatattaacagaatacataagactctgaggcagaaatgtttaattctaccttaaggaattgggaaagtttcatatagtagaggagatgtttgatccaaacaaagaagtaggaatcatagctaatctgatggaaaagaaaagaaacaaaagttacagaagaagaaagagcatgaggcttaaaatggtgttaaatattctagagacggtcagcagcccgtgagcccaacaggccggaaacaaggtgacactagggccactgtctggagcagcatggtccaatgcaagtagacagcgagccacatttgtaattttaaattctctactagccacattaagaaataaaaaaacaggtaaattataattaataaattttacttaataaatacaaaatattatcattttgacatgtaatcaacactttttaaagtattaattatttttttaccatcttttaatgctaagtctttgaaatctgatgtgtatcttatacttacagcacatctcaatttggaccagccacatttcaaatgcccagtagacacatgtggctaccttattgggcactgcggtttagagtgattaatgaggttgaaggctcaggtcagtaccatgaacagtaccaacatttaagtcaggtgggagtggaagaatacaaagatgtcttgtggggagttggggaaaaagagaatttcaaaaagagactcatcatttccaaagataaattgtcatctttcactccccaatatagtcatcttccagcccttcccacctcagggaagggcaccagaatccctcctgtgtcaaatgggaacctaggggtcattcatgacacctcccactccctctgccaccatatgcaacgcatcccaacacctatcagtatgcctcctaaatatctctcaaatccatccacttcagtcctctaccacgcgtctccagtctacagcaaactgataatacctcttgttcagagtacaacaaagcccttagtactctacttgcacccactctagcatgctccaatttattccctccattgctgcagagcaattttttaattttaattttaatctgagtaaaaccttctgaggcctttcccaaagacagagctccttacaaggccctgcctctccaatccatctgtcatcagtcacctctttactccccaccccagcaacattggcttttgttgaattccttgtacttgccttgctcctcctgccacaggatctttgcacagtctattctgtctgtctgggatgctcttacctttctctttcatagtgattcttacccttcagatcttattttaagcagcatggcttcaagaagggtttttctgataagatgaaatcactattttagtattgatagcactgttttccttttttttctgagcattcattacaagttgcaactttgcatttaatgttctccatctcctccccactagactgtggggatgatgcatatgattttgttcagctttgcattctcagtgtttagctcattactataattcactcaatcatccatgcaccagacatttactgagcattgactagggagcaggggctctgctagctgtgggaggtgaacaaaactggaaagctgttctgggctgaggagctgtgggtctagaaatgctcctctgcagttccctgtggttcacttaggttttcaactaggagcaactgtatataaattacataatgatatcaagtacctattacacaatttctcctaccaattcacccagacacaattaatctttttttttagctgaaagagtaatgaaaccacaatgaagaggaaaattcagctgagaaaaccgactaacactccgtatccctggcactgattctaaccaaaagcaaatccttcatttctctaagacaatacataacaaatggttatccaagactgaattatttgtggacagaactttacactttttttgataatacaattatgaacaattttatcatattttcttaacattacaaagatgttttagcaacttttaaaaatcatttcccagatatgcatgggaccaactttaatattttaagttttattgcaaatattctaatacttttcaaatggaagaaaatgatggatgaacattttgtaggtgcagaatggttcaagtatggccaggatacattctcagctgaaactcagtgaagtgatgactgtatacagagacttgggagaaaggtcaagaaagcctccttttggaaagagaggaaggaaggaaaggagggagggagggagggaagaaggaagaaaggaaggaagaaaggaaggaagaaaggaaggaaggaaggaaggaaggaaggaaggaaggaaagaaggatcaatatttatcaagtacttgttaaatcaagctccatttttagcaccaagtttctcatttcagaggaagtgttgtgttataaaaggcttgtttttagaaaatttaccagaataaacttggtctacattagtataaagttgtcaaaatgcttaactacttaattaaaattaccaacacatatggcacttactatgcaagaagtgctgctctatgtgactgacgtgtattaactcatttaatcctcaccacagctctaagaagtagttactgttattaacttactgcatggatgaaaagattgagtcatagggaggtaaagtaacttgcccaaatcatagagccaataaaatataggactgggtttgaaacccagcagtttgaggttaaacccaaatcttaatcactatgccaaactgcctcttgaaactttttaattcttcttttaaagtatttcaaaaattgtatgactgcagactaaattcatatctttattacaggatgaaaaatacaaaagtcatataattacaatctactcacaactgaaaatccatcatatgaagacaaagcatctctaaaataaaatataagccaaggggaaatataatttatccaagctgatgcacatgctatttcaggtacataaagtctacttggttgtcacttaatgttaaaagtaatgtaaattataactggcaatactgtgatcacacaaggtaaatctacatataaactggtaagtgaactgtactgagtttggaaccactattatgtcaaatctccaactaaaatcttttttgaataccagctatttaggtaagagagaaagtccagtccatatactctacgtacttgtgctttctaaagcagaaaaagactccataataacaatgaattggtgaagaatataataaaaattatattgaaccacattttagtaactcttaactcaccttctagaatgctattaggtttaaccacataaaattgacaatatttgatcatgtttggcctacaaacatggcaattcatgtgtttcaactaataggaaagtcatacttcattatatataacaaaatctgagaaaatgcaagtcattttctctgaaaggaaggaccagtcagcagcccattaggagagcttttgagaatcgcagctctagaagacactgtttagaatcctccagcacaaaatgagttgctggtaaaaattcagggtggacatgctccattaacctaaaaacaaggccactgatttatgagagcagatgggtgtatatgacagcgtgataatgtttcttcaaaacttacccttggaggctgggaggagggaaacatggggagttattggttaatgggtacagagtttatgttgagacaatgaaaaacttttgggtatagatactggtgatggttatacaacactgtgaatgtatttaataccactgaattacatacttatagatggttcaaataataaatattatgttattatatattttaccacaataaaaacacccttggaatacaattaattttctctgttgcaaacttgctattgcaacttacttgaaataaataaggacattgatgtaattacaaagaaaacattctgacatccctctgaagacactgcagtggctgattctgttccattttagtgccccctttgactatgcatgcagtttaaactcagccactttgtgggaaatgttggcagcattttcagttccttggtccatcagagcttttacctgacaatctacacacacacgcacacacacacacacacagagtatatataccccatctgctgagaaccacatgcatcagctatttgggaatagaaatcatctaccttgaagctattggctgacatcccacatgttctggcagccacttcaagttgtcactatcagttgtctcatgtcaaacgagttaataagctcatttagagtcttggtgggcagatgtgcatgtaggtcaaagccttttctacagcaagaattgctggattactaatgattctttccctttaattaggcccagaacagaaatagcattcagactttgacgtctttgaaggaaaaacgttcacatcgtttggcggcttggctatgagtcttcatttaacagttatttataattaaaattgtaaagggattcttcctatacactgagcagtcacaacccttgttcaaaattgttgtcctgccagaagaaccagaaagcaaattactgtttttggacaactagaaaagctgacatgttcaagtaccctacacttaaaatagtttatatgaagccaaaaatacagtcattctgttaagagaattgtgaacttaaaacagttttttgtttgattaattattctttaccaagaaatgtaggaatctacatgttttcacttgatttacttcacttcaagtgataaattataaggaattatatcctgttacaaatcatgactttttaagtggttgaaagcaacatcatgatgttaggaaattgttaggtttttgacttatataagaactgaaatatatctacacaagatgcttgtttgaggagaaagtttaaaattctttataattgttcatatttgtgatgttgaactacttccaacccataactggaaacattagttatgtttagtaggttgacctagctactaagctaattttgagccaaaccaagtacttaaataatgaccaaaacaataatgtatttttaaaactactaaatcttcattagtgatttctattctaacgaaaatactggcatagaaaatgtaagactctaagttgtacacaagaaagtgtaaaaaatacaaattaaaccccaagtcttcatgccacttttagaagaaagtagaagtaacacattggattgtttaatgcacaggaagcttttgatggggtatgtcaacactgtcctgtttgtctttattacccaactatgttagaagaatggtcaatgttcccgactgttacatccttctctctggtttgctccacaactcattgccatctccttgacccttctactgaaattattcttttgaatcttcccaatgacctcaatattgccaaattaagttaccacataggcaactgcccacataacctgtcttcagtatgatactgttgaccactcatgccatttaaaaccttttattcactcattcattcaagaaatacttgttgcttcatgtaactgtgtgtgaattagtgtgcaaagcagaatttttgaatctcccagatagtggtgttcctgacccattgttcccaaatcttctgatttagacttttcaaaaatagtgatagacctgctcatatctgtccagttcttctgccaatggttcctatctgaaagaagactaggaatgattaacggtataatacatggaagctcaaaggagagaaacttgattagcacacttccagctcccagaaatatccacacatgcattcctaatatcatatctgaaaggaagacagccagccctcttaccaaaaccctttttcatagaacactttgaagaaaacaggatgttgtgtagggacgtttagcatgcttacagttttaagttcagggtctgtacatctagctcttgtttactgaatctcctcattagtatatcattaacctgaaaaatatatcctttgcttgggaacctcagaaactgggatggaagcttgaaaaagtagggttcggaaaagtagggtatccaaaaactgtggtgtggtgcaagcttcagggtgaactaaatatatcatgtactaccctcatcgccctcactgcaacgaactcctcttcaaacatggttgtagttcattcactaacagtaggtcttttgtccatttgggatgaatgtttgtgtcatttaccctgaccatatccatttattaaactgggccagtctagtgctatttctctatggattttcttaatatctcagaagtttaaattgaacataaagtaagaccaagtctcataggtaaaagaatgctaagtttcttacacttgactgtacagcaagaagaaaacacttaggacaaatatcctgcaggaatattatgaacgtcctagagtagaacaatggaaggagttaggagaagggaggcaattcattttttaagataaatatacaatactgcagtattttttaactgtttgaggattagcatatggtactttcccttgggaaaaaacatgagggatatctccttgtgccctttaggccttgaagctctaatgctggggtacttcgaaatgtcaccagctgcttcctgcacacgccactgtgcagtccctcctcccaaggcacaaagagagtcttggaaagagtggatttgcatgagatttgagaaggaaatgcccttcagaaataacctcagaaagacatcaagaaaatggcaaaaattacctaatataggctgggcaaacccagtgttccactgtgttgatttattcaaaattagttttggtaacttgtcctctgtgacttgaaaggcctaccaatcataagccattcttcctagtaattaaaggcctttttcaagggtcacatgtgattgcaacctgagccaccatgacagccccatggaaggcagcagcgttgggtttttaggggttcagtctttcctcagagcatagcgctgtctcctgagtcacaatttcagtttggtctcagggataaggcttcttgggcacttgtgtgattacaattctaactgatttccgagactattgagacgttccgttttttttcttttgagacagagtctcgctctgtcaccccagctggagtgcagtggtgcaatcttggctcacagcaacctctgcctcccgggttcaggcaacgctctgcctcagcctccagagtagctgggatcacaggcgcccgccaccacgcccggctaatttttgtgctgttagtagagacggggtttcaccatcttggccaggctggtcttgagtcttgaactcctgacctcgtgatccacctacctcggcctcccaaagtgctgggattacaggcgtgagccactgcgcctggctgagatgttcttatgaatgccacaagatgaccttcctgtgtggtagaggatgaggtggactctgagctaaggcttctttctgagaaacatctatgttttgttgctaaggcaacaaagtcattcagggcagactaggagctactttacatgtggaaagtattattgacagaaataatttgtgaaaatgggccaggagcacattttttcctgacttaacacatgcatttttttccttttgttctttggccaccttttctgaaaaccctttaatgaagaaaagccaatccctaaagcaacagaaagtgagcgtaattcaagagaaagaccatttgtaaattcatagacataggcaggccctatctagaacctctcgtggaatctttgcaaatgttgcaagtttaaaggtttctattttaaggtcttatatgaaatatagtatttgaaaatgcacaattagcattaccgttttctttctcccaagatattcccttccttttttttttttttttttttttttgagacggagtcttgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgatattcccttcctttttcctgcactttcagatgaagattaaaacccaggagaaatgcacctttcaacaaactgttgtccctagccagagtccaccagaagggaagacagatagaacttccacactgtcaaaaagaaatgcatttatttcaggccaaatattcaggaaattcagcaatttttcctaaagggataaatataatatggtagctaagagcagacttgtgggtttcaatactcagtctgtcccttactagctctgtagacttggacccattgcttaaactctttgtgccttagtagactaatctgtacaatggaaataagaatagatcatgtctcaaaaggtggtattagtattaaatgagcacttaaaactttacttatacataataaatatacaataaataaatgttaggtactgtacaagtttcaaaataaataatcttccttgtgcccattagagaatacagaattactgaattttagagggtttctttgcacaaattgcaaaagcagcttcttttaaaattgtctaataaaatgataatggataaaaataaatgtcactataaaatattatttccagattgaggaacaaaaatagcttattatgtcttcaaagtatagtacattctgggaggcaagatgaaatcattccctgaaaactgacttttatgacagtacactaataagtgtataaaatgaaaaaaatagctaatgaccaatatgacatgaatctccagctaacagatccaaagagcagtagaaattatatagaagttagtaatagtgtcaaagtaagagtacagaccttaaaccagaactatgactagaaagaaaagggggaactcatgcccacttcatagactccgagcgatccccaacattatctagaaattgacagctttttgattggcaatgaactttgttcacttggcagtgaactttgtgcttaaaacttaagtggcaatttcatgtcatgtatattttacaaaagagaggcccttgggaaattgatgaagtcctcaaatgcttttggaaaaatgactccttttatgattatgctgtaaaagtcaaccacaaagtgctattatgtcagaaaaattataaccaacccccccaaaacatacttgatgcattattaaaacttaatgcactgctgaaattaaaggccaaattttattgaaatatgtttttaaccctaagtgataacactattagacataaagagttgagccaggtatggtggctcacacttgtagtctcaactctttgggaggccaaggcaggaggattccttgaggccaggcattccagactcaactgggcaacaaagcgagagcccatctctacaaaaaaaaaaattataatttagccaggcacagtggtatgtgcctctagtcctagctattttggaggctgaggcaggagaatcacttgagcccaggaattcaagttgcagttggttatgatcatgccactgtactccagctgggggaacagagcaacatcctatctctaaaaaagagagagagaagaagaagaagaaaaggaggaggaggaacacctttttatggaccattccctaccataccaccacaactgccagccacgacctgcatcacccaaagctgcaggcactatttccaggccagcaccacctcagtgccctccacagatgatgggacctcactgggactctgcctcaggcaagccatttgatctccaggctttgtttctcatttccaaaatgaaaatgctaagccagtatgatctctaacatccctagtggctcaaacattctataattccatcatactgcaaaccccagctctgatccctgactgtaagcctctttctcacaaacatgaaaattgtcatcttaggtaatcaaagaattctaaaaattgtgtggtctgtcaaaatatatatttttttcttactgtaggattgtacctgtagccaatgcaattttatcaaaacttctgctcatcagtattcaacaaggccatttctttccccagagagaattaatcataggcaagaagtgaaaaagacagtttccccagttgaagcctaagcacatgcctgctgagaagcccattctattttaatttgccaattcaaagtggcctggtaaatcacacactgtcattatctcattaaaaatattatactgtcactctctttcctctctctcaagtagcccaactgctccctacaacttcagtttaatatcacccttaaaaagctggctttctttagggtcagttgaggatggcatcttctgcttttattactgccataaattccataccactcaaatcactaagtcgacaccatttactggatatttactatatccgtgaaatttactaagctttgagaagagttaaaaaggaactaaacagcttgttttagcaaattaatggtcactctcattggaaaagagagccttataaccaggcctttaaagatccctcccatctgcatctttttgttctgcgtggcttgtattcaacccctccctatttgtcttggctggttatctgtggactgatactacaagcatggtgctgatggttgagatttccctgtaattaaaaaaagcttgatttctgttggtataacaactgtaaatttccttcccctataaagtgtatattgaggtggcattacatttgagaaatagagtggtttgaattgtgtcacttgttattgctttttggtttctaatgagccataaaataaataaaagtcaggagtaagaaggaaacacagcaaagattctagataatggcttatagttaacaatatccctctttgaataacataataataaatgataaaggtatgctgctaacttcctgaatgcattaggacttaattctctgtatacatctgcaggttattatgcatttccaaaggtacttcctcaaagaatccattgacttttacctaataaaacatacattactatagcgcactaggggaaaggcactctgcctgtctttaatcaaagggtaagattaccttattgccttgaaacccctttgggcctgggtctcctggaggtccagtaattccctgctccaggatgaaaaccaagaattagttctgtgtacaaaaggccagcaggaatgaatcattctttagggtccctagagatcctggcgatcgaagttagactgtgtaactcagagctaaattgaaatcacattcaatcgagaagtgggatgagataaaatttcttgtgtcaaatacgtagcttccaaaatagcacttatgctaagagcaaacatttaattaacgagatgtttgtttactaaacctgtgtttccaacattattccaacgttcttgactccttttaaaaaatattttgccagttaagtatcttcttttttaaaatatctaaggcatatgtaactgacgttagagcttccaatgaacctgggataaccagaatgactgcctggctctgacatttccaggctaaagcaaagaagttagtggttaactagatggtgtctaggagattctgggtaaaattataattttctgtaggctttttgaaatactgaaattaactcctcacacagagcaccattataactttagaagagataagttcctaggctaggaaaagattcaaattattttctgaaatctatggatgtctaacttaaatgccttagagaatcagtccatattatagaacattatctagttatagaacaataaaaatatactgtgatttagataaaatgcataacttttccaactacattatagtagcagtgcaaaaatagttacatcctgcttttaaccacttgactttccatctttccagactcttaattttttaacttcatcccctaagctgctcactaatacttgcctgttggtacctatctttagggagtcttagttaagttaatgaaaacattagggaagttgtttccaaaatttattgcacattgtaatcttctgggtatcttaaacaatattaatgcctggcttcaatccccagacattctgatttaactggcagagggtgcaagtgggcaaggggatggtttaaaaactccccaggtgattctaattcaaacttagatttggttttaacccccttacctgaattcctctgggtccctttggtccatatggccctggggatccctgtggaataaaattgaaaataagtctctctaaatatacatcttcaacgtgcagtgattttaggtaggagggaaggaaatgtgttctcggtaattgccatcttccctggttatcttaacatcaaaggcaataaactgaaataatcctaattaacaagccaaggggtaggagtgtcaaactttccttcagtaaacaatctccatgaaaatacaattttagatgtaagtccgttgcctacatattgacattttggtcattttggttacagtaaagaaattactttataagattccttagagggctataaacttattggaatattatttccttccgacagggtaatgtcagttaaattaacaatgtagtgcatttccatgctatctagatcactcttttgctcatcttcaaaacactgaacgtggcaaaacactgtttatattcaatactcttctaatagaaaatatttcattcggtcccataaccaggaaaccctttaaaatttattttgtgagggagaacatagtctagtttttatttccccagatttccactttttttttttgcttatcaaagtacaacctgttaacaattgacacactttgacaattatagaaacatataaataaacaatttgaaaaatcacacagaagcaaatgctgttaacattttaggcatattttcgtccagttttattcccagtagattcctcttcaaataatgtgatcaaagtgtatgtctgattttgtgtcctacccatttggccttacactgtatcaaaaatatttttccggccaggcgtgctggctcacgcctgtaatcccagcactttgggaggccgaggcgggcggatcacgaggtcaggagatggagaccatcctggctaacacagtgaaaccctgtctctactaaaaatacaaaaaattagccgggcgtggtggcgggcacctgtagtcccagctactggggaggctgaggcaggagaatagcgtgaacccgggaggcggagcttgcagtgagctgagatcgcgccactgcactccagcctgggcaacagagcgagactctgtctcaaaaaaaaaaaaaaaatttcctttttccatgtcattaaaaactcatagtaaacagataatagtcaagaatagggaactaccataatttatttactcatttccctagctttgacctaatattataatgaacatctttatgtataaatctctgcccaacttctgattcactcctaagaatagtctactagaagaggatgatggaagcagagaccataagcacatttaaggttcaccggctgtcctttgtctctcatgccatatatagaaataaagagagagaaacttcctccataaagtttgtttgttaatcatttccactacccgagtatgagagagtgtatcttcatcttatgggctccccatcaacaattagtattatacattacttcactgtttgctaatttgataggtgatataatacttttgtatgtttgcttttggttgctggtgttgttgttgttgttgtttgagacagggtcttgctctgttgcccaggctggagtagctcactgcagcctctatctcccaggttcaagcaatcctcccacctcagcctccctagttgcccacactggtgatataataccttattgttttattgttggttttgttttgtttttgagatggagtcttactctgtcccccaggctggagtgcaatggcacaatctcggtccactgcaacctctgcctcccaggttcaagcaattctcctgctccagcctcccgagtagctgaaattacaggtgtgcaccaccatgcccagctaatttttgtatttttagtagagatagggtttcaccttgttagccaggcttgtctcaaactcctgacctctgatgacctgcccaccttggcctccaaaagtgttgggattacaggcataagccaccacgcccagcctattttgttttttttgagacagggtttcgctctgttacccaaactggagtagagtggcacaatgacagctcactgcagcctcaaccccctggactcaagcaatcttcccacctcagcttcccaagtatctggaattacaggcacatgtccaactaatttttaaattttttgtagagacggggcctcactatgttgcccaggctggtctcaaactcctggactcaagtgatcctcccacttcggcctaattttaatgtattaatttcacttatctgattgctactgtattcggatatttttcttatttattagccattttaatttccacttctctatctcttcatgttgttcatatgtttttctgaacaaacttgtgtaaactcttcgtgtcaaggactctatatctcatcagttctaaggcacattttttcacatttttatatctctgacattggggtatattttacagtcaattgcaccttacatttataattggcagtgggttttttttgttgttgttattcctttttggtatggaaaataatgggacatttaataatccctgacatcttagtcaatgaaatatgatatcctttgtcaaccattttaatttcatctagttttcccaggtattctttgactttcatttctattctattctatgtgtgtccctttttctgcattgccaatatccaggtccatcttccatgttcagttatactccaggaagaatctattcattttcacatttcccattttgaccagagataattaccaagcctaccttttgcagatccacctgactttaactctacagtactttaaaagcattcagaaagtctcaatctatttaaagtgtttagtttcatgggccaaagtcattatctcaccctcttctcctaaccttctgcctcattttctctccttgactcccttccagaattataacatagaaactgaaaaagtttggtatcttggtggcatgatgttaatagttcttaatataatgaaaactatttatttttactctgtacttttttggaccctttaacatcatgtttcagatatactctctgtatatatttggccttttgaggaactctttaacataatattatttccaaatttaagtgctttcattattgattgattgattgattgattgatttttgagacggagtcactctgtcacccaggctggagtgcagtggcacgatcttggctcactgcaacgtctgcctcctgggttcaagcaattttcctgtctcagcctcctgagtagctgggactacaggtgcacgccaccatgcctggctaatttttgtatttttagtagagatggtgtttcaccgtattggtcaggctggtctcaaactcctgacctcaggtgatccacccaccttggcctcccaaagtgctgggattacaggtgttagccactgcgttcagcctatatttattttttaaaataaaggtgaatatttatccaattgtttgtgtctacattttcaaaattccaaatctctatgtctagttgcaccacactgtttataactatttcactgactgatttcagagttcttcacactattttggaaagtgcctgttttcagtgtttgcatctggaaagcacttctaccctgacctaactgcagctttaattaactttgcaggttaaataattctttttaccataacattcagtgggcgtggcctccaaggttagggtgtcagaaaatgaagtcttaatggtccataaaaaaggcatttgggggttctattattgagttaggcatcactttgttttctaccacatgttttacagatgtgaaaaattgagccattgattccaactctagtagtgagatcaccataattcagcccaggaatttccccttaaggaaacgcaacccaaaagggatcacagctgtaagcagtttaaaaacatgttccttaccttgtcaccttttatccctggtttaccacattccccacgttcaccctaaaaaataaataagtgaaataaataagagaacacttgcagtcattcactattaagaatgtttgtttgtttgttttttaaattcccagcagactcttgtaacataagcactcttttggtttctacacaatattagcctcaatactgtgggttttatgggcattgaaatctgaatatttttacccaagagtcatccttaacttgacaggaataaatcaggaacaatgtaataaggtttgacatttttaagaaatggatgaaactagaagaaaaggaacctagcatctaatcacatattagatgccctttgcatatgtggtttaattgaatccacataacggtccagggagatcagctttatcattcttattttataattgagaacatttaaactcaacaagataatttccctctatcaaatagctagtaagtaaaagaatcagagtctgaacccagatactttaacttggaattcctattttttcaagaacaccatgcttcagcctgagtaccaaccttgaccacctagtagtgttcacctggagaaccgtgagagaaaggttctgaagtgagattgcatcgtgagttagtgggaacaggtgccatgatgagttagcgaggactgctgtaggagagccgggcttggcagcaagcatgctacatatttttcattattatgctctacttccctgtcttccctagaatattgctgaaaaaacaacatttgagttattctttagagtttatcagtgatagtttatcataaatattttatcttagttaatctgacattacctgtctgagataaatattaatccaattttatagattaaaattttgtaattaagaaggttaagtaaagagaatgtggtatacaatggaatattattcagcctttgagaaagaaatcctgtcatttgtaacaacatagatgaacctgaacctggaagacattatgtttagtgaaataagccaggaacagaaagacaaatatggcatgatctcacttatatgtgagatctaaaaaatttgaactcacagaagcacagagtagaagggtggttaccaggggtaattggtggaaacttgggaaatgttggccaaaggatacaaaactagttagataggagcaataagttcaagagatctattgttcaacacgatgactatcattaataacaatgtcttgtattgaaaatcactaaaagggtagattttaagcattctcaccacaaaaactgatcattatgtgaagtgatatatatgttaattagctcaatttagccattttataatgtatacatttatcaaattatattttatacaatacaataaatatgaactttttagatttgtccattaaattttttaaataaaactaaatatttttaaaaggttagtttcctcaagtagaaggagaattgggacctctgaatactaatccattatatcagacttttgaaacttctactacttagaactaaaaggtgacagtcagaaaaatgactaaagtttcataatcatagtaatattatctcctttataaatcactttagagttttcaaaatgcttttatatatatcgttattttgatcctcaattcaattctcattttcaagataaggaaacacaattggatatgtcaaatgatttacttaaatgtacaggctacccaatgactcctagtccagtgctctcaacactagcttctgctgctgcttctttattctgcctctgtactgctctagggcatgttactggaagtgccactacacaatgacaaggaaattacattcaaatgtaaatcaatgcactgcttctttcatcaaggaagtcttgctatgaaaaataaatgtcagctgaactttaaacagtatacgttgtaatatagtggatttatatgctggcggaagctttatcttgttgcagaatagcaacaaaccattcacagactggcagccagcctgcagaccacagtttcaacagcagtgctctatggagggaaatcacaactgtaacctccaattatggatgcaaagtgtgtgccatagcctttacattattgctaatccccatagcagccttgcgaggtatatatacatatctccactcacagataagcaaaatgaggctcagagacattacatactttgtccatgaccacaaatttgagtctgttaggctctcaagtccatgttcttatcagtcacctgtagctgaacaaggcacactatcataggctgcaagtcactttccattaacctgacatttctgcctagggtactgcctgggctcttgcaggcatcaggagcaggaaagagggaggtgtgactcttagagccagctatgcctctgatcaaaagcaatctgttctctcttcacatcctttcgtgagtcaaactgacccaggaaaaactgagctttcacttagaacaagttgaacatttatttctgaatgcaaatggaaaatcacttttgaagaatcaattagaaagcaattaatttaataattttggatgggaataaaatgagtcaaccaccaaaatataaaacagaaagtaccataaatacactcaaaatgcttttggctacaattcacattccatttgtccagacagatttgttagctataggggcctgaggaacagcatttgttttttggggggcacagattgccatcaatgaaaatattgtattcatgttatttgcctctgcaaaggcgttttcctttttggtgggctcattaatccctgtggaatggccacaactacatggtttcagaaagcgagtacttcagaaagccatgaacagatcagctctgttctcagcctctattttctgatgctgctgctcctggtgaaattctggtttgaatgtcgatggttcagggtcactttgctctgacagcttgtattttccaagtgagaactcttccagtgaatcaataattctccagaaagtgaaattaatcttttcaaaaaatatatgtataaagcttccttgtgttgataactacctcactatataaatcaaaatggaggagggggccacccactattttcctcaactatacacacagttgataattttacaactgtgaaacttttttagttttcccatattaatatttgttcctttcctcttcataatggcacttacatttgtagacaagccaacattttggaatacattgtcacgcccattatttgattctccaaccactctgtaaattaggcaggcctgtacaaattgtattccatccagttgaagaaacagatactccaagacattgagttacctaagttcttaaggctgctaagtgtagaatcatgggattccttacactcttccccttggagttctaacattgccagcgattaggatatatttattggcttacatgtaggctcacccctaatatttgcagggcccagggcaagagtgtaagtggaagcccacataccatgtgtctaaatagttgaaagttataactaaactaataatgttctggcttccttccttaacaaatatgtcttcaaaagggataaagaattaaaagacttatgaattcctcagaggtccttgccagacatagccccctgcagcctggccccaacttcccttcccacctccaactccttccacagcaagagcatgagcacacacgtgaagatgccccgggtagcacaacaaagcccgctacatgacctctcctgccccaacaaacagctaccattcggctccccctccagcctaggaaaatgatggatatggaaaggaggtttttgtatgccctcccagcagcaggccttttgaagtcttggctacccaatgcatgatccaggagaaggaagcacagacctcctgcagactcctggctccatgagaagcagggaggccagaggagactcagagctggaccctctaaagttctagcctctttctcatgcctgaaggttgtagccctgtaggatggaatggatgataggtgcatgttctgattcagatagaaaatctgataataacaagaactgtgggacagacttatcaatgaaccagtgagcactctcagaggttcctgagccccagtatgacttgttaatcccttttaaagcagtttggtatcctaacttgtaactcgcaaataatcatcaaatcatctaccaacccataccttttgtttgcttgtttgccaaatttactcccctgcaagctctacccaattggctgactcagtgaagtcagtggctcttcactgcttaaccaggataaatcctctcttttccctgggagaggatttggtgtctaggttttcacaggaagttaaacaccaagggtgcaacctatttgcagtattgctgaatctgtttgtgtaaagaaacttttagcctgcatacctgtgctgcatggcttataaattggggttctctattaaaataattcatgtttgcaaagctgaaggaggctggattctaatctcaggaatcatggtaccctccatcccttacaacacacatccatatgttaagttctattattattttatgttaactcaggaatgagggaatccagacttacaaaaataaagaaaataacttttattaagttcctaagtacacttatgtttctgtttttctttttgaaattctggtcaatctatttgttgttaccaacttaccttgtcacccttgtacccaggaattccctaatttaaaaagaaaataaaaagtaaaatatgatactctgaggcagaattagaataaggattaggtatttttcaattacaaggtataacaaaaacacatctatacagtctggaaaattagatcatagaaatgtaaactgttccacttctctttgtgcttggagaaatatacatttactgaggagaagaaaataatctgttttccctttatcacattttattctcagtttcaggtatttttccatatccagtttcttgccctttggcccaaaactagaggagataatgtacactgaaagtcattgtagaagtgatggcctataatggtcccttcaaaactgttatattgacttttaaactatgaactattgcagctaagaatgtttcatagagactctgaaagaaattggctttgaaaatgagctgagataatggcctttaaaatgtgtgtaaatatttgtatccattatggtcctccttacaaattcggtctaagatatataacatcaaggaaatgaaaggttcctttatcagccctaatgcgacagtgacctttaagctactgtcttttatctcacactaaataagaggccagcacttctactgtcttctgtgtgtcacccttgggaatcctgtacagccttttccattgtgtcactgcccatggccctttaagaaatacaatagtgaatattacatggcctgggaaatcaccagctctaagcagcagcaagtcctcttcaaatgggatttttttgtctttcatacagctatatttttcaaatatggaaatagaattgtcagatttattgagagctgaagaaacctatttaataaataagctattattacagttacatgtgagtcagactacaaaattttgttctatgcatgacttttttattaatactattatctatttatttatttatgtgtagagagagggtctcactatgttgctcaggctggtctcaaactagtggccttaagtgatctttgcacctaggcctcccaaagtgctggtattacaggtatgagtcactgtgcctggcctgactttttttacaaaaggaaacttcatgaaggaaataaaacttccaaatgtgtggtcaatgaggaatagaagataaacgtagaattctctcctatgagataataagctttttaaaaatacaagtactttatcttagttttatttttacatacttgtatgctttatatgtagaatatacctaagaaatgtttcctgaacacaaatttcagattttttgttgacattactaaactttctatcagattttttaatgaagttgattcaaaataccaagagaacagtttttaacatctctgggtctgagtccagggcacatccagggggacaagcagagaggggcaatgtcatatggtcttctttttatgcaccgtacacatctctgctatttgatacacttactgcaatgcccagaaaagtgcaaaataagaaatatactgtaattagttcttgggcaatatccactatcttctaatttggggtataagaaatcaaatagaatggtaaattttattatgtctgcagaattggattaacaaaagcatagtttagaccatgtagttcttatgctcctgaaattctaacttattctttatcttaaaaaacttaagaaataaagcaaacagttttctcattggagcctttcaccaatgtcaaattaagcatcagagaatttgatagggttgaacactcctgctcccattttcactctgttagctgagtattttctccccacatttccacttctaagatcatatctttctgattgccttcttgagccatcaagagcacaaggtagatagaaatcacttttgcacttgcactaagggggtcaaaatggtcaaccacaaaatcagtaacctaggatcactttcttaggaaggcattccagttgtgtacatacccctggacctctttctccagcttctcctttttgagcgttgccctgtgacaaacaaaaaacagtaaaaattccacagccctgaagagtgactgattgctcaataaaatgcattatacagaagattaatagcttagcccaattaggaaacatctttagtctttcccgttgacattttcactatgcaatctaggcaaaaaaaaaaaaaaaatagcaactcagataaactttgccctttgcagtgaagccagatgtgtagggtgcaggatccaggtaccttttcacagcttacaccacatcccagttgaacaacacagcgattgttctcaaatacatcattatactcacttggagccagtcactctggcttttctctaaggggctttggaatgttttccaaaatgtcctcaagagtgattgcttgatttcagcaagacttaagaaaatatattatgtggcacaaaattacaaaccaaagaaataaaatgtgaacttacatttataatgggtatttaacacaaaaaaaagaagacatgatagcatcagtttggacgtatataagatgagtgagtatagggttgtttggttgagcatgtgtgtgtatgttgtaaagctatccaaggctgctatattccctttccttgacaagcagacaattgccaaaaatgcttttatgcatttaacttttgatttttttcattacctctctaaaaactttctaatagggctgttttagagttcatttttgagttaatttttaatgtaatagttaactttgttagtatttgagtacctcttacttattgcctaatttttcccaaactatttgtgtcaagttacctgcaatgaaaagcaaaccagtttcactgccacattgctatcactagttattattgttttaatattgctgtgttaattgctataatgaaagaaatgtttttaaacgtcaaaacacacacaaaaacaaatgatgtgaactagaaaaccacttccagaaaaaaataatcctctggattccaaagtttctaaaatgtaagtatcactactaaaggatatctcattctctctatttaaatttattttattacctaatgaaattaaatgtgcttttacttttttctttactagttttgtttcctctcttgaaaattgtgttcagaaattaactcagtgtactgtagaaattaacccaatgtccattacatttgatgcaaatatttcctgatatttctatttctttaatattccttccttatattaggacattctcatgctgctaacaaagacacacctgagactgggtagtttataaagcaaagaggtttaatggactcacagttccacagtgctggggagacctcataatcatggaggaaggtgaagcaggaacaaagccacatcttacatggtgacaggcaagagagcttatgtaggggaacttccccttataaaaccatcagatctcatgtgacttactcactatcacaagaacagcatgggaaagacccgccccctatgatttaattacctcccaccagtctctcccaccacatgtgggaatcatgggagctacgtacaattcaagatgagatttgagtggggacataaccaaagcatatcactcccttttctttaattattatttttttcattacacagaattttgccttaaattttcacatagttatatctacttttctctttgtgattactgctgttgttcttgaacttggaaccaaaatcctaacaatgatctgaacagatgaatgttttctttaaaagcctgggattttttttgataggtacacagagaaaagaattcgagaagtccttgaagatgctctgggagtgagaaacaatctggtggtttttctatgattattgtcagtcagttaatcattaaaagtatacccattaaaaacacaagtgccagtgtcaatctgatatggaacacatattactagttgctgaatcatcatcctaaataagattggctgctatcgtttaagtactagtttctgtttattcaatgtccctaggtttcctaaacttactgactaaaatgttcatatatgttactcagaatttgtgaattcaagctaatagaaataagatagataatataggaagtggaaatcctgtattcttcacaaaagttgtcacatttttgccatatactacaatgctttttatttttaaaattgttgttttaaaaaaaaagtctagaaggagatacgctggtttaaagaaaagctgtttattcatttaccgggtttccttttggtcctcgctcacctttgatacctggatttccatgtgtaccctgaaggcaaagggaaaaaatattattttaagtaggaattctattgttttctatactttataataatttctgatcagttttgtttcctagaatgagggagaattgtaaaacctttacctgccaagcagaaattcaattctcttctccctttttctacaccaggaaaaccactgtcttgaattggcagattttctagatttgctcaaaagagaataatgtttctctcttcccaccaattacttcttcccaaaacaatcacttctcagcagttttgcaaacaaaatcaaactcatgcaaagatttaaaagagtagctgcaacaggcagaaggataggagttgttcccaatctctcttcattgtgggtcacttctacgattccctctgtcactcacttttaaaaggaccaagctagcttgcttgcctttggtcaaagaggttctgatatccaggagacaatctcaaaagatgggagaaaggagctctgtaatcctgttccagaaaagcattttgttttcctgttcctaatcaaccagaaagcttgcttttctgagaaatggtgttgggggtactcgataatgttaaataacatattctgtggcttatccctactaaaatgtgacaagaatgtgactaaaattgtcaggtgcttagcaattgtgagctttcttattgctcattttaaaatataaagaaatatttcttaccctggccatctcttggtgtcatagagataaacgaagactttataggaagggatggctaaacctttgctttagccaaagtcagcttctactggctgccccactatcatataacgcatctaactttgtatttggggagaaaaacatcccttgattggtaggatggtttgaaaaattgtaggctttggacccgagtctcaaggtaaaatttgtcacattctaattcattcacagtacacattcccctcccacccccaaatacaagcattagttgaaaatttttatccatgcattttgtgagattctccatagggcttcttctgaactctaaggatgatatttggaattatacaaataaatagaagactgaatgagcacgtgaatgctttatgaagataaatgttaaaaaaatgctcagcatttccagtgatctagatgtcatttcaaatgccttcccagtacagacatggcacctaccagttattaggccagaatataaagaaagcactccttcctggattatcttatcaaacaatgaatcatcatagtcaatcctgccatttatttttggttgccatgtgcttacttccatttcacagaactcaccctaatcccccaaagcatcgtgaccagcttcctgtccatgaggccacacggtgttgctgctgcactgctgcattcgtgtgaagccaacatttaactttcagagaggcttgtactccatgtttctagtaggataaagctttgcttaaagcactgattatttgtattagctttttctgtattcacttcactattgagaaattctggcttcaattattttatgaggaggaatataaatgtcctttgtgggaacaacttcaaaacacacctgccctcagttcaggtcagtaaaatcccaggcttatttctaaggatagaatgtgtccctttagaaataaaagaaagaagtagcatttccatttttcctcccatttccaaacaattgcttttcagcagtgcaaaatagccccgatgttttcaagagcgagtagagctatcattgctaggactttctgacttaagttcaaagtggaagtatactcacaggaggccctggatcacctggatctcccttctcacattcacaaatcttgcgttcacactgaatcaataatgaaatatgatattaacacacagtgaaattcaaattgtatgcagcatttcaaattgtatttcaaatacatttcaaagtgtatttcaaataaatttcaaatagcatttcaaattgtattcagtatataaccaactggagcactctcaaagaaattttaccttgcacatttatggatgttttgctctctctattaaattattccaggcaaatttatacctaccaagagctagctaacaaaatattattaaatttcagcatagttaaataaaagacatcccatcaaaaatacatgtataatatatagatgccagttaaaaggagaaaataaatattttcagtggacttttagaatttctgatccttctcttctatataacacatcaaagctcaataatataataatattaaatgctcctttactaggcaaaggaaaacatttgacttatagcatattttactaattgtaagataattgtaagatgcaccttcttcctcattttaacaactctgaaatcagaatgagtcttataacagctgttgaccaggttcagtcatgacaaagtagttgctttttgcacatgcacttcaaaacttacagaatgaaatgggagaaaattccagaacatacttaagaaatgcttcatcaccaatggttttgctggcatagaggtcagtattacgcagaaaaacaaggacatcaacaactcagacaaaaaatgattcagatttaccaggggtgtctaatcttttggcttccctgggccacattggaagaagaagaattgccttgggccacgcataaaatacactaacactaacgatagctgaagagcaaaaaaaaaaaaaaaaaaaaaaaaaaaaaagggccgtgcatacattttataacgtttttaaaaagtttataaatttgtgttggtccgcattcaaagtcatcctgggctgcatgtagcctgtgggccgcgagttggacaagcttgatttagagtctgatgtgaagaagttttagaaataaccaagttattttgcttacatattcccttatatgtatatatgaaagtgatacaggattttaaaatctacatccaaaatgtctaaaaacttatttccacaggtataaaataaaaagtgcaattaataagaagacactgtatcatagataagctagcaagggttttttcctttctttcttttctttttttttttttaaacgggagtctcactctgccaccaggctggaatgcagcagcaatcttggctcactgcaacctctgcctcctgggttcaagtgattctcctgcctcagcctcctgagtagctgggactacagtcatgcaccatcacccccagctaacttttttgtatttttagtagagacggggtttcagcatgttggccaggatggtctcgatctcctgacctcatgatccacctgcctcggcctcccaaactgctgggattacaggcgtgagcgaccatgcctggccgttttttttttcctttcttaatggtacataacataatggtatatccgaacatgtacaattcaataaaacatggtgtgacgtaggtttggttgactcctattattttatgcaacaatacttgtaaatttcctgatgttaaataagcagctcattgaacaaagctcagatgttccaaactctttcttttaagaaatgcatgtccaggacaggactcctcagcaagctgatgattatctattgtgctaaggctcgtccaatcttattggccagtttcctttgccacgtggtctggttgccatcatcaggctgccttttcttcacaataaggagaatgagctcaaagtcaattggcaggcagcaggggatgactctagactctgtctcttagctgggaaccctctgcctaacctagccaacaccaggaacaccccccaaaatagaggacctgatgtggctgatgtcagatacatgcttagaataaaggaagcacatcaaagtaagcaaaaactatgtagtttgctcatgactgatttctaaaatcactcctggagtcacattcaatatttcctactttttctaaattttccaacttgcattgaatatggtagtataaaagaaatcagatggctgcctcagaatagagtggctcattttaaaagaactaagcatttttatttagtcacacttaatcttctaatgtgaattataatgctgatttgataatgcaagtgtttggagtaattcgtagtaatcaaagcatgtggtgcttaccttcttttcaaataagatatcctacaagggaaaaaagaatgaagcattaactcgattgatagttctgcctccagctacttattagtcataactattccctatgggatatgaagtttccacaaagaatagcaattcagcctttttaaacttgtaaaagcaataaaaccaaccagccaaccacccaaggagcagtccgagccatgtaataataagagatataactaccattaaaaattaacctatattttctaggaacttcatcttactgcattctatgttttatcttttgtttcctttatcagctctgtaatctccataatttgactataaagttaatcagtcataatgacaaagctctcacttttacatacaaagactgaggcagaatatataattgtatattttcaattttttccatccctatgcacatatacatgcatctatttttcatgatttatttttcaagattaaaacaatatagtcataacttcatgaaatattaatgggtgttagatcatattaaaactcaaaaagagaaaattacaaagtccagtgacattttttgagatgatctgaattatgagaagacaaagatttccattattatgatcactaggggaggagttttctatttcaaatttgaaaagcctccaatatgatactttatttacagaatttcaacagaagccaaaaaagatactcagcttttaaatttaaacagtattaggaataatattttggtaaaaattttgaactgttcatagcaatatgcattacttatgtaaaagaggacttacatttataactggctaacttaggggaaaaactaagtgatagaaaagtaatacatatttcataataaaaaatgatcattatgaaaaacaaaaaaacaaatttaatgagtcttagtcaatcagactcaacctcttgctttgcaataaggaaacatggttccaccataatgtgactcaactgaggtaacacacttgggctgcacctcctgaccgtcttcagtgcatgtcatatgtaccatacaggaatgaattagccagaatatttttcaaaactattttaaatttataattttgcagaaatgtcatgatcttgtttttgtctaacacctaggcctcactaccatacttgaattcagtgggatattacctgacaagtgcactgaaggctgtgttggaagacaaacgctggaaagaaactaatctatgtttatatatagaattagtactttcttaacctagaaattatgtgtcaaaccagtgccttgtgatttcatctgaaggggtaatttacatacgataaaatagaaagatgaaggagcaagcactggaatatttgttgcaagatattaaaaatgcagaagctaacaaggaagttaaataagagtatgtagctttatgaaggatgctgcatccctttagttttatttttactttatttccgtacaaactaatactatagagggacgagataacaaaatgctttaatgatttaatagggaaaaaattaggctgggaattaagtgtcattctgggtttccatcccgtttcaacaattaactagctatgtggccttggacaagtcatacaatccttccaggtaattttctccatatataaaaaaggacaaagtttgactacatgatctcaggagctataaaaccctagccacagacactagctacaaaatttagagtctcacctaccacccctcccaaccaaacgattttaaattactagccatgtaaatccaggctgaaagcagatgagatatttgtatctttaagagctaggaggtcctatggagaaataggaactcagatacactgatagttttagttaaaatggtattaccctctgtagaacatttggttatgcctacaaggctgaagatggacctgctttatcacgaggctgccaggacaattcttgcttttgcctgttatcctgacatcctttctagacataccacagggaaattcttgcacttgcacatttcagcattcattgttttttgtaatgaaaaactgtaaataaaataattgccaatagtggaatggatcagcaaatgaaatactactcggcagttaaagtgaatgcattggatctacacatttcaacaaaatttccaaaaaaacattgagtgcaaaagcaagttgtagatagatacatacaatatgatctgatttattaaaatacgtaagatatttcaaaccacgtcagagagtggtttcctctgggagaaagagagagaaaagaaattcaaaagaagttcaacagaggcagtaaaacaactaataattcaagtcaaattgtaatatttaaaaaccactactgaaataaagaaaaatttaaatatttgtcactttaaaatcttttaacaatgagcaatatcttttttttttcttctttttgagatggagtctcgccctgtcacctaggctggcatgcagtggcatgatcttggctcactgcaacctccacctcctgggttcaagcaattctcctgcctcagcctctgaaatagctggaattacagagcacgccaacaagccagggtaatttttgtatttttagtagagacagggtttcatcatgtcggccaggctggtctcaaactcctgacctcaagtgatccacccaccttggcctcccaaagtgctgggattacaggtgtgagccaccgcacctagccacaataagcaatatcttaatcaatttttaaattcacgaattcagctcttactgtgcctgatgtgtaattttatacttttttcagttctttcttttaaaattcaatttcttctttgccatattgctctttagaaatatgtggcataaggcttaaaaccatagcaatgcaaaaaactatttttggaactcatttaattttgtgtttgctggaatttatatttctatggaaacaaaaatgaacccaaaactacacaatagataagactgtttcaaacaaagaacaaagccccatccctgagggctcttataggctataagccccaggaacagaggacaacacacagcaacccgagtaggaaggaggtcctaggccaggggcgggggagccgctaacaagatggcttcttggaataggtgggttttctggatggttttgaagagaggaatgcaaaggaccacccattgatggtatgctgtcctatatgtcaaagttgatgaggaaaaaagtcataaggactagtgtgggcaataagacaaaggaagtagttatgaggaacatttaaagggagtggatggaagggcccacatggacagagccggaggccttgggaggtggcgagggcttgcactcaggcagggaagcaggctgcaaggagaacagtgtcaaagcctgacgggaggccatgttcaatgacagactgggggcatgcttgagtttcaatgaaaaggataaatagggaaagggtctcatgacagcaaaagaagatgcagtcagaatttcattaatggattcatatatatggcatatattcacatatactatatatgcaaaaccagaatgctagaatggaatcaccaatttttcaaggagtataaggtttatgctgtgagaaggggacagaaaacatgtgagggatggacaaatatcacagcacatggaatgacagcaaagcactcggtaggcaaggggaacaaaccctgtgacaaaaaaattcaacttaaaatggtagcaaaatggccactataaaatctaaaacagaaaaataaggccctaaacagaggaagtcttgaaaaaatggaaagtgatcataattaatagattaagaaagcataggattctaaagatgatatagacatcatcacattgatctcttcttggtatgtgagggagggaataccttaaatttatgttttttaaaaatcgttcagaaaaaaagacaaatttgtcacaacccttatttccataaaggctttttaaatacttaacatcaaaggcaatagagggaaaaaattgtctttaattttcacatatcctctcttactcttctacaggaccaagtaatatatccaggactttggaatgaatttgtttgtttggtttcaatactattatgtaaattataataaaaatagcaataaaaatatattacatgtcttcttcaatttggagtcattaagtctcttttgagtaattcagaactaaaatgtttctatggggttcttacatgataattcctactagaggcatcaaggaatttgcaatgatttgttttgtctttgctcctgaagaatctattcattctgtatactcgtgtccattaaattcaactaaagtctattctacaataaaagggagtaaacttctgatacagaaaaaaaccctgatgagtttgaaaatcattatactgggtacaagaagcctgacacaaaaataatacatactatttgagtttgtataaaattctagaaagtatacactaatctagagtcacaaaagtaagatcagtagctcaggagcaaatggggtcttacaaagagatatgaggcaatttggggaggtgatggaaatgttctctatcctaattgtgttggtagtttcataggtgtgtacctatgtcaaaagctcatggaattgtgccctttaagttaatgcagttgtgtacttaaatcatacctaattaacttatttaaaaagtcaactacataattattttaaaataaaaagtttaaaaattcaactaaagatgtaatagaaagggattagataaagaatttttccaatggtctcatcaagagtcaagttctgggcccggcgcgatggctcacacctgtaatcccaacactttgggaggccgaggcgggcagatcacctgaggtcaggagtttgagaacagcctggccatctctactcaaaaatacaaaaaaatgagccgggcatggtggcaggcgcctgtaatgccagctacttgagaaactaaggcaggagaatcgcttgaacccgggaggcagagtttgcagtgaaccaagatcgtgccactgcactccagcctgggtgacaggagcaaaactctgtctcaaaaaaaaaaaaaaaaagagtcaagttctgccttctagatggtggcaatttgtaacattgaaagttggtataccattctttgaagagcctaataagcactttggatcctgtaagtgtttggaaagcagcacctccttctaaaaagtggtttattcatggagcttccatctgaacaaacaagctgaaatcacagatgctaaacaaacaagctgaagtcgccggatgctaaggaagagcagtattcagtcattttctgtttgcccaggaacagacaaacaattttgcttccagtctactgccaagagcctgtgttctcagtgaagcaggtgctctcagcgagggtgtatctggtgggaatatgaacaacctgagcctacacctgtggccaaacaaggagctgcctgtcccgcatcttctatggtcagctcttatccatcttaaggtgaagatgaataagtaacaacagcccactcatgaccacatcaccaggattctctcccacacgggctggagccctctgttttatgttcagtggtgaggaccccttaagtcatggcacaggcagggctaagtgttagccaggaaccactacaaatttccctttcatgcaaaagagctgctcagaatgagtacttaccttgagcaccacaggactgggcccatcagctctatctctgatctaggcataactctcccatttaccccgaatccccaaggaaaaaaaggctagaaacaatagtaactttggaggagggctgctaccaaactgtttcagagcagttctgattgagaaaatatttttttaaaaagcagttactatttcctctctcaatatgcctttatagggttaagcatgcaaactgtgaggtcttcaccggccttaaattttcaactacaaaatgggtataataacattacctacatcataagattgtggcaaacattgaataaaataaaatatataaagtgttcaggaaaatgcctaatacagagagagtactcaatacctaagagctattatttaggtaagaaaacctcagatcttatgctgaaagcaacagagagtaaaaagataagagtaatgttgagaaaaagatcgagggataagacaaaaggagcaaaacaatctctgaaatagagcctgagttttctgtgcaagctgtagaaaacagccatatgaaacgctcagtacataaaggacacctttgccttcctttctcaggaaatcaaagaaatccaagtttttaagaaaatcagtttttaacactcagccaatcaaccaatttatctctaggcgttttctccttgagaaatattgtgaagagggatttccttttgattgtggtgccgtgtgttttacaaagcagcaaggaaaggcttttatacacagctgagcaacaaacaaagaaaagctgaccagacctatcaagtgggactcattgatttgatgggagaaactgttgcttgactgcaggttgcagatgattttaaattggatgggcttgagaacatctaagaaagaaggaggtaattttaaaaattggaagtctatgaactttgagtagcataatgtaacaataggtgagacagagtcaaaaatactcagtcctttagaagagtaagagagaatatgtcaagattatgtcaaaaatacctgtacagatgtggaatgggaaaagaccaacttggtacaaatatagcctaacacctcaagttgagcacaacctgaatataagtcagcaatgttcatgattgtaggctgtataaacaggagcttaaggtatatgattggaaaataaccccttccaaaatcctcagcatcagctagcaataaagttaaaaatgcaattccagggaattagcctggaacttttccagattgtctggagtaaactgccaagaaagtggagtgacacttcagaaagattcttctttctgttttcagtgttaactctcattttctccatctttttgacccagtatctcttcttatgggatttacaacaaatatgtcaatattatgatgataactgtataatcaacccattaggtacctaccagacgatcttgaattttatctacaagggttggatcactcaacagtaaagtgggttcactggatgaatccccagaaatcaaacgaagtttggcttcattgactaccgtagaaagtgcaatggtgataaatgatattcctgaaattctggcatcttcagaaatactttgaacatctggattctttggatggtcgatgccatcagtcatcagcaaaaccactttcacaccatccttacgcccttctctcttaagtagcctagtggcattggaaatggcataataagagaaggtaccttgccctattaaattcatagacttgaccttctgcttaaatgtctgcaggtccttccaggaagaaaaaggtggatcaatttggacagagctgctaaactgaagggctgccagtttgatgtcatattccaaggagcgaccaggagtcaattggaaaatcttgtcactcaagctatccacaaaatctttctgtttatcaaagagggcaattttagaactttcagagctgtccacgatgaagacaatatctatgaaacaaatggagcctgaaacagaataaacaggttaggcaaaataattattcctatcatgaaacaaatttgcatacggaaagccctgaagtggtgtgttgtatattgtttggtgttgagagcagcgtgaggagagaaagagagacacgttggacagaaggcttcaattgtaaaaaactaaatgtctaagtttatgaattattttctccttgtaaaatcatgcaaattaaaaataaataagatatcttttattctgagcatcttttcaatgttaaacctgctgaaagtgggaggaaatgggaagtcaagatgcatcacattttaaaaatccaactaacactgagcatagttgtctagaagtaaatgatactctaattctcaggttgtgtcatattggtgagtccctatttttttttaaactttcttgaaatcaagggagaaaatgactataccccctataccaagagtaagtggagaagaaacctaacttaaacacaacttaagtttaaatcccagctctgtgtctcagtggttaatttgcctatggccttgagtatgccactcgacctgttaagacctcaatttttttaatctacactatgagtggcaatctccgtcctgcctattttacaaggttactgtgaggctcaaatgagataataagtgcacaagtgctcttattaaagactctgatgtgctataagtatgtaaggtatattatcatcatataattttatcaaagtagactatcacatgtatacatgtatatggcttgctatttatatcaaatgctatttagaaaaattcacataagtatttttaacaggctaaacttaaaaacaaacaatttttttttttttaccctggacatcacttttccttgcaagcaaatttgattttggtcctttctttctttgtccggatactgtttgactcgtaaacgctgacaaaagcaggagatagaagacaaaatatctgttccacattatggtagatggtgaaaaatcatctgtcttgtagcacctttaatagaaaagtcagttacaaatactttaataaaatatggtgtttgttatttttaaatttcaagccagcagggttgaaaactggcatgtgactggaaaaaagaggttttcattcatatttctagaaaaatattcacattgagattttgaaagatttcaatccaaataaatcatggcaccatgaccaaacatttattagtgaatatttctatatattcaaagaactatatttaagtattcttaattccgcattgtattttgaggagcatagagttgggagagccatttaaaaacatttcaatcccgctctatatgattactgtggttcaatcacagggtctgctttgacatttccaaattcttcagggggaattcagattgctatatggtcatttcattcactttcattataactgattcctgacaaatctagtattttgtagaactgtagacaaccaccaccctttcaggcttaatactacacacataacttcagtgagttcagaggtcaaggtaaaaattaaacgacccttctgtttccatagaaccccatctctcttttctaccctagctttggaaactttgtctccaccaggggttcaaagctgcatatgcaatgaatcaaaagagtatgagagcaaaaataatagatttgcttaaaagcaacactcttcttccagtgatggctaaaagaactaatggacagaaacgggacttaaagccaagaagcaccccctctgaatagccccgtgaaactatttttctgggtggattaacaacgaaaaatctaattctgtattaaaatcctcaatcttcatcagtcaatatgcctagctacacaccaactgactcttaaactgacagatttccctgggaggagaagactcatgtgttgctgcctcagtatacccaagagaatgggaacgagaaagcttatttcgaatcaatacttagtatggcttaaaaatgcttgcctgctgaaactttattgacttcaggagttctggaaaaggaatcacattttccttctttggcaccttgcctttaggggataagaatctgggaaatcatgagcacgatttttccagactctgagtagagagtggaaatatatgcaaaggcagtgaggagtgagatggagactgacttttttcatacatgccagatggataaaccccaaagggaaacaaaactgttgggttaggagaggaccaatggatggcttcatgccacagtctgctcctcacatagcatcatccagctggaagtgtattaaaagaactttggataggtatgaccaaacatcttgtgtagcaattggccaaatgccaactgatcctcagacaaggtatactaaaatgtaaagacagctgggtattaaaaacaaaacaaaaccaagaaatgtgctaaggaaacagaacacacaaaggccatctctcctcaagttgtccctttgctaaccaaggaaaaaaataaatgatgtacaactttaagtctgaaggttagtgtaaagataaggctatgtgaaaaacacagttgttattgcattttcaaaggggaaagggaataacaccatggccatggtattacatatgacttttctctttggttgagttcataccataaggaacatctcagaagttctggaaataagaggctgagaactgaattccattgagaactgagcaagattttataagcaacataatcaagcaactcttcaaaacccttcatgtaaggttttagaaatactggctttaaataaagatttatcttttcccaaaactaagcacctgctcttactgttttcttggcatataatcatgaatttgtacctgatccctgtatatatgatattcacaaacataacttttccattgacaataatcccagtatctcatattttgttcttatttgctctgacattgttaatctagctctcccaaaccaaagtcttgttatttctttctgtttccctattgtagccagaggacattttcatacctctctagatttgtttctctagcttgttagttctactgcttccctgaaatatctttctcgtttattaatttggcatcttgagagcccactcatttctaatcactttttaccatgttttattttgcctctgtttttaataattctcacctttctctctttctgatgtcacgtacaagcaaaataggtttcagaggaaacagtgccattagttaagtgaaagaaatgtgaacctctgtgtttactataggttacattttataaatgcagaaacaatcataattattaatcaaataccgtagttttacttttggcctaaaatttatttggggtaaatatcaggatcagtaaataaatccaagatactttattttttataatttttcaaaaataaaatgatcttatatcagagttcaccaactttagttacaatgtttgcatctcagtttctacacaaatagaaaatgattgaataaagactttattcaaattgacaaattagccaagttgtaaagtattctataactaattctgaattgtaaaccctgttccaaattaagaaaaagatgtcctaaaatatattaacatcgttgtaaaacaatttagaagactgtaaattaaaaatccatttcaaaataattttaagttttaaatttctacattttaacaatgttaatatttttctaataattgatttgaagtaattgcagagaatacaaactattgacaagctttctcacctaataattatgtaagtaagtcatttagtcttccacagttccttgatggtcctatctgatttcaagtgactaaaataaatctgttatgtcttaccttataaagtttgtcaaacaggaattaaagactagttgagtaaatgccaacagcaaggactgtggttgggggtgaagttagctatttgatattgttctgttctgtgggaaataaaagtgtctttgctttaggatcttttgcagtcttttgttcatgtttattcgactaagtcaaagcaagagtggtcaggcatttggccagggtgcaagatctgggtgggatcagtaagcaatttaaaggaacagtgtcctttcagaatgagactgtgttttccagactattgtaaaaacaacttgagagaactttctacattttaggcattggttgacagcctgcctttttttctcatgctatgtccttctctttttattgctacatttctttgcctgggggatgtgctctaagatactggttctgaacatctctgtgaaggagtataaatgacaccagactcagaatcaaagctgtttttttaagagaggtaacagtttgattgttattaaagctggatgatgagtacataggtgtgcattgttctagtctttgtatttctgtgatttttgaaattttttataataaaaggtatatataatatacagggaaagagtggtctgagtatagtcatagttctgcccctaacttttatgggggcttcagttccccacttatgaaatgagagagtagatttaatcatttattaagatgtgttcgaactgtaacatgagaggtttacagcggttaatattttggtctctctctaggaaaggatcactgtggtttttccactccctgtttccctattttctaccttgtggttatggtccatattaagtcaatgtttatcatgtaatatatactgccaagaagccacctgacccctagacagctaacaggcaggcttctccacggacttcctctgaaatagagaatagcaagatcatccgagaaagcaatacaaatgtgcatgttacggttatttaaaatgaactttcttagccattttaatgtgtatgaatttccttattacagcaataatagcctccaattcatggacacttaccaggtgctaggcactgtcctgagtgcttcacacacattacctcatttaatccttcacaagcacaaccacctatatacagtaagtcctcacttaatgtcctctgtaggttctggaaactgtgacataaagtgaaacaattgataatgaagacaattttcccaagagctaattgatataaataagagttaagctcttatggcatattcctagtcacaaaaacatcactaaacctctaaatactcaaaacacctctaataataaacattgaaataaatctaagctatatatacatttatgaaagattgataaaaacaagataactgcttacctgcatattccagttcagggtcacggttgaccagatcctgtcccagcagctgaggatacaaggcaggaaccagccctggacaggatgcagtactgtcaaagggcactcatacacccacccactctctcagacaggcaccatgtagacacaccaatgcatctaatgggcaaagctttgggatgtgggaggaaactccaggacctggagaaaacccacacagacatggggaaaacatgtcaactccacacagtgagcctggcccaggaattgaattttttttctcatcaatgttataacaaaatgacattgaacaaaatattattccaggaccccttgtacttagtagatgttgtaagaattcgaatttttccaagatggaggcagagagaggttcagtaacttgtccgctgtcatactaaaaccagagaatggcaaaatgaacttttaactcaggctggtaagacctgtgagcctcacttataacaactactgcatcattaagtatctatgcgaacgtctgtgttttcactgtctcctcctcacaaaacaggtttcgaggaactgaggaagttttgtgaggctttggtaacagaaagaagaaacggtgggtataatgcagaaataacaacggaatttcctagggaacaaccatgtatttacctgatagcctatgggtgttagtcacactttttacttttgtaagatgagaatcaagagacaaggaagtagcatcttttcaggtcaactctctttttgctgaggcaggttaaaaacatgcagaataataatgccactaagaagcaaacaggtgattcctagatgggggaaatggactaaagccctcctgccttggagctgttttgattaaagttggtgggaggttggagtccaacttagtcatccattccctttcattctccaacattaaatagggtaactcaaaccaaagatttgccacctctcattctcaagcgtgaaaatcagcactaaattaattgggaagattatgcaaaataaaatcttcagtttcatcaatctataaaagacaattagttttgcacccagagaaacaatgcaccacaatcttaatcccaacagatggtcttgaattagtatgctattggacttacaccagaacaaataagagagcatggataaccataatgactagaaaaaggcaacgtggagcccatgcccttctgacagttattttgtagtaaaagtctttatggaagaaatatagcacactattttcattgttactactataaatagcccagagtaagcagtcatatttgtgaaataaatgattattagaagtaatttttagtgtttatcagtcacttgaggtctgtgatacaataaattgctcttctccaaagctctgctagatgaaaatcttttttcaactttttcaaattcttttaatatgctaccatagtagcatctgcattgtgtttattgattctagtaccagtgccaacatcttaatttcagtggtgatgatattttggggtcctagaatcatttaaaaagagacaagtctgctaggacttacatatttcagagaattgtatctgcatgaagtcatagaaatacacacaaaaaaaggctggtaacaaatcaaagttatatattttgaccaagattaaggcatagtatagtttcacaagcttctccctattttagccacctcccacactgctgatctagagtagaaaaaaaaaaacattaccaactaacaaggaagaaattaatgaccttcgtacctgatttgaagaaatttgttcttgaagatcctttcctttctttctttctttttttctttttctttctttctttctctttcttctttttgtcagtagaaaagcttgatatagtagaatttctaacacctgccccaaagctctgaaatttctgggattcattatccttggacccagaatatgacctaggcattctctcaactccttcatcagtaattagaggaacactgtcttagtccattttgtgttgctataaaggaatacctaaggctgagtaatctataaagaaaagaggtttatttggcttacaattctgcagtctatgcaagaagcatgacaccagcatctgcttctggtgagggccattgactgcttctactcatggcagaaggtgaaaggggaccagcgtgtgcagatcatatggtaagagggagcaagagagcagggagagaggtgtcagactcttttaaagaatcagctcccccaggaactaatacagagagaacacactcattaccgcaaggatggcattaagtcattcataagggatccacccacatgacccaaacgtttcccatcaggccccacttccaacagtggggatgaaatttcaacacgaggtttggagggggcaaatatgcaaaccatggcaaacaccaaaactgtattggtcttatttgtcaacaaagggaaagattaaaagcattcaaagacaataagaaaataaaaattatcattggtaataaaatacaggatgtggcattgcttaaatgtggaacagcgtgacttcagttcctatgccctcaccaaattctgattgagttgatccttccacattccctctactatttttcaattgttactattatttaataaactttatggtttagagcagtttcggggtacagcaacacggactcaattatcttttatatcgtttactccctaagatctcttgcttcattatttgtcattcaatccccagcttgaataattgtgtcacatttgcaacacacagtgcctcataggctacagtgacaggctaaattcccgttataccaatcttatgactattaatctctttctctaaaatattttttcaatattaatatttcttctttccatgttgtttattcctgactaaatgcaattattttagaccaaaaataaatcaaggtgccatctggaaagttttacaattttttttctaagaaatatctgaaagtagattgatctagtcctatcataggtttgaatgttcaatatttttctttaattattttctttggtcaatggatagagcagttttaactttttcatgcagagcctacaaatagagaaagatcagatctatttataccttgactaaactctgctttaaatggcaaaatatttctatttttcacttagttcattttactttcagatattagacagtgttattctagatcttggtgaattatttgataaccactgattggtatttaaacttttcttgtattggggacaaacaatagtgttaaatctctgaactggaaggaaacttagaaaccacttttatttaattctgccatttcacagttgataaaatagaggacagatattaagacccacccaaaggtcaaatcattaatcagtgagggactaaaatttaggtctttgtgcatcaaagtggccatctttcattatctctaaatgccctagaaaatttttaggcctttgcgctatccaggcttgtgcttgagcaggagaaaaaggaagctgtatggctaataatttatatttataaggatttaactttagtggcaaatggctcagaacaaatcatcatgggctaagtcccagcacattaaagagtctcacctctcactgtgtaaatcttagtgcctgggccattaaaggcaatgaacaccacctcttcgaaccctgggttgaaaaactttctcctccaggtttggacaggtttatctgagtagctggggattgttacagctacttcaataactgatccctaatcaaaacatagccagtaatataggtagatatcatcatttgcatgaatattaagttgtagaaacacaatacctacttgggttttctggtcagtgtattgagatttaataagaatatccaaaaaaagttttaaaataactcttctaaatttctggaataaaagtgttttaagagcattaagtaacttattatcccatgttatattaagccgttacaatgctggtttacacaacattgttcccagttaaggtaatagggtcatctgtttttttcattgcatctaaattatatagttcctcctgcacaacagtttgtttctccttctgcccttagaaattctatactaagggtaaattattcatggacaaaatttatagaaaaggggacttgaggtgaattttttttttcctatttggggatatgaacaaccttttaataatactaaattctacacagaaataaagtacctattatcattattcattgtttatatccagaactatagattttgaaatcacatatataatgttatttaatgttgagtaacttttacttaattatatattttctgttattctaattgaccaaattcagaaatgccaaatactaacacaatttagtcaggactctgcatgggtcttcaggaagtgttgtttgaaaaaagatatttgggcaccaccttgtgggactttgtagaaagacatagtgtgagagtttgtcaactattgttaacagatgaaaaattttaatcgtctgtgatgctgaacgggtggaataaaagttgctttctacagcttttttgggcagaagaatgaggagacgaacgaaagagtgataaaactactcttatataggatcaagaagctctctaagtaacatctgatgaaatccataactcattcacttaactaacatcaacttagtttctactatatgtgaggcactggatagaaaacagatagatgcagtcacttcaacccagtgaagaaaataagcaagtaaagagcaatggcaagttttacccaaaaaaaaaaaaaattaagtaatcacatatctaactctagttgacaataccatgctgcagggtttgggaacaaaatttaccagtgtctgcaacttactttgaaatgcatcataaagaaagaagatggggctgggtgcggtggctcacgcctgtaatcccagcactttgggaggccgaggcgggcagatcacaaggtcaggagatcaaggccatcctggccaacatagtgaaaccccgtctctactaaaaatacaaaaattagctgggcgtggtggtgcatgcctgtaatcccagccactcaggaggctgaggcaggagaattgcttgaaccagtgcgctgagatggcaccactgcactccggcctggccacagagtgagatcccatctaaaaaaagaaagaaaaagagaagaaaagagacgggtagaagaatgggtagatgggtagattatgcaatagagcaaatatgttcattgtaaatacaattgtgaaatctgggtggcaggtaatgggtttgctgtataattctgttaacttttctgtatgtttgacaattttcataacaaaatattaggccaaaaagagcaagagcaatatagtgtgataacatctataaaagagacttacacagagggcacccaggtcagactgtgatatggaagttggaagtgcaggagcagaggataaacagtggtttcttttatgccatgttaaagggtttaaactttatcttgaaagcaacgggagccactgaacaattttaagcagggttgtgacatgatcacactttcatgctaggaaaatcactctgattgctgtgtgaataatggcaggaaaacaagcttggaggctgagatctactaggaaacttactatgacaccaatgagagataaggctctcaagtaccagcaatgagaatgcaaagtgaagaagtctaagaaatattaagaagcagaatcaaagagcttagtacctaattggcctaggaaagtggaagaaatgaaggagaaagatggtacccagcagtctgccaaaaagtatttaataactgtctctctggggaaaaaagtgtattgtacacatatacatacgtaagtttatcagaaatgttattgataaagaacgtatggtataaaattttcaaataataataaaatacacaatattctctattataaattctatatagcaaactgattcatacagattgctttcattgatttttggccaaattcttatatctttagccaatctatggttgtaattgatgaatgagtatagttccaacaagaatgttggttggcattttcctcttcttgaacaagtaagacaaaaatgaaacaaagaaaaaggtgcatgtgcattgaaacttcatttgtttgtcaatgatataagcaactttgtagctgaataatataatacttttcaaatactgaaacattttcttagtttttttcttattcaactgttacagataaaatacacttttgagtttaatctgcattattgttttctccatcactttctttggcctagacaataaataagacagtaattcaagccctaatttgtagcagatttctattgtgtaaaaagtcctactatgtcagatttcaaattactaatgtgacatcactgaacacagggttgcaaagagaaacacaaatatatagcagcataccactatgcaggatttccatcatatagttgccatggatgcaaacaacttcaagtacacacacaatagtaagatttagtaaataattaggaagtaatgagttttgagtatttattactattgtttttaatgtaatttatttacttgtaagttaaatatataatacaacatttaataatatctgcggttaacaactggctcaaaaaatttctggaaatttagcagttgaccctcacaaggtgacatgagccatcttcagcacaccagagactatacctaacttccaggctgtgcggtgcgctcttgcctcttaaaagagtacagcacacaggtctgagaattggttctgccactttttgacgctggacctgtaagttctgaaagccttacacagtttccacatccgcaagtgaagactatgaggaggagcccaataaaaataaggatagcaacagcagcatccgaatcaacaacaaaaataacacctctctcacagtgttgtggtgagtatcaaaagagctttgtaaacagtaaaaatccataaatgttctgtaatttcaaaaacaacttaaaagacaaactagtaaaagaacagagattataacaaactatctctcagaccacagtgcaatcaaactagaactcaggattaagaatctcactcaaaaccgctcaactacatggaaactgaacaacctgctcctgaatgactactgggtacataacgaaatgaaggctgaaataaagatgttctttgaaaccaacgagaacaaagacacaacattccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagcagaaatgaataaattcctcgacacatacactctcccaagactaaaccaggaagaagttgaatctctgaatagaccaataacaggagctgaaattgtggcaatgatcaatagtttaccaaccaagaagagtccaggaccagatggattcacagccaaattctaccagaggtacaaggaggaactggtaccattccttctgaaactattccaatcaatagaaaaagagggaatcctccccaactcattttatgaggccagcatcattctgatatcaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatctctgggatgcaaggctggttcaatatacgcaaatcaataaatgtaatccagcatataaacagaaccaaagacaaaaaccacatgattatctcaatagatgcagaaaaagcctttgacaaaattcaacaacacttcatgctaaaaactctcaataaattaggtattgatgggacgtatttcaaagtaataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaggaggaagtcaaattgtccctgtttgcagacgacatgattgtgtatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccagcttacaagggacgtgaaggacctcttcaaggagaactacaaaccactgctcaaggaaataaaagaagatacaaacaaatggaagaacattccatgctcatgggtaggaagaatcaatatcgtgaaaatggccatactgcccaaggtaatttacagattcaatgccatccccatcaagctaccaatgcctttcttcacagaactggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttaacaaacctgagaaaaacaagcaatggggaaaggattccctatttaataaatggtgctgggaaaactggctagccgtatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatggaatctaattaaactaaagagcttctgcacagcaaaagaaactaccatcagagtgaacaggcaacctacaaaatgggagaaaattttcacaacctactcatctgacaaagggctaatatccagaatctacaatgaactcaaacagatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgttggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaagaactctaaatcatgctgctataaagacacctgcacacgtatgtttattgcggcattattcacaatagcaaagacttggaaccaacccaaatgcccaacaatgatagactggattaagcaaatgtggcacatatacaccatggaatactatgcagccataaaaaatgatgagttcatgtcctttgtagggacatggatgaaattggaaagcaacattctcagtaaactatcgcaagaacaaaaaaccaaacaccgcatattctcactcataggtgggaattgaacaaggagatcacatggacacaggaaggggaatatcacactctggggactgtggtggggtggggggaggggggagggatagcattgggagacatacctaatgctagatgacgagttagtgggtgcagcgcaccagcatggcacatgtacacatatgtaactaagctgcacaatgtgcacatgtaccctaaaacttaaagtataataaaaaaaaaaaaagaaaaggtgggcagcaaagtcaaaaaaaaaaaaagacaaactacactagaacaggttcataatatataggatcagtatccagaatatataagaaaaagaaaaaaataggatatgaaatggcagttttttagaagggaaataagaatgtctaacaatcatatgaaaaaatatttactctcattagtattcatgaaaatgcaaactaaaagcactgagatatcatatgtttctcattagattgacaagtttaaagagtgtaataaagggttagcaaggatgctgggaaatgggacatgtggtgggagggtgatttggtaaaactgcattacagagcaactgggcaatatttgttaaaaataacaaagtgtatttttttcgcttccaggaatataccctggagaaattctagcacatttgttcaaaagacatagacaagaatgtttattctaataaaatgttagaaacaacctaaatgttgatcagtaggttggataaataatttgggacgtaacaacatttatttattcaacaaatatatcttgtaatctttatatatccttaaaatacaattttaaatagaaaagaaagctatgtaatgatataaaaatatgatatattttctataacattttaaaacatacaaaatgttagctattttacagatacatctgtaaaatagatacgtctatatgttgtaaatctataacaaactttgatagtagaaaactcaccagttttctgacagtggttgtcactggagagagaaaggggaataggactgggactggatacaaaggggacttcaactctatttctaatgatctgagaagaatttttttaaaaccctgaaacatttaaattctgggtggtgggtatacagatttttgtcatattacccttaatatacatgtttttaaattttcacaataaaaagtactttgaaaacccttcaactcttcaacctattaagcaatagctaaaacagagttgataccatgccagttacacagatttaccattttggactctactccttaggccaccagatctcattaattcttattttcagcatttctcatggatactttaattttccaccagatcgccgcttcactaactagaatccttagcccctgcaaaatactcactctccaaatagccctagaaatcccaagtagacatcgtatatgtactcataaacaaatcatcagttaccatttgacatcatccatttctttctgtcctgtacttgaagctcattctatctctagacttatagaaaatggggcaaatttctactttttaatgcttcttaactggcatgcagcccacaaagatcattccttgctctgaattcttccagcgttatttatggtaccattcatctaacaatacttattgtgttttgtactgagaagtgaatattttatgttatataataatacttaaataatatatattttattaaaggcaggaattttttaaaaaattctacttcttttatagtacccgtagcaatgtatgcagtcattcatcagcaatggttgtaaaatgaacaactattttaaatattgtagcactgtgtgattgtcttctaaataactttatctttccaagattttgatgacttaaactcgcaaaattcctcaaagtatgtcatgggaaccctatgcctctgccttcattttttcatgatacttctgttagtgtgtaattttaggcatctctatatcccttaattcactgctacccataggaggaggagttaggtgtatctcatacttagtataagtatgtcacatgcaacatgtggaacatacttacactgagaaaaaaactaattgcttatctgaaacttaatttaacttggcagcctataatttttgtgtatgctaaatctagcaaccctaacactgacccatctcagtgttatgatggggggagatagtctaacatgcattgatctaacatccattcgttgatttttcttgaactagtggagttagtatgttaaaagtcctatgcattgtgatttcctcttttcctcttttactattcagaatccaaggatggaaggcagcgagtgacaccctttgcaactgtaataccccgatgagaaactccaaatctagacatgggtacaggtacttagaagcttggtttgagttgcaggtccaaggcacattcagctttatggaaaactatgctgatattttgatccctatgtttctgaccgctatgtgtatttctcaattaactccaaacccagaagaatgttgagaataattatcagtgttaacccccatctccctgtggatatatgtggatatagttaaaagtgactacattttatttcattctttacatactctccaatccctaacctctaccttgtcaaatacatccaaagtaaagaaaaaattaggtcaaaaggaataattttcagtaactaagattttaaagagcttgtaggaacacgaatgttaatttcagccacaagaaaacttcatggagtcagtgcttttattagaacgaataatcttagccaatttgatttaatcatcagtgtagatcttacttgtatccaataatgtcaaggccactgctgatacatcagcattctttataagctattaaatgggagtcttatttcctagacatttatattaaacttataagaaaggaaaactcttaggcaataagacatgtatttaacaaatacaatttagcatttgtaaacattaatataaggaatcatttctaagtaaccacagaatgccttagaacttcagtcagacagatagaatttaaatgtgtttggagacaaagtggaaatgtcaaagtttactaaattactaatttactctaaaactcatgcacccaaaaaactaactttattttctaaatatgaacttagcttgttccagataaaacaaaacaaaaaccttaagctgatcacaggagatgattgtcttcctaaataaaatagtctcgtccaattaaattcagtgtcttgtggctcttcaatatagattcaatagttacacttattgcatacttccaaagatgcagtataacagacatgtatttccttggctgatgttaaaaaaacaaatatagattgaaactttaacttttaaaccattaaataaataattaccaagatgctggtaataattaatgaaaactaagctgctttctggaaagaagcttatttttgaatccactgtataaacattcatcacatagtaatgttgttaatagtctgagcacttgcttaattgacacactatgtgcaaatacttctcatgatacatggtatcattccttttcctaccccagattagaaaagcgcctcttcctcaaatctctcgctacctgataactgtcagaataggtaggatgcaattgaccctccatggagacgtttaatgtacaaactgaagaagtataggcctcagccctgtgtaacatctcactgtttatgcagttaacatacttgtgtagagttgaaaaattatttttatttttcagtttgtattatatttattaaagtttaaaattttagtttaataaagtggcttgctcatcctgattacagttgaatgttaccattctgtcgagtagaagtccacaggatgcatcataaaacaactttattattcccccaccactcttcctattggggaagtggggcaggattttccttgcaacatggatgaaatcacaggtagtggtcatgaatcttcgggttggtctttgataaaaaaaattgcttctttcaaatttagttataaaaactctctcgttccaataatttaaatgtttatcacaggtagtagccaatattctgagcttgaagtttcttctctggaatactgcagtaggaaagcggacatagtcaacttttccatttccccactttgtgcctctctgccttccccaaactcatgaattgcagtttcaggcccttccaggtagaagacaggaaagatctgcttagctggtcactgccacgctttgattttggaaggtattcaggtgatctctttctcactgcagagctcttatgcattctttggagactctgcttcaccagggatttctcatctgaagttctcttaatgctggccttaatgcaagatctcttctccagcaggtatcaaatacaatctttacctcacaccatcttgttcccaacagaatacctccaacatctctctgctatggtcacctcagtcctggcagatagttctacagatttctttaagctgactctcttgcccttgtagtctacatcccatcctcagggcaagactcatatcctctatcctgacaaactgagagtgaaggttgttccccacaggtgcacctctcacctcttggccattagaaccagccagccccagtacctgagttttaaggcatgggtcccaaagcagcccaccctgttccctacctacctccctcttccaagatgcacggatcaagctctctgtgtggaacagcacctgcccttcacccccagatatctcataggggattaggagtgagactcacagaaaatgaatttctccgaagaaatcacttccagactcttctgttcttttatatctcagaaaggattgggttttcaggttgcaaaatcttttccagctctgcataggtaggtagcatctcactgaggaatggagtatttaccacctattgttctgttccagtctagtagagctttagcaaaaactacaggcaacaaattctatttttaacatcctgttacacaaacaaatatgctgagtatgcacacaaataaatggtgaaagaggcacaaagaagtgaaaacaatcgtgcatggtaggaatatttgaattgtattacatgtcctttaatattgttttaacagtaatatttttacattttcaattggaatgaaagcatgtatgtgtttgaataatttttcatcgtgcactcatttttttgattccacaactaatgagagaaacagtgatgattgtaaaatgtatcccacccttaaggaattcacagtagaattccttgtagttcctgtagaactacaataatataatgtaatataataggtaatagtattataatactctgtgtgtgtgtgtgtgtgtgtgtgtgtgtgtgtaaagagatggggactaaggcaggtacagcaaagtgctaaggagtccagatggggatagatgctacttctacttctagctgcaggagacttcaaggaggggctggagggatgtatcttgagggatggatagcatttgatttttctaagtcttggagaagagcattctgggggcctggggggaaggaacaaaagcacgttataaggaaagtgctatggaaaagtaattgggaacaattcagtgggacagctctagtatgaattaagaaatcaagtgggaaaaaatatgttgggccacagtaggtagggacaacctcatgttgataaccctttaaaaaaattccagatgtttttatccatgttacatggagagaaatattcaccattacatgtaatttactaatctttaaataattatcatatacttacctcatttatacaacacatttaacatctattaatttagtaaatgagatttctcttaagcactgttgcaaactgaatccctcttctcaagtttaaagtaggagactcttggaaatatttttcaaagagaggacaaaatatgccaatagaacaatgattataaaactgaatagtataaaagtcattaaaaggctaaaactttggaagtaaatttgtgtccacatcatgcctgtcctgattctaattctggttctctttatgcttctgggttttttccctctttcattgcttccttgggttatgattatacttagccaagaaagtcaggcttagcttctcaaatgagctgctaatgttccaggatttagagcatgtgagtcaactctgttatccatctgaaggttttccagttacacattgtaaggtacaatgtgtaccttacagatgtaaggtacatctgaaatagtccaaattactgactcaggccaatcacatatgctttgatttttctgtgacctaatctttttctcaaaatgaccctggtcctcaatgcgttgtcttcatagtctaataaacatctacctcccagttcttgttctgaaaatctttttcttattttactaccaacagaaaactgtttatataactgctttgggtctaattataaagttaatctgattcattgaaaatacaactttttttctcatctctcaaccattatgacttgcaacacggacatttaagtcaagtctgaggagtctggatgttggtctatagggaatgttaaccaatgaaaggctctaagtaaagggtcgcttcaggtatgcttcagagtaatcaatctggcctcacagaggaaaaggattagagtaaatgagcaggaaccagggagccagaggccaactggggagactaccgtctggctgaggagtaattaagacctaaagcagggcaatagctgtgggagcagagacattggcagaatgtagccacatcatctgtttcaaaatcccaaatgtgatttactcaagtcttgttcaatgaggggtagagatcaggcagtaaaatgactgtggttttactggtactaacgatgccaatttgagaacaattttgatagctgctactttagtgactcagtgcccgttagaagaaacgcgccaaattactaacaaaaaaagcaatgagcaaggcaggaaatgtttggattgcccatgttgcagttgtcatgctaaaactgctccagttaataaggcatctgatatgctgcttgaatcttatttgtaccttaactttgtggatataggattatgatgtgtctattatggaatttagcatcctgatccctccaattatactcttaaaataacattcatttttttcttattaaaaacatttttatattgtaacgcatataacaattacattcaaatttagaaaacacagaaaagtataatgaagaaaataatgatcacttttaaacctaccacacagagaaatctgttaaaacttacccttttaaaataaggctaggatcagtataattatttcatccagtaatatttcattcctgtaacagtaaaccgtagtgctttctcaatctttaaataatttcctaaaacgggtcaacaagctaatccagcctgccacctgtttctgtaaataaagttttgttggcacagagccatggctatttgtttatgtactatctatggctgcctttgcactacaagagcaaaatcgaatagttgtgacaaaggcagcacagcctgaggagctggaaatatttactatctggctctttacaaacagtttgctaactcctgctttaaaagattattttaatgacagcatataattagatcaaaaggcagttcccttggagagtgcacgagccagtggttagaagcacaatgctggcgccagattgtctgggtttgtatcctagcgcaaccatttaagaaatgtatgagcttgcctaccttatttcacctctctgtgcctcagttttctcatctgcaaaataggaaaaataaaagtgttatcctcataaagttgtgatgaagatgttgtgagccctgtgatgcgcctccagattttcctttggtcattagtgacttcttccttcagctgtgggaagtgctgccagtagacagccctcagctgtcagctttctttggggactgccttacccgaggaaattgcctcactcaaaatcatgcctcctccaagggacagttcacattcaatgacacatccacataaatggaatagtataaaggcctgtgtcccagcccccaactcaggacaactctgaaggaccagtccaactccagagttacccatgggctggcagaggccttttttggcattgcatagctgctcaatctccccctctgcctaatctcccttcttcctcctcccatccttaggtgctgatcccaacaatactccctaatgaatatgctacatcctagtctccattttagaatctggttcccaggaaacctaacctgagatagtatgttaaatgagtctatatttaaaatctctgacacatagtagatgctatatatttatataattttttcttaaataaacaaataatccagtgggaaagagtgaaatggaaatacaagttcaaggagaaaaaaatagaacaatgtaaaatttcctacaattgaagaataacttaatcataaagtttttgttaaaaaaattaattatatagatcaagcagtggttattggttgagacaatccacattgacaactttgaaatattccagtgttaatatttatttatttttaaaaatcttttttaaaaaggtgtacttttcttttaaatagtatgtgtatctatttgtgggatacatgaaatcttttgatacaggcatgcaacatgaaataatccaatgctaatctttaaatacaggggacaaacatcaatcagattctcataacatgttcagagtctacataaactgaattctggacctagttcaatacacaagggaaagagaatgacagtgtaattaccaataattaaaccaaaggcataattttccaaatcacttttagtaagtgaataaattctgacattttaaaagtctaaagctacataaaattcaaagcaatcaaactatttttctacctgaaattttttttgaatttctggagggagggcaagatggctgactggacacagccaggtggaacagctgccaccaaggaaccaagatgactggggcatgtctaacagatcttcagagggaagtcacctagagtggatggagggaagacacagaacctgggctgaagggggaagaagctgggaaccctgcatgaggctaccacacactgagactcgttcctggccccagtgacaccaggggaacaggtgaattgaactggcaaggagcaacccgttcttgccatgggcctctggaatcccagcaggaggagacccccttgaccagcacagacacttgagttagcaggaaaggctgcttagagaagtggtagcggcagcacatcagctgaggcagagcctagacggtttggtgcaggagcatctttagtggagcacagccagggaagcccatctccctagactcaacttgctcccataagagactttagccctagggaaactgtaagatctgaactctgcaaggtgatcttgcccttcaaatggggccagttcaacctgagcacctcttggtctgctggcctctcccagggccccagcctccccacacctggttgcagagcagcctcaggtgccctgggggcccacttcacagctcctgtactggcagatcatgcctggctggcagacagctccagaggggtggcccccatggccatgcaccagcctgcctgctccctttctacactgcagtttctcccaggctcacagcaagcccccacattgctttcccagagcacatgtgcatgcgcaggttttgccttccttacccaccagtgcagtgtgtgcaagctccctgccctgctactgctgcagtgagaatgcactccaccccacctccccaccaccaccaccaccattgcagttggagccttggcaggcatagagccagccagccagccctactcccaccagtgccctgcccttgtgccaacactgccctgggagtgaaactaggcagagaaaacagtggatcctcccctgccctgagggaccaccctagcctgcagcacacagagaatacacacagacctgtgcccaccagcaccccacccccatgctaacaccaccaccagcctgactgcacagttgccagcagcgaccccccgacccccacccagcggtgctgcctctgccgctgtgatgaatgcccacatggaggcaggcatcccagcacctgtaccctgctgcagcaaacaagcatatacctcactatgcttccactgccactgctgctgtcatgtgtgaacgaggatggatcccagtgttactgcactacaaaatgctttggctaacaccacccattagtgtagtgaacagcaatccgaaccacctcagctccccaccccaaccccccatacagtggattcctaacctcaaggatccagacaacaagatcagggcccgatacaagtcccccagagagagaacacacagtccaagagttgagagcttcagcattggccccttaaaatcttccaaaaacaaagccagttgactgaatccatcttataccacaaccaaaccctcaaggtcatcatactagatgaaagaaagaaaaaaacacccaaaggtcagcaacctcacagattgaagaaacatcaacccacagagatgagaaagaaccaacccaagaactctgacaactcaaaaaaccacagtgccttctttcctccaaatgaccacaccacctctccagcaagggttctgaacaaggctgagatggctgaaatgacagaaacagaattcagaatatggataggaacgaatactagccttgaatgtaaatggcctcagttccccaattaaaaggcaaagtggcaagttgggtaaagaaacatgatctattggtatgctgtcttcaagagacccatctcacatgcaatgatacccataggctcaaaattaagaaatggagaaaaatctaccaagcaaatggaaaacagaaaaaaatcaggggttgcaatctcaatttcagacaaaacagactttaaactaacaaggatcaaaaaagataaagaaggggattacataatggtaaagggttcaattcaacaagaagacctaactatgctaaatatatatgcacccaatatacaagcacccagattcataaagcaagtccatagagaccttcaaagagatttatactcccacacaataataatgggagacttcaacatcccactgactgtattagacagagcattgaggcagaaaattaacagatattcaggacctgaactcaccaatagatcaaatggacctgatggacatctacagacctctgcatccaaaagcaacagaatatatattcttctcatcaccacatggtgcatactctaaaattgaccacataattggacacaaaactctcctcagcaaatgcaaaagaactgaaatcataacaaccactctcttggaccacagtgcaatcaaattagaaataaagactaagatatttgctcaaaaccatacagttacatggaaattgaataacctactcctgaatgacttttgggtaaataataaaattaaggcagaaatcaagaagttctttgaaactagtgagaagaaagatacaatgtaccagaatctctgggacacagctaaggcagtgttaagaggaaaatttatagcactaaatgcctgcataaaaaagttagaaagatctcaatttaatagcctaacatctacaactaaaagaactagagaaccaagaccaaactgaccccaaagctaacagaagacaagaaataaccaaaatcaaagatgaactaaaggagattgagacacaaaaaaacattcaaaagatcaatgaatccaggagtttggtttttaaaaaaattaacagaatatactactagctagactaataaaaataaaagagagaagatccaaataaacacaatcagaaacaataaaaggggcattaccattgactccacagaaatacaaataaccgtcagagaatattatgaacacctctatgtacataaactagaaaatctaaaagaaacataaattcctggacacgtacaacctcccaagactgagccaggaagaaattgaatccctgaatagaccaataacaagctcggaaatggaatcagtggctgactaccaattaaaaaaataaaaaaataaaagcccaggaccagacagactcatagatgaattctaccagagctggtacaattcctacttgaaactattaaaaaacactgaggcagaggaactcctctctaactcattccatgaggctagcatcatcctgatatcaaaccctcatagagacacaacaaaaaaagaaaacttcaggtcaatatccttgatgaaccttgatgcaaaaatcctcaacaaaatactggcaaaccaaatccagaagaacattgaaaagcttatctaccatgataaaataggttttatctctgcaatgcaaggttggttcaacatacgcaaatcaataaatgtgatttgtctcataaatggaactaaagacaaaaaccacatgattatctcaatggatgcagaaaaggctttcattaaaattcaacactgcttcatgttaaaaaactctcaataaactaggtatggaaggaacatacttcaaaataataagagccatctatgacaaacccacagccaacatgataccgaatgggcaaaagctggaagcactccccttgaaaatcagcacaagacaagatgccctccatcaccactcctatccaacatagtattgcaagtcctagctacagcaatcaggcaagagaaagaaagaaagggcatccaaataggaagagaagtcaaattatccctgtttacagatgacttgattctatatgtagaaaaccccatagtctttacacaaaagttccttcagcttataaatgacttcagtaaagtctcaggatacagaatcaatgtacaaaaatcaatagcatttctatacaccaacaacagtcaagccaagagccaaatcacaaacacaatctcattcacaattaccaaaaaaaaaagaataaaatatctttcctaggagaactacaaaacactgctcaaagaaatcagagatgacacaaacaaatgaaaaaaatgttccttgctcatggataggaagaatcaatattgttaaaatgaccatactgcccaaagcaatttagagattcaatgttattactatcaaactaccaatgacattcttcccagaactagaaaaaaactattttaaaattcatatggaaccaaaaaagagcctgaatagccaaagcactcctgagcaacaagagcaaagctgaaggcagcatgctacctgacttcaaactatactacagggctacagtaaccaaaacagaaaggtatgggtacaaaaacagacacattgacaaatggaacagaacagacagcccaaaaatatagctgcatacttacaaccatctgatcttcaacaaagctgacaaaaataagcaatggggaagggactccctattcaataaatggtgctgagataactggctagctatatgcagaagattgaaactggaccccttccttatatcatatacaaaaattaactcaaggtggattaaagacttaaatgtaaaacccaaaacccctggaagacaacctaggcaatactattctggacataggaatagacaaagatttcatgacaaagacaccaaacacaactgcaatgaaagcaaacattgacaaatgagacctaattcaactaaagagcttctgtgcagcaaaagaaactatcaacataataaacagacaacctgcagaatgggagaaaattttgcaaactatgcaactgacggaagtctaatatccagcgtctataaggaacttaaacaaatttacaagcaaaaaacaaaaaccctattaaaaagtgggcaaaggacataaacagacacttttccagagaagacatacatgtggccaacaagtatatgaaaaaaaaaagctcaacattactgatcattagagaaatgcaaatcaaaaccacaacgaggtaccatctcaccccagtcagaatgactattactgaaaagtcaaaaaataacagatgctggcaaggttgcagagaaaaaagaatgcttatacactgttagtgagaatataatttagttcacccatggtggaaaacagtgtggcgactcctcaaagacctaaaaacagaactatcatttgacccagcaatcccattactgggtatatacccaaaagaatataaatcattctattataaagacacatgcacatgtctgtttgtcgtggcactattcacaataacaaagacatggaatcaacctaagtggccatcaatggtagactggttaaaagaaatgtggtaaatatacaccatggaatactatgcagccgtaaaaaagaatgagatcatgtcccctgcaggaacatggatggacctggaggccattatccttagcaaactaatgcaggaacaaaaaaccaaatatcgcatgttctcatttataagcggaagctaaaagatgagaacacatggacgcatagagggaaacaacagacattagggcctaccaggggtggagggtgagacaagggagagaatcagggaaaataacaggtactaggcttaatccctgagtaactaaataatctatataacaaacccccataacatgagtttacctatatggcaaacctgcacatgtacccctaaacttaaaataaaaacttaaaaaatcttccttgtcctatttaaacataattcttggtattgaggtaaatctgaattcacatgatatgctttgtcaaatttttccaaaaacttttttttttttttttttttttggagacagagtctcactctgttgcccaggctggagtgcagtggcatagtcttgactcactgcaacctctgcctcccgcattcaagcgattttcctgcctcagcctcccaagtagctgggactacaagtgcgcaccaccatgccttgctaatttttgtatttttaatagagacgggctttcaccatgttggccagactagtcctgaacttctgacctcaggtgatccacctgcctcggcctctcaaagtgctgggattacaagcatgagccaccacacccagccctgttttgcttataatttaaagatttaaaaaatattacaaatcatatacttgacaactatgtaaatttgttttgacaatgttaggtgtaatcccaaaatgcatgaagaaatgcattgatttaaaaaatttatttggggatattctagaaaagtttttgaaggccattattttaagatatctctgatcttctgatcttcaacctatgtgaaaagattacctaagccatggcacatgtttacagggcttcatttcagcttgatacctgcccagcctccatctaaaagcaaaacttgctctcaggtacagactgattttgtgcatgtggaaataaaaagaattgggattagccagtcacagacttcacaaaatgttccagtactgtagtaactgaattgctgccaggagcagctgtaaataagaaagaaattcgctgtccttcaactgcaatccttctggttttaaaaccacaacaaaaatcctctcctggatcaccacaacataaatgaagaatcttaaaaagaacatcctggccaagcgcagtggctcatgcctgtaatcccagcactttgggaggatgaggcaggcagatcacttgaggtcaggagttcgagaccagcctggccaacatggtgaaatcccatctctactgaaaatataaaaattagccaggcatggtggcgcatgcctgtaatcccagctactcaggaggctgaggcaggagaatcacttgaacctgggaggcagtgattgtggtgagttgagactacaccacagcactccagcctgggcgacagagcgaggctccatctcaaaaaaacaacaataaaaaaatcctattaggaatacaaaagcttaaattaaaaacaaacaaaataccgagactgaactacagtggccctaggatctattgtaaaacgcatgtttagtaaaggcaactagtgtaatctcagaccagtctgtcaagttctctgctacggtttactgtttccaaagatacaaagcactcactcaactcagtaaatattttttggatacctatgcaacaggtgctaagggaaatccaaagttccatgctaaaagattgctacctgcaaggatcttggtttagtagagaaggggaatcagtttccaaaaagactgagaaaggtgtcacttattcctgtgaggggctttagaagaattagtggcaatatgaaaaaatatatactttcacaaagcttgagtggaaaagaaagttgaaaaagggacattagctggaggaggatgtagaataaatacgttgttttaggatttattcaatacatttttatttaccacatttattaggtactgttttacatcctggtgattaagcagagaataaaatagacagagcccctctgttttaattagggaattggctaagctgctctaccaggtccaaacaaacaatgattttttaaagaacaaagtttattttctcttgcataatggtccagaagtctgtggttgatccaagggaggaggtgccccagctccctgagattagtttgggacttaggctagtgagaacagctttgccttccttaatacatggcttccatttccagtctgtatttctttttgccatttgccagacagcaagaagagggaagagaaagtgtatagcaagcagctttccttttaagggacatgatccagttctactcacatcttacaggacataactttttgatatagccttaccttgctgaaagggaggccaaggaatgtcatgtctaagtaggtcaccaagtgccctgctcaaatttgaatgtagagttatttcctcttactaaaaagaaaaaaaatacagaatgaaaactggagataaggagaagacacagtctagaagataactataggaaagtaaagagatggcgacgtatgtgaagttgtggtgtcataaagacaacaacaaaggagctaatttataggtagtcagtgacaagtgagcagtcttgagtaaagggagagtatgagtcatgtagatttctgcattccagacagagggaatagctagtgaagaagccctgaggcaagagcatgcttgtcatgtttaaggaacagtgaagtcacagggataaaagacaaaccagaagaaagtgatgatatgcaacaaagtgaatgagacatgtcaagagaggaagtagtcaagaacaacagaagttgcaagagtgaagctttggccattgaaactggcagcatggagctcacaggtgaccttgacaagtggcagtttcgtggcatggtgggcatgaaggactgaatggagtgaattcaagggagagagggggaagtggaattacagagagcaaatatgatcctctcctttgaagagaaaatgggaataacttgagtatgtgttgaaagtaaagaaccagtagaaatggagaggcaaagatacatggaagtgaagtaattgatggtgcaaggtcccagaagaggagatatacatggggttcctcctcttactctttgtcacctaaaagaaggtaagaatggtagtgaatcaagatgttggaggagggaaggaggaagcagtgggaggttgtgcaaattctagctaatagttttaattttcttttctgaagtaggaggcagtgtcatctcctgagtgcaagcagaaaagttgtcctcaactatgtatagtaggagtggataaggaagagatttgtattgatctgaggttttgtgtgggggtttgaggccagggtcaaaaccactgagaagattggcaagatagtgtttgaagtgatgaatactgtcatgtctcctctcagtaatacagcactttcttcagcctacattcttctaatggcaggattggaaaggcaatactttccccaaactcatcatcttatcaaaaccatctgccaccaagatcatcaggactaagctcattatgctgtttacagccatcaccaccacaagcccaagaccacccacttttaatcatgaacagacaagcaaagactgtcagacatctgaagactgcctcgaggtcagactcgtgacacctgaggcagcaccattcactcagttttgggaacaaaaaacttggaatcctctttcaccgtcattcacttggtcagtcaccaagctctgttcatcccgccttctaagtattccccagggcccccacttctctccatgcccactctccgtgccactggtaacctgcgtttctatcatccctcattctgatactctatccctccagctctctgcgcaaaaactgatcatactggccgggcacagtggctcatgcctgtaatcccagcactttgggagaccgaggtgggcgcatcacgaggtcaagaaatgagaccaccctcgccaacatggtgaaaccccatctctcctaaaaatacaaaaaattacctgggcgtggtggcgcgcgcctgtagtcccagctactcgaggtgctgaggcaggagaatcgcttgaacccgggaggcggaggttgcagtgaggagagatcgcgccattgcattccagcctggcgatatagccagactccgtctcaaaaaaaacaaaacaaaacaaaaaactgatcataccacttgcctgattaaaaactttcgatgactctaacattgcctttaggtaaatgccatccaaactcactaaactggtttccaacccgtttctgaaagcaccttaatctctccccacttcctctgctcattcatccatacctactgcctcctcactgctatgtcctctctcctgacccggcacttgctctttcccagtcctagaaggctcttctcttccagttcccactgcccttttccctttcctggctaatcccatactcatccttcttgtctcaacctagtggtccttaaggaagctttgctgacccccgacaccgagcgggcgtccctcctgtgtagcactgtgttagccctaccaagtcaaggctctccttgcctgtttcctgccggaaccatgtctttttacttcactcctgtctcctcagcattccagcacagtgctgggtacataacaggtgctcaagacaagtttgtggaatgactaatgagtgaataaatcattaaccaaacaccttggatctcctactacatcatttgcaaaaaaaaaaaaatgtttaatagaaattaaaatggacccagtgagctagagtgtgtgaccctgcttaaaaacgacagagtggttctgagaagcagtcccagcctaggaacccggggatccggcctgtggacccacgggcagggcctgcggggtgcaccggcgctttcgggcggaaggcggggcctcccggccagtgaccccgccccgaggcgcctcccgggcggggaagggcggggctcgcgctgggaaactccccttccaaggccgaggcgccgctgcgcgtcctccaggcgtggtggtggggtcgtgggtcccagcccagtggtccaggtcacgggccgcacggccgcggccgccatcttgcccgcgtccgggctcctgcggcgggcggggcggtgtcccggccggaagcggctgtgcggcggccgcgctgccacctcaggtcagtgagcgcgacccggttcgcgtctcgactctcgggagcgccgcggccgcagcgaggggccggagatagcctagttgaaaggcccgggcgtctcggcggggagcgcgttccgcgctgtagggtaatcgcgccgggcggccggccgcctggccgggcctcagcgggagccaccgggggctgcgggcggccgtgggacctgcggagacctcctcggggcgcagggaacacgctacagccttcgccgcggcgggcttgtggggagcggcgtcccagcctttcccgggaggctcagccaggtgcctggagcgggagagtcggactcagattcctgctttacctagaatagcaacgtgccctgttcccgttgtaccctcttaaatactatacttcttaaacggcctgtctcccggtgagctctgttctcttctcatatgagtaatgaaaattaagaggatgaatgaaacctcacacatgttgtggactttgctgaataggttagcaaatgactgcaggccttttgtatattttaagggaaatttggatatgtgcagtgcatctcctcgaagatgctgatggtggaaatttcttgaaaccgctctcgtaatttgccacggtaagaaaagtaaaagacaacatcaaaaagcatgtggttggatcctttgtacactgagtagtattttaatgtgttggacttcactgtccagtagccacatgggattgagatgtgctataagtgtaaaatacacatcggatttcccagagttggtgccaaaaaaacgtaaaaatcctcaataatttttgcattgattacatattgaaaggataatgctgttgatatgttggctaaataaaatgtgtttttaaatttcattccacctaattttactttttaaatgtggctactagaaatttttaaatcatatggctcacactgtatttcttttggacagtgctgttgcaaatattctggtgaatgaacacagaatcagcatggctttcctttgctgagaaatcactgatgggaagtgagacttgttaaacttgaaaggtgaggatataaatacaagctgtaattattgcagaccgcaccccttctacacctaattttttaatgtctccaaaatttggaaaaaacattaactttcagggctgattaagggaatggtagtaatactaacatctgtgtgatgtgaagagctcatttcagttgattgtcacagctttgtgagatggaaatgggatagattttatctcggttttatggttttggagtattacaagatttgttaggatctgagctggggagtggctgtaggatttctgactctagattgttttctttacaccagattcttggtgatgtatgttcatgagcaaggaactgtttatcctgtatattacatggtgaaaaaaaatacacttcttaaaagggtggacatagatgcacctctctatacagggctactcttatgatgtgcaacctgtgcagtagcacagagcccagcatttagaatggctagcacttagtttaatggccagtctgctgtcactgtctggacattgtaaataatttttaaatgaggggccctgcattgttattttgcaccacgtcctgcatatcgtgtagctgatccttttctttgcagtaatctaggacggaagttgagagaccttggataaccacccaaacatctggtcttcactttactcctttgtgaaattagaagatttagctagtctttttctctcaagttttgattctgtatgaattactgtcatcagattttgtggatggcaatagaagtattttaggtgcataacatgggaagaaatgctgatattctccgttgagagtcatgtaaatcaaagttttaaattttatgctaaaactcgtattttatgttttgtaagatggatttttctttgtggcatcaagattgcttaccatagaccattggtataaagagtcgggttgtggaatgaaagcctagataaaaagtgtgtttatttaaacattgatttttcaatgagatgggaaaatggcccagatctcatgatgtctccaattaagagatttcctttgtgggggtatgagtatgaacccttatttggcagtatctgttcctctttgctgtcgtagctgcttcctgttacgtgaggtgcccctcttcctcctcattcttaaattttgaaactctttttaaggttggacttaattttatcactacagtgcaggttttttttagaccagagacttcatcggctcatgtttgctgctgtgttcccagcttcataaccatgcctagaacatagaaggtgcccaatcaatagtcacagaataaatgaaagtataatagcagacatttaaatcttggccggagccagcctctcctagggagcgtagaagtggaagcatgaggaaataggtaaaacttggagatagcagttgtgagaagtgtcagagggatcattcagcacatgcatttatttaacaaatgtttattaacttcctactaagtgcctagcactgtactggggactagaggtacaatggaacaccaaaaatacttcacctgctctcatggagtgtataatccagtagaagagacagagatggatgattaaagggaaagaatactgtttaatgacagtgtatgtctgagtaaccagacctcgactagggaggggatggagggtggttgacgtcaaggttgagcaggtattaacttggcccagaagacagggaactgtgctctaaccagaggaaacatcatttgcaaaggtatggtgatgagggaggagggtatatactctaggaagtggaaaggacagtgtaaaaggacagcaagaatgttgtgccacaaggccggtgcagtaggcagagaccaaaagcatttagggttttgtaggttatactaagagcagctgaagaccattagagggttttaagcaaggaaggatagcctggtcaaggttgtgttgtagaaagatttttactctggtattctataaagcaaaatttctgaaggaccaggggaaagatgaataaaagaaaagcctccagcaccacacaccagatatgttgtataccttaatttactgaaatcagttttcagaggcttgagactatcctctgtgtggtagcacttggaagcctgagtgaggagacaagatgataaataattgggttgatctaggactggggaaaggcaaacccaaagtggcaaggaaatgaagacattgagggtgctagtaagaatattgaaatgattgatcttgggcttgagaaatgctaaagaaggaaataaaaccagtataagaattcctaaatcagtggtccccaacctttttggcaccagggaccagtttcatggaagacaattttctcacggatgaggggtgggggtgtggtttcaggatgattcaagcgcattacatttattgtgcactttatttctatttacattgtactatacaatgaaataattatacaactcaccgtaatgtagaatcagtgggagccctgagcttgttttcctgcaactagatggtcccatatgggagtgataggagacagtgacagatcatcaggcattagattctcacaaggaatgcacaacctagatccctctcttgcacagttcacaatagggtttgcactcctgtgagaaactaatgctgctattgatctgacaggaggcggagctcaggcagcagtgtgtgagatgagtggctgtaaataacagatgacgcttagctcccttgcctgctgctcacctcctgctgtgtggcctggttcctaacaggccagggagcagaactggtctgcggccctgggagttggggacccctggtctaaattatatgagtctatgaagttttagactggtaattcccaactgaaacttttgcaagatcaaaaagaaaagcaattatgtttgagttgaactatttagtgtatccttattaggagtctatgccaggctctatatatggcactaaggatagagaggtaagtgaaccatagctttaccttatgagaactgacaacagagttgtacagatgccaattgcaatgaagattttaagtatgttcattctttttgaatctattaccttttgccagcctctgttagaaacaggcatttaaatttttgtaggcaaccttaattattgaaacaccatttttaactatagctatatttagttcgtgtgcttctactgctagaatatttatttttttcaaaaattctactttaacacttattcaaagtttgtagaagcgaaaactgaaagagcctctaatgatcacttaatccactttctcagagtgtggtatgtgtgtaccactggtcataaacaggatgctttgtagataaaacacaatcaagcctttttaatagttatatatttcagtgtaggttaaaaatatatttagcatagcataccatgattcatggaccttatgaagagattaaagtcaattttcagattttaaaaatgagtcagtttaaagaaaaatattaatggcataggtgttacatgactgaagtttgggaaatactaatctaaaccagctcctacattgtgtagatgagaaaacaaaggggttccccacacacaatgacttttctgaggcatataactaatatacggcagagctaggactagaactcaggttcgttcagtacattccagtgtttattctgccatacaaggctgatgcttattactaaagttgaagaaaccgctgtcttagtatgacattgtactttaaatctccattgttcattacgatgaccacatatggttatttatattaaaatttgttaaaattaaggtttaaaatttgaattagtcacatttctagtgctcagtagctacatgtggctagtggctaccatattggacagcatgaacatgaaacatttctgtcattgcagaaagttttattgggcagtgctgctttaaactattgcttaggaatatgattcataagttttccccccttcaaagggataatacttattaatttgcttaccacactgaagttgttataactctgaagttaagctgaaggtactagtaacagtgcaattaagataattgatcatgggaaatatagccaggatgggattctcagattcctaccagctcattttattggaagtggttgttctttctccttttttttcaataaatattttcttgaattcatagcagatagagagaagaaatacaaatatattgaaaaagagggttcttgaatagagaattttctgactttctgaatagtttattcaacgtaagaattatattttgctgatattttaaaactttttatttttaaacattttcagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactatatccttttcattgtgaattttgtgaggtgaatcaggtagaaatgttcttgaagtttgccaaaaggtcagtctgtaaatatgctcaatgttttatatacaaatacaagttacataatactaacattataaagtaaaattgttctaaactttcgaacttgaaatactgctttgtagattgtgtaggaggaagaaaagtgtatctctgcaatagagtcgaaccaccttatttacactgatacttattatgaattggctccaaatcaaaataaatttagctttgaaatatattgtcatgcatcactagtatttcctatgcatttaaatacttatgaagcaatacacagaagatatggatcagaaatctccaggcaacaaaggatcattggtttatgcaggaattaaatcaattgtaaagtcatcgttgggtaagaaaattctatttcattttctccaatatgtttataacttttgtacttttattttgccccctgtcatttggcagaaattatctagttatttcaggatcatgtacataattttttttgttttctgattggatatttcattgtattgttgagttaaatgcatacttgtatttatatccaaaaccctttttgcagggagtcttaattctctgaagtgatgttgatcttcttaaatctatccacacgtttattcaatgttatttttttgaaaacccactttgagaggttttacactagacaatttacagattactgattgttagttcaggttttatcgcaacattttgcttcttaaaaactaaaaagatctctaattgaaggagatccctttttattttgctcctcaaatactttcattgagccatctaacagcaaggagtatgatatgaaatatggcctaacgtggaggaattatacctgatatagtccttggttaattagtgaatgaattaattaacgtgtgagttaatgtaggattgaaaattggtatggtaaactattaaagaataaaagtgacaaaaaccaaacttttttttttttctgactgctttaaacagttgttcctattcttttactggaattgaataatgggttatattagaattgcaggttgagtataccttatccaaaatggcttgggaccaaaaatgtttcagatactttcagattttgaaatatttgcgttatatacttagagattgaccatccctattctgaaatccaaaatgctccgatgagcatttcctttgaatatcatctcagcacttagaaagtttcagattttgaagccttttggacttcagttttcagatttgggatgctcaccctgtatctctgtgatctaggattcgttctctaacttttggtaagtcaaatttgggcccaagtcaagctgttagaaaagtagttaacattatttagtcaaagagcagtaatagaagtagtaaatccaatttgattttttacggagcttgtatcagtaccatacaaacaaaatacaaaataataaaatattttagagtaggttaagtgttttaattaaactgttacattatagtgtttttttaacgtctttcaaattactttggttcactttactgaaagatgcagtagactacttactgatcagtttgattttattgtttttgtattagccctccaccaaaaaaagtaacctttattataaatagtaaaatgaataagtttagttagaagctgctgtttttattaacataggtaaaagggcacacatactgttttactcccacaaatgaacctggtaccatggttcaagattttagagccattgcctattgctacaaagaattaaacaccaagtttatagaatttatagtgttttagctatatagtagatcaggccacactgcactcaattatttagaggttggttattgtgttttttgtattttgatatattttaaggaaaagccagcatctgaggaaaagcaaaaggggaaaatgtaatatgtttatgtttctggtgcactagagacaaactgagtatcccacccctgtgtcaaaatagtctctacccagactaaagaaacactactgttggaaagatttcctcattcatcattctctcattgctaggttttcagcttttttttttttgtttggtatagatatttttgtttctactacccaaaggtgaaaagtagagaaatactgtcaaatatgccactcttagatttcagtcttctgttttatttggccataccttttcctctaattgtatctctaataatcaacacatggtaagtcaacacattgagccatcttgtccacagtaacctaatacacaagtttattagagcatacagctaaattttaattttggtaacaaatagtatatatataagtgcttgctatgaattagttgcttttcccatgttactttaatttttacaactacaatatgaagtaagctcattcattcagcaagtatttattacctacatgcatgctatatgccaggagttatcctaggaactagagacataactctcaagaagatacataaatctcttccctcatggagattgagcaggatcaatgtcatccctgctcttgaggagtttatattctagtttagaatatagacaagtaagctggcagttataacatagggaagaacagacagttaattacaggaaggactcctaatctggttgcagggattagaggtttctcagaggaggtacagttaaagacaaggtccagacagggagcagcatgtgcagtggacccagagggtagagagcatagcacattattatggctgaaacagagcatgagagaggaagtgaggaaagaatggaggctagaaaggtaagcagtgggctaactcaagaaagacttagaaatcatgttaagaatttagggagattcatcttgtaagacggggaaacagatggatttgtgacagatttgtgttttaaaaggatcaagattgatagtagggatatcagatagaagcctgctgcaaggaggcaagacgtgatgctatccttaccaaggttagtagcagaggagctagagaaatgtggatacattagagaataggagaaaatttaatgattaattagataaaggggtggagaagatggaaaagtcaaaggtagcacacatatatttagtttgggaaactagttaattttaagtatgttaattaggaataacacaggaagagtatttgggtttattttggagcaagttgaaatcaagatgcttaggtagagacgtccattgggcaataggatatcagttcaaagcccaggggaggaatataatgtatgtcagaaataaatgatatttgatagagtaaatggaattgtttggagtaagaaagagatggcttaaaggagactgaggcagattgtcgagagatgtaggagaaagatctatatgacaaaaaccgcaatcacttttgtaccaacctagtatacattcatgtggaagagaggtcagttgtccggtgctccatgcttcagatccagccaaataagaactaaaaaggactcactgaatttaggactaggagaaggtctttcactggcggtatggatagcaaattgcagttatattagaaattcagagtgggttgaggaaatgaagtaatcaattataaatactttttttgaaggaatttgactatataaaggaggacaaaaagatacgcagtaggaggagacaaatctggagccgggagctttgtgttgctttatttctgttttcaacatgggattaatttaagcatgtttaaatgctaattgaaggaagcccatagaggttaaagatgcagagagaagggagtgaagcgaagttcctagaaatgggagggaatgggatccagagcacaggtttctttagctttagatacaagggtgcacacctccacatttgccagaggaaagggggaaaggatgctgtatgcaggatgtttgagtttcaataaccagaggctgagggatttcccattttatggctgctgttgagaaggagcagggaggtcgtaggaagaggatatggagaagaggagagagagctgtcttgagaaatatgggaggattactgggtaacattattttaccagaaggcagaataaaggacagtagggcaagataattaaatatattggcaagagagtggttcacttgacccttgggatcttatttggatagagatgaaaatgaagacaggataagactgataagtaaaaataatagtggtgaagacactgcgaggttgtgaaaaatataaggaagtgagatttttggaaggctatgtggttgtggttagaaagtaggtcttttggaggaggacagtttcaagtgtggctgtgaaaggagtagctaaagtcttggaggtgtagaccactggagataaggaagcaaaggaactgagaggctagtttattgaatgggctaagtgcttagatcaaccaggatgagaagaatgcatgctctgagggaatctcttctacagacctgtatagcaagttcacagtgttattagtaggtataattccttccttttaagatggcagaaagttgtataaaaaatattggcctgctttaatccatcatgaaaataatatttttcatgcttaaagagtaaactctacagttccggctactcaggaggttgagataggaggatcgcttgggcccgggagtttgaaaccagtctgggttacatagagaccctgtctctctttttctttaaaacaaacaaacaaaaaggtaaaatctaatctagagaactgagaatttgtctatgcaaaatgacttcaaggggcaaaatagctaggatttcttataaactggataattgtattgcttagttactacatagatattaaaatgaaacaaattagtagctacaaagagcatagtatctgattgctgatttgaaagaaatgtttaaatcctaatttttttttttttggagacagagtctctctctctgtcacccaggctggagtgcagtgacacaatcttggctcactgcaacttccacctcctgggttcaagtgattttcgtgcctcagcctcctgagtagctgggattacaggcgcatgccattacacctggctaatttttgtattttttgtagagacagggttttgccacattggccaggctggtctcaaactcctaacctcaagtgatctgcctgcctcgggctcccaaagtgctgggattacaggcatgagccatcgtgcctggcctaaaccctgatttttaatgtttaaataaacttgttttcctcgcagccatcagtaaaacgttttctgttatttatgtataggacagtctcaaatttaggagataaaattttgttactttagtggtacataacatgcataaatatattttacttcgttttcagagatatattaaaaatttatatgtaaaactcataagttaaaacccatgctgacatcatattgcttatttgataattctgataatcaactgtagcatagttatcaataaaaagatctctaagcagaaaaaatatgtgatacaataaccatgttcttaacatgcaggacatattaatatttctacctcctagcagtgacctctttgaattcattttcagtcatctactgcacaatgacgtttctgttaacaatcgactgcatatataatggtggccccataagatttaatactgtattttaactttaccttttctgtgtttaggtactcaaatacttaccattgtgttagagttgcctgcagtattcagtacagtaacttgctataaagcagaggtgtccaatcttgtcttccctgggccacaatggaagaattgtcttgggccacacataaaatacactaagaatagctgatgagctaaaaaataaaaaagttcttaaaaaatccccccaaaatctcataatgttttaagaaagtttacaaatttgtgttgggccgcattcagagctgtcctgggctgtgggttagacaagcttgctttatagcctaggagcaacaggcccatgtagcccaggtgtgtagtgggctatgccatctaggtttgtgtaagtacactgtgatgttcatacaacaacgaaattgcgtaatgacacatttctcagaatgtatccctactgttaatcaactcatgactggattgttctctattctgttccatgacatgatttctataaaataaaaactctttgagaaattagaatattattattaagctgtaaggaaccatttgaaaaataaattgctgatttttgctcacctgttttaaaattgtattatcactaaataccagctttaaatccaaaatttataggagagatatgaaaatacacaccttataatacatctcagcctctacctgaaattaaatgactgcattctgccctgacaatttaaatttgttattcagaatgaatgttttaatttttttaataagtgttttgttaacttttatcattaatcgttaaaagttttcacattatagtccttaaaaatccactttcataagctaaaagtgattttgtctttgggctgactcccctcatggttgcaaataaagtagcatgctccttctttttagtgggtaggaagtgctgttaaagtaagaaaactttttggaagtttcctcttaactccttgacctgaattggcaatagtttccaatagtcaggttaaaaatacgtaacttcaagtggaattatttaactaatttttgtatttccaaaattttacaaataacacatcttgaaactttttcataaagcaatcggatataatttaaaatatgtactaacatgcataatattttagacttgccacagcctaaaatcagataatcacacaaggtttttaaaagtatgaattaggtataaaagagagtttagacctttgactatgtactattttacctttttttttttttttttaaagagacagaatctcactctgtcacccaggctggtgcgatctcggctcactgcaacctccgcctcccaggtttaagcgattctcctgcctcagcctcccgagaagctgggactacaggtgcacaccaccacacccggctaatttttgtatttttagtagagaccgggttttgccatgttggctgggctgttctcgaactcccgacctcaggtgatccgcccacctcgtcctcccaaagtgctgggattacaggcatgagccacggtgcctggcctaaaatttttcttaaaaatcatttagtctgaatacttgaaaagagtaaaaataggccgggcacggtggctcatgcctgtaatcccagcactttgggaggctgaggtgggtggatcacctgaggtcgggacttcgagaacagcccggccaacatggcgaaacccggtctctactaaaaatacaaaaattagccgggtgtggtggtgtgcacctgttgaggcaggagaatcgcttgaacctgggaggcggaggttgcagtgagctgagatcgtgtgccattgcactccagcctgggtgacagagcaagactccatctcaaaaaaagaaaagaaaaattttatatatgtaatttaacttgcaaatgacaagtttttaatattttcttatttttgcttgtgtttgtttatgcctttaattccttgaccagaatgactgtagctaaattaactttggtagtgtattttcattcatttactatctcgtcatttccatgggtcaggagtctgggcacaccttagctgggtcctctgttgagagtctcaaaaaggctaaccagaaggtatcagccaaattgtatttatttctagaggttggagtgctcttccaagttcatggagttgttggcagaattcagttccttgcaactgtgggactgaggtagccattttcttgagggctaatggccagaaattgctctcagctccttagaggctattcacagttccttgccacgtggccttctcacagaccctctcagagcacagcagcttttacatcttcaagatcatcagcaggagatctgtctcctgctgcttctctcttacctcgagactgtctttcaaaggacttacttaattaggtcaggcccacacaggataatcttcccttgattcgctcggtgaactgagtaagggccttaattatatctgcaaaatgctttcacctctgctgtattctgttatctcgagacaagttacagattctacctgtacgcaaggggaggggtttacacaagagtgtggttggcggggcgggagggcgggccaggacaggaatgcagccgtttttaacagttctgcctacaaccaacaggttgaatgaggaattctagaaactgtctgctgttgatctagttatttacaaatgtataattgcagtattgtatgtaaatatataaatatataattactgtaaattacaaaggtaaattactacaaaaaataaaaagttggtaatgttggacattcatgttgcctaattcataatttagtttattctgaaaatcctttttgttaaaaaacataattatataatgacaattttggtggtaaaactttctagaacatttaagaatttgttattatagttcttaagtgtcatctttattcgttttgactttatttggcactaagtatcatcctaagtgaaattaccatgtcattaggatcaactgccttgattgcagtataaataatgctatgtgaaggcaagggtttgttctgaaaaaagaatgagaaatgaagttttctgatttagtaaggggaaaaatagccctcaagttagtcccattatattttaaaattattacttaccttaaactttcaaagtactttgaagtctgtaatcttgttttttaatgtacagagaaagaaggaagaaagcaagatcacttctactggatttcagacagtagggataccttgtgaataaaacagacaagacacctgcccttttggagcttatgcgctactgggagaagagataagactgaaaaataaattaataaatgggagcacatattaagtgctaaaggaaatagaggaaacaatgggtggtgagttagataataacaagtatgtctattttagattaggtggccaggcagtaactcagtttagtccatctgagcatttgctcttatttcagtagttctttgctaactcaaggagctactgtacttaaaaacatgcaaaatatgttgtatttgtggcatagttcatatttacactatcataaaattatggccgagaagttaaatattctaaatgtgtcaacatagttctctgtaaaactgacttactttccaaatatattttgaaataaaacaatataaaaatgttttctgtttttaggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggtattaggttataaactaagatattagttataatctaagatgttagcagttcatggaatcttttaaagaaaagaggctaataattttcaaatatctaatcacttaaaattttaatttaatttttgttggaggagaaaacacagcagtatatctataacagtaaatacttagctcatctcttatgccttggtttagggctgtaaaaacaaagatgtgtcttaaatgttagtataatattataaggagtgctcaagtgtgtccattttcaatgttttctcttaaagatagttcacataacattttttaaaatatattttcttaaagattagggctactttagcctacaagtatttttacgatccatatttgagtgttttagtttatactttctttgggatggttattgtttgacctttaagaaactctgaatgacacttttatttaggctaatacaaattgttataaaaagcatactttgatcttcaaattgcttcttgaatctggtgattaaaatacagttttcatttagtattttttaaaaagaaagagataaggtttttttactctggcattttgccagaggatcctcggaaaaacaaatcctaatacaaaacctcaggggtttttttcttatcaggaatatttcgcttggaaataactaaaatatatatagctattggtctttagtacacctaaaaaataatttttgaatattcagaatactgaatccttacttgctggtccattttgaaaccattatagtttagctgtagcatagagaaaaacatgaaattcactgtaattttttttgtagtctaaaagttaaaaaagtcaatgttttgctcagattggcatcttttccttcacctttgctctaacaaaagtctccctcatttaagagtgcaatagaaaataggtgatgatggaaaaaagaattgatatttaaagccatttctaattataattttgctataacttgaaagggtgatactttcctatcttgtgtacctgggaaatttggtggtcgatttaaacacccatactaacaatagggaaaatgtatctttccagtgattttaaggactgaagagaagacttctctgagtcaaacattcttttccatttagaagtaaattgttctatacaaaatccaaagatacttctttgctatttttatttttattttaaaagaccttaaatctaatgtattaggcaaaggaagcaagcacaaagtaacttgggaaagtgtttatagaaatgaggaatataaagctgttaagaacataaagtgggaaacactgctttatttggaaaagaaagaaaaagattagaatcaagaaatagattaagaaaacttatataataagtgtagaaaatacttaaaagtcaaagttaaaggaaaattcagttttttcttttgaagctgaacttcggttagaagactaggcagccatactgctgaaggcaaagttagcagcttatcagcatgcatctaaactgctaagaacaaatgtttaaaagactattggtaacaaatgctttcttgcaaatgggtctaaatgcagttctgtggtaattcttgtagttcattttgtcctggaaaaattgtaagtgtaatactgtaattaaagtattgaaatattactttctgcactttgcattgacacttatatacataagtgtctgcattatatatttaggaataggaaaataaaatgattttgaatattgcagtcttgagatgcaatatttactataagtgtttttgaaatacctttacattaataaacttgttaaagttgacagtgattctggtaggatgacttcacttttcttcatttagtaagcaataacatacatatatgggaacatacacaggaataacttatataagaccctgcctggattgagaacttgaaaagtaaaagatctgcttccctgcacagagtttgcacacatgggcatgagttttataagggtagaaatgttttgcttattgtctttgccaaattttccagtctgaatcaaaacccaaaccccccccttttttttttttttcaagagtaaagtgcaactttattaagaaagtaaaggaataaaagaatggctactccataggcagagcagcccaaaacccttattctctgagctcatttttctgagggtaaaagtcaccctctgatttctatttatggtttaagaaatgtagaagagatattaagcttttgatcactttgattagctggctgtttttaatatgcaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttggtaagctaacttgttttttaagatcttcctttgaattaagataggagtttttatctaactttattaaaattttcaaatgtctgttgcataaaatattatatttttatgcatatgttatttaaaataaggcatcttgggctttttttttgagcagctcttcttgagtgtgattcccgtcctagagttagttaactgataccaaactggatttgatttttatggttttaatataatttacagatatagaaggaataaagattttatcctttagcttaagaactgagctgtagaaatctacagctgtgtaaacataaaaatatattcgctgtttacactgtgcacacatgcacgtgtgtgtgtgtgtgtgtgtgtgtgtgtgtgtgtgtgtgtagttaaataaaacaactcacgattattgatcagttatggtggaggtggccatacatcttgtcccagttagtctttgtggttcctgttaggaatgataacagtacttacagtggactatttcagctttttatttggtctttgtgttattctttttctcttctgttttaaccacctgtgatcataacacaatcaaataggttctttatcacaaaacggggaaagaaagaatgaagtgagatttgcttaccagttttagctattgggttttaagctaaacaatagtactacaactttctttgcactacttggcttctttctagcagtgggaagaactttctacactgaaattcatttctgtgtttgctactgtaccatttcttatcaattatacatttcttgaataagtgatttaaggattagtccctaagaatttgtaaaaatatgtattttattggagcagcttaatgaaatgtttaataaatgtgtattttgcactttatgtactttattacttttaataaattactattgaactttttctgaccaattcaaattaatacgtataatgttaggactttattttttaactgtaattaatcttttttgttaaacagaagactttaaatgtatcttggagagataaaataatgctttcacgaagtgttagagaatgatagagactagataaacaagtggattgttaacttctgaattgataaaagatgtatattgtttaaatattaaatttctgcattttaagttaagtgacccataataagtacttttctttcccttttttttttttttttttttgttgttgttgttgttgtttttgagacagtgtcttgctctgtacccatactggagtgcagtggtgcaatggcagctcactgcaacctccacctcctgggtttaagtgattcttgtgcctcagcctcccaagtagctgagactgcaggcatgcaccaccatgccggctaatttttgtatttttagtagagacggggtttcctcatgttggccagaaatatcaattctggtctcgaactcctgatcttgaatgatccacctgacttggcctcccaaagtgctgggattacagatgtgagccgccatgccctgccccagtatccttgttttgctatacataaatttgagttattagataacagtcatcttgagtacgaagttcatatttccaagctgtttcatttatgtatttagttatactttatgtataaataattataattaatgttgctatttaaaaaatgttaatagtaatgtgaaaagtactgaattgggaagtcggaaaatacaggcctgactccttgctctgccccatttaccatagccattcagttaatttttttgagtattactttctcgagatgtaaaatgggacagaataatgtttataactctttccagatcaaaattttgtaacatatgcaactgaatctaagagttaaatctagttatatgaaatatgttctctctttagggcaaaaccatattttatcatagaaaaaatatgctaagatataggtatcaactgaagtgatcttacggttaaaaaagtaaaattttcataggatgacttcagtggaaattggatcttttttccacccttaaattatttttacaaattacaaaattaattgtaccttcctacatttgtagtaaatatatttcaaaagtgtttcatgatattgacgagtttacaaaaattttagttattataatgcctctgaaatctttgccacaaaccacctatataacaactttagccacaagagtgtgtctgtttatgttttaaaacttgtcactttgtacttggaaacgtatattggtattcttctaagttgtgtactggtgtagccaattcacaaatttcttagacttactgattaacttagtagccaaggaaagatttccttagttctctaaaattaatttctatgatggaaagattatgtggcatcttaaatttgatatactgtgcatcattgcttatgttttatgttatgtaagactgacctggatttttaaaaactgaatttggctagtgtttaaaaggtaaatttttactttgcaaggacaaaaccttattgctgaatttcctaagagttacatcaagaaaggcatctcaggcaattaatggctctgcaagataaatataacttattaataaatttggaaataaacatattcattttatttatataaaacattcagtctctgcaaaaatttaaaaccagtgcgcctagaagtaactccttgctttttctcttctttccagtatgaaaacaaagttgcagtacgtgacagagtggcatttgcttgtaaattccttagtgatactcaggtgaaaactgatttaattccacatttgaagtaattaatatgtactgtcacaattatgtaagaaactagtctttataattacatatgtatgagattgataagctaattcttctaaaaagtatggtaagaatttattagataaaaatattttgaaaatgtctaccataactaaatttatttgtttagaatactgacaatattttagtatatttcttctttggagggtaagattagttagtaggtaaagatgttaaactcacctcttagtgatgctatgaaagggttcctcatttttactacattaaacaatgctaaatgcctatgctgtgtatatagtgagggggaaatgcatgtaaacaaccagtaatactatatgctaagtactataataatgaaaaatgctggggaaagatggaggaatcttggcaagagtttggggtgggttgaagtcagggaagacctaaaggaagttattcttgatgatcttaaagttcccttccaactccagattttgtgattctgttacatactactatgatagacagcaaaaatttcgcagaataatgaggacaattatctttaaaataataaaccatctatagttcttttatggattaattatcaacataataaatgcctttttaaaatattttaaatgattatggatattgctttgaaatttgtaatagatgcagacttcttagttaaatatttatattttagtaaagtcttttgttttaaaatgttttccattaggaatgaaattgttcaaaatgtagttttgaagtacaaaatacatagtgaaacagattgctttagaaaaatcactttaaattttccagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacaggtcagtgcagtttgacagcagcttttaaaaaagtaacaatattctatattttctttcctcagttgaaagtaaatatgcacttttgcttgcttaggatctttagaaggcatttagttttaacctaatcagttgatctactgaagacttgtgccttatcttactgtccctaagcctcttcattgagttatccagtttttcctttcagtctgagaagggccagtcttgactgcatctgaatttatgtaaagctcaaattgaatagagaaactctcttcagtttctccaattgttgacataactgcatcttctacaagaaagattggcttttcctgatctcaactatagtcttacttgaagtgctgaagtctagttataccacagctctcagctttcattttctctttttattatcattgggggtatttggggtaaccaatttatccatattttctcaatttttactgtccagtgattaaaaacagattccaggcatagattgctgtctactttacttttgctggaaataatggtaaaatttagagtattctcctgagatttcctgtagccctccagttgatcttatccttacatgatgttggtaccctcctctttcctgccctcatcctcatatcacaatatggtagcatactgtgtactgggtgaacacaggaaaatgccccctctcccactgcaccttcttgtgcatatatagagacactagcccacagaccacaaagtaaacttacctaatgtatcaagccactgcccatggaagaaaaagtacccttctataacattttttcttgttgagataaaattatgtcttttaaattaaagtgtatgtatatggctgtagatggctacagagtgcaaatgagttagtaacttcttaccaagatttataaaatatatttaaaatgcagacaatacagatcttgcttttttaaaatccagtctgataattgctgcctttaattggagtgtttccttcatttacatttatatggtcatggttaagtctaccatcttgctgtttgttttccgttttgtttgtcctttttccttttgttcctatgttcctttcctaccttattttgggttaatatttccatgtttcattttattgcctctattggctttttagctatatctcttttcattatcttttttaaaagatgttgctgtagatctaacaatatgcatccctcaactcatcaaagtcaacattttaccccctcatacttcacatttctcacctgacacatcatgctttctttctactttaccctttcttatgtcactctgacactttctgggttttacttcatgcttcacaaatgtcacaacagtgtgatttcatttacacatccattcctttgtcctattgtcatatattttacttttacagatattatatactccaacttacagtgtttttttaacagtcatttgtcttttatgtaaattatgaaaagaaaacatgggcttttatatttattcacttatttaccattcctggcattctttttcccttctgtaaatcctatagcattccttgtaatataggtgacagattctctcaaattttaactgaaaatgtctatttcactcttattttttctttcaacactttaaagatgtagtttcactgtcttctggcctctgttgtttctgatgagaatcagctgttcttatgcttgtctccctgtctgtgatgtttcattttttgttgggttttttttttttttttgagacagggtctcgctctctcacccaggctggggtggatctcagctcattgcagcctccaggctcaagcaatcctcccacctcagcctcccaaggaactggaccacaggttcacgccaccactcctggctaattttttgtatttttgacagaaatggggtttcaccatgttgcccaggctggtctcaaactcctgacctcaagtgatctgcccgccccggcctccgaaagtgttaggattacaggcatgagccaccacgcccagcctaaattctgatttttaatgtttaagtaaatttgttttccttgcaaccatcaataaaatgttttctattatttatatgtaggataatctttttgggtttcttccaagatttttcctttacctttgatttttcagtagtatgaccttaatgtacctggttgtggttcattttatcctgtttgtggttcactgagcttcttggatctggaagtctgtttttcagcagatttgggaagtacggggatattatttctttaaatatttttttctgcctcaatcttattcggtttttcttctaggactcttattacatatgtattaaaccacttcatagtgttcgtaggtgcctgaggctctattcttcttccttccatgttttttttcccactattcttcaaattggttaattttttttttttttaagacagagtcttgctgtgtcacgcaggctggagtgcagtggcacaatattggctcactgcaacctccacctcccaggttcaagcattcgagtgattctcatgcctcagcctcccgagtagctgggattacaggcatgtgccaccacacctggctaattttttgtatttttagtaggacatggtttcactatgttggccatgctgatcttaaatgcctgtcctcaagtgatctgcccgcctcggcctcccaaagtgctgggattacaggcgcaagccgctgtgcctggcccagatttgttgattctgttgacttattccatcacctctgtctgctgttaaacttcccagggaattgttcatttcagttattgtgcttttcagttacagaatcttaactttgttacagtttactttagcagtccccaacctttttgccccagggactttttagcaccagggggttggtttagggatgattccagcacattgtatttattgtgcactttatttctattattattgcactgtaatacataatgaaataattctacaactcaccataatgtagaatcagtgggagctctgaggttattttcctgcaactagatggtcccatctggggatgatgggagacattgacagatcatcaggcattagattctcataaggagtatgcagcctagatccctcacatgtgcagttcacagtagggttcactgtcctatgagaatctaatgccaccactgatctgacaggaggcagagctcaggcactaatgtgagggatggggagcagccgtaaatacagatgaagctttgcttattgccctgtcactcacctcctgctgtgtgacccagtttgtaccaggctgtggacctgggggtatattgggggttggagccccctggtttacatttctcggttcagattccttatctcttcactaatcaaaacactattttcccaagcccttctgatttggtcagactcaatctctgaactattttcattacagatcatgttgtggcttgattttaggctttattggagaggatctagagaagacttactgtatatgtattgaccaaattcttacttagtttatccccttcttgccatataaggggaaagaatgagatgtgaaaacatcttatttttctgtgaattttctttttaaaccagggattatatgctactttggtacttagttctgcctacttggtcataattagggctagagtagacctctacttttttaagaaatgaaattgtaagctatgtgtttcacatgttcttttagctaaatttaactctggtaattaacactgaatttaatagatgaaagatatgttgcttcagtttttgattggatgtctaaagattatattagctcttacagatttttgttctttttttttataagtaagatatacgccaggttctctctgaaatttcacttttctattggccctcaagtaggactgagaaaactaaccttcagattgatgccaaagcatcattggaagtagagactttctctcctttctccattatgtaaagttaaggaagatatcctggacagggctgaaagtcttctaagaaaacctaaagcggccgggcacggtgactcatgcgtgtaatcccagcactttgggaggccgaggtgggcagattacctgaggtcaggagttcaagaccagcctggccaacatggtgaaaccccatctctactaaaaatacaaaaattaggtggtggcacacccctgtaatcccagctactcaagcaggagaattgcttgagcccgggaggcagaggttgcagtgagccgagatcgtgccactgcgctccagcctggccgacagagtgagactctgtctccaaaaaaaaaaaaaaaagaaaaagaaaagaaaaaaagaaaacctaaagcaagcatagatgaaatgtggaatgtcacagctgccagggaaaatacaactttaggaaaattattactggcaagaacttgaagatcttaatgagaagaactctaaagtaaatttaactaaaacaaggtgttgcttttaactgtggctacgggcaaaagaactaagaaggtatttggtttggttttgctttttcttgttctgttattatttttaaggcaagaaatgtatgttttaattgaaggcaagagtaagaatagacaggtttaacttacagataagtagatatataaaagcagcatctcagttcaccgtgcattgctagataggaaggaccaagctaactgttagttcagatgtgactgagcaattttggtgtgcatttggacttttttttttttttaaatggagtctcattctgtcacccagactacagtgcaacggcacaatctcagctcactgcaacttccgcctcccggttcaggcatcaacctcccaagtaactaggattataggcgcctgccaccacacctggctaatttttgtatttttactagagacagggtttcaccatgttggccaggctggtctcgaactcctgacgtcaagtgatccgcctacctcggccttccaaagtgctgagattacaggcatgagccatcacgcccagcctgtattacatttggatttgatagtaaacagagtttgtgaacccagaggtttttaattgctgggacaaagggtattcgtatcactgtttacaacattcaaccacgaagttctattttcttaaacttaactaaaaggtagagaattagacttccctgggcaggtatgatatataaagtacatatttatgtcattagtggaacccagcttgagataaattaatggagcttccataaattttctttattctcattaggagccagcttttggcaaaaaaaaaaaaaaaggcctatttcttctgtgttactcatacttacatgctacccagaagtctctggcctagccaggagattttaaacaattgaaataattcatgttttcgttttagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtaagtacattgttttggagaaaatcaaattgtaacatgttgatgttcaatttaataagttactattagctcattattttgcttatattgagttcccattgatgtctttgtcttttgtagactgaactttgtccttgatcttcctgtcctttggttctgcttcttgctaacaatcatctcagtggcttgagctttagtcgcagatagaacaaaccacagcaggcctgaagttttccagtgtatttccagccctttcagattctaaactattacattatcttataaattccacttgtgtattaagttttttagcattatttatgtgcagtaaggcaggatttgggttttttagactttagcagtattacctatatctatatgtttaattacacatggaaatttttttttagcattagtttaaaaaatgagattgttgtcacataaggtataccacattaaatcactgtgtcttagttcagatattaaatattatgttatcctcaatatgagcactggatggtgctattttcttattttaggaacttgagaaagtgcttatgttaaaaccagagtgttgataaaatagcattacatggtagtacatgttactaatctatatgataagtgattaagagcctagcaatttacggtaaaaacaaaatgaacagcttctattgctattattctaaaaatttaactatttaccattataagtttgttaactctctttgtcttaggaacagcgttttctttataagaaaattttgttcagaagattatatcactgaactgtggtttagaagtcatattgggatattttgtaatggcccagtgtgaattctgaagtcattgttatttctaaaatgttggagtctaaagtttgagttcttccaccaatttcagtggtattagtaagaatataattaaaaaggaagtaccccaaaaatgtaattgctaggtataaattttaaatgaaagctagtcaaccttagcagatcaattttgaaatataaaataaagttttttaaaagtatttaaaaataatttgttaggcgcacactaagttatttagcattccattatggtttgcattacatttattttttctttcatttgttttgtaggtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggtatgacataattttacaaaatacttttatgaactgaaatgattcttacataattgagttaatgttgcaaataaaatacaaactagctagagttattatttctaagaaagggcagtttactagcttgaaggcttttatgttcctataatttatgaactatgaaaactaaaagcaaaatctatatctattgatacttcaggtaatttcacaagttctgaccaatttaaagtttgtgagaaaaacttaaatatgaaataatcttaatatattaccattttcttatcactgtttccactaagaggagttcgttcaaatttgattatttaaaagtcagtatacccgcacctattaacagatactttgtatttctaaggatcttttgacatcattaaagcactttgacatttcttccttcatcttcaaaacctacctataaaatacatgagagaagggtcagttgcagtggctcatgcctgtaatcccagctctttgagaggccagggtggaaggattacttgagcctgggagtttgagaccagcctgagcaaaatagtgagaccccatctctataaaaaatttttttggccggacatggtggctcacgcctgtaatcccaacactttgggtggccgaggctggcagatcacaaggtcagaagatcaagaccatcctggcaaacatcgtgaaacctcgtctctactaaaaatacaaaaaattagccgggcgtggtggcacacacctgtagtcccagctgcttgggaggctgaggcaggagaattgcttgaacccgggaggcagaggttgcagtgagccaagatcatgccactgcactccagcctgggcgacagagcaagactctgtcctaaatttaaaaaaaaaaaatgtttttaattaaaaaataataataaataagaaaatacatagagaaagtattagcctagaagtcaggtcccttgacttctagattttgatgctgcttctgctgtttgtcagttacctagtaaatttatatatatatatatatatatatatatatatatatatatatatatatatgaaggcaatacgtaatgttttaaatgtacattttagttttgatttaaattttaatcaaggatttttattttatacattgcatactgaccactcttttatgttactctggtcctaataaacagaaaataacaatttggaatatatacatatacacacacacacagtgttcgtttttgtttgtttgtttgttttgttttttgagacaggatctcactctgtcacccaggatagaatgcagtggcatgatctcggctcacggcaacctctgcctactgcctcctgcctcctgggctcaggtgatcctcccacctcagcctcccaagtagctgggaccatagggtttcaccctgttgccctggctggtcttgaactcctgaactcaagcgatccacctgcctcagcttcccaaagtgctgggattacaggcatgagccaccatgcccagcctatattttttaatggttagaaatattaagattattttttattctttatagtaaacatatgggaaaaaattttgagaatagtagataattaaatatcttatacctggtggctggaattattccagctctttacctaacttgaaaatgatactgtggcacaattttcaattaaaatcattttgggtatttggcacacaggtgtaatgaataaagaactggttagagtgtcagaatgtctgttttaattctaactctgtgacatgcagtctgtgacactgagagttacttgcaccttcctctggactggagatcctttctagtgcagacattttataattctattctgtatcgtgttcatttaagtagtctgctttatcattacattaacatttatgaaagacttgctggtatcattggcttagcgattatttttccatctagatgctttttttaaagaaatgaagagaatatgtaatgttttaaatgtacattttagttttgatttaaattttaatcaaggatttttattttatacattacatactgatcactgttttatgttaactctggtcctaataaacagaaaataacaatttggaatatctacaacaatgagagctcgaggtaaaatatagcataaataagacatatatgtgtatgaactgagatatatagaaataattaaatgtaacacatcttttggaccataagcctcaggaagctataaggattatttgcattcttacacctgggcactcttcctttttgctgaataccagtttttcaatcttttctatttttgaaataggtaagaaaagaaaataattttctagaatttgaagaaaaatcttaaaacatttgaaattctttgttatgatgactaatataacgaatagcactcaggtttatcaaatattaacatttttccatatttgttatagaatttttttccatatttgctacagaaataatttctttatatatataatacatatttgaacactgattttacttgatacattaatataatgctgatgtgctgagatgaataaatcaaagaacctcttggagctcttggtgtgcaataagcatagttaacgaatataaaataagtgatattttctagaaaataaatactggtctacaatgccttatctgtcatttcaaagtctctaaaaagatctgaaaatccaatgccttttaaaaataaaattacggtaatctcatttgaccacaaaacctgttcagaattgatgtgaggctattaagatatttatttctcttatttattagtgaatattcatctttcactacagaaatactaacgagtttgattacagggtgctttagacttccctcaaggtgtacatatttgctacttttttctaaaatcccaaacatcctggattctgaaacacatctaaacccccaacatgaattaggactattatataaggaaagaattaggaattttgaaagtgggaaatattacttctatctgaaggatatctggaaagctttaggaggaagttaccatttaagccagtcctttaaagtttggtagatttaatatatgaagattgcagggaagccgtccaggttgcagaccaagtgtaaaaaacatgaactagggtgaagagattggtaagtattatgataagtacagggggtgtttgggaagagcaagtgtattgttgtgaaaggacctaggaagtgaactgataagaaacagtaggaaaattagggagagcctgaatatgatctttaaaggcattgctgagctaagttagagaataatcactctttataatagcaaagacataaaatcaacttcaatgcccatcagtggtggactggataaagaaatgtggtacatacacagcatagaatactatgcagccatgtcttttgcagcagcatggatagagctggaggccattatcctaagcaaactaacacaggaacagaaaaccaaataccacatgttataagtaggagctaaacattgagaacatatggtcataaagaaggaataacagacaccagggcttactggagggtgctaggtgggaggaggatcgaaaaactacctgtcgggtactatgtttattacctggatgatgaaataatccgtacaccaaaacccccatgacacgcaatttacctgtataacaaacctgcacatgtacccctgaaactaaagtaaaagtttaaaaaaaagaaaaagaagcaaattatttttttttggcatgtgaaatcagaaaagtccatttccaaagtaaaacaggatctaatagaaatcaagtgctggataattggataaagagtcaagacccatcagtgtgctgtattcaggaaacccgtctcacgtgcagagacacacataggctcaaaataaagggatggaggaagatctaccaagcaaatggaaaacaaaaaaaggcaggcgttgcaatcctgatctcagataaaacagagtttaaaccaacaaagatcaaaagagacaaggccattacataatggtaaagggatcagttcaacacgaagaactaactatcctaaatatatatgcacccaatacaggagcacccagattcataaagcaagtccttagtgacctacaaagagacttagactcccacacaataataatgggagactttaacaccccactgtcaacattagacagatcaacgaggcagaaagtgaacaaggatatccaggaattgaactccgctctgcaccaagcggacctaatagacatctacagaactctccaccccaaatcaacagcatatacattcttttcagcaccacaccacaccttttccaaaattgaccacatagttggaagtaaagcactcctcagcaaatgtaaaagaacagaaattataacaaactgtctctcagaccacagtgcaatcaaactagaactcaggattaagacattcactccaaaccgctcaactacatggaaactgaacaacgtgctcctgaatgactactgggtacataacgaaatgaaggcagaaataaagatgttctttgaaaccaacgagaacaaagacacaacataccagaatctctgggacacattcaaagcagtgtttagagggaaatttatagcactaaatgcccacgagagtaagcaggaaagatctaaaattgacaccctaacatcacaattgaaagaactagagaagcaagagcaaacacattgaaaagctagcaaaaggcaagaaataactaagatcagagcagaactgaaggaaatagagacacaaaagacccttcaaaaaatcaatgaatccaggagctggttttttttttgaaaagatcaacaaaattgatagactgctagcaagactaataaagaagaaaagagagaaaaatcaaatagacgcaataaaaaatgacaaaggggatatcaccaccgatcccacagaaatacaaactaccatcagagaataccataaacacctctatgcaaataaactagaaaatctagaagaaatggataaattcctggacacatacaccctcccaagactaaaccaggaagaagttgaatctctgaatagaccaataacaggatctgaaattgaggcaatccttaatagcttaccaaccaaaaaaagtccaggaccagatggattcacagccgaactctaccagaggtacaaggaggagctggtaccattccttctgaaactattccaatcaatagaaaaagagggaatcctccccaactcattttatgaggccagcatcatcctgataccaaagactggcagagacacaacaaaaaaagagaattttaggccaatatccttgatgaacattgatgcaaaaatcctcaataaaatactggcaaaccaaatccagcaacacatcaaaaagcttatccaccatgatcaagtgggcttcatccctgggatgcaaggctggttcaacatacgaaaatcaataaatgtaatccagcacataaacagaaccaaagacaaaaaccacatgattatctcaatagatgcagaaaaggcctttgacaaaattcaacaacccttcatgctaaaaactctcaataaattaggtattgatgggatgtatcacgaaataataagagctatctatgacacacccacagccaatatcatactgaatggacaaaaaactggaagcattccctttgaaaactggcacaagacagggatgccctctctcaccactcctattcaacatagtgttggaagttctggccagggcaatcagacaggagaaggaaataaagggcattcatttaggaaaagaggaagtcaaattgtccctgtttgcagatgacatgattgtatacctagaaatccccattgtctcagcccaaaatctccttaagctgataagcaacttcagcaaagtctcaggatacaaaatcaatgtgcagaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaactactgctcaaggaaataaaagaggatacaaacaaatggaagaacattccatgctcatgggtgggaagaatcaatatcatgaaaatggccatactgcccaaggtaatttatagattcagtgccatccccatcaagctaccaatgactttcttcacagaattgaaaaaaactaaagttcatatggaaccaaaaaagagcccgcattgccaagtcaatcccaagccaaaagaacaaagccggaggcatcacactacctgacttcaaactatactacaaggctacagtaaccaaaacagcatggtactggtaccaaaacagagatatagaccaatggaacggaacagagccctcagaaataatgccacctatctacaaccatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccgtaaaaaccctagaagaaaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaagctacaatgaactgaaacaaatttacaagaaaaaaacaaccccatcaaaaactgggcaaaggatatgaacagacacttctcaaaagaagacatttatgcagccaaaaaacacgtgaaaaaatgttcatcatcactggccatcagagaaatgcaaatcaaaaccacaatgagataccatctcacaccagttagaatggcgatcattaaaaagtcaggaaacaacaggtgttggagaggatgtgaagaaataggaacacttttacactgttggtgggactgtaaactagttcaaccattgtggaagtcagtgtggcgattcctcagggatctagaactagaaataccatttgacccagccattctattactgggtatatacccaaaggattataaatcatgctgctataaagacacatgcacacgtatgtttattgcagcactattcacaatagcaaagacttggaaccaagccagatatccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaatccaaacaccgcatgttctcactgacaggcgggaattgaacaatttgagaacacatggacacagtaaggggaacattacacatcggggactgttgtggggtgcggggaagggggagggatagcattaggagatatacctaatgctaaatgacgagttaatgggtggagcacaccaacatggcacatgtatacatatataacaaacctgcacgttgtgcacatgtaccctaaaactttaataataataaaatttaaaaaaaaataaagtgctggctagtggctcgagtatctaaacctccctggtgctttgcctgcaatcagagattgcatccatccatcatgctttgtgattcaaatagctggaatttctataagcttatttaactgagagttgatatttttatactcaattgtgctttgaagattagaaatctgttgaaacagttctaacatcattataaacattataaatattatttattcaacaaatgtttatttggtacctattgttccaagtgctagaaatgttacagtaaagaagacaaaaatcgctgcccttacagaatttaacttctggacaatgacacattttttaaaagttagattatctactggtttccttcattttcttcttacattatgagttaatgcataagtgaaactctagtttcgcctaaagtgttctgtggcacttgtcttcataattcactataaatcttttaaaatttgaagtcatttgatcttaagcctttatacttggcagtgagatagaccttaatacttccagtttcgtcagaaaaatataaggatatgccttgttctgattcagtctgttatctgtttatgttagaagttacaaaaacaaagtgacaagcactaatgagagctttacacaaaggtgtaaagtagtgtacatatcagatctatattttatttatctcttccccctttcctttttgccctctcattattaattgttggtgaccctttcaggagtaattctagtgtgtttacatctttaatcattgaattacttacacatcctttcacctcatatcattagcaaaaacggatattttttaaaactattcccgactgcaagattatccttttggtcatgaaagcgtgacctgcaatggtccaagcaaaatttttaacatagttatcgatgcataatgtctttatagatagcaattaagtaaaaatattaagtctaattaagcaattgtttaagttacacaagtctcatgaagtgcattgggaaactttctgctttttctcttctttgaaagggcttgtacagatgagaattacctgtcccttgatagatttttttttttttttgagacaaagtcttgctccatcacccagcctggagtgcagcagtgcaatctcggctccctgcagcctccaatccccagatttaagcaattcttgtgcctcagcctcccaagtaggtgggactacaggcatgtgtcaccacccccggccaatttttgtatttttaacagagacggagtttcaccatgttggccagactggtcgtgaactcctagcctcaagtggtctgcccgcctcagcctcccaaagtgctgggattacaggcatgagccatcacacccagccctacctgttccttgaatgttaagtaaaattcacttgtaaactgggcctggtattttccttgtggaaagattttaaactactgatttggtctctccaaagttttaaatttagattgtttcttagtgggtttggatttttttttccatttttatattggctattaaaaatgtaggggagcttctgtcattcagtttcgcttcatctaaactagaacctaccatcaaaattgctatttcaatatgatgtgtgattcatatttggaacacagttttagaaatgctttttgaaagtaactttaaataaaatattatgatatagttaatgaagatcattttattttgtcataggaggaaccaaatcagatgaaaaagtggacttgagcaaggacaaaaaattagcccaatttaacaactggtttacatggtgtcataattgcaggcacggtggacatgctggacatatgcttagttggttcaggtaatcagcacatttcttctttgataggcttggagttatgggggataacacagattgcttctaaatagtttgggtttatctattagcatttagccaaagtatgaattttattttttactgtcactcatgttaacaaaggtggtgtgaacatgtcgtgattagatatcctatgtaaccttaaactataaaggtaatacttatgtaagaactaatttaaatgttttgtatgagttaaatgtttgaataacattatttaactttattcggggagaggatatgtttacagtttttacactgaatattctgtaatttaccatgcaattgaattactaatgaaatgttaaaagagcatatcatacctctgcctcagttctcttctaagtaagctttttatgtagtcacgcaattaagactgtcaagacatatttgaatttcattttgaatggtgccagtggccctgtgctcctggttgatacagcatttatacccagtttgtcttactagctaatttaaactctgagcacatccctgtcaccttcacaactataaatgaaatatcttgccatatatgtagaaagtaaaaggtatgtgtttcttaacttctccctaaacttcagcttggcagtagtttataatttgatgcttttgatgctttttttctctgggttttagtttctatatttttccaaatgccattttgaaaagttgcattatagatagatataagtaaacaggtgggcacagtggtgcacacctgtagtcccagctactcaggaggctgaggcaggaggatcacttgagcccaaaagtgtgcgtacagcctgggaaatatagggagaccctgtctcttaaaaaataaataaataaataaatgtatgtctgtctaatttggatttttaactgttatttgacctatttttttagggaccatgcagagtgccctgtgtcggcatgcacgtgtaaatgtatgcagttggatacaacagggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcagcagttttgatgtttgagtgattttgatatgcttcacagagacaaatgctgccaaaataaacatcgaagtatagacatgagttctgttcagcaggttgaaaagtctgatttagaaaaactttctaagttttggttgaaattatgaacactctagaagcagaatttctggaagagccaagaacagactttgagcctatatcttcaaagctgaaactggatatctttcaataaaatatgtgcacttttaaaataaaatgactaattctgtgattcagacaatagttttaagttcagctgtgcttagatttctttcagattaatttaaaattacagatttttacttttagaattgcagagcccctatcccacactggagaatattttttattactgtctgttatatatgtgtctatgtgtgtgtgtatatttatgtgtgtatgtataaatatgtattttttaaaggagccttttccctcctttgattttaagataagcaatcttttggcataacattatcgtcttcctagaaaagccaagatgaagaatctatcttacaactttttctcttcagtagagaaaaacatgtaccatttcaggtgaacatacaaaattttcactttctaccttttgccttccaatgtcctgatttgtcttcaaaggtttttctccatattaatttgtcatcttatcctcatcacctgagaacattttactgcatacaaagtctatgcaagattatatgtaactagccatttagtataatctatgtcagtgtttctgtgctgtcaaattccgtcctgatttggaataccataccttgttctttccaaggtagactaggaagtgttggggaaatggggtcacttcagagaccattttagatgtaagtttttaaatgtaagtgttactggggctaagtcaggtactttatttaaaacatttttttttctcatttcatagctagatagttgtaagagaaatacaaagaatttacaagatgcttctctgtcatctgccatatgcagagggactgaactaggaattttgtagttgaagctgtgttcataaagagtaaatcttattttatagattttggagaaataaaacaagaattttaagagctttcgtattagcagttttgccttataaaaactaagatttgtcagattagtttgaggtgtaacctaaatattaaaagtagattaaatttattttttaccttgagtgtctgatacataaaacccttttctaggaaaacattggaagtagtacatatttactctaaatgtctcacctgcatgacagtcttttcaaatgaaagacatggtaattgcaatttttttttaaagattgctattaagggtactttttccagccttcatttgagtaaatcttaattgatttcattttattaacatataccctttacctttaatatttcatttgaagtgttcctttcaaacttactgtcttaaatatgaaagtcagctttaagtaatgtcagactcatatgcattttcattctcattagctaaagtaaaatgtaaaattatctcaaatagttacaagttttggaaatacagtataaaacatgaatgtaaagtctattatgtaatatgcttatttgtaatcctaatatatgagggtgacatttttaagattgtatgtatgtgtcaacctcttaaatgttttctgtgaagcccaaacatgcagtttatgtctctggtgtctgttttgcatttcagtgtgcatggacaatcaaattattttctcatttttatcactaagtcactggtatttgggtttataaactcaacaagatactttacctaaacatgatcaatagatgtgtttattaaaagtgtttttattatttttaaaagattgaataaatctgggttgaagtcattgtatctaatcaagaaattatgattcctttacaaataatccacgtgaagtaatattggtgctttttttgatgacagacttcatacttaatattagaagtaacattccttttaggctctgtttttcaattcaacccactttccagaatagttattatcctttaaaatggtatattttaaaagtagcttcccattgtcaatgcttcacatagtaagtatttaaaagaatgtagttcttcatttaattagatgactcaatttcagtcattcatttgactgcaagtagttaaagcatggtctttgaaacataaattataatcctagcctcgggatcttcggtaagtgacttgacctttttgagcttcagtttcttcatatgttaaaagaaagatacagaaatacctacctcagagtgtgggagtattaggtgatgcaataaacatgaagtgccatatccctgtcacatggtgctctataaatggtagtgattagcagtcattgttaccttcattttcatagattgctcatgtatcagtactttttcaatgaatacttatagtataattttaattatagttaaaattataagtataatgaatacttataattttaacgaatctacatttgtctcaagaatgaaaatttccttggtgtgagttagctgaaatagattttcttaaaaagagtgaaaattcccaataatagttatactccaaatatagggtaaacaaaagtagctaagtcctgtctcaaaagaaaaatgccataatttggataaatttatagtattactgtttttgctgcatgcaaaaatcctccaaatgacctcctaagagttaaatgtgatataaaaatgaacccagaggaaaaaattatggcaaatttaacaactgactattgaaaactttaagttttatgtctaaactcttaatttaactacgtttaaattgaactccctaatctggatacttggagaaagtatccaggattattctgtgtactttttctttttctgccattctattacacttgatgttcatttaaattataatgttggggtggtagtgataatttcaaaagtatactgtgagacttgctgtcccggaatagccgtaattaaagctagtgggcacaatttctgacatctgctcagacaggcatcagagaggtaggaggcacatatttgggtcaatatcttgtatcaagtctagtgacccacatcacaatgacagaaacaggccttgttagatagcagctcccctgtccactactcactccttccattacatcatctgccagttttctctcctacctgaaaatgttgtaggttactttgttgattataacaagtagcactttacaaatatattaatttttataaaatactacttttcccagagtacagcgacagaaggaaagcttcccaaggtttttaaaagctaacaacccagatatcaaattaacacaactttaacatgataaagtcacaagtaaaattagcatcaaatgcagcagtatataaattactgttaatgccttttatgtgccaggtgccaagcgcattatcctgttttcgccataaacctatgaggcagttatgccattattgtccccgttctgtaaaggaggcaactcaggcatagggacatcaggtcacttgtcctaggttacatgagtagcaaatacagccaagacttagattccagtagtcttgacctgctaatctgcccttttaatttctgttttctgcttctgtgtactactttgtaggttatatacgtaagagaatgattcactacgacaaagaagggtttattccaagaattaagtactgggtaatattttaattatatttagtattaatataccaaaagagaagaaccacaaagagcttgataaaattcaaaaattgatctcttaatttgtttttgaggtcagtttttatgcaaaggaaatgttttctctccattttctcccctcctgttttactgtctcatacatcatgatgcctattagagaaatactagaatccttctcactatagacaggaataagaagtggatgctgttgtcactggttctgcacatggcaatgaaaaagaagaaagcgaaaggcacacctttgcttcttttccaagtcatcaaaatttgatatggcaaaaatcatagttacaaggcaaacaaattgataaactacaacatttatgacaaattgccttaattcagaaaggacattttcaaagccgaggaaaaaacaatcagtagataatatcaatcaaagacttgtgcaagcaaaatagaactgctgacaaataaatgctaaatcagtaacatgctgattaaaaagtagaatactgttcgcctgactgcatagatttaaaataataggcattttcatggatgtgggaaggaaacattctgagataacagcttatgagagtttaagtcttgaggacaggtaaactgtattaatcagaagccgtaaagagtttcataccctttgacatagtatgctgggaatattttctgagggattgattgcataagtgcacaaagatgtatatttttatgatacggttctacacagtattgtttataataaaaacttggaaacctaaatgtccaataatagaaaagaataaattattgtatatacatacagtgggttactaagaaatgattcaattagtatagatattttcattgacaaaggtttcttaatatattggtaagtgaaagggaagttttaggatagtatatctagcatataaatatatttgtttgggatatggttaatacagaaactttaacagtggccatctttaaagagtggaattttgagtaacattttcttcatatctatctttcatttttcccaataataatgaatatataaatgtacatgcatctctctgtctcactctgtctctcgcgcacacacacacatacacaccatatatgtatatactggcttttagaaaagttatccatgaccttgtatcttgttattaaacacagtgaaacaatcatatgttaggatttattctatgcggtgaaaaaacaggctacaagatgttatgaaaatttggattgagatctaattgttcagaaagcattttctagatttcttactctacactagtaatatacaagaataacaagatatagtcctctcaattcttcattacatttggaagtagtgcattatgttctccacttagcgtattgggaaatgaatatgtaaaataattctgatttccctgagcttagtggtacatgattaataacttcatttcaatattttttctcctatatcttcgtcatgagatttcctgactcctcttttttggctctgggtctgtggtgggaaagctgtcctcctctatgtactgaatttatgtgattattgtccagtctaatctggcatgcactttgctcaattcatttccaataatagcaggttatttaggtttaagtgatgaattctgaacatgcctgtgtgtctttgcttcaccaaaacacagaaccatacctacgtgtgctggacagtgttaaaggttctgatgttaaaggattgatggcaccatagttgccttggaggagttgtatgtctaatggaagaggcagatccaggcatagttttcagcagattcaaatctattaagcttaatatttacaactgctatagcatttgcataaaatgagtatcattttagcatctctgcaagccagaaaatgtctatttgattttctcattttggactttaaaaattattttccaattaaaaataatttgaggaaatagagatttccataacgtttttcaaaaatgtaattttcttactcatctactaatggcacagtgttttaaaatgctttgctaaaaaggcagctttaggattaaaggataatttatgtaatgttagaaacagcagcaataataattcagtagagactttcatcattcaatttatgaaaagcatattgccttaacataatttcttaactggaaatttagatgcaggaatcaaattagtctcttaaaatataaagtcacaaagacaagtctggaggagcatttgaagggattaatgtctcacagcttgaaacatatatgtaagaattcatgcaaactatttatcttacatctttttatttaaagaattttagctccatctacacataagaaagcctggagtttgaaataatagttgtccaaattcatgcttatccagatttatatcacattgcagccacatattttgctgatgatagttaaataagaagttgctactgtaaaatgtaaagctaagtatcctttttagcaccatgtattatttcatagtaaaaattggaatgttacaatattcctgtggtgttatgtcaaaaaaatattttcatcgtcaatttgaaaacttttattatgcattaagtaggtatacttaatatttgaacaactatggatgtgtatctttatggtacataaatgttcccaaaatagatgaagatgtgtatttatgaagcaaacatattcagcgatgtgacaaatgtgagagaagtatctcttgataaagtaatacttctttaaaaattaatatgttttatcatttcaaatcttctgatctttttcttccattcttcaaaaatggaatgtatggtcacttgtcactcttagtacagattagcatttttaaacatagacggctttctgaaatacattaaatgctttttggaaaattgagtgtaactctttgaatgaatgctaagatactgttggcttccaaaagagaatactccagacagggtacattttttctctttttctactggaagaaccagacacaatttagagacaagtaagctgaggacagattttcaaggtcatctgggaacaactactcttttagaaacattgtattgttttttaatatattttattgaattttgttacttctgtcttcagaaaatgttatatgaatacagaaaatgtatgttccctgtggggacctgggaaattaaaaacgtgtatcatcctgataaaacatatctcatgggaaaaattggccaaaacagttagttactcagtatatctccaggtttgcatcttctacttcttatgtattcatttagagtcctcttccagtgtgtggacctctgcagattctagataacttttcaaatatgctagattttgagctgtatattttttctcaagcagagacatctgcgcatagtgaaaatcaattctcagagaccaaaattgccaagcatacgtgacggaactgtagggaaaaagggcataactttaatcttcaaagaagcttaaaaatagctccacagttattatgcatgaggcctgacaattgacatttctcattttggcagcattcacctacagcaccctatcagcaactgaacacattcatctctggaataaatgattaatgagctgcctatcatttccactccttttgtaccaagtggtggaggcttcagttgatcatattgcagccatcaacatcattactgaaattgattctgccactagagggttgtgctaggatcatcaattagcatttaaattaaaaagttatggcattaaaaataacaaaaaaataatcccttctgagtcactctgtcagacctggtaaggtgattttgtttttttgctcatcagacagcatcacaaaaccttagattgaggaaggaagcatggaaggattgtttttgtttcaagaacaaccctctaagatttccaaactttttattaatcactgtcatgttccttgaaatgcagatttatgaaatgctacaatttgcattcaatagtgaccaatgaagttgccaaattatttccttcagacaaaaagtcaaaggatagagttaggcatttttgaaaggtcagaatttatccagaaagggggaagttagaggaaggagatttacaaatgatactgagatacagcaaaataaagtttttcttatatttcagcaggcagatgtgagaatgaagtgaaaagaacatcatcatttagatgtcgggatgatgtgggctgcatttctaaaacagatggcagataatgtgggtctccatagtcctacaaaaaagtgacagattgtagttttggtaaaatgatacatcaaggaaaatgaatggtacttggaataggtattttagcatctctttctgctcctgggaccaagttcctcaagttctcaatattactgagcttaaactccttcctcatctatgttcatcttccagcatggctttctcctatttcctcattgtttcctctctcttcccctgttgaatttcaaattcaaatataaacagttggttttggttttatctgcctctgaattaagacactacctttactacattgtattggtcacccaattgaagtgcatgtgcattttcttcagagctgagacgcattgattatacaacaaaatggagctatcataggtcctcaatccagctgctctgtcctatacttgattaatattctttccacaatctgttggtagtggtattgtgacttttcatttctgtctttgtgaaattttaagaagaagctaacaaaggctgctttgaggactgctaagtagaggacatttttacctaacattgattaatgtagatagctgagacttacttgtattttgaaaaatgggaagaaaatggtcatggtaagaagcactgggtgataagaaaaacacatagtaacaagatttctacatgtgagccaatagcaaacttcctctatgtgttaaaattctccaatgagaaatacagcaactcgtttcagacaccatgagatggacaggttaggccaagttgtgcttgacctagtggtgaatgaccacacacttctttacctttggcacaagtggttcatcaatctcccactttccctcagatcctttttcagcgtagtattctaggcaccaactgccaactggccagtgttcacctgtttgtcattttcagcttaactaccaatttggacaattggagaggtattcgaaccggatggtaaagctgaaattagatctcaagtctcttcactgaagtctagtactcttatatttcatagacaatgaactggaccagatgaattcttctgttagtatgatgtatatcatatgaacttccaataattttaaagctaactttttattataaaaatgatacaggctcatggtaaagtcactgtgggaaacagtatggtgtttcttcaaaaaattaaaaataaaattaccaggcagatgtggtggctcacacctgtaatcccagcacttggagaggccatggtgggaggattgcttgagcctaggagttcaagaccagcctgggcaacacagcgaggtcccaactctacaaaaacaaattccaaaaattagttgggcatggtggagcatacctgtagtctcggctgaagcagaaggatcacttgagcccaggagttcaaggcttcaacaagccatgcttgtgccaatgcactccagcctgcgtgatagagtgagaccctgtctcaaaaaaaaagaaaaaaaaagaaagaaaaaggaattaccatatgatccagcaattgcacttctgggtatatacttaaaataattgaaagcaatcttttgaaatggtctcaaagagttatttgtgtaccaatatttatagcagcattattcacgatagttaaaatgtgaaagcaactcaagtgtcctggacagatgaataaggaaaatgtggtatacatattcaaagcaatattattcagccttataaagaaaggagctggatatggtggctcacgcctgaaatcccgacactttgggtggctgaggtaggaggattgcttgaggctgggagttcaagaagagcctgggcaacatggtgagatcccatgtctacacaaaatacaaaactgggccagacatggtggcacatgcctgtagtcttagctactcgggaggctgaggtggaaggattgcttgaacctgagaggtgaaagctgcagtgagctatgatcacaccactgcaatacagcctgagtgacagattaagaccctgacaaaaaaaaaaaaggaaattctgatatgctgaaacatgaataaattttgaggatattatgctaagcaaaataatctaaccaaaaagacaaatactttatgattccacctgtataaggtacttagattggtcaaaatcatagaaagagaaaatagaaaggtggtagccagagactagaggggagggaatggggagttactgtttaatggatactgagtttcagttttacacaatgaaatgagttttggagatggatggtggtgatagttgcacataattatgaatgtatttaatatcattgaattgtatgcttaaaaaaggttaagttggtaaattttatattatacgtattttgccacaataaaaaattgggaaaaaatgcaggcttatcacaagaaaaaaaaattacataaagtataaagtggaagtaaatatcttcttagcagtttgccccattatcttcctgctctatgtgtcacctccctaaacgccaactctcactttctaggaaaagctgctttaaagtctgtacacatgtaaggaaatgttctttacataaaccacatctggctgtgtttgtctgcgttcatctttgcctctctctctttgcctggataagatcatactgcataaactctcctctaatggttttttcctatctaaaatatgtattttgaagagtttcccttattagcctatatatatctaatttttaaaaactgactgaatggtgtgtgattagatgtctatatctcccattgatagaaatgtagggtatttccattcgtttttacaaatgatactgcagtgagcatctttgagtataaatctttgggtacttgtgagtgagttaatttctcagataaattaggtggaattatgagccaaaagttatgtgtattttacattttgatagatattgacaaatagccctccaaaagttgaactaattatctccctataaactaaacagcataggaaagtgcctgttttcccaacaccttcaacgctaagcattataaaatttctacttatagccatgtagtagatgaaaatattgaaaatattttaatttacatatattcaattctgaatgaggttaaacatagattttatatgactattcactgtttgtatttatttacaatgcactgcttgttcatttccatgctcaattttaatggtgtttactttgaggaaaaaaaaacacctatatggaaaagccctgaattatatgtaattccctctttctacaccttttctgctataatttgaaagttagctttggtcagttttttcactgtcactgtttctttcctccctctcctccctctcctcccttcctcccttcctcctttcctttcttccttccttccttgacagggtcttgctatattgcccaggctggagtgcagtggctattcacaggtgtgatcctagtgcactacagctttgaactcctgtctcagcctccttagccgctgggagtacaggtgcatgccactgcacccagtgccttgtttcttttatgataatcatttctctttcaatgtttaaccagattctccacaccttgacagcaattagggtgaggaggactaatagtactgccaaaggcccctgatggtcttgtttcagagataatttttgttacaacattgcttagcccattatgctttataatcttcttgtcagtaactgtgtgtccttggtattcatcttgtttctcagtcatttctactatagaaagaatcatattttcgagaataacaaaatgtctgataccctgttttcaggataccttcatatactaacagaccaaagtgactggacttggccaattcagttacaatgaatcctattgaaaaatgaacctggtttacctgagggctaaccattcaggaacaactgtttatcatgaagactttttagtttaattttcaaataggaaatgtattcacgtgtgtattaggttctccagagaagcagaaccagtaggatacacacatacacacacacacacacacacacacacacacacacacacacacacggggattatgggaactgacttcatgactatagaggctgagaagtcccaggatgcgccatctgcaagctgaagaatgaggacagccagtggtgcaattcagtccaattccgaggtcctgagaaccagggtagccaatgatatatctctcagctgaaggcatgagaacatgtgtgtgtgcgtgtgtctgtgtctgtgtgtgcgttggggggtgcaagtcctggagtccaaaggtccaagaaccaagagctttgatgtccaaaaacaggagaagatggatgttcaggctcaagaatagaaaaattcattcttcatccacctttctgttttatcctggcactcaatagactggatgatgtccactcacataggtgaggctggattatctttactcagtctactgattcaaatgtgaatctcttctggaaacatcctcacagacacacccagaaataatgtcttaccaactatctgggcatccgttagcccagccaggttgacacatacaattaaccaccacaacgtggctcaaaagtcaagaagtataaagaaaacaaagtgaaaaggtttttttttcatccccatccattatcttccagtttccccaccctatcctcatggagtttgtagtatattgaacaggtagaccaccaagaaattataataaggtacattcagtcttctcattatcagtaattttttactacgtttctgggttctgggaggagggtgttacagaatgctgagctgggaagcttcaatcatgagattttaatatttatcaatgaagggtttaaaaagatggagaatgagttaaaggaattaactgccacagagaaaaataaagtggtcccttgtcctacatcttggaatctctattgcgataattgctatgtgtgtggcaacttcctggaggttacttattaaaaatgtaccctgaagtaattcatatgtgtcatgctaatgccctgtccacttcttactaaaatgtatgggttaaaattaacagtaatacttttgtctggatactgaatccaactaagtagaaattactcatttctaagttgtaatgtattgtatataaatgtaacattgttataatacaattatatgtatacaatgtaaaaatgtaatatattgtgtatatgtacaaatgtacatttgttgtgaaatattgtgcaatataattgtaatattttcaagccctatatgaaaaagctgttatttgcatgactgtatcctatgaatagttatggaaatgaataaataagctttttagaaacagtttacagagtcataaacacttaaatatttgcgcctgaattttctcatcaattctttaggtgttttcccctaaacaaaagaatctgtctttatttttcatgaaatcacttttctattttggcatacatttctttttcattttaaagtctgcaatcttcattatataacctgcaggctatatgagtgaggtaatccactctccctctctgttggagggagaatgttttcctgtgccactctgtaatttgttttgcaacaattattgctatttgtaagcatatcttgtaatcacaagatacatgtagctgaatttagaatctgttgagaacacagaaggcagcagcagtgtttctaaatgtcactgacttaatgattttaactaataaaatttttaaagattcaaatgcatcaacccaaatcatccatttctgaaatgtattttagataaatcccttgaagtgttcttttgttgcaaatgggtgtcattatgcattagtttctttctccaaatccctgcaatcccctaacctaatttccaataagacaatctatcagacaatttatctctagttcctgtgttttaaaattatggaagctaaatgttgtgttccagattgtttagggagtcatacctagaagcattttgtgccttatacttctttctactcttttgattaagaaaacataaatgtgtatataactggtatattttccaattattttaggcgaacgtcgcaaatgtattttggcccttttgcgggggcctatttttccttttaaaaagtaccaaccattcaactttgaataacagattatacagtggagcattatttttttgaaaaataaattatcttaggtagaattttagagtttgtatatactcatcatttattttccctgtactgcttaaaatgtattcttaaatttgtatgttgggtcaggcgcggtggctcacacctgtaatcccagcactttgggaggccgaggcagatggatcacaaggtcaggagttcgagaccagcctggccaatatgtgaaaccccgtctctactaaaaatacaaaacattagccgggtgtggtggcgcttgcctgtagtcccagctacttgggaggctgaggcaggagaatcgcttgaactcaggaggtggaggttgcagtgaatcgagatcgcaccactgcactccagcctgggtgacagagtgagactccgtctcaaaaaaaaaaaaaaattatgttaaataggtttaggttatgagatgaagagaaagtaggaaaagcaacatagaacatattttattgctattgaaatgttatttttattttccttgaaaagggataaagtgggatattagtgccaattttggcaggtgagtggtctggtgacaaataacacagtaataaattgattgtccccttatatctccactgctaactgaagtttacattgggcaaagaagatagaagcctttgcagctgccttaaattctgctgtggaaacaagtgttgcatatatatataatttttttttttgagtcacagtctcactctgtcacccaggctggagcacagtggcgtgatctcagctcactacaacctccaccttctggcttcaagagattctcctgcctcagcctcccaagtagctgggattacaggtgcatgccaccacgcccagctaatttttgtagttttagtagagacgaggtttcaccatgttagccaggctggtcttgaactcctgacctcaggtgattcacctgccgtggcatcccaaagtgctgggattacaggcgtcagccactgtgcgcagccataaatatatatgtgttaccttgagttgttttcatgacttacttacactgtggagagtgaaggaaattgctcagtgggtcaattccttgaggtcaccgagtcccaacagaaatagtccacaaattcccctggtttagaggcaatgatttctaattcctagctccccacttggtccaccgtatgttcatctggaaaacatttagtcatttccaaggagattctaaaatgaggcaactcgtggtcaactgtctgcctttcataacaggtcaatcaaatatatgaccaacaaagacatacatttctgagccatatggaaaaaataattgactaaatgggaccctgatcacttaaaagaatagatgcgtctcttaaaaagaaaatgtattctctcatcagttccaatattttcataacatttaaagctctcaaatgctaaataaaaatatgaaaacatttgagtgaaatgtggcactgtttctgattttctgtaaggttatgataaatttacttgacacaatttaactttaaatgatcatgtcgtgttaagcagaattaaattaatgaaaataaatgtcaccatctaaataataaatatttcctaattgagtagctaaggtaaaaataatgctaaattatctagttttttaattagtaattattcaacagaagatttctccctgctaattatctttcaagattcagatgaaaagatactaagatcttttaacaaaaccattcatttaagcccattattaaacagactatattaccttaacattttatggtatgaaattctcacagtcaaaatcattggcttgttttcctgggtaatatttcaaactcctgtgaaaaatgaatagttgcttagaaaagggggctaattaagtcatagtgtcatttacggcattgcccaaaactgtcactctgctcacatattttccttcaacttacaggcctcgctattttctgataactgtttggaagttttctgaattttgcatcttgaatacctcactgttgttctttatctgcccaccgaagagacaatcatgttgaaattgcattttttaatatgcaaaagccacagtatttgtctaaaatttacattctgtaatatgtaaggaaacaatagtatgcaaactacagttttatccttgcaatcaatatgaatgtattacactacaaattgtttatggcctacacttctggccttcattagccatctcaaaatgtcatgctgtaggtcaaatggggtcataaagaacataagtggcttacctcaaaccaacatcactattagaaagtaacttaaaacacatgctttgttggtattttagatttaacatcatcttcttaggaaagataacctgtggttccagaattattaatttttttagcaacctatcagaatcaaattctatgcaaattaaataagaaaccaaattggagtttcactaaatagaacctacagaatttgcttgttgttaatgctggtggatttctttgaaaccttagactagttaaatattaaatagctagtaagagtggagacatttctagagattatactagacagctgtcgactgagatttcatagggcagattttagaccttatttgtatctccagtagttagcccaggatttttactcaaagtgcttgttaaataatataatgcatattaaattaataccttaaaaagacaacctcactctagaaaaacaaaagacaacctcaaaattctataaatttagtaataatactaggtgatcattcagagcacttaactcaccttatgaagaggtgctttcggagttgtgttcaattttgtcactttcagatgaaaataaaagtgaacactggaagaacatttgtaaaattacagctaaagacaaccatattgtagttcatcattcattccctacattagattgtgcttgatatttcttcaaaaattcaatgttagtaaaaagtttgattgtcctagtgaatttaatgatattaaaactctataacctattgttcttttcctttcttagcttcccaggaagactcggggctaaattcaatgcctaattatattttctatattagtttgggtgtttttgtagttaccatttccttttttcaatgtttccctttttatttttatagtttaatcctttttagaaatgtgtgctgtatattatgaattaatgtcagttttttattcttaatcctcatttttcaattgtttgtttttgagctttcaaaacacattgttcactactccttgaaactttttttttttttttttgagacagagttttgctctgttgcccaggctggtgtgcagtggcacaatctcggctcactgcagcctccgtctcccgagttcaatgaattctcatgcctcagcctcccgaatagctgggattataggtgtgcaccaccatgcccacctaattttttgcatttttagtagaggcagggtttctccatgttgcccaggctgatctcaaactcctggactcaagtgatccaactgccttagcctttcaaagtgctgggattacaggtgtgacccaccacaccagctgaaactctctcttccttgcctttcactatattctttcagtcaacaaatatttattgaatacttaattgttgtcaggcactgttgtgattcctctcccaattcaatgatcctcttcctcatcccacttactctcagttctgccccatatatggtgcaggtccaccaaggttctgtcatttattttatgatgttctcaattctgcactctgtgccttgatttaggaacacaatcccttacttgaaacttttgaagccacatatgcttcaaaattctgaatttttggattttagcaaagtcatagattgtaacaaccatatattttgtaacactttacacagagaggggcagcactctttaatcaaatatattaatatttctgcaatgaaatatatgaatgtttacacaaaccgagatagggactatgactactatagtagtatatatagactataaccctcactgcattttttttttttttttgatacaggatctcactctgtcacccaggctggagtacagcggcacaatctcggctcactgcaatctccgtctatggggttcaagcaattctcctgcatcagcctcctgagtagctgggattacaggtgcccaccaccatgcccggctaatttttgtatttttggtagagatgggatttcactatattggccaggctggtctcgaactcctaacctcaggtcatctgcccgcctcagcctcactacaattcttaccaggtgttgcggctaaatgagttctgtcttagaaaatgcttttgcttttcaaaccattttcgattttgagattgcagataagggatgatttacctcttaaacttttcctactttaaatatattaagcaaattttgtctcgaatctgtctggtcctacatttccaaataccttctagacatctttacaaaaggacctatcaaatactttaatttgtaccaaagcaaatgtattgccttctaacccactgatctctttcttggttgtcattctgtttaactctttagcatcatcactgaatcctatggaatccatcataatagttcttgaactccttgcctcctatcacccgccccaatattcacgtaggttcttttctattttccctaagcttcggccagcttgagaaataaagggaccgagtacaaaagagaaattttaaagccgggcgtccaggggagacatcacatgttggtaggttccatgatgccccccaagccgcaaaaaccagcaagtttttattagggattttcaaaaggggagggagtgtgtgaataggtgtgggtcacagacatcaagtactttacaaggtaacagaatatcgcaaggcaagtggaggcagggtgagatcacaggaccacaggaccggggtgaaattaaaattgctaatgaagtttcaggcaccattgtcattgacaacatcttatcaggagacagggttttgagagcaactggtctgaccaaaaatttattaggcaggaatttcctcttcctaataagcctgggagcactatgggagactggggtctatttcacccctacagcctcgaccataagagacgggcacacctagggtggccgtttataggcctatacccccaggcgcatattctctttcccaggcatgttccttgctgagaaaaagaattcagcgatacttctcccatttgcttttgaaagaagagaaatatggctctgttcagcccagctcacaggtggtcagagtttagggttatctctcttattccctgaacaattgctgttatcctgttcttttttcaaggtgcccagatttcatattgctcaaacacacatgctctacaatttgtgcagttaatgcaattatcacatggtcttgaggcaacatacatcttcctcagctgacaggattaagagattaaagtaaagacaggcataggaaatcacaagggtattggttggggaagtgataagtgtccatgaaatcttcacaatttacgtttagagattgcagtaaagacaggcataagaaattataaaagtattaatttggggaactaataaatgtccatgaaatcttcacaatccatgttcttctgccatggcttcagccggtccctccgtttggggtccctgacctcccgcaacaattgtcacagttctgacaatggtgcaggccttcattacctctcctctcagttttgtgacttctcaaactaggctagataggctaatttattcatgcactatgttagacattggcaaataccaataaggcaggcttaacttcaggttccccatttatagggacctcttcttagtggggaaggctaattaaaggattaaataaattagggaacgtttggtacaatgggctattttgcaaccattaaagacaatgagattattctatatgtcagttgccaagacatattaagaaaaaacgcgtccgggcgtggtggctcacgcctgtaatcccagcactttgggaggctgaggcgggtggttcacgaggtcaggagattgagaccatcctggctaacacggtgaaaccccgtctctactaaaaatacaaaaaaattagctgggtgtggtggtgggcacctgtagtcccagctacttaggaggctgaggcaggagaatggcgtgaacccgggaggcggagcttgcagtgagccaagatcgtgccactgcactccagcctgggcgacagagcgagactctgtctcaaaaaaaaaaaaaaaaaaaaaaattgcacattgcagaatagtgtattgaggtcctatgaacacatagtttgcctatatagagaaagtcctggaaagctatatacaaaaacatgcatattaaattaatacctttaaaagacaacttcactctagaaaaaacaaaagacaacttcaaacttctataaattttgtaataatactagttgatcactcagagtatttacctcaccttatgaagagatgctttcagagttgtgtttaattttgtcacttctagatgaaaataaaagtgaccatttgaagaacatctgtaaaattacaactaaagacaaccatattgtagttcaccactgacagcactgtctctggaaagacaatgtggactttattttctgatttttccttttttagtgttgtaagttttaaaagaatatgtattttaatctgaaaagggattatcaaattaaatgtgatgagagatatgaataaataaatataatgaagaaaggaatataacacgaagtggccgggcacagtggctcgcgcctgtaatcccagcactttggtagggcaaggcgggcagattgcttgagttcaggagttcaagaccagcctgggcaaaaataacaaaaccctgtctctaccaaaaatacgaaatattagccaggcatggtggagcacacctgtggtcccagatacttgggggactgaagtgagaggatcgcctgaccccaagaggtcaagactgcagtgagctgagatcatgccactgcactccagcctgggcaacagagtgaggctcttgtcttaaaagaaaaaaaaggtggaaatatagcacaaagtaactaactcaggctaagttatgaaaatcttagaaaatgctttcctttgagtacagcaacagacattccaatcagagcaaacagcagattcggtggtactcatttcttaaagggtacagtgtgtctgggaacagcagattgggtgctggagagtagcttcaaggggaaaccagatttgacactgatgttagatatggaagatagtgaaaaggactggagatagtcaagtgtttctgggcaactgggtggcttatggtagctttaaaagaaacagggctaatcaaaaccacagtgagatgctacttcagagccattagtgcagttataataaaaataagtcagtgaagggtttcaacttttggtaatatggacctgctctagtcagtggagagcctctggaggttgttgatttttaaataaaatactttttttttattttggagtaattttagatttgcagaaaagttacaaagatagtacagagagttatcatataagccctcaaccagtttgtctcccttaatgttatcttacgttatcacggtatatttgtcaaaactaagaaaccaacattggtaaattattattacctgaatgccagtcttcattcagatttcaccggtttttccattagtgtgctttttcttttccaggagccagtagaggatcccacataacatttagttgtcttggtctctgtaatctcctcactctgagtttctcttctcagtctttccttgtttttcatgaacttgacagttttgaggggtactgatcagaaagtttgtcgaatatccctcaatttgggtttgtctgacattttctcattattagactggaggtacgggttttagaaaaaatatcacacaggtatttttatcacattattttagaggacacatcactgctgatgttaaccttgatcacttcatttaggatgtttgctaggtttttccactgtaagcttcccagaaagcttttcctttccatgcttctcaggcttttaagctttacattatattacaagcagtgtttaatgcgatttttttggctggatgatgggaagagggtggaaaaaagaaggtcagttacatagctaaggttgtcgtaataattcaagtgacagaggacaagcacttggacttctagtggctatagtagatagtaaaatggattggagatattcaagtgtttctgggcaactgggtggcttacggtagctttaagagaaacagggtaagtcaaaaccacagtgagataccactttatacccattaggaaagttataataaaaagtcagataataagaagtgatggtgaggatgcagaaaaattagaatccatatacactgctgatgggaatgtaaaatggtgtggccactttggaaaacagtcaggcagttactcaaaaaattgaacattttactatttgatgcagcaattccacttttaggtacatacttgagaaatagaaacacaggtacacataaaaatgtatacgcgcatcttcataatggcattactcattataaccaaatggcagaaactacccaaatgtccatcaattgatgaatgaacaaaatgtggtatatcttattcagccataaaaagggtggaaacactaacatgctatgttacaacacagatgaactttgaaaatgctatgctaagtgaaagaagccaatcacaaaagaccacatattatgattccatttgtatgacatgtccagaatggagacaaatctagagacagaaagtagattaatagttgcttagcactgggggagtgggtggatggtggagggatcaggctatgacagggcaaatggtatgaggtttccttttggggtgatgaaaatgttttcaaattgattatggtgatggttatacaaccctgaatacactaaaagccatagaattgtacacttgaatttcgtaaattgtatgatatgtaaattacatctcaatgaaattattaccaaaaaaatctgtaacacatggcaggggaaccatacttgttcaaactacactcattcaaatcaaagtgctggtgggacacccaggtggagcagctgaaaacttaggttggggctagagatatggcaccacaaatcattagcataaaggattcactcagtagaaaacaaggtaattcatttagtccaatttactaaatatagtagctgaagggaaggtttcaagcagggcaacttcaacatttaatagcactgaattttcaggggttaacacagaactgaggactgactctgatatggtttggctctgtctccccactcaaatctcatctcaaactgtaatctccatgtgttgaggacagaggtgattgaatcatgggggtggtttcccccatgctgttctcatgctaacaagtgagttctcaagagatctgatggttttataaggcagttttccctgctcttgcttgctctctctctcctgctgccttgtgaaggtgtctgcttctccttctgccatgattataagcttcctgagacctatccagccatgtggtactgtaagtcagttaaacctcccttgtttataaattacccattcttgggtagtataatatctttatagcagtgtgaaaatggactcatacagttaactggtaccagaagtggggtactgctataaagatatagaaaatatggaagtgactttggaactgggtaatgggcagagtttgaaatagttggagggctcagaagaagaaaggaagatgtggaaatgtttagaacttcctagagacttgttgaatggttttgaccaaaatgctgatagtgatatggacaatgaagtccaggcggaggtggtctcagatggagatgagaaacttattgggaactggagcaaaggtcagtcttaccatgctttagcaaagagactggcagcattttgcccctgctttagaaatctgtggaactttgaacttgagagagataatctgaaattggaacttatgtttaaaagggaagcagagcataaggtttggaaaatttgcagtgtgactaagagatggaaaagaaaacccattttctgggatgaaattctagcaagctgcagaaatttgcataagtaatgaggagccaaatgttaattgccaagacaatgtggaaaatatctccagggcatgtcagaaatcttggtggcaacccctcctatcacaggcctggagacctaagaggaaaaaaatggtttcctgtgcagggccaggtgcccgctgctatgtgcagcctcagaacttggtgccctgcatcccagactttccagccccagacacagctaaaaggggccaaggtatagcttgggctgttgcttccaagggtgcaagcccaaagccttggcagcttccacatggtgttgggcctgcaggtgcacagaattcaagagttgaggtttgggaaccgccacctagatttcacaggatgtatggaaatacctggatgtccatgcagaagtctgctgcaggggcagagccctcatggagaacctctgctagggtattgcattaggaaaatgtgggattggagcccccacaaagagtatccactggggcacgcctagtggagctgtgagatgagggctaccatcctccagaccccagaatggtagctccactgatagcttgcaccttgtgcctggaaaagccaaggacactcagtgtcagcctgtgaaggagctgcccaaggccatgggagcccacccccttacatcagcatgcccacgatgtgagacatgaagtcaaaggagattattttggagctttaatagttaacgactgccctgctggattttggacttgcatggggctatggggttttggtcaatttgtcccatttggaatgggagcatttatctgatacctgtaccaccattgtatttagaaagtaactaacttccttttgattgtacaggctcataggtggaagggattgcacttgccttacctcagataagactttggactgtggacttttgagttaatgctgaaatgagttaaggcatggggggctgttgggagggaaggcatgattggttttgaaatgtgaaaagacatgaaatttgagagaggccaggggcagaatgatacggcttgctctgtatccccaaccaaatctcatcttgaattgtaatacccattatccccatttgtcaagggagagagaccaggtggaggtaactaactatatcatagagcggtcctcccatgctgttctcatgatagtgagtgagttcacaatgagatctgctgggtttttttctttgtttgttttgagatggattcttgctctgtcagtaagcgggatctcagcttactgtaacctctgcctcctgggttaaagcgattttccttcctcagcctcctgagtagctgcacgcaccaccatgcccagctttttgtatttttttgtagagatgaggttttgccatgttgggaaggctggtcttgaacgtctgaccacaaatgatccatccacctcggcctcccaaagtgctaggattataggagtgagccactgtgctcagctgatctgatggttttataaggcagttttccctgctcttgctctctctctctctcctgctgccttgtgaaggtgcctgcttccccttccaccatgactgtaagtttcctgaggcctccccagccatgtggaattgtgagtcaattaagcctcctttgtttacaaattacccattctcggggatcatctttatagtagtgtgaaaatggattaatgtagactcctctggcattcaagacaacactgttattgagactgactgatgtctctcctcattttcaactagtctctgaatgagaatacattctgagaaatgaaccattagacaaattcattatcgtgtgaacctcacagaacatacttacacaaacttagatgatatatgctattgctcctgggctcaaacctgtacagcatgttgttgtaccgaagactttgtgcagttttaaaagaatggtcagtatttgtatatctaaacgtagaaaagatacagtaaaaatatggtatagcccaggcacagtggctcatgcctgtaatcctagcattttgggaggccgaggtgggcacattacttgaggtcagggatttgataccagcctggccaacatgacgaaaccccatctctactaaaaattcaaaaattagccaggctcaatggtggtcgactgtaatccctgctactcaggaggctaaggcaagagaatctcttaaacctgggaggcagaggttgcaatgagccaagatcatgccactgtactccagtctgggtgacagagcaaggctccatctcaaaaaaaaaaaaaaaaaaaattacagtatagaagattaaaaaatgagttcaagaccagaccgggtaacatagtgagaccccatctctaccaaaaaatacaaaaattcactggatgtagtggtgtgtacctgtagtcctagcttctcaggaggctgaggtgggagacgcactcctgtctgagcaacagagcaagaccctgtctttaaaagaaaaaaaaaaaagatacacctgtatagggcacttaccataacttgtgcttgcagactgaaagttgcttccaggtgtcagtgagtgagtggtgagtaatgtgagggcctaggacattattgaaccctactgtagactttacatacttaggccacactaaatttataaaaatatatttttctttcttcaataataaattaactcttgcttattgtagcttttttaatttatgcacttttaaatttgttttaacttttcttttttggatggggtcttgctgtgttgcgcaggctgaagtacagcagcatgattgttgctcactgcagcttcgagctcctgggcttgagctatcctgccacttcagcctcccaagtagctggggctataggcatgcaccaccacacatagaacacaaaaaaggtacagtagggcaggtgcggtggctcattcctgtaatcccagcactttgggaggccaagacaggcagatcacgaggtcaagagattgagaccatcctgcccaaccaacatggtgaaaccctgtctctactaaaaatacaaaaattagcggggcatagtgacacacgcctgtagtcccagctactcgggaggctgaggcaggagaattccttgaacccgggaggcagaggttgcagttagctgagatcatgccactgcactccagcccaggtgacagagcgagcctccatctcaaaaaaataagtaaataaataaaaaaggtacagtaaattttttaaaaacatttcactctttttgaataacacttagcttaaaacacgctgtacagctgaacaaaaatatttttctttgtattcttatgaacttttttctatttccaaaattaaattttctttttacattttaacttttttgttaaaaactaaaacacaagcacacacactagcctaggcctatacaggatcatcaatatcactgtcttctacctccatatcttgtcccagtggaagttcttcaagggccataacatgcagggaactgtcatctcctataacaaggtcttctttgggaagacctcctgaaggactctcctgaggctgtttacagttaccttttttcctgtaagtaggggtacagtttaaaataatgataaatagtaaacacatagccagtaacatggtattttattatcaagtatcatgtaccatacataattctatgtgtcatacttctacatgcagcctactgtgcggcttgtttacaccatcatcaccacaaacatgtgagtaatgcattgtgctaagatgttacgatgcctttgtctttagacaggaatttttcagttccattatgatcttatgggaccaccatcatatatgcagtctgtcattgaccaaagtcattatacagcgtataaactgtacagttgtcttcatttcatgtaacagaatgctttaccgtaaatggctatggcaatgcccctcaagtaatgagcagagtatttttggatgacagaagttgaaatttaagattacactaattaaaactaagtatttttggtataatttacaataacctatatggatttagaattatttccttattcaagggaatgggtcaagccataaaacttaactggccacgtaggtcatcggttattctatactaccttattccaaatctgccacatcttccctgctcacccccaacatggtgctagagagagattccatactaaagattagacaggtgaaaagaataaaaagaaagtcaaatgattccaccaactctttcaatgatcatatattccttgtttggaatttagtaaatgctattttaaaacccaggaaggctgggcatggttgttacacacctgtaatcccaacactttgggaggctaaggcggtaggattgcttgaggctaggtgtttgagtccagcctgggaaacacagtgagaccccatctctacacggaaatttaggaaaatctagctgggcgtggtagtgcccacctgtagtctgagctacttgggagactgagcccagaggttcaaggctgcagtgagctatgattgcacaaccgtattccagcctgggcaatagagtgagatcctgtctctacaaaaacaaaaccaaaccaagccagaaaaagagatacttcacagattacagaagatgtaagattctgtttgcctttttttgagacagagcttcactcttgttgcctaggctggagtgcaatggtgcaatcttggctcaccgcaacctccgcctcccaggttcaagtgattctcctgtctcagcctcctgagtagctgatattacaggcgcatgtcaccacgcccggctaatttttgtatttttagtagagacagggtttcatcatattggtgaggctggtctcgaactcctgaccttaggtgatccacccgcctcggcctcacaaggtgctgggattacaggagtaagccagcgtggccagtctctgtttgcctttttaatgtcatctacttcattttgtaagtagggtatcaaggaaataattatcaaggtatagtttgggaaaaggtgagcaaatccttaacacagctggcccaaggttttatttggtaggtctaaatcttgaccttatggctatgaaatttcaagtttgtgcttgaatacatgattaaaagaatgaaaatgaaatgaccgatagtacgtaccattttagtttttattaataaaatagaaacttagactcggacaactgctttattcttgcatctaatctgaccatatattggagtagcaattctttataaaaggacttcggtgagaactgtcaatatatcagttccatcaaaaactctaggttggaatatcttaaaaacagcaaattaaatatgagaaagcacagaaatctctccctcaaacaagaagggcttcctttaatagactttaatatagctcatttacaatcgtatgaaaatccatcaagatcaatcatgttgcacaatccctaaaggataaaactgagggaagtcatggataattttcacagcttcattgtaaagtccaagatctgaaagaaacatttaagcaaacatttaatctacaatggaaagttgtaacatcaattattatctaagatatttttacctatttcctttttctcacccttttggaagtgagtttctaaaaatggagatatggattatggattcttgtatttaactgtggcaccaaaaaaaagacatgggagtaccatccattttgatgttcattatacaggcagtttctgcctggtagtgttttgggtgttatgcattattcaattccttcaattcagatattacaacaaaaaaactaatactatttttgttatatttaaaaaaattatctttcaacaaacattaattaatctttactgagtttcttacatatataagcactacttaaaagcaggccaaaacaaaatgtacccccatttgcctttacgatcacaaaattctatagaaattgaaaatgtggcagtactaaaactctagaccaatatatatcaaactaaaaataaaactgttttcctgtatgtttatgttatgtaattgtatgtaatacatacaattttgtatgtaatacaaaatgtatgttaaaacatagttatataaaactgtatgttatgtaattacatacagttatataaaactgtatgttatgtaattacatacagttatataaaactgtatgttatgtaattacatacagttatataaaactgtatgttatgtaattacatacagttatataaaactgtatgttatgtaattacataaaaccagtcaatactagaatgctttatttaccaaaaggatggctatcttctttaaactggacataagatgtacacaagatggtggccttggcggttactcttccaaccacttccacaattccagagatttcttcatcaagctaagacacagaacaagacatcgatttggtgatatcacattttcagttgacaattattttggaaaactgttatacaggttactaatctatcacttcaagtaacaaagtaattttaagaattaccagtgtaaaagttaaaatgtaacttgttaacaaatgtttgagtacttaactgtcagcatgttaaaattcctgctacctttagcagtagcttcaagtccaaagctacaattcaagttaaagacaaaatcactattgaaaacgtccagcatttctataagcagtaatatcctatgagaggaatcttctataatctgtatttcacaatgtgttctgtatacattaaccaaacagcatatggatttgtcttcacaaaataccaaaaaaagttttaagtatgttaaacataaaatgcaaacataaataagtaaaaactggaaatatatgaacaaaaatagaaaataaaataaaatcgaaaactcttgaggggctggtcgaggcaggaggattgcttgagaccgagagttcaagaccagcctgaggaacatagggagatgccatctttacaaaaaacaaaacaaaacaaaacaaaacaaaacaaaacaaaaattagccaggcatggttaagcatgcctgtagtcccagctactggggaggctgacatgggagcaacttgatcttgggaggctaaggctgcagtgcgccatgatggtgccactgcattccacccggggtaacagagtgagaccctgtctcaaaacaaaaaaacaaaaacgaaacaaaaaacctcttgaggaagaaaaaagcaacgtaaatttttcttatgtgattttatggtctttcataaggaatgagaattgttatccaacatttatgggatatgttcaaaaatcatgacgcccaaaaaatcattggttaaaaatgtaaaaggaaatataatgagagaatagtacaagaattaaattttacagccagggacgttttaccagctcatcctttttaaatccattgcaaaaattagaaacatcggcaacaaaccaaatcaagatgaagaattaactataatatataagagacttattaacacttaaacatacgggttccatcaactcgatggttccattttttccttctccatctgaaagaataaacatttttccggtgggatgaatctaaaaacgaaacatataattaaaatctcactaaaacaacaacaaagtttgactaaagatgagtacattgatccttagttgagcacaaatcaactgtttcttgaacagtttattcattcagtttattcaacttattggatcaaattataatcttatgttatcaaatctgttcatggaacacacagttaatttctgaatttcagataaacaaggattttttttgtagtgttaagtaggttctgtatttgctaaatatggcaaccctattctgataacaaattaaaggatgcccaccctaaaagtgaaatctgctggcactcatgatttagacagtacatatcccacggagggtatgttttaaaaaacaggcatgatgaagtaaaaggagaactggttgctagaatatctgggtcctactcctgggaagcagctgtaaagagcgctgtcagattgcgtttgaatgccagctttgccatttgccgagtttctgagcattttagtcaaccacctaccactcctactcagtttccctacttgggaagtcagagcaacactcatttaaggaagaggatgtgtggatgaaatgagctactaaataagtctttatataatagttttcttttcctcagcttttcaggtcactgattccaagactttgggcctgtttctcgcctgtagaatgagggaacttcactttaatactggggttaaataactcgttactacgggacccaaagcggacaaccaaggcatgttttacagagaagcgatcacaacgaggaaacgaggtttgcaaaaataagtaatttcagaagagaaggaaaccagcagattagttttgtctgcgtccgtcacgtctgagtaaactaagaaatctgaaggtagatgtgggagtggtgtttataatttcccttacgtaagcacggctagaacggaggcgacgggcactggaatttagaactcagcatttgaaaacactttgtttccgtgccataaaagagcgccaaaatggggctacaacggctaaagaatttccaaaaagttccttgtgcaaaataaaggagtcgggggcgcagtgatcggaggctttccgtcctttttcatcccccgttatccaggcggggtccctccctccagctacggacttgggagcccatgattgcgaacccgcacaccttttccagcctccctacgaagcagacaggcttgtcgatgaattgagctagcatgccggcgttgatgcgcgacctgggcaagtccatcatgtccaccatgattatggtccaagactgcggctggcgggaaacccacggacgactgaaactgtgcgccccgcgggtgtctatggggcagatttctcggcaccaatcagcgaagactagcgctccagcttcgccaattaaatgcgcggaaacctaaatcgcaatcgcgctgtctctgaaaggggtggagaaggggctggatgagtccggaagtggagattggctgcttagtgacgcgcggcgtcccggaagttgacagatacagggcgagaggcagtggaggcgggacttggataggggcggaacctgagactacctttctgcgatcacaggattcccggcggtgacttgaccccggaagtggggtgtgaagctccggtgctggtgcggcgggggactgcggggccagcctcaggtacctcgtctcgcgggaggcgccgcaaccttactgtttccccattcttcccgcgaacagagtcaaaagagctaggcgggagtcggcactagctgctgccgcggtgctgtgggtgctgcgtaccagctgttcactgctgtctcgccttccctcttgccagttctgcgtgggaggcgcgggagttttgcggaatgatacgtggtgtggcgtcggggttgtgatacccgcccccttggagatgggcagcggggtcatcagtgatcttgatcactttcttcaggcttttgccacttgttggctgagggtcgatttactcccttagctgcgtcactctactttctccactttctccacctgtaagaagagagattgatccgattacttctaagacgttttttagcccaacctggccacactgcggaggcgccggttctttcaccccgctaacccctccgtgttggcagccaatagaagcacttaaggatgggtaacggggaagaaccactggccagtactaggggagacaagcttaaatcgttgttagaccccgagctagggttccccgagctagggttctcccttctgaggcgtgttttccccatctgcaaaacgaagggttaggcggaatgatttgcaaggtcccagttgactctgacttttggccatatgtttgactcaacagtttaaaccccctcagcagtctttctgtcgttgccctccacactgcgagactctggagggcgatctggaggtctggaagataaccgattcctgggagatttgggggtagtctccaatctgtccctggctcatcttgtgacccgaagccggcggccttgccaggagtattctagaatgagtgcacataaaaataccttcaaacggtacggtggaaattggacagaagttttaattgggtattataacgttgtggaaactgagtctgtgaattggcccaaagctacagaattgtcatcgttcaaattcccttaagcaaaaaagatccgatttgagacttcacgtggcaatttaagattggaatctcatgtacgataattaaatgatagtctcccttagtgtttccttagcacttaataggtttgtcttagttttactcactaacggtactttaaaggatttcattaaacagatgtagaatgtgtgtcagtggtgtataaaaaagttgtggttgtattggtgcaagtcagtaaagtctattttatattacagctttaagtcttttgtactttagcattgttttgcaaagcaagttgatgtgcattatataggggagagtacacacatcaatgtctttaatagcatttttttttgaggcaagatctctctctgtcacccagactggagtgcagtagcatgcacatagctcactgcagcctttaactcgtaggcttaagcgatcctctcacctcagcctgccaagtagctgggactataagcacataccaccacacccagctaataaagattttttttttgttgtttgtttttttttgttcagatggggcctcgccatgttgaccaggcttatctcaaactcctgggctcaggcgatccctccctcccccgtctccctcccaaagtactggaattacaggtgtgagccttggtgcgtaccctgtaatagtgattttttttttttttaaagagcactcctgtgagtaccagatgttaatgtcgttgtttacctgcagttagaaagaccacttttaagcaaaggctttcttttaaaacagggagatgagcaggaagataatttaaaacagctttttcgtgtatttttgagtcacttaaaatattataaaatacatgatgtacagaaaaaagtatagctagccgatttgcatagttttgagagaaatgaaatgaatccatggggcctgtcattcagctgaagaaatggaactttaccagttaccagtaaattttaccagtttgcacttccccaatgaagccctccttgctacagccataagtaaacactatcttgaaatttgtgttaagcttcctaagcttttctaggtggttttatcacacatgcaggcgttgctaaatggtatgttgtttaatattgccagtctttgacctttatataaacagaaacgtatgtatcttctgacttcttttgtttgtttttgagattcatctatgttgacgaatgtacgtagatcatatttttttttctgttacaggtaggcatgagtgggacagtagtgggctctcccccaacccactagaaatgttgggggatggtttggcaattaccgaatttgcttctctaaaaatgataattctgcagcgccagggagaggccatttcctgatggtccacacctgttatcaaaatgttaattgaatgtagacccgagggagaaacagcttcctgggcatgcatattaagagacaaaaatggtaaagtatgatcttccaggtacactccaccggaaaaaggaaggaagcctcagatgggcgtgcatgtaactccctaaaaacacttcccaaggctaaggagggctctgtgcctgccggcagcctatcctaaggaaagaatcatgggaaatagacaagcttgtaaaagtcctaggatcagggccgggcgcggtggctcacgcctgtaatcccagcactttgggaggctgaagcgggtggatcacctcagatcagaagttcaagaccaccctggtcaacatggtgaaaccctgtctctactaaatatacaaaaaagtatccaggcgcgatggcgggggcctgtagtcccagctactcgggaggctgaggcaggagaatggcgtgaacccgagaggcggagcttgcagtgagccgagatcgcgccacttcactccaacctgggccacagagcgagactccctctcaaaaaaaaaaaaaacaaacaaacgaaaaaaaaaggatcaacggttaaatcggacacttgacctactctctttaaccttcacattcccgcttgggtctctaacaagcacaccttcctttcttcctgttttaaggccttttaaagtaaacttccattcctgctctggaacttgcctgggtctctgtttctgctttatgcccctcagtcaaattttttcgtctgaggaggcaaggactgaagttgctactgacccgtgaggataggccaccggtaacttggggtaacttggatctctgccactagtaaaaaaatgatttccccaaatggtggtaccagtttactctcttacctggagtataagacagtttacagttattgtatattcttggcaactcttggagttttttcccccaatttgatggatatgaagtgtttttttgtcgtgaccctaatttgcactccctgattactgaaaagtttgaacattttttcagatttttattggttatttatgtttatctttttttccttgatttttctttttcttactgacttttaagagctttttattagtgagatattgtaatggtacaagtgttgtctgtttttggcctatctttccgtttccttccttcattccatcctttttttttttttattaggaagacctcttttaatatagttaaacattttcccccttaagtttaatgtaggagaaaagtccattaaaatctcatttatgaattctttgatacatcgtactcttaaaggtattctatttttcctaaaatgtttagagttttgcctttcatatttaatagtccgtcatctagaattcactcttcatgtatgttgtcagataagtctccaatctctgttttgttttaatttcagttgtcctaatgtgatttgactgtatcacctttttgccaccttcacttgtcaccttaagtttacagatatgtgtggagtcaattctattctatggatctatttttctatccctgaaccactacctattttctttaatagtgtagcttatcataacttttgatgtctggggctgtgttctcgggaatgtcttggttatttttgtctctttgctcttctgtatagaatgtagcttatgaatttccaggaaaaactgtgttggaattttgatcaaaattgcactgtatccttggatgtatttcaggaaaagtaacacctgaatgtcaactcttactatccttgagccattttggtcctcttaaaatctttccaaaaggtctcatacttttctacataaaagttttgacttttagcttagatttattcctagataccttgtttttgttgctattatgaatggtatcattttttaaattaaagattttaactgattgttttggtatatagaaatgccattttaagaattttctatcagttttttttggaattttctattcatatttgaataattatagttttgtttcttaagaattcttacatattttatttatctttcttaccttttgcctaggatagagccttcagtaccattttgaatagaaatagtgtttaagtcaagatggggtttagctgcataaacaaaagtatctttaatgcacaaacgcttattctcacatgtgaaagaagtccacagctgtgcaacttagtacttatgtggtagtgcactaagactcagggccccaggttctttctgtctttctgtagttctacattcaatatctagttccatatttatggttatctcataggccaggtaagtgatggagcttcagctatcaagtaaatccacgttctatgtggcagagaagtggacccgcattcagcttcctttaaggagtattccccgaagtccttcccaacttgaatttctgtttattagattaaggaattttccttctattcctagtttgataagcattttaattgaattgttacggaatttgatcaaatgcattttttgccttaattgagatgattgaaatgagtatgtatttttcagtgtttgaaccaagctcacattcttggaagcttggttatgatatattgtcttttatatatattcctggatttgatttgctgttgtttttgtttaggatttttttttttttaatctatgttcatgagtgagattggtctgtaattttccttttttgtatagtccttgtcaaaatttggcattatggttataagacaggagaattccctggacccctttgtgggacttggaaccagggtgtggctcgtttgctcggctgccgtgtactcaaaccccttacgggagagggagcatgcaggtgagcaggtgcaggagttggggtgagtgatttgggcctccagccccatggcagtgtctaggggcgttacagtgctcttttagccctgccgtctgggaatggcttaagtgttaaatagctcagtagagtcagtgtgacagcctttttgggttcccacacccagtgcatcctgaattcttgtctagcatcgaggaggaatcaggttacatgggcttgaaagatggtgaatgtgggcattttattgagtgatggaggtggctctcagtgggatggtgatacggtttggctgtgccccactcaaatctcatcttgaattgtagctcccataattcccatgtgttgtgggagggacccgatgagagataactgaatcatggggacagtttcccccatactgttctcgtggtagtgaataagtctcacgagatctgatggctttataaggggaaacccctttcgctggatttttttttttttttttttttttttaattctctcgtctgacaccatgtaagacgtaccttttgctttccgccatgattgtgaggtctccccagccacgtggaactgtgagtccattaaacccctttttctttataaattacccagtctcaggggtgtctttatcagcagtatgaaaatgaactaatacagatggggagctggagaggggatggagtgggaagatgatcttcccttggagttcggctgtcccatggccaatctcctctctgaccgtccccagccaaactcccctcgacactcagatgcttcctctcttctctcctctgctgcaccattctgctgctctgccactcttctgctcatggagcctggggtttggggtttatatgggcacagaataggggtgacatattgggccaaaaggcaacatttgggtgcaaaaacagcctgttcacatttagggctatgggtccaggcttaagggtggagccctcgccagggaccccacccttctgccgcttgtccgtatcagttacactagttttgtgaaattagtgtggagtgtttcttttatttattctccaagattgtacataaaactgaaattatctattgagtgtttggtagtgttcacctataaaaccttttagatcactatagttatctttgactagagctttagacatttcccacaagtttttataagcaggtgtacattaagttctaggtattttctagttttcagcatatttcttttttgacccatgcattatttttgtttcaaaatgtataggttttattaaagttattttgataattcccagtgaaactgcattataatctgagggtatggtttgtctaattctttgcaattatatgagactaattctttgaaattatgtgaggcttgctttaaggcttattaggaacatggacaatttttcatgtgtgcttggcaaaaaaatgtattttccagttgttggatccagtgtgtaaattgcactgttcacataattctgttttctttttgtctgcttaatatctcaattatcgataaatatgtgacatagcctatagatggtagcattgtcaaatttctccttgaagccctgatgacttttgctatatatatacatttctttaagagacagggtcttcctctgttgctgaggctggactgcagtggcgtgattgtggtgcaatgcagccttgaactcctgagctcaaggctcagctttctgagtagctgggactgcaggcacgtgccatcacacccagctaatttaaaataaaatctttcttttgtagagacgggttctttctttgttgcccaggctggtccataactgctaggctcaagcaagcctccctccttggcctctcagagtgctaggattacaggtgtgagtcactgtgcctggcttggctttaaagtttttgttgttgttgtttgctactattatagacgtgccagctgtgttttggttagaatttatttgtcttatcgttttccatcctatatctcacctaggggagacaagacccatgggcttgaatgctcattttctcatttcttttgtagcttagctgacagctggcctgggaggtctcagctgaaggtaaaaacaggctgataccagccagtgggctccagtggcctccttcttcttaaagaagtcatttcgttctaaatcaggagatttccattaggacttaattgcctagatgtatgggggatggattcctttctaagagagcactagcgtttgacagatcatgagtgatttgctgtttctctgcttaagttttctccgcttaagttttctccagtaaaccatagactttatactgtgtggcccttctgttatttgtgtttgtgttggcctgacagctttaactttttttgtattcttatgttccaggtgtgtctgtcttgtaaatagtgcatatagctggcgattcattttttctctcttttgtccatttatattgattgtggctactgatgtattatgatttgtcttagtctatgtagtgttgctattacagaataccacagactgggtaatttataaagaaaataaaattggcaggggaattggctcactcctgtaatcccagcactttgggaggccgaggcaggtagatcccttgaattcaggagttcgagacaagcctgggcaacatggtgaaagcccatctctacaaaaaatacaaaaattagctggccatggtggtgtgtgtgcctgtggtcctagctacttgggaggctgaggtgggaggatggcttgagttcaggaggtggaggttgcagtgagctaagatcgtgtcactgtgttccagcctgggcgacagagtgagaccctgtctcaaaaaagaaagaaagaaaaaaaaaggccgggcgcggtcgctcacacttgtaatcccagcactttgggaggccgaggtgggtggatcacctgaggtcaggagttgagaccagcctggccaacatggcaaaaccctgtctctactaaaagtacaaaaattagccaggcatggtggcggatgcctgtaatcccagctactcaggaggctgaggcaggagaatcgcttgaacccaggaagtggagattgcagtaagccaagattgtgccactgcactccagcccgtgcgacaagagcgagactccatctcaaaaaaaaaaaaaaaaaaaaagaaaagaaaagaataaaaaaggaaaggaaatgatgtcttatagttctagaggcttggatgtccaaggtccagggacccacatctggcaggggcttgttatgaggaagacagaaaggcaagagaccatgagagaaatgtaagggaaggggactaactaatgctttttttcaggaaactactcccccaataacttaacccactctagcaataatggcattaatccatttatgaggtcagagctctcataacctggttaccttttataggtcccagctctcaacactgttgcattggcaattaagtttctaacacatgaactttggggaacatattcaaaccacagcaggattaatttccacgtcagttttttgcttcctatgtgttctgttttgttgttattttttcctttcttgccttcttttgcattgatttttttgttacttttttcttctttaatgttatcagtctgtgttaatttgaatgttatacattctgtattcttgttggtgggggggcccaccctacaaattttaacctgctgccatggtccgaatgtttgtctctctccccccacccaattcatatgctgaaatcctaacccctaaggtgatggcatatagtattaggaggtaaggcctttgagagggcacatgaattggattcatgcccttataaaagagtcagagagatcccttgctccttcaaccatatgaaattatagtgaaaagatggctgtctgtgaaccagaaagtgggcattcatcagacactgaatatactggagctttgatcttacactttccagcctctaggactgtgagaagtaaatttctgtttataagttacctaattcatggtattttgttatagcagcatggacagattaagaagcatgcatattaatcttgaagtcgaaagttactttgggtcaagacagaacctgtaattccatttaccttttcccaatttttatgctgttgtctagagatttagttctgttttgatttcttgtaatcccacaatttacgttcttgtaactctgcctagacattattattgctttatgcagttaatatttgcttgaaattacccatatatttatcattttctttacttaatatttttacagcttcatcagttcatgtttgtttttctgagtgtttatttcattcgagttctcaaagcatagttttattatctttctgtggtatagaattctaagtggatggttaatttcttccaaaactaatgtaatgataatattttactcttgtaatgtctgctttgttttaaattgtgattttgctgtaggcttacatgtctcattatttgcttgatcctcagttgtaacaggatggtagtgatggctgcaggacagtgtgaatgtacctaatgccactaaaccgtacacttaaaaattgtttaaatgataaattttatgtagtatgtttattaccacagttaataagtaaaacaaagtttaagctggttaaagtggcaatgttacttgtgccaaacgcaccttgatttactaatccagccattctgcatcctgaacccagaatggtccacctaaaatatcagactgatcactctccatccagtgatttcctccggcatcactgttaagtccaaactccttggcatggcatataagaaagacattccaggttctggccatggcttacctttacctttaatgctgtccctccccaacactttattataaccttcactgagatcttggttaatgtatagtcagatttgttgtactcaggaaccagcagaatccccatatttgctctcttaaaagagcatttgtggtacaaaaagccaggtgcatgacctttgagcaacccctctgtagccaaagagaaagcccaaagcaataccagagcacatttttctggtaatatagcaaatcagacattcagagaaatcactccctgtacagtccatctaaaaaagttggattaaatatttttaaaaatatatggctaaatcaataaaagatttcaaaaattacatagaaaccagaaaggacaaggatctacaaatccacaaaagtatatgttagtactagagctaatgttggagagttccctgaacctccttgcaggacttgtgacaagggtgggcttggcttgtcttttggctggggtttggggtttataagggtacaggatggagggtgtggcaggccaaaaggcaacatttgggtatggaaacaggaatgcctgttcccatttagggctgtaggttttcaggcttgaggctggggcctttgccagggaactgtcctcttctgtctcgtattttcctgcctcctgtccatattattttccctatggccattgctttgggtacgtatttttccatcctcatgttgatctcattctggtgatctctaattgaaggagagactgtgtcagattactttagtctccctcacttaactttttattgctggcagcttcttgtttctgagtctggtcctgaaagtcagagggatgtacacatttcctggttcactcaattcccaaaggctaacaggcattcatcatatgtgactctgctgggtggaaattgggtcttccgagactcagattttaaaaggtctgtgagtgagttgaagaattaggagcagtttacagttctttgaacttgaaattcaaccttctttctttcttctgctcagagtttttcctgtcttgtactctgttttacagagtcctccttgggcagttacacaccattcaaaccactgccctcctgactcctccctctctccccttgcaagagctgtgacttctgaatggaagtgggagaagatcttgtcagggaggggtagaaggaagggaggaaatctagtcctgtaagactttggggtctccatgcagtgggatgtctggcagtctttttttctggtagatatagctcttgtattttataattaagctcaggcagtggggatggacaaagtattttccacatcttctttgtggttcatgctcctgttttacattgctcgtttgctcacttggccatttattcattcctttgataggatttccgagtaaagcagtatactcttggtcgattgtacttcttggtcaatacccattgatcatgcagttcgtggaagtttgactcagactttgagatatggtctctgattttcagttgatatagttattaccaatttttttagtgtgtttctttacatacattttgttgtaaaacagctggctgtcttgtttactcagcagtctgaagcaagtcattagacagctagcaatatttttgactagactagaatgtgagtaacattttgcatggttaatgcatggttgatgctggttttatacaggacttagcaccttgctttgtgcccattgacattgtgagaggtggtagagaagtaggataaagaggcaggaagtagattggttaattccgtgaatttggagaaagtgacttgtctaattttgtttgtctagggcctaccacagtgcctggccaattttgggccctcaaaagatgttggttgaatgaattaaatagtgaacaaacaaatgactgagtgttaaaagaagtttgttcttcaatggggaggaagtagtaagccttctgatgatgcagtcaggctatattgaaagtcaaataatttttagttggcagtttagggagtgattctttctggatgttgaatgtgatggcttctattttgtgtaaacattaaaatgagcgagcaaatagaatattttaaagacccatactgaataatgttttatttatttttacatttattcttgctccccagtgctctagagagttgtaaagaggtgtgacctcacatcccatgacttaattctcccttaggacattatttagatgtgttttatgatatttgttttatgtggagagatgctttttgttagagttgtctgaattcttttgcagggtgttttttcattttcaaaatgcaacaccaaatgaagttgcttcagaaattcttcttgtacagtagtgttatttacactcaaatcaaaatggtttgtggcagttatgcagttatatttgtaactttcctaaaacatataaatgtgtcactgtatcattaatttagatgactcaagatgacactaaaggctgtaaattgccttctttgtcagtgattgagatccaaatgataaattcttagtgcagtttgtttataagctctcaaaaaggcagtaatcttatcttctaaaccttatcttctaaggatgctagttagcatccttctttaggaaaaaaactgtggttttcacatgtatagcattacaaaaaaaacctcttgaaattaagatgttttctgactgaagtgcatcacgcactaggtgatcatacccattcacagaggagttacaacacattttttattattcactgtcattgttcacactgaagaaaagggcagtattctgagagttctcaggtgaagtctgacgctcccagacctaggggaatgtctttacctagagagtgctgctgagtggttaatgttgaaaaagaagtccctttcttgtaatgtcttggttctccaccaggggcggttttgtcccctaggagacattttgcaatgtctgcaggcatttttggttgtcacagctgggggataggaaggcacttagtgggttaaagccagagatggtgctaaacatgatacagtgctaaggacagcctcccacaacaaagaattacctgatcccaaatgcttagagtggagagattgagaaaccttggtccaatgtaatatgagatttcccccctaaattagtagattgaggggagactttattattccgttctgtttttcatattgtgaataagaagcagtagagaaaaaagcagtcatttcttatcactgctaggctacccttcttgattctgaaaaccataggaccatagggcattcaattaaaaagaaaacaaacacagatccttaaatccatcaacaacaaaaccaaaaccttccctgactattctctagtagatactttgaggctcaaatttatttacaaagtaatggaggagagtaaaattgtttgacgtctgttttacccaagtgaggccatctgtattcagtgatggaaataggatctgacaagaggggaggttctgttctaaaattttcttaggtgaagttgttagttttcaagatgactttatcatatggatatgggaagtgattctgtagagacagtacagttatccttcggtatccctaggggattggttccaggacttcctgctgatacccaaatccacagatgctcaagtgccttttattaaatggtatagtatttgtatatagcctttgtacatcctcccatatgctttatccctaaattccttagaatatctaactctgtgtaaatagttatattttaaaatttgggctgggtgcggtggctcatgcttgtaatcccagcactttgggagcacaaggtgggctgatcacttgaggctaggagttcgagaccagcctggccaatatggtgaaaccccatctctactaaaaaatacaaaaattagccaggtgtggtggcgggtgcctgtaatcccagctactctggaggctgaggcaggagaatcgcttgaacctggaggcagagattgcagtgagccaagattgtgcccctgtaacccagcctgagtgacagagtaagactctgtctcaaaaaaaaaaaaaaaatttgtgatatttttaattgttgtactgttttttatttttttgactatttttgcttcatagtaggattgcaggacctatggatctggtgggcccactctattctagaaaattagtaattctggattatgtaatgcttgctatgctagcaggatttactgttatagtaacagcaatgattccagacagttcctggtagtagatatcttacatgctaatgatgagtagctggcagttgagattatcaaatgatgcctctggcctgctctccatggcagacagagccagccattaaaagtcatccagtcgtgggaataaactagactgccccttcccccagtactcttttcacctaggatttcctgtattgcgtttaaggatttcatgtttgaaatccacgtgtctcatttggaaaaagcttttcctgcctttaatttagtataaagtaaaataagaaaatgattgaaattatgaggatcaagaaaaaataaaataaattaaatgaaaagtttcagtttggctcctgttgaaccctatacagtgaagttctctggaaccctctgcattcctccagagtcctccctggcttgatgctctataattgatttgtagctcaccatcttccaacttcctaagtattttagctgtgctgttttggctaaaagtaataacatttaaattctcagttggctgaaagcatctataaggttatattagagaagttttattaactcatataacttccctttttaatggatgctatatatgtgtatgatgtgacattacatttaggggacgaatgaaaagattaggagtgttaaattagaggacaggctcttttttatgtattttaatttaaaaaatatttttgtaggtatatagtaagtgtatatatttaggacagtctctctctctctctctctttgtttttgtttttgagacagagtttcgctcttgttccccaggctggaatgccatggtgtgatcttggctcactgcaacctccacctcctgggttccagcgattctcctgcctcagccttccgagtagctgggattacaggcatgcgccatcatgcctggctaattttgtatttttagtagagacggggtttctccatgttggtcaggctggtctcaaactctcaacctcaggtgatccgcctgcctctgcctcccaaagtactgagattacaggcatgagccactgcgcctggccaggacaggctctcttaaaagtgaggttaccgccactacttttattcttctgtatacaccattgtaaaagctgcgtggttctgagggtggaagtggagtggaaatacgagttgaaggagaaaaaagaacaatgtaaagtctcttgctgttagtaaagaacttgttcatgtatttaaaaaaattttttttttgttttattatacttaaagttctggagtacatgtacagaacgtgcaggtttgtttcataggtatacacgtgccatggtggtttgctgcatccatcaatctgtcatctacattaggtatttcttctaatgctattcctcccctagccttccaccccatgacaggccccagtgtgtgatgttcccctccctgtgtccatgtgttctcattgctcaactcccacttataagtgaaaacatgtggtgtttggttttctgttcttgtgtttgtttgctgagaatgatggtttccagcttcatccatgtccctgcaaaggatatgaactcattcttttttatggctgtatactattccatggtgtatatgtgccacattttctttatccagtctatcattgatcggcatttggtttggttccaagtctgctgttgtgaacagtgctgcaataaacatacgtgcgcatgtgtctttatggtagaatgatttataatcctttgggtatatacccagtaatgggattgctgggtcaaatggtatttctgtttctagatccttgaggaatcaccacactgacttccacaatggttgaactaatttacacttccaccaacagtgttaaaagccttcctatttctacacatcctctccagcatctgttgtttcctgactttttaatgatcaccattctaactggcgtgagaatgtatctcattgtggttttgatttgcatttctctaatgaccagtgatgatgagctttttttcatatgtttgttgtctgcataaatgtcttcttttgagaagtgtcagttcatatcttctgcccactttttgatggggttgtttttttcttgtaaatttgtttaaattctttctagagtctgggtattagccctttgtcagatggatagatcacaaaaattttctccctttctgtaggttgccagttcactctgatgatagtttcttttgctgtgcagaagctctttagcttaattagatcccatttgtcaattttggcttttgttgccgttgcttttggtgttttagtcatgaagtctttgcccatgcctatgtcctgaatggtattgcctaggttttcttctagggtttttatgattttacgtcttacgtttaggtctttaatccatcttgagttaatttttgtataaggtgtaagggagcagtccagtttcagttttctgtatatggctagtcagttttcccaacagcatttattacatagggagtcccttccccatgcttgtttttttcaggtatgtcaaagatcagatggttgtagatgtgtggtattatttctgagggctctgttctgttccattggtgtatatctctgttttggtacccataccatgctgttttggttactgtagtcttgtagtatagtttgaagtcaggtagtgtgatgcctccagctttgttctttttgcttatgattatcttggctatgtgggctctattttggttctatgtgaaatttaaagtagttttttctaattctgtgaagaaagtcaatggtagcttgatggggatagcattgaatctgtaaattactttgggcagtatggccattttcatgatattgattcttcctatccatgagcatggaatgtttttccatttgtttgtgtcctctcctatttccttgagcagtggtttataattcttcttgaagaggtccttcatgtcccttgtaagttggattcctaggtattttattctctgtagcaattgtgaatgggagttcactcatgctttggctctctgtttgtctattattggtgtataggaatgcttgtgatttttgcacattgattttgtatcctgagaatttgctgaagttgcttatcagcttaaggagattttgggctgagacgatggggttttctaaatatacaatcatgtcatctgcaaacagagacaatttggcttcctcttttcctattcgaataccccttatttctttctcttgcctgatggccctggccagaacttctaatactgtgttgaataggagtggtgagagagggcatccttgccttgtgccagttttcaaagggaatgcttccagtttttgcccattcagtatgatattggctgtgggtttgtcataaatagctcttattattttgagatacattccatcaatacctagttttttgagagtttttagtatgaagggctgttgaattttatcgaaggccttttctgcatctattgagatagtcatgtggtttttgtcattgactctgtttatatgctggattacgtttattgatttgtgtatgttgaaccagccttgcatcccattgatgaagctgatttgattgtggtggataagctatttgatgtgctgttggattcagtttgccagtatcttattgagtatttttgcatcgatattcatcaggaatgttggcctgaaattttctttttttgttgtatctctgcctggtgtcgggatgatgctggcctcataaaatgagttagggaggagcccctttttttctattgtttggaatagtttcagaaggaatggtaccagctcctgtttgtacctctggtagaatttggctgtgaatccatctgttcctggactttttttggttggtaggctattaattactgcctcaatttcagaacttgttattggtctattcagggattcgacttcttcctggtttagacttgggaaggtgtatgtgtccaggaatttatccatttcttctagattttctagtttatttgcgtagcttgtttatagtattctctgatggtagtttgtattgctgtgggatcaatggtgatatcccctttatcattttttattgcatctatttgattcttctctcttttcttctttattggtcttgctagcagtctttttattttgttgatcttttaaaaaagccagctcctggattcattgatttttcgaagggtttttcatgtctctatctccttcatttttgctctgatcttagttatttcttgtcttctgctagcttttgaatttgtttgctcttgcttctctagttcttttaattatgacgttagggtgtcgattttagatctttcccactttctcttgttggcatttagtgctataaattttcctctaaacactgctttagatgtgtcccagggattctggtaccttatatttttgttctcattggtttcaaagaacatctttatttctgccttaatttcgttatttacccagtagtcatacaggagcaggttgttcagtttccatgtagttgtgcagttttgagtgagtttcttaatcctgtgctctcatttgattgcactgtggtctgagagactgttatgatttccgttcttttgcatttcctgaggagtgttttacttccaattatgtggtcaattttagaataagtatgatgtggtgctgagaagaatgcatattctgttaatttggggtggagtgttctgtagatgtttattaggtctgcttggtccagagccaagttcaagtcctgaatatccttgttaattttctgtctcgttgatgtatctaatattgactgtgagttgtcaaagtctcccactattattgtgttggagtctaagtctctttgtaagtctctaagaacttgctgtatgaatctgggtgatcctgtattggaggcatatatatttaggatagttagctcttcttgttgcattgatccctttaccattatgtaatgctctttttgtctcttttgatctttgttggtttaaagtctgttttatcagagactacgattgcaaaccctgctgttttttgctttccatttgcttggtaaatattctttcatccctttattttgagcctatgtgtgtctttgcacatgagatgggtctcctgaatacaacatactgatggatcttgactctttatccaatttgccagtctgtgtcttttaattgggggcatttagcccatttacatttcaggttaataatgttatgtgtgaatttgatcctgccattattatgccagctggttatttttccagttagttgatgcagtttcttcatagtgttgatggtctttacaatttggtatgtttttgcagtggctggtacctgttgttcctttccatgtttagtgtttccttcaggagttcttgtaaggcaggcctcatggtgacaaaatctctcagcatttgcttgtttgtaaaggattttatttctcatttgcttatgaagcttagtttggctggatatgaaattctgtgttgaaacttcttttctttaagaatgttgactattggccccactctcttctggcctgtagggtttctgcagagagatccactgttagtctgatggacttccctttgtgggtaacccagcctttctctctggctgcccttaacattttttccttcatttcaaccttggtgaatctggcaattatgtgtcttgaggttgctcttatcgaggattatctttgtggtgttctctgtatttcctgaatttgaatgttggcctgtcttgctaggttggagaagttctcctggataatatcctgaagagtgttttccaacttggttctattctccctgtcactttcgggtacgccaatcaaatgtagatttggtcttttcacatagtcccatatttcttggaggctttgttcattccttttgattgttttttttttgttttgttttctaatcttgtcttcatgctttatttcattaagttgatctttaatctctgatatcctttcttccacttgattgattcggctattgatacttgtgtatgcttcaggaagttcttgtgctgtgtttttcagctccagcaggtcatttatgttcttctctaaactggtaattctagttagcaattcatctaacctttttttccaaggttcttagcttccttgcgttgggttagaacatgctcctttagctcagaggagtttgttattacccatctctgaagcctccttctttcaatttgtcaaactcaccatttttgttcccttgctgctgaggagttatgatcctttggaggagaaggggcattctggtttttggaattttccgcctttttgcgctggtttgtccctatctttgtggattcatctacctttggcctttgatgctggtgacctttcagtggggtttctgagtggacatcattttgttgatgttgatgctcctcctttctgtttgttagttttccttctgacaggcccgtgtgctgcaggtctgctgaagtttgctggaggtccagtcgagaccctgtttgcctagggatcatcagcagaggctgcagaacagcaaagattgttgcccgttccttcctctggaagctttgtcccagaggggcacccaccagatgccagccagagctctcctctatgaggtgtctgtcggcccctgctgggaggtgtctcccagtcaggagacatgggtgtcagggacccacttgaggaggcagtctgacccttagcagagtttgaatgctgtgctgggagatgtactgctttcttcagagctggcaggcagggacgtttaattctgctgaagctgcacccacagctgccccttcccccgaggtgctctgtccctgggagatgggagttttgtttataagcccctgactggggctgctgcctttctttcagagatgccctacacagagaggaggaatctagagaggcagtctggctacagcggctttgctgagctgtggagggctgtgcccagttggatctttcccggcatctttgtttacactgtgaggggaaaacggcccactcaagcctcagtaatggcagatgcccttccccccaccaagctcgagtgtcccaggtcagcttcaggttgctgtgctggcagcgataatttcaagccagtggatcttagcttgctgagctccatggggttgggatccactgagctagaccacttggctccctggcttcagccccctttccagggcagtgaatggttctgttttgctggcgttctaggggccagtggggtatgaaaaaagaaaacactcctgcagctagctcgatgtctgcctaaatggccgcccagttttgtgcttaaaacccaggtccgtggtggcataggcaccggcgggaatctcctggtctgtgggttgcgaagaccgtgggaaaagcgtagtatccggaccggagtgcactgttcctcaccgcacagtccctcaaggcttcccttggctaggggagggagtttcccaaccccttatgcctcctgggtgaggcgacaccccaccctgtttctgttcgccctccttgggctgcacccactgtctaaccagtcccaatgagatgagccgggtacctcagttggaaattcagaaatctcccgccttctgtgttgatctcactgggaactgcagatggagctgttgctattcggccatcttgccagcaacccctcttcatgtatttttaaaatggttaatggtgagtgttaaaatgttgtggtgtttagattttgttgaataaatttaaaagaaagatataatgattttgtttcaacatgtaaatatttatagtatgctagaaactatgtcctttataattttcaatggaaagttttagatgtgaaattaaaaagtacataattttctcaaaaaaatttaaagaagtgtgtgagtgctttgaaaaagccttttttgcctgtagcccaaactagaaaatagatttcttattataacccagcacaggcacccaaatgcgaaagtttataaagcattagttaccatgtataatgctctcaatctttttgccttctttccctcttcccctactttttttttcttcctatttcattccattaaaaaaaaaaagtctggtcttgacctgctaaattgtttacttccactcaagggttggaacttgcagtttgaagcaaacacctaaatctaagatagttttttctttctttgtttttctttcattttttaaaagtctgagcataaataagagaggtggaagtaaaatttatgttaatcaatttaattaattagtttccaagctgttctgtggagctgaaaagtgacatcagtttaaatgtcttctcttgcttatcctctcaggcatctgtacctcttccccattacaccaatatcaaaaactacaaaataaaaaacctaggtgggacggaaaaacagggggagagtctttatgtaatactaattagtagtctaactgatactaaaggataaattttaaaagaggattaaatcaggtctctactatgaatctaaaatctgttaaatactgaacttgttaattaaggagagaactagtgagatactgcaactggttcaaaagagaactcaaagcctcatcacacactgataggcaaataaggaatgtaaaatttataaatggatgcaaaattggttagtatccccggggcaataacgaatgcattttaccagaagcatttttatggataggaattacatgcatgactatcagttttatacaactgatctcctattcctacagatttataaaatagcctagtcaaaacaagcaaaggtgggaataacctgaatgggtgagctagccaggaaatctactgaattctaaagtattaaacaatttttccttctactgattagatttaggctattaattcctaacctaggtctaaaacactttgccacctgaaggccaagtccagttttagaggatttctaccatctgcacagtatttgtaaacatcgtgaatttcttgctattatttaaaacctagatttttacataatagctggatttccagtttgtcttggaaaatcagattgaaatggaatttactattattttcttctcttaagataaagtcccctacttttccttttcttattcataataccacttttccatatcatttctgtacatcccttcttttctcattcaaacttcacccatcttaatccagtcccgtttcagtacaactgtcttaacttcttggctccaggctcttctcagtctctctagcatgctattttacatttaatctctcttaaatactttgctcaagactccagactgcccagtaatgtccaacaaatcctgttttgccactctgaatatgctgacactttcctgacgcttacaactcttcagtaatttatttcttcccttcttttgcagtcttgatttctgttgcttatctacatggttccttcctctagtgaggttaatctctttgctttcctctatacccactatgctttttgttcatgttgatccttcctacaggaaaggccttccttctcttctttgtttatacacatcagatgaagttaaactcaaggctacctagtctgcgcagcctaccagagttctaattcacattgatctttctggaatgttttatgctttctagcgttgttttaggttgtgtattcttatcactcaagattaaagctaccaaaagcatggcctaccttcctctgtactgtattggtatctctgaggagaaattagtaaacttgttgtctaaatttttatatttgcataatcatgcatttcactgtacaaaaggaggaaggttaaacatcgttcaggattttaatttttcagcactgtgaaatttacatatttattgtatttggaataaaatgtgtgtgggtgatatatagatatatatatatacacacacacacacattcatacacatgtatttacattattctgtctatagacagtagctgcatcaatcacacaggaattttagtctatttgatatatttacattaactagtagtctgttgaaattcaaaggagataatcaaattgagaaaaccatgttgcctaatccttttgtcatggataatattacttaaaagggaagccttggagtaataggaaaaaagaaatatattctagtgctctcctacctctattctgaacaataggatctgccctgctaagcaattaggcaggcccttttatacgcagtctgtgtataccattaaaagtcaatacagtgtccttttattttctagttttgtgtgatgcatgcagaaaagaaacattttgctttttatataaagactgtccctgtaacacaaagtgggttaagagatttgagacaattttcccaataattgtgaactaaaacttacatgtgacatctaattgtgtcaataaatttttaaagaactttattgagattggatcagtaacacattgaaaatatacaatttgatgagttttgatgtgtgcttatactgctgaaacagtcactgctgtcaagataatgaacatacccatcacttccaagagtttcctgctactcccttgtcatccctccttcctttgttccctctgtgttcctcccctccccaggcaacctctgatatactttctttcactgtacactagtttgtatttttgagaagcttatataaatggaatcatatagtatgaacttttatattgtctggcttctttccatcagctttttttttttttgagatcgttgcatgttgtagcatgtatcactattttgtttcccttttactaccgaatgggatgcatatggcagtttttaaaaatccatttacctgttattggacatttgggttgtttccattttttggttattaaaaaaaaagttgttacaacatttgtatacaagtgtggacctacgttttcatttcctaagggctaagttatatggtggatatatgtttatgtttttaagaaactgccaaactgttgtccacagtggctgtaccatattacccttctaccacaagtgtacaagagttccagttgctccatatctttgccctttgccaacacttgggaaagtgttttttgtttgtttgtttgtttgtttgtttgtttttgtagatagggtctcatagccctgtcacccaggctggagtgcagtggcatgatcttgcctcattgcatgctcgacatcctggtctcaagcaatcctcccatttcagcctgccgaatagctgggacctcaggcacacgccaccacacctggctgatttttgtatttttttgtagtagagatggggttttgccacgttgcccaggctggtcatgagctcctggcctcaagtgatctgcctacctcagcctcccaaagtactggaattacagatgtgagcccctgtacctgaccggggcaaatctttttaattttaaatattttaataggtatataatggtatctcattgagattctaatttacttttccttgttgactgatgatatgggtcattttccttgtggtggtttgctgttcatgtatcttgctaggtgaagtggctgttcatattttttgcccggtttttattgagctgttttttcattattgagttttaagagttctttatatatcctttatatacattatttatcaaatatgtgatttccaggaattttctcccatttttgtggtttggacagatgaatttatttatttatttattgtttgagacgaagtttcactcttgttgcccaggctggagtgcaatggtggggtctcagctcactgcaacctccgcctcccaagttcaagtaattctcctgcctctcagcctcctgagtagctgggattgcaggcgtgcgccaccacatccagctaatttttatattattagtagagatggggtttcaccttgttggctaggccaggtctctaactcctaacctcaggtgatccacccgccttggccccgcaaagtgctgggattacaggcgtcagccactgcgcccggctgacaggtgaattctttatcccccacctgtatagaggtagctccaggatccctgagtattaagatgcattataggttgggttctagctcagataggtaagttgccactagctaataatgggtttttgagaataaaatttggtatgtttcctgtttataaatgtaaaatttgctcattgtagacaattgaaaaaaatactgaaaactacagagaaggaaatgagactggagtattcttgggaactccaggcggaagtccagctgtcaaggccatgcatatcagaagcaagagtgcttagagcttaccgcatactaggcttggggcagcaggattatacaggtcccttccacttaaattactcttaattctgctaaggattgcctcagaaatatgatgggcagaggttgcagttttttttccctaaatgtaagttcactgctacacctacagttttggatcattgtctggcctatccacttaatgaatgtttatattataaaagtatgaagtaagtgaaggtcttcatagatgttgtgcaggtagtaaatgtcttcacagcatagagctgagcaaggcttgggaaagtagggactgacaaagacagaaatggaattaatcaaatgtatttgactaacattgagaaatattatattaaagaaagtccaacacagacgtcctaagtgttaagtgtttctggtctctgctgctttactgatgaaaagcattcagttttggtgccaatagaatttggtttaagattgtgctctactctactagctatgtaaacttggaccaatacttaacctagtttttcacttcagttcttttttgttcatttaacacagggtcttgctctgtcacccaggctgcagtgcagtggctcactttcacccccgccttctgggctcaagcagtcctccaacctcagcctcccgattagctgggaccacaggcacacaccaccacagctggctaatttttttttttgtagagacacgatttcgtcatgttgcccaggctggtctcaactcttgggctcaagcaatttgcctgcctcggtctcccaaagtgctgggattacaggtgtaagccaccatgcctggtcctactttacttcttttacttacacaatgtgaataattgtgtatacctgtggggctactgtaaggattataggagatagagcatacagtagtcccccttcttatctatggttttgatttttttactgtttcagttacttatggcaactaagtaaaaaaatttatgagtacagtactataaggttttaagagagggagagagagggggaccatattcacataacttttattactatatattgttatagttctattttattattagttattgctaatctcttagtgtgcctaatttataaattaaactttatcatagatgtgtacatacagtaagttctcacttagcatcatggatgggttcttagaaactgactttaagtgaaacaacatgtaatgaaaccagttttaccataggctaattgatataagcaagagttcatttcttatggcatatttctggtcctaaaaacatcaccaacttctaaataaagataaaaacttttctaatgttaaacattgaaatgaatgttagtgatacatacatttaagaaatattaataaaacaagtaagataattatttacccaattattctagttaagtgctacagctggccagaggctcttctggcagcttaagccctcaaggcctcaggaggaaccagctctggacaggaaaccactctattgcagggcactcacacacccacccacactcactcagaaaggaaccatgtagacatgccagtccacctaatggacatagctttgggatgtgggaagaaactggagtactggggagaaaacccacacagacgtagggagaatgggccaactctacacatatatagacagtggccccagctgggaatcaagtttttttttttttctcatcagtattaaaatgaagcaacattacttgggggaaccttttgtataggaaaaaacatactgtatatagggtttagtactattgttggtttcaggtgtctacttgggatcttggaacatgtcccccatggataaggaggaaacgattgtatacggtattttgatatagggtctgacacactgtaggaactcagtaaatgttagtggcatttgtagttattccccttcgcctttccagttactagtcttaggcagggtaactaaatcttgctgtacccctcatagaggggagatctaagaatggtatttgccagtccttttctccactgtaggttacgtttttataccactgtgtgtttttgagtgatatgaaaagaatatcatgggattaagataagctgatggcagattttagtgctttagcatatgttcttttcaggcatggaggggattactcaagatacatggttagactgaccttaggtacctagtggcatgagtctttagcatcagcagcagtattgatcatacaagggaatcccaagactcttattgtaaactaggaagcatgttcccacagaacaacatcttgaggtggactgtagtaggggaaggagttaagttggtggtcagattggtggagtgatagacacgagggtgactgatgcctttgtaataatttcggaactgtctgaaattatccaaagcaaatctttgttgccattctcagttcttttctatagtctctgcctcctttgccttattcctgacctgtttttttccatgcctacacgtttcttgacttttggagcctaaattatccctccttctataatatatttgggatattataatgttctgatgtttggaagtgacagattataatgttatgctttgccagtaagtcatgctatgtaacagactgctgcagccagtgtgtttaaatttgatgttttaggtcattaaaaattttaacgtttcacttaattacttgttataaattccatacacaatacttgggttaaaaacaggttgtttgttttcttatactacacttgagtttagtctggcttttataacaacttaaacttttggggttggagaatgacttattaaaactacttttgtgatatccgtgtttgttccatttctgacttgtggccagacatcaaaaggcattggaaatttgagtccttctgttaaaagactgttattcatatgttagaagaggagccacttcgtaaagggtctctctatatatacaaaagttcttgtagcactctaatggcatgtggcacagtgaacaaggcaagtcacatggccacatctaactccagggagggaagagaaaactgtcctattatgtctccataaaacagagctggtaaacagccctaacgattcggtggttctcatttgtgttcaccatatattcagatctgtctctctactactataggcaaagtaactcacccctccccaaggcagtctgtctcattgccccattcagatatagcatcatgctcaaagttcagtgcctctggctgatacacaagagtctgttcatcatgttcagatgtggtactcttggtctggagacttcatgaactaaaaagacaagtaatctgcccctcctttacccttacaccctggtggaactggtaagcataattgccaaaaccactcccatttacaaaggcgaacaaagggagagagagaacagtcaaaagttgtagcaattctgcaattccacagtagaattttgggggacccctatcttgggcccaagaatgttccttaattatgtccagattctgcttcctgggagaggctcctccatccattgtcttccatgccattggcttcaccctgttggaattttttccttttcggtaacttccttggctacaacggaaatgggcactgggcctccttgggggctgaacagttttctctggcagcttcttatctgtagaaaattggtgtctaagggttgttttaagcattcaataatcatattactctttgaattgagaccagattatttttgcagtacaactctcaaaaattttgttggtttcttatctacttaactttagtcagcttcgtgtgtcaatagccagacctaaaatttttgctagatgtaattcttagatttcctgtatttcttatctttttcacctctgtgcatgcccccctcttctctttatttatttgaggatatcttggctccacaaggcttcagttggagacccacacccttagtctcttttttctgaaccgttttatcccaagagaaagaatttactgagtgccacattagtctacactgaggttttaatatcagctatataccctttatttgatccttagctgaggctgagttttaattagctgttgttccttaaaggccttctcagttttgtttttaactgttcgaggttgaaaagtagttgccttttccaattgtgtaagtcgtttaatttgaaatctattgtcttacatttctgcttgcaaaccaattcttttctgacctcattttttccttgtgggggtttccctttatcttattcagttactttttttcatttgattccttgtcttttcatccttttcttttgctttttcatctaatcttgtttttcaccagtttcattagaggccatctctccttgctctctatagagagtgccaaactgttttcaaacttttcttttgtatctattactatatccagtaagcactttctttaaggatttcagaagctgttccttttttctaattagaatgttttcttcttcacatgacttgtgtttttcttctccattttgaattccttttttaaaagtgaaatctgccagatatgttttctagcaaccaatagattccttttaccattcacttatgttggggttcatatccttctctgatctacaactcaggtcaggccaaccagcacaaatcccagtataattttcagttgctagaaggctttcactcacattaaatcctcaccctcccttcttggttttctgctatgggtgaaatatatgaaaactaaaacttggagcacttgctgccaccaggattattctttgctttctcttttatttttttggcttgtaaggaactgtcctcagaatcctatgtgtccttgcaagtacccttcaactttctccccagttgttttctagaaattgttggcctacttgaatgtataacaatgggaatagtaggaaaagagggttgtgtatgtgtgcttgtatttgtgtgcgtgtgagcatgtgtgtatgagggatggtcacaataatctcaccaacgcaaggatttgcactgatgggaatttaaagttggctgcaattttataatgggtactgatatggtttggttctttgtccccacccaaatctcactttgaattgtattaatgcccatgtgtcgagggcaggaccaggtgtagataattaaatcatgggagccatttcatgttgttctcgtgatagtgagtgagttctcatgagatctgatggttttataaggggcttggcactcattctctccctgtcgtcctgtgaggaggtgacttcccctatgcttttaagtttcctgaggcctccccagccatgtgaaactgtgagtcaattaaatctcctttctttataaatcactcagtcgaggatatttcttcatagcagtgtgagaatggactaatacaggtacagtgcttgagtgtctcaattaggtaaccatcagtaggggatgtttgatgtgttttcttttctccagtggccttagtcttatgaggcttaaggtagtcacaacatgacaagaaacctggacaggtctgtttattttattttttcctatcacccaaaccagtgtctgttttatggttagcaagatccttccagattctcgtgttatctgttgatttgagttttgtatgtagggatttcctgggttattttctgaatcttcagaacttgagagaggttgcactgtgaacttcaaaggatacaggagtttaaattggaagatcattttctagctttgtcggctgacatctagagaaggctcatggttttacatgtggccatagaattcctaagagtaactattgttatatcgttatgctgaactttttgctaaaaagggtaagagttttacagttgcatctgaatttgacattgtgtaatgtttctatttcaggtagcagcagcagcagcagcagcagcagcagcagcagcagcagcagcagcagcagcagcagcaatgtttcacttcttcagaaagcctccggaatctaaaaagccctcagtaccagagacagaagcagatggattcgtccttttaggtgagtctttttaagaaacaaaataattagatgaattatgttctctttaaaaaattacttgaaaattatatgattgattttaaattatttcttataatttcagaattaatttatgtgtttaatttttaaagcgtaaaatctgtaaagatgaaagtcatcaattacttggaatagtgtcatcaagtgagacttttcttccgtgttgatttggctgtgttctccaagttaaatgtgtaaaatcacttctttttccccccctttttttttttaactgtggaaaatctaaagtcttcaagaatccttgatgaattcaagttctgtcttataaatagtactaaccttgtttcataaattagcatctgaaattaaattaggcatccaataaatatttgctgaatgaagtagactttaaaatctaaatatgttaaatagtgtttcctgtttaagactattttctattataaaattaatacctgcaaattttaaaggttttagtgtctttaaaaaatatttcttacaatcaaatacagtgttcttcaccaggggagttctgaaaagtaaaatttcctccatgtcatgtcacatttcttcccctgaggaaaagttttgcacaacatctttgtatgctcttcccagaaattctctttccaaagtatggtgtggggtagtcaaacccagtgtttccttgtggttctcatccttttccatgctggacctcctcccaccaaattcctactccttctctgagaagatttgcattaactcatatggtcttcactccctggaatgtttctctgggtctccttttccagatactggtttcctacctcttacttcctttatcttggccccatcagactggcatctgctagcatcagccaatgctctgtaggctttgagaaataagggatgtttcccttagatttaagggtaatctctgtgagaccagaatagagtttttctcgtggataaactttactatagaattttccatcatttctacagccatgttctggcaggcctgttgtttttgagaacctgtcttgtatgtccagggacaggagcagtagctgggaggttgctcagaattgttttcttcagaccagatcccttatacctgaggtaaaaatagtggggcttagtctttgaccagggctgatgatttttctgggtagccttctgactgggataaggtagggtgcagtggacttaattgctaatatgacccttccttcatagtgtgtcaggaatttatgccttggcttccaagtcagaactgactctgttaactccgattttagttccttgaaagctgccagtgttacttttttcacacttcttgaattagcctcgctaacagaaaacttcaggggtacatcaggcctcctgtgaagtttctctttttcaggagtttcacaataaattcttctctcagaattttttccaaaaaactcttgttttccactctgttatatattcctgattttaaaatacctctgaagtcttaacacatatacagggaactctgcttttttctgttgtttttattatatatgtatttaaaattttttttaaaattatttttaaagaaaatagagatggggtcttgccatgttgcccaggttggtcttgaactcctggcctcaagcaatcttcctgcctcggccccccaaagtgttgggattacaggcatgagccaccacgtccagcctcttttctgttgtctttatgattagaaattgacattattctttttgttatcaaatagccatttagaggctgtaagttgggtgtactggcatctttgaaagcacatagaattcctaatgctggaccttaaactttttattcatctactttatccctacttctctgccactttgtaggatttctgagacaaattttaaccaccactgcagtggctcctggtgctgctaagatctcctccaatttctggtagcatgtagtcctgatgagacattccattgcatgtcttgtagctatctcagtagaagcccagtttccagggccttctgcctccgagtattatctactatggatctcctttccctttccaggaaagactagtttaagaagtagtctttctttaactgagcctcagaaggcacacaaacttccaaatttcgtattttaagaaggaatttccgggacctaattactctaatatgctctcagtaccagctgctccatctgagggaattttcccaggaccatcttggactagcataattggtgtcgtacccagcaccatatgtctagcagttgaacagtcatggtgaggaatcacttccgtcgtagttccaggatagcagtttaatttgcagtgcagctggtgctgtacctggttcaaatgacccaaacaaatcaggtccgccagatgttggctgaggcctcgttgcccttcagctcctctgtctgctgatgcttgtctctgtttagcctcatttccccccaggtgcaaagctccaccccttcaccattttcataaaatcctctgtacatagtcttctgtgggtaccattactctcctgaagttttgatggtatcagtcagcatcatgtctcagctcttacttcctctgtcttcgttctcttttcatcattcatcccctcttccttcttccgcagaagcatctcagaggctctccagtgacgtgctgttaaaagtgctgaccctgggtcagaccctttgggttggcttcgtggctccacgacttactctctacccttggcaggttagttacccttcccagtaccacttagcatatctaggaaatgagcacgatatcggtacctaccccatgaagttattgaggggaataaatgagttaatgtgtgtaaaatgtttagaaaaaccctgtgagtgaggtagtactattatatcaccatacacaggctaggatttaatgtttccaagtttctccagttagtatgtagcagatctggaattagcccaggcaatctgacttcagaacctatcctctaaaccactgaactatccatctttttgtaaaaaaagttatatcatcagttttaattctaagacattattgacatcctaacctctttgttttttaaaaaaagttgtattctctacaattgaaaagagaaagtgctgttttttatttgttttaataaaagaaggttggtggttgtaatactgttcataaagtttggcttttattttggctaacccaaactttttactatttaatagtttaaatgtttttaaaatattttaaaatatttcagaaaactccttgatgaagttgaaattggaagttggtatatatggtttaattagtgaaaacatccttcagtggtgaagaacttaactgaattgacagataaagatcttgacagattattaggaatatagttaattgtctttaaagttatagttaattatcaggtaaactcttttttaaaaaattgatttgctctgctaggtttctctttttattatatcattctatactgacatatataatatctactttagtctcagagcatactgtataaaatattctggaaaaagtcaagtagatcaaatggtaaatagaaaatgcttttaatgcttttattaacatggacacatacttgcacacatctgttttgttttaaattttttatttttaatcattatgggtccgtaatagttgtatatatttacagggtacatgtgatgttttgacacaggcatataatgtgtagtgatcaaatcagggtaattaggatatctatcacttcaagcaattatttctttgtgttagcaacattcaatttccactcttttagttatttaaaaatatacaataaattattgttaactatagtcaccctattgtgctaccaaatactagatcttattccttctatctaactgtatttttgtacccatcatccatccccattttatttccctctttctgctacccttccttgcctttggtaaccatcattctattctctatctccatgagttcaatttgaaaaaaactgagctccctcatatgagtgagaaaatgtgaaatttgtctttttgtgcctgctttatttcactttacatgatctcctctagtaccatctatgttgttgcaaaggacaggatttcattctttttttatggctaaatagtattccattgtgtatatgtaccacattttctttatctattcatctgtttttttgtttttttttttttttttttttttttttgagacggagtctcgctctgtcgcccaggctggagtgcagtggcgggatctcggctcactgcaagctctgcctcccaggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatctattcatctgttgatggagacacttaggttgattctatatgttggctattgtgaatagtactgcaataaacatgggaatgtggacgtctctttgatatgctgatttcttcttttgggtatgtacccagcaatagaattgctgtatcatatagtagttctgtttttagtttttttgaggaatctccatactggtcttcatactggctgtactaatttacattcctgccaccagggtatgaggtcccttttctacacatccttgccagcatttgttattgcttatcttttggattaaagccattttaactgggttgagatgatatctcattttgattttgatttgcatttctctgatgatcaacaatattgaacgtttttttaatatgcctattggtcattttgtatgtcttgagaaatagctattcagatatataaaaaaatatatttatatattatttaatatatatttaattttatataataaatatatatttatatatttaatttatagataatatatatttatatatttaatatagataaatatatttatatacttaatttatagataaatatatatttatatacttaatttatagataaatatatatttatatacttaatttatagataaatatatatttatatacttaatttatagataaatatatatttatatatttagtttataaatatatatttatatatttagtttataaatatatatttatatatttagtttataaatatatatttatatatttagtttataaatatatatttatatatttagtttataaatatatttatatatttagtttataaatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttatagataaatatatatttatatatttagtttatagataaatatatatttatatatttagtttatagataaatatatatttatatatttagtttatagataaatatatatttatatatttagtttatagataaatatatatttatatatttagtttatagataaatatatatttatatatttagtttatagataaatatatatttatatatttagtttatagataatatatatttatatatttagtttatagataatatatatttatatatttaatttatagataatatatatttatatatttaatttatagataaatatatatttatatatttaatttatagataaatatatatttatatttaatttatagataaatatatatttatatatttaatttatagataaatatatatttatatatttaatttatagataaatatatatttatatatttaatttatagataaatatatatttatatatttaatttatagataaatatatatttatatatttaatttatagataaatatatatttatatatttaatttatagataaatatatatttatatatttaatttatagataaatatatatatatatatatatacacacacacatattaagaggcaataactcactatgttactcaggccactttcgaactcttaggctcaagccatcttcctgcctctgcctcccaaagtgctgggattacaggcgtgagctgctatgcctggcctgcccattttaaaattggattattttattttttcctgttgagttgtttgagttccttatatatactgattgttcatccattgtcagatgagtagtttgcaaatattttctcccattctgtgggttgtctctttactgttgattaatcatttcttttgttgtgcagaagccttttaacttgatgtaatcccatttgtccatttttgctttggttgcctgtgcttgtggggtattactcaagaaatctttgttcagattactgtcctgtagcatttgcccaatgctttcttctagtagtttcgtagtttcaggtcttagatttacgtattttatccattttgatttgatttttgtatgtggcgagagataggggtctagttttattcttctgcatatagatatccagttttcccagcaccactgattcaagacttccttttcccaatgtatatccttggcacccttgttgaaaatgagttcattgtaaatgtgtgaatttattcctgggttctgtatttggttccattcgtccatgtgtctgtttttatgccggtactgtgctattttagttactatagctttttagtataatttgaagtcaggtagtgtgattcgtctaattttgttgtttttgcttagaacagttttggcttctctgggtcttttgtgattctatataaatgttaggattattttttccatttctgtgaagaatgtctttggtattttgatagtgattgcattgaatctgtagattgttttgggtagtatggacattttaacaatactgattcttccaatccataaatttggaatatctttccatttttttttatgtgtgttctctttggttgctttcatcagtattttataatttttattttagagatctttcactttggttatatttattcctaagtattttattttactggtagctttataaatgggattactttcttggtttctttttcaaattgtttgctgttggcatataaaaatgctattgatttttgtatgttgattttgtatgccgtaaccttactgaatttatttattagttctgatagtttttttagttgcatacacatgtatcatggttagcatatatccacataactttttttgtggcatcgtgtgcaatacgtacattacagaaaaataaatatattttgttggtttgtgtgtttgttgatgtctaaatgataaagctaagtaaaaacttataaacatgattatatttgtagcaacaactttttatcaatatggacaccacagaatttgttagattatctccttatgtggcctttataacccatttctagaaaggtcagagtaaattatgttgtttaagctataaattatctatttttttccacttgagaataccttttcccctaggcaagcatttctgcttaacacaaataggttttaggtcacaattattagatggcattgcagagttgatggaatcaacacatcatgacttgaaattcaggtctgggcagagtctagacacttgttttggtaataggaatatctgggctgttcatatacagttagctcacatttggacagaaaacctttctccgcattaagatttcgaaagcttttagcctctgtaaaatgtctagtggtgccgaataagaataagggaaaaaagttcttgtagaaaaacatcctttcccttgtaaccagttcctattcacgtaagaaggtaatagctattccttcattcagtaatgaagttgaagtaatcctccagggtactcattttacacaaaaacaaattgcagttttcatttgcatcactgggtggcgatttttcatagccttatactactatttaaaaatccagcaagcatggcactattcgtaattaccagggttttctcctgttatgacatgtttaattgtacttttaagacattatctttaagttgattacaaatttactagtgtagtggcaagctcatagttattttaagttaggaaaagggatattgcgtaaatgttaggatataattccttccaaaactaagacaaaagcatgaattagcttattatgttatagcaaaaagaaggaaaaataacaacaaaaagtaataggatataaatgaaaaggaacaatttagatattgttgttggttcactaatattgttgaccaaatattgaatataactttgaagcaggcagaatgaaattgggcaaacactattgtagagattaaaggaattgggttacagtacaagggaaatgcatcatggttttcagaatatgcaggtgcttcttcaagtagggcataagaacttctagtttccattaagctaattattttgtaacacttgctgaatttagaaccagaatttaataattcacagcagcttggatttcaccttttaaaatacttaaaacacattgaaatatgtaatttagtctcaccttctgttttccagtctcaatgatcagtcagatattgaaaataagtgagttatttttaagattatctcctatggaattcctcattctgggaaccaaaccacatatacatacttcatttaaactatcatatttttatatggaacttttaaaggtagtctcttcatcgctgtgttgtttcctttatttaaaagtggaaatttagctgtatacataaaaatttacattctaaggaatgagggacagtaagtcactttgattctgtctagggttgaaggctttaattaaaacagtgacaaaaactaaacaggttttcaacatgtgcttcctatttttattgcctgttcttacaaaaaatgtataccagatctttaaaaaattagagtgtttatggattaaaaagtaacttaccctatcgctgtctccttacccacgtatcgggatatccagaaaaactcgatttacatttaatttacttagcagtttttgtgtttttacttttgacctttaaattgcaaagcaagtatgccaggatttttcaactaacttcatgatgtagatgcttgtttttctattaagaaatgtggagttgtgtgtctaatggatagaattaacagtattttcagtcactgttacctgattctggtttacctgttaatctagcagcgtttcagtttcagtttttcggaggtgaaaaagttaggttaggccatccccgtgtggggtacaccacccttccttaactccttgaatgtacagtgaaaggcaattgcatgaaggaagaggagaggtgccaactgtactcagaggcagaactgagccttctgtttggcacagttaattgtgggaaagtcattcatttttttcggggactcagtggatttagttgactcaaacgtaaattagggatctatctctctgtgattctaacccttctgtgcattaggggatacttagaaaaaaatactggtgctgggacccattcctagattctgattaaaaggtcctgggattaggcccaggaattgattttttccccccagagttctccagatgattctagagttcatgcaaggctgagaagcactacagttcactctctaataattgtatgtcatcaaataatgtgttgagacactttgaaaaagacttcataaaatataaagttacagtttcttttttagttgagccataaacaaaaagcaaataaaaccacagaatttctgggtaattacatttccttcaatatattaaatcattaaatagaaaaagagcagaaagcttcatacatgatcctatgaaatgaaatttgttttcttttccttttcttttttttagacggagtttttgctcttgttgcccaggctggagtgcagtggcatggtctctgttcactgcaatctccgcctcctgggttcaagtgattctcctgcctcagcctcccaagtagctgggattacaggcatgcaccaccacacctgcctaatttttgtattttggatagagacagggtttcaccatgttggccaggccggtctcaaactcctgacctcaggtgatccgcctgccttggcctcccaaacagctgggattataggcgtgagccactgcttccagccaaaattcattttctatgagtaatatacagttttcccttggtatctgtgggaaattggttccaagacccccgctcataccaaaatccattgacgctcaacgctctgatataaaagagcatagtttttgcatgtgacctacatacatcctcccatatactttaaatcatccctagattactaaaatacctaatgcaatgtaaatgctatgtaaacagttgttttactgtattgtttgaggaataatgacaagaaaagaagcctgtacatgtttagcacagatgcaattttttttttttttgagacagtgtctcactccatcacccaggctggtggcagtggcacaatcttgactcactccaacctctgcctcccgcgttcaagcaattctcatgcctcagagtcccaagtaattgggattacaggcgtgtgccaccattcccggctaattttttttttttgtatttttagtagaaatggggtttcaccatgttggccaggctggtcttgaacttctggccttgagtgatccacccctttcggcctcccaaagtgttgggattactggcctgagccaccacgcttggcaaccacaagcaatttttttttctgaataattttgatccactgttggttgaatccacccatgaggaactcatggatacggagggctgacagtttttgaaaccttagatgttttttgaaaaatcagtggaacaactgggaagcattttattaaattaattatacaatgtgaattccaactgatctatgactctttctggctttagccatagtacaactatgaatttatgtgaaattatttgacagattaacacccgtaaacttttcaaaccaacatctgaggtaccttttaaaaatcagactaacgcattcaagcagccatgttttaatacaactatttgggggtagttgactgtttcactatggtactatttccttgaagggtgcttattccatacaacatctgtagggaaaacattgtaagtatgcataccatgttatgtacatggaatttctcctactgtttccttacaggctttactaatgctgtaacttcacattttgtcagatttaactcaaaaattatgatgagtggctttcatatttatttaaactttattatttcattatattaaagatatagataatgaggatgagactctaagtaaaatgtacagtatgaatattctaccttgtatgagtaattcatatagggttggaagacctgaatgtctttctggtaatcttagtactacaatattcttttatacttaagtaattatcatattgagcatctgttttttttattcattgcatgcaaccaatgcatattatgaagggaagaattattattgggtttacacattgatcttttttttttttttgagacggagtcttgctctgtctccaggctggagtgcagtggtgccatctcagctcactgcaacctctgcctcatgggttcaagcgattctcctgcctcagccttccgagtagctgggactacaggtgtgcgccaccacgcccaccaagttttgtatttttagtagagaaggagtttcaccactttggccaggatggtctccatatcctgacctcgtgatccgcccgcccctgtaatcccaaagtgctgggattataggcgtgagccaccgtgcccggccacattaatctttataaatgtgaatttctaaaaaatttaagtgttggcccacttggtttctcaagttgcctgcctgaccctcttcgaagttgtacttttcttcttttctttcctttccgtactattctaaagctttttaataaactttcactcctgatctgaaaaagaaaaaaatttaagtgttttcttccttcattatatcatgatagaattatggtcttaccttggaagaatagtatctcataaaataagtaagaagaatgtggtaaattagtgtcgtatctttttttgattgtagtaatcagtaagtgaacattcttgagcactttctctatcccaggtgctctcctgcttggttagggatgctccagattcctgggccttgcccacacctagtgaaacagaattttgggagctatagccagagaatcagcattttaagcaagcaatgcatttagtatagctacttgggaagagttgactgttttactctacagtatttttatgcatactgatgtctgagaattgctggaataattatttttataaggtatggtagaggagcaaaactattctaggtggtggggcagattgtgtaaagttatatagcttcagaagaatctgatacataggcagggccagtattcttggctgaatagagagggtgtatcagggccactattgggaagtgtgtccagaaacatggtttgtgggccttgtgtggccttctcaaatgttagaatgttatcccattggcagtaaggaactatcagaccattttaaagcagtaaagttatgggttttgtttttttgtattttttatcagaaatttattgacaattttttaaaaatgtagataatttttatagtttcagcaagattgagaattatcttttaatgaaaaaactaattgcagcatcatgtcctgaatgcattactgagaaggcatgcacgtatactcatacgaggttgacagagtaagtcagagaaaccacaacaacaaattaataaactttccagaaccatcatgctgcaaagttatttttctgaacacctgataatttaaccttttaaatcttctttagcttcactgtgatatggggcagacactactagtccctcaatatctgtttccccctttatctttccatgtggccgttttccagttaggtgtgaagattatgatgaagtttctggccaatgggatataagaagaaatgttgtgttgcagattctaggaaatcttttaaaaacacactgctgtgtaccttccttactcctctcccctgcccccacttcccttatcctggaatgtggatatgatgattatgtagaattctagccagcatctaagaccatgagaactagggtacgttgtaaggatagctgaagagtgaagtcaaagagttgtgaagttgccataccagtcctttgaactttcctttgaacttcctttatgtgagacacaaagttctgttctgtttgagcaactattttattatgtgatttgcggatgaaccaagccctaagtaatacaggtactgaactggaaataatagtatttggattctatttaagttctgtcatttacttgctgtgtgattttgagcaggctacttaccatttcagcctcattttccttttgtgtgaaatgttaatgatatcatggtgtcttcattacattgttgcaggagatgaagcaaaaggaaactgtacacagatctgcactgacaaaagggagtacaaagaacttgtaattcttttgctgaccctgggcagttcagtgaaatgcttgggagaatgattctgaggtagcacttagtttagctggagagaatttggggatcactaatgatgtatgttgtaggcaaaggaatggtgtgcaccctgccagggccacatataggccttccctcaactcagactggaaggccgatctatgcttatatgatcagtccaccagaaagtctattcacacccactaaaagctgaagtgtttaaagtgtgcattaactagcagaacattattaaagagaattgctgccaaactctggttgtcagttaaatttgaaaaggattcacttcctacaaccggtatttccatcaaaaatgatatgtacttttatgactatacatacacacacatatttttaatgataagtattaaatacatgatattcaaggtttacactatagtgttactgatttaaaggagtaattgctctgaaaattttaagtattctaagtcaaataactaagctgtaaatttatggaacgacttatttttatttctggcatccatcatttcctgatgcaccagctgaaaatatgcttggcagcaccaaaggaaaactgtaacccctgaaatagcttgttgatggatggcttgaagaagttgataactgagataagcagccattgtccctgttgctgttgctatgttaggggttcttaacccatgttgagtttggagggctgcatgcagtggtctggaaacttctgacactacatgtaaaattttaggtttgtatttttggggggagaacattccctgcattacatcagattctcaaagatctgtaacccccaaaatattaagaattacttttttagatgttgctttggtttactagctccttgggctgtgatttcttaggatatttttatcttaatggtaaaggtgggagagttgttgtcaggtggggcatatctcattgggtacctttactagtttggcgtcagaaagtagaatgtgagaacctttttacttgttatcttaaaaaggaaaacttacttataattagtagtgattatttgctcatggtttgccttttcactgattatccgaatccaaggtgtttttctgctgccttgccctcagccccgtgtttcctcatgcagagtgcccagcttgtttcattttgtctgtgtcgtgttcagtgtcaagatctcagatgaaatctgtctcgaggcttcctcagtttctagatagctctctttttgatctcatgttgtaaatcttctatcatttatttgcttcttaatcacatggtattttgtagcagctcctatattattgttttgtaatgttatttacgcctttatttttgtatgtcttgccaattatgttgtaacctcctaaaggacatctaacccgctgcgtattttataaaattgtaagcacatgactatcaaaaagctgatcctcagtctgtatattgttaatagcttttgtaatgacttgtaaaccatttaatatttggttagaaaacttggtaatatcttctattaaggtattttctccaatgaaaataagtctttgttaacttatctattacttggatttaaattatacttactttatttagttatataaatgcaaattagtaagcattcagactaagcctgccttactctggggaggaggggcttcctttacttccctacctctgcttgaccatgcgttttaggagagccaaccttattcccagccccagaaagtcagtgctcatttgcctaagccagtcacggtagtctaattcaccttgccagtgattggcttaggaatgggcacccatcacatttctgactgcgacatgaaggaagatcaactgagagactcatgggcagatacagacagaagagactgccacctcttctcgtggcagttatttgatctggatgaaatggctgatgatgttttatctatcattgccaactttgcttaggagagctagcttgagacagaggtcacatgtcgaagatggcagagtaaaaggaggaagcaaccatgatgacattgttgaactgacatattcactaatttgggagctgtttacctctggactttttaggtgagataataaattcccgcattaaagtttaagccacttttagctaggtttatgttacttgcagctgaaaatgtctgcaccgatgtttgacagatgtgcttataatgctatctccctggataatcttttcttggtagagcccctgtttttcatgcccagacttcatggaaatgtatttatatgtatatctcagtaaagctcttcagtctgtgtctatatagaagacatttatatttatgtctttctaaactcaaaacaattggaaatagtctggagttcaattttaaatgaaattaatagattgtcagagtcataagtaaacattttgaatggtatactcactgccatcagaaatgttgtgcattttggatattgctggtaccaagggagaccatattactgctacaaagcagctagtgattaacaaccatagtaattggtgatcaggaaacaagttaaacatgctcacataatagtttgctacttatatataggtgtttttactgtgttttagttatgtcttaagaaattggttgagggttttagatgatatattccacattgtaatttttcccatctaaagtgatgggaaataagcttgccattatattttcccacccatttgattttcaggaacgtattactgatattaggcagggattcctttactaatctggaccagctatgttattaagtcagcaattctgctgatgataatgtagtctttaactagcaactcacctgtatccctcacatattttaaatgttacatatttggaaatgtatttccaaaacgctgaaggcaataaatgaaaccataattttttttttaagcatggaagttcaggagaaaaattgaagtgtatatgtttccttttaccatcccaaatttctagttacaaaatcactttataaagtttaaaaccaagtatatattatgtttttactggagttgaacattaatcatgcccagtatgtcagatgtgaaagaagagttttaaaggtaatgaaaaatattgtattaatcttatttttaaatgtttacttttttattataaattgagctgcagttttttaatattttgcaattataaggtgggggtgatgccgcacctaagttttagagctaaaaggacatcttagggataattctaaacagccacatatgtaaatatttctgtttgatagttatatattgagaatactttaatatatctaaattcttttgtttttgctaaggagagaaaggaaggtaaatatagtattgagctaccttatatgagttgccaaattatggtatgaaccaattatagtgaaagcattcccttcacatataaatgcttttctagcctgtaggcatcttttcattgctaaagttgggttaaattttcaccacagaaattcaattatgacttatacctgttatgaaaatatgtaaatacatcaaatatattttaatgttttaggtccagatatatttaaatgttttttatcccctaaaggagtgcagtttctttctgctccttctaggtctccaaagttacaggaccttgaagcatgtagagctcagcatggtacaaacctgtatttttcaatttgtgctccatgtgacccttcctggaactgagcagaagtgttatgctgccaacattgaataatggtggtcttttcacagtttgtaggggaaaaaagctgatggaattttaggtttttcattccaaaattttccttaaattctagaaagagccaccattaattttcaagcaagtattaggcaggtaaaatgtatgtatgaggaaaaaatggttattcaaggaaaaaaacttgtaaacaactgataatatctacttttataactgttctttagatatttgtagtcgtcatcattattttatattcaattaaaataaaccaaacattaatagcaatttaaacttagaattactaaatacataatttcatctaaaatgatagtttgtatgatagaatttaaaatatcagtatttactactgtcctgcaaagagcattttgacttcaagccttgcatgacattcactatatgaagagattacatttcgaaggagaagatgggaactctgctgcttattttctttctcatcttacgcatttcagatcattttgctggggcatagattctctatccagtgactgaggaagtaaattggatttttatctctaaagttttcttagaaagagctttacattttagtgacccttttttgttctatgtatttaaagagactgacaaatccctaatttattctaatctttatcgaattaaaatttgatggtattgaagtgttttctgatacatggagttctttctcaggagggaaaaaggtggttcaccagctgccaaacaaaagtcatgaagattttttagttaaaattttatctggctagtagctcagtttagccttgactaatcttgtattaaaatactcatgcaaatgtggaaggaaaaattttataactgttccaaaacttaggaatgacagtttaatgctagaaactgaggtgaagttagattgagaaaaaactaagcttctacacatagtacagtatgttgataactgcagttattaacagctattcctctttacccctggggttccattctgtaaatgaaacagagtacttcgccccctttttctgcactctcgcacacatatcaccatcttcccttactctggaaagcagctagtcagcaggtagagaagggactggtggtggtggtggtggagggtgatggggaggtatagtctagtcctcaccaggaaaataatgtgggcaggaatagagacaaaaattggtgctgctagtagtcatgaggagaattataacttttttcttgtactcctgcagaccacgtggtagaaataggaggagaaagacattccaagagagaagaatgacactgaatgaaagcccagagaaaataggcaaatggattgaatgctatgggcacccacctgcctctaagctggtggaaatttatattcatacagtctttgtggaagacaaattgtcaatatgtatcagaagctttaacaaggtagatcgattccctttgccttagaaattccacttttagtaatttatcatcaaaacacaagcaaatgcattttttgtttgtttgtttgtttgagatggagtcttgctgtgttgccaggctggagtgcagtagcgtgatctcagctcactgcaacctccacctcctgggttcaagtgattctcctgcctcagcctcccgagtagttgggactacaggcctgcgccaccatgcccagctaattttcgtatttttagtagagacggggttcaccatgttggtcaggatggtcttgatctcttgacctcgtgatctgcctgcctcggcttcccacagggctgggattacaggcatgagccaccgtgcctggccaaaatgtggcttttaaaatggtatatttcatgtgaacctttttgttatgtatattttatgtgtctaaaatagctgtaggaggaaaaacatttacctaaggaccatatgattacaggtaatttaatcttttttcttcctgttgattacttatatctacttcattattctgtaatgaacaagtattacttgtataactccaaagtcaaaaggaaccccaaaggtatatatatgtccctgaattcttgaatctctcagggagctgtagttcttctaaaagcagaagtacattttactattactactgaaattgtactgtgcttcttgtttccagtatacaattcaccaaacatttactaagtaaatatgaatagttactcttaaaatatctttatctatctatctatctatctatctatctatctatctatctacattatttcggtagacttaaggccaatgtataatataggaaaatctcatctgaaactttcccttcattctgcaatagcttagtaatgtatagactttccaaggggaaaagatgttttgggggaagaagttaaccaaatttttatttgggtttctctctcatgttttcctggatgtcgatagttcttttattctcaaaagagcttcatgaaactagaacttccagtgtatcaggaggcatcctttaaacattaaggtctattttaaggtgaaattctactatattttaaaaattgtttatttaaattctataacttttagtggattgcacaaatttatgccttgtttattttataatgactttattacaattttaataatttagcaatattatatgaacgtgaagttttatatccttctttaaatattttgtaagatgtttatgtgatattttaagtttaaacttataaactctaatcatattaacactacttaccatgagtgtatgtaataatttttcctctgtggtgggtttttatattgttaataaagttatatttcatattatcttaaaatggcaattattaaaaagaagagctttccctctgaggactgagatctctctttttgttgccattattgtcagttgttctggaatactaatgctttgttgatataaggcaactgagtttttttcaactgagtcattagacacttgaacaagagcaaagctttagatttttctccatacctatagaggggcactatgaagtagttggaaatttgtctgtgtgagtcatatttgagcattccaaagaaggaatgaagcatgttttctttttctcctcatgactagtgataattgagtatcttttcttgtacttattggtaactttttatttttaatttttatgagtatatagtaggtatatatatttatgggttatatgagattttgatacaggcatacacatataataatcacatcagggtaaatgggatatccatcacgtcaagcatttatcatttttttgtgatacaggcactccaattgtaccccctcagttattctaaaatgtataacaaattattgcagactgtagtcaccctgttgtgctatcaaatgccagatcttacttattgtatcaaactatgtatttttgtacccattaaccatctccattccccaccccacccccaccactgtccttcccagactctggtaaccatcattctactctctatctctctgagttcaattattttaatttttagttcccacaaatgagtgagaatatgtgaagtttatctctctctgcctgacttatttcacttaacataatatcttttttccatctatgttgttgtaaatgacaggatctcattcttctttatggctgaatagtactccattgtgcatacgtaccacgttttcttcatccattcatcttttgatagatacttaggttgattccaaatcttagctattgtgaatagtgctgcaataaacatgtgagtacagctatatctttgttatcctgatttccttccttttggggatacacctagcagtgggattgttggatcatacggtagttctatttttagttttttgaggaacctccctactgttctccatagtggttgtactaatttacattcccaccaacagtgtttgagagttccccttttgccatatccttgccagtgtttgtcattacctttcttttggataaaagccattttaactggggtgagatgatatcttgttgtaattatgatttgctttctctgatgatcagtaatgttgagcaccttttcatatacctgtttgccatttgtacgtcttcttttgagaagctcgctgtttccaagtagagaaaatcactgttgctgccaaccaagtagccgtgcaataatttgtttacttgctgtcaacattttccccaccacagtttatctcatagagaattctcaagcccagccaactttaagatttcatttgtaacacagaatgattatgttatattagataagaaaggctgtagagagagaaaaatctcctaaccttgtctttctgtcttttctagacataatacgttgattttttttactctgattctgtccatttaatttttattacatgtttctcaaccatggtctttccttgttactttcaggcatagaacttcctaaatgtttagtctcagagcaagaacactcaagcttttcatgttctttggcactagcagccgtaacacattgaatttctggcagtggaatttctactcacaggatctgacccctcacaccatggccctgaattaaaaaagacattgcttctgagcatatgcaactcagcaaggatcctcaacaacttgtgtcctatgtagacctagcatctttaatatctatgtatgttgggaattatctgtcaatgtgtcacctttaggttctttatttttctacatctgtcttctgtggtcataaatgctgattataagttaagcagcagtgtgcacactacatcttatgcactaatggttggatttagtatccaaccatggcaggagtgtgaaacagtgagatggatcattgacctttgtctataggaggctcttttaaaccctactgtgtatatctccgttttttttttttttttctgataaacttaccagtgtaatttttttttgagatggagtctctgttgcccaggctggattacagtggtgtgatcacagctcactgcagcctctacctcctgggttcaagcgatcctcccattgcagcctcctgagtagctgggactacaggcatgcaccaccatgcccagctaatttttttattttttgtagagatgggggttttgccatgttgcccaggctaccagtgtaatttgttttctccttgaactcatacaagactcactcttttagccaaagttggtaagaattattaggtagattaaaaaaaaaaacaccccaaaacaaatgtggtctgatggtgaagtatcacgataaagacaatttgtaaaaactgtgaaatcatattagatcttagtataaaattctaattttctataaaaaaatacttcttagaagtcctgagcttagccactggaactggccacaagacctgatttgggaagaggtaacctgttatatgaatttagttagtaaaattgtagaaattcagatgtcatttgatcccagggaagtgtatttctccccagctattaaccagtgtcaactgtctgaaatttattgatccgaaggctcttcctcatttgttgccagtagctctccctcatacagaacaaatgactcacatgctcaagctaaataaagcactccgtaaagatttttctgcctctagaactgctcaaagtcagctctcaatagtgggcactgattcttgccaactggtttacccttattaactctataggtagggccctgtgaaaccacactaacatgtagatgttctctctttttctttcttcttctttttttttttaaaggctgcccttttcagacattccttctgaaatctgttaagaataacataagactagtcacagatttattgatttttcctgggcatttgactatgtgaagtggaaccagctatgacctaagcttagcaagctcagtaaacaccctctctttgctccaaggtctgtataacttctgtcttagtacacatgccaagcagtcagcaggaacggtcttgtggtagatgagatgattttcagtcaggataagtcagattgttttgcttttctttttatttaaaaaattattttttcaccctttaaagtcttgatgatcataatccacttcttgatggaatgtgtacctgacactttgatacactttgcaacagtcctgattggctttctgaacagattccttattatctaggaatgatatcttctatctaattattttcccaaataactgcttagtgtttattgctttaatatcagaatcctctattctgccagacaagttgcagcatttaatttgttttcttctaaaacacctatgaaacagataaattatccattttatttcatttcctgtaagttattttcttaaaacaggtatcttatgggtacatactggaaactttaaaaaatggctaatgtaaaattcattttgaaatatgattgtggcttccttttgtggcagtcctgctcaaaattttccaagtatctcaggaaggaagaagcacgaatatgtacctgctaaagcccttggggtgggcacctaactttaaagatatttttatttttttaagctgatattatcacattcatgtgacattggcacccagtgtgtaatagagctgtggttattttaacataaaatgctttaaattatggatcatcaggtagtaaactggaggatatgagatttactgtattttttccttgtcattatgcctcttttcacatggtgcatgtactcttgggtatccatcttccaatttgagacgtataaatcagagtttttcagttgcttaaatgactctctgtttgagaccagaagtgttttcagaggaaaattttgatattccctcagctcaccttcatgagggctgtgaaataaaaactttggggagttgcctggattggattccttagcaagctgaccccactactcatttgattgttagaatgtgcatttcttttaattagaaatagagaatttctgcacttcacgttctggctagacaatatgttatctgaatcaaatacttactaaatgcccatgagttagacactgtgctgacaggcactaagaataaacaggtagttctatatctgatgtgatattatttattttgaattgctatatgcttcattagtgtttttggatgaaatttagtaagatatagacagggcagatttatttctgtgagaagattgcaaaatataacagttcccattcttgaagtaactagagaaaatttttttagtgctttttaaaataaggtttatataatggtgcgtttcctgctgcatctctgccatcaatttcaaccaaactggtagaagttttgattgagaagtagctgtaagttgactttcagtgtttttacagcttagccttttccttagaagtcacttctagaaccagatccacctgatttaacaaaatgtgtttgaggttgaatcattgcaggctttattctgtctaaatgtttttttcttttctttttttttgtagtatttcgtagaactggagatcctgtttaggcagttgattccacagttttgactatcaagtaacccagttgtaatgtgggtgctacagcctcagcttcttaaatttggtttggagcatcctttcaaccttctttctccagctcttaataattacctgctccacttctttaatgactatttagtggtaaggtaaataggaatcttgtcttaagatgaattcatctcaaagtgatttggagccaaaaaccagaccatgacatttctggctgtggatttcgtttccaccaactcaccctcttgtcttttttttttttttttttgagacagtctcaccctgttgcccaggtctgataacagctcactgaagtctcgacttccctgggctcagtgattctcccacttcagccccccaagtatctgggactacaggagtgcaccatcatgcccagttaatttttatatagtttgtgtgtgtgtgtgtggggggggggtagataccaggtttgctatgttgcccaggctgatctttgcctgccttggcttccaaagtgctagcattataggtgtgagccaccgtgcctggctgggttcccccaactctcaaggggtgctgagttgactgattatgggaatgccagaacagaattctgagaatgcatttgtgtttttccttcttatcagactcattttaataatataacagatttaatttttagttttcattgactctttatccaactgatttaaaatttaaatatatttatgctttaatcactcataaacttggacctcaagttaaaaatttaatatccttagttccttagaattttgtaagaatttttgaattagaagtacaattttgtttagtttttacttacactaaaataggaaaatcattaagctgtttaaaaatagtggcaccagactgaactaaacaggagcagtggaaagtttcactttagaaactgctagagaactgaatccctagggtggtccctggatgtgatggtccaatctgtaaggtcatcttggaaatagatttagttctaagtttaggaccagaaaagactacttccttcctccaggcttttcacatttatccctaaagctatattgagtgagggcagatatatttttcaattccacaactgctggtgcaccacaacttgtaaggttctgtaatcttagtgctcatataatgccttacacatattaagtttttagtaaatatttgttgggggagaatgagtagatgaattggcatggtaagaactctaaactgagctctgggttataagtaatactgtttatataagtggaaatacgtgttttgtttattcatagattatagccagaaaactacacttaaaaataaattcctgaagtgaaagtaaaaattaatgttttcttctcatgaagtaagtgtggtgatacttacaagttattcaaatatttagagatgctcagtaaataactacttctgtggagggtgtcttagtcagtctgggctcctttaacaaagtgtcatagattggtggcttgtaaacaatagaaatgtatttctcagagttctggagactgggaagtccaagatcaaggcattggcaaataggcagtctggtgagggccttctttctgttcatagatggcactttctccctgctccccacatgttggaagggtcagggtggctttctgaggattattttattccattcatgtgtacttcaccctcaataccaaagtacctcccaaaggtctcctaataccatcactatgaggggtaggatttcatttcatgaattttgagggaacacaaatattcagtgtagagaaaacacctgaagtccaaaaatttatattaagaaaaagtcaggctgggtgcagtggctcatgcctgtaatcccagtttgtgggaggccaatgtgggaagatcgcttgaggccataagttctagaccatactgggtaacatagtgagacccccatctctacaaaataaaaacaacaaacaaacaaacaaacaaaaacaccaaagggccgggcgcggtggctcacgcctgtaatcctagtactttgggaggcctaggtgagcagatcacccaaggtcaggagttcaagaccagcctggccaacatggcaaaaccctgtctctactaaaaatataaaaattagccaggcatggtggtgggtgcctgtaatcaaagctactcgggaggctgaggcagtagaatcacttgagcccaggaagtggaggttgcagtgagctgagaatgtgccactgaactctggcctgggtaacaagagcgagactccatcttaaaaaaaaacaaaatgccaggcatggtggtgcatacctgtagtcccacctacatggaagactgaggcaagagaattgcttgagcccaggagtttgaggctacagtgagctatgatcacggtactacactccagcatgggcaacagagggagaccttgtctcttaagaaaaagaaaaagtcatacaagtataattcacacttggatctctatcgccatttggttaatattccagttgtgtattagacatttaataaacatgttctgtattcttgtagaggaagatgtgtgaggaggaatggaatctatcatacctatttaaggaatgaactgtatcatttcctctctaactgtggggcttagagccctaaaacctcatgtaaagataaatttgtggctgagaaagttaaaattttaaggggaaactaggttaggggaccttaaattgaaggtatgtgacagtttttgcatttgctagaagaaaacaaagcacactacagacaatctatgtgacattttatatatcttaaattagtaatactggaactgtcctgctcaacttcatttgccatccgttgtttgctagagactttctcagtgctcactcttacatgcttgtaaatctgtgctgctttgtgaagatgagagatgtatgaagtagtatttttctgaaccttcccctctatttaaatgctctgtgtctgtgcttttctgattcagagttgaccttatgggtcttgcttataaggtcctatatttcatagtgaaatatgattaggaggctgattaggatgattaagagaatgacagggtatttacttatgtttgcctcctatctgtttatcagttccccttcattctattcaggtttctgcagctgtgggtcctcccatggttatttcatgacaagccatttacccatgtctcggatgactgtctgccctctgaggatgcctgggtgtatttgctttcttcagtctccatttatctttcctaataattcactgcaaccatttctgccatctctctgccatcagctatacctcccttttctgtttctgacctcttttctcttcttaacgaattttccaaataagagtggctcatgatttgtaaaaagtagaactgaaattcatattgaaattcagatagagaaggtatacagaaatatattcacatatagttgaatttaatgtaagggatgtcaaggtagggaagtgattactatgtagatgttttctattgtgtttgtgattgcaaggaggattttatatgatagtcatagcttgtctttaaaagtttggtatgtgataatatcagaacagtaaaaggctatttcacattttaaaactaaatctttattaaataattatttcacaagttagtaattattgatattcttcttcagggactagagttcctatgcttcctaaactgacttttaaggaaagatgagactatattcagtgcagttttaatatgacatattttattatctcttattttttaaattgatattttatgaaggagtctatggactataatacgaaaattctggttggggaggcaggaaacctggctttcaagtacactccaatagcttttatataaaattcaggtgttctttttctctaatacttgaaatagctattttcattttcatgtcattttctgtacttttcctgatacttttaaacattgttttattttcaaatgaacagccctcaaagatgaaaataaaaagcaaaagtttcttaatgtcttaaatgcttttgtgtatattaagtgactttctttaaattgaatcttacttttccactgacatctatgatgatttctgaaatgtgctccggtgagtaaaatttgacaagccactccatctgccagtggcctgggtttttgttgttgttgttgttgttgtttttggtttgccttttgtaaaaaatgcttagagacaagtcaaccagtttgtttgctgatgaacagttattgcttcacccacctgtacaacttcattgtcctagctacaggggaaaatcatttatttttcacttgcgtcattctccagtcctgttgtcgtgtaaacttatcatgtgctccttgaagccatgcgagcaggcagagcagaatttcaggagaatgccttcagctagtcttctagttagtactacactgagtttactgcctgctttttagaacttccttgccaaaccttcactgaatgactcttcatataattgaatacagctgtagtttattttatttgccgaaaataattactggtgcccactaaaatggtgattaaaatccacttgatgtttgtactcttttttgctgagattttaaaaatgtgcttacagtgaggcttctataataaaaataatgtagtttcctgaattatggaattcgtgtgttctcatttaaggttgcagtttaaattgatcttttatcaaaatttagactgaagaagagattttccatctaatttatttacctatagaatttttaactttttagtatgaagtaccattttgtgagtgctctaatttcttatttattaaataaaaagaaaactaaattttattcattgtgtggatatagcacatacacataattttataaacatctttttgtaacctatattgaatcccagaggtcctgactcaggtttcagacaagctcaaaatacaggcacttacaacacaggtgctaacaacaatttgtcctaatcagttcagggccaaagttcagttccttcttctctggccaataggatgttttaattatgaaacgcagacatctcagcactttgggaagccgagactggcagatcgcttgagcccaggagtttgagatcagcctgggcaacgtggcgaaaccccgtttctacaaataatgcaaaattagccaggtaatgtggtggcgtgcccctgtagtcccagctatttgggaggctgaggtaggaggattgcttgagcctgggaggttgaggttgcagtgagccatgactgtgtcactgcagtgaagcctgggcgacagataacctgtctcttaacaaaggaaagaaagaaggaaggaagggaaggagggaagggaaggaaggaaagaaaagaaaagaaacatagacataccttagagcaacagttctcaaggagatactttgatggaatcccagacatcttccttttccaactaagtatctgtgtgtgaggctgtgttttctttattgtatttcaactaaacaacacatcatgatagtctgaatgcagaagagaaaggccaactgttttctgttgagctagaaattaaggatatttgtaaaattataaggctactctttttactacctttctttttgttttggaaaatatagtcatttttcatagaaacattcatgtaaatatgtaaaacagttaacttaataaatatatttaaaatttgttttgaagttttgatttctaatatgaaaaatattaacagatataactgacgtaagagtcctttgggtcctcagtaatttttgagagcataaagaggtcttggagatcacagagtttaacaactgctgccataaagaattgcttctgggccgggcgcggtggctcatgcctgtaatcccagcactttgggaagccgaggtgggcggatcacaaagtcaggagttcaagactagcctggccaatatggtgaaaccctgtctctactaaaatagaaaaaaaaaaaaaaaaaaaattagctgggcatggtcatgcacgtctgtagtcccagccattcagaaagctgagggtgagaatcacttgaacccagggggtggaggttgcagtgagctgagatcgcaccactgtactccagcctgggtgacagagcgagactccatctcaaaaaaaaaaaaaaaaaaaaaaaaaaagacttgcttctgtacttaaatgccagtttaacttatagattgtctttaatcacaaaagggtcatcaattgaaaaaaaacgatgtgttttatttgggtaaagtaaaataggcctagaagatgggcagattctaaacagtattcatcatctgaatgaaaagaagattctggataaactcagcatgcctttacagatacagaagaggaagggcgctgattgtgaaccatggtgcttcttggcatctgtaacacaggactactgacattctttctggcattgttattattctgaattgaagggagctcctgttctgacatgttgtaaaccagtctttgtttttgaactttttatgcaatgatgagaagagatctcaacttaggaatcttgttgacatgcatggaataggaagtggcatataaacttccaagatgattgtaacgaagttcgtatagttgatgcactgtgatttagttttgtcattaagattctgttttggaaaaatatctgacttataaaaaaatagaatcttaaaaatgtttaatcataataaccacctacattattagagtgctttggagtttaaaaagtaattttacatgttctaaaaatgtaagcacgataaaataactatgtaggtttaagttaatgtaattggtttgggtcactgctctgtacagcctgcacccagtgtttatattcagtgtgttattacaaaatgcttaatacatattgtatgtaatcatctggctctaagtactatgcttgtgtaatccattgttttcataatcatattagtatttctattatagggataatgaattagagttcaagatgaaacagtcgaacttatttataaacagagaactgaatgtttttaggatttttagggtagtgaaactactcttatgttaatatattggtgggtacatgtcattataaatttgtccaaactcatagaatataaaataaaaagactgaaccctaatgtaaaatatggactttggtgatagcgatgtgtcagtgtatgttcatcaattgtaataaacattcctttctggtggggaggttgtaaatgggggagggtgtgcatgtgtaggggcaggagttatatgggaattctctgtaccttctgttcaattttgctatgaacctaaaactgctctaaaaaataacctctgctttaaaaaggtatgtgtactctataatcttttattagaaatctttgttgctatttttacatggaaaaatacaggatgaagtcattattccctagaataaattatggaagtcaccattcaaagttatgatggagtcaggatgctacaaagaaagtagattatctcaatagtgttgtgtatgttgactgatttggggaagagagagtaattagtgaaaatatgtgaagtccatgttgagtcagaacaaaacggataatcaccttctgagatgaaaaaaatcatcaaaaagagtctaaaaattatctgttggtacagattttgggaaaatctagaagaggtggaagtagtgaggctgctcatgttatcaccctagtctgggtttgctggttagagcatgtatgattggaagagagagagagaagttcaggaaataccaacagagcatgggaactgtactaggttcagtgattccaaaaccaaaaatgaaacctatataacaatgctaacaatatatgtaatatttccagagtttccaaagcctcatttaaattgtgcctgaaaatgttagatatcattttttaaaattggaaaaaatgaggaatacaaaacttaagtaacccatccaaaggcacatactagtaggtaataatgaagataactaataataactcatttacataagaactctaagaacttagtactattatttctaactcacagatgggaaaacaaagtgtcgatgaggttgactaacttgcgtaagagtgcgtggttagtaagtgacagctgggattttaaactagattgtctgagtctgtgctcttaatccgtatgttctacatcctatctgttggttttgttattttttggatagagcatcttgacttacttagatttaaaataaaatccattgcagcacaaacatttgcaggggtggctaagatcctaacagaggcccagggagatgacagcaaatctttcctaatgccaggcttatattcttgtctcattcttgtctttgaagtcaaaacatttttagtcagtctctagaaacagaaacatgactgtgtcaggacactaattaattagcattgaggagttgttttctgattataaatatataactattgtactaccattccctggttggtaggattgctgtttgtgcacattatttgaggagatggaataaacaggcaaaatcagtttttacaaccctgtgtgaatactggtctgtacagcaaagattatattcattatggttataaactccttgtctgcctacaatattaatatggaatgaatgttatcaccaagttactgtaactcagaagacttcagaaaatatcctctaggtatcaaattaaatttgtaactacggtactttttgcttgccttgaatgactttccctggaagccagaagccttgtgttcagtttctagcaccatcagcaatgttaccttgggtaaatcatttaaacatgttgaacgtatgttccatttggcagtgggaatgccatatgctctcaaattgcttcagtgtgattttgtaaaagtgaaattgattttaaaatatgaatatataaagtgatttcactacttattaagtagaatgcattgtatacttcataaagctaacaaataataaaagactaaatgatattttggaatttaaaaaagacctctttagttttctgtgatccaaaatctggcttaattttgccttaaagctattcttagtgttaatatataatgctttttaaaaatcggccaaggtatctttgggcatttgtagtccttttctgttcagaaatgtcattaacttgaaatataaagatgctttctaaggaaactggtttgcctagccagatcttttaatgtagttattttgctatgtgagctgtaaaacccaaacattgaggctgctttccacaatgccttgttgcccagacagtgatgtcatgttttaagcatgtttagtttgcaaaggtcctgcttttgatcctttagttgtcacttttttaatgcggctcctcctgaatcacaaaggtactgaaagtaatttgcttcattaaggtctgttgctgacactgttgtatttcagtcgtcattcttctcttagcctccttcattaagaccttattcaaatttggatcatggttctgctgcgacatccacgccattatcatctaaatagcaattacatattcaaacacaacagcttctccttaactgtctgtaacttaacattttacatagattcaagtgggaattaagaataaaatgaatcttttcttcgtgatttacaaccctccctttcacccttggtttactagttaatgttgaataagctacttgtagacgaaggaagacaaaattattgattgctcagctttagttttgtagagagatatatattataaattgtttctgtattaaacagttacccaagtgtcagtgacccttattcaatcacccatgtatttattagacagcatttaccattttggatataaggggatcaggtctaacactctgttaagaaattaataggatcttttacaaaagcagcagtgctttataacttgaaacattgaaaggaaacctttaaaaataagtcaacatatttgtccttttgggacagacctcaaaaatagaagcaaattccattaaagtagtaatatacttttcctactacttcgttttggccatcttaaaattatattttataattagtaaataagctgatttgactgaaacgagcaactatgtttattggagacagacccagcttttcaacagatagaatgttaggactttttttgcccattaatatgtggtttaaagggaagttataacaagacaccaaatgcatatgtatatatacaaatacaggcagttgtatgtttttaagaagtttttaaccagcaaggggtgtgtgtttgtgtttgtgtgtctgtgtgtgtgtgagagagagagagggagagagagagaaagggagaggaagggagaaagtgtgggaggaaaagaggagaggaggagaagacagaagaggaaaacagtcctaactattaaaaataccaattaactacttaataacacatctttcagtgtcttgcataataatttcttagatattttgcaaaattcggcatggttaagggattttgtaatggttaaataattttattagttgtttgaaattgactgtctttgttttcctatctgtgtgctgagatttatctcaattatatgtgtgaataatgttatgcatggggttacttttaatatggatttaactgagattctagactatattctttgtaaatatgaacattagaaacttgttcaattgtgggtcgtcattaattcaagtcaggaaggctcaccctttgtcctcacaccatctcttaagaagataagtcctgtggataagctggagaggtcagatgttggtgttgacttaaagcattgccacccgaggagggcagaatgctgtaaaacaaagcagaaggaactgtgtggagagaaggtgaatgactgggggacttgaagttgaaagaaaagtcaggcgctgagcctgcaagggcaaaatgaggcttgtgggataagaatggtttgtcagaagtcacctgtttgctcagaagtcatctttccctaacaagggtctgtttggtatgttcctgtattacaatttataataactgtttttttacctgctgagggtaagatctttaaagtgacatcttaccagctattattcttagctcttgcttatgcaaatctcaatttgaaaaataaccttttaaagtttttttttttaaataatgagaacatattcagaatgacaatgtgatgaacacctgtgtacccaccaattggtttaagaaatataatttcttgttaaccttgaagttctctaagtcttctccttactcccacctcagaggtaaattccactctttaaattctgcttttttggggtctctttttaaatagtgttaacatatttttcatatgtgtagttttgtatgttttacaaccatatataaatcgagtcactcacaatgtatgtacaatatgttcttcagcaatttgcctctctcactcagtatcatgtatctggtctcatctatattgctctatgtatctttagttctttcatttttatttgacattccattgatgaatataccacaatttatatatctgttctgatgatgaacatttggggttttgttttgttttcctaaaaacagtgctgttactgaacattagtaggcagaagaaaaaacaaaacaccttgatctgtgtctcacactttatgcaaaaattgcccaaaatgaaaggactagtccctagaataagtacttgcaaaactcagcagtaaaaaacaaaaaacaaaaaaacataaaaccaaattagaaaatgggcaaaagacatgaagagacatttcactgaagaggatatacatatggcaaataagcacatgaataagtgtcattagccataatgcaaattaaaaccataatgataggtctctacaaacctgtatcagaatagctaaaataaatagtaataacaccaaatgctggtaaggatgaagagaatctggatcacttattgatgataggaatgtaaaatggtacaattactctggaaaatagacagtttctgaaaagctgaatatgcagttactatacgactcagcaattacactttgggcatttatcccagagaaattgaagacgtatatgtgcataaaactgagtatttatagcaattttattcataatagacccaaactggatacacaccaaatatccttcaacaggtgaatggttaaatctatggtatatctatatcatggaataatactcagcaagaagaagtaacaaactgttgatatatacaacaacctggatgaatctccagagaattatgctgagtgaaaagagccaatccctaaaggtaacgtactgtatgacttcatttatgtagcattcttgaaatgaccaaactgtacacaaaaaatagagaaatcattggtcgccggtgggtaaggatggggtgaaagttagaggcaagtgtgtgtggctatagaaggataacactggggattctggtggttatggagatgttctgtatctggtctgtgtgaatgaaatatcctggttgtggtattgaactatagttttgcaagatgttgccattgtggtaaaccaggtagaagctacatgggatatttccatataatttctccaatctgcctgtgaatctagaattatctgaaaaagttcaattaaaagacaacatgatgctgttacaaacatccttgtacatgtctcctggtgcacatatgtgagctttcctctagattttatttccgggaggaattacaggctatgcacatgttaactttagtaaatcatggcaaatttttttcccaagtggtatatgaaaattctatccttttcatattatactctatcctttttaaggatattgtacttcaaggatattatactctatcctttttaacatgtaatactgtgagacttaaatttttatcagtctgttggttagaaaatggtatcttgtgtttttaatttacattttcttgtttataatggaattggacatttttatttatgtttaatagtcatatgtggtttttttgctcagtaaaatcactattgatctcttttccctgctgtattgtctgtcatttaaaaagttgattctaaggggatctagttacaaattttgttgcattttaatgacttatgtttttctttttatctgttaatgaagagacattttgatgtgacagttttaaaatatataaaacttttccttaactttcatatttcagtctgatttaaaaagtcccttcttggagatcagaaagtcatcttcctatagcatcttcttatagctctatggttaactttggttatagtgtggtatagcgatccgattttaatttttttttgtagggataacctattttcttagtactattttggattaattcatcttcttttcttcacgtatcttccaagcttactcttacatatatagtatctttggttctcctactttatgaggctatttttctctctcttagccaatgtcataaagctcattatattaccatcctttaaaaccatctcaaccttcctttgttctctgcttttctatataatgaagcatcagttgatcttatgccaaataaataaaaaatgaataacagatggataatcactcaaacctacccactctgatgtgatttttgttgaaattttattgaacatatagattaatttaggggagaattgctatatttacaatatttagtcttcttcagaaatatatttctgtccatttgcttaggtttccttaatacatttttgtaaaattgccatgcatttttcataaaaatcacatttctgcttttgtcagatttattcttagagtgcttttttgttttattattatagtaaatatttttaaagttgtattttctgtttgttgccagcatagaaacatgtagctgatacttgtagcaaccatcttgataaaatatttacttcccataattcatctttagattcttttgaattttctaagtacgtaattataacctctgtgaatagtgagttttgtttcattcaaatccttgtggtttcattttatcttttggtcttactgcatggtctaggacctctagtatgttgaagagaagtgtcaaagaaaacatcttttccccacttttgattgtaaaaagaatgcttataatgtttgcaattgtgaactactacatacaatacattttgtttttttgggttgctcctggttggctaaaggcttattgtagaaacataataggcatagagtgttgttagaattggtataagatttgattttaatagaattcacctgtaaaaattatcttggcctcgtgtttctttagtgggtagcttttatgtaccgaatgaatttgttgataattgcagactagcctattgtgtcaatttggtaagatatttttctaggtgattgctcattcaaaaaatattctagggccgcgcgcggtggctcacacctataatcccagcacattgggaggctaaggcaggcagatcacaaggtcaggagattgagaccagcctgaccaacatggtgaaaccctgtttctactaaaaatacaaaaaaaaaaaattagctgggcatggtggcgtgcacctgtagtcccagctactcaggaggctgaggcaggagaatcacttgaacccaggaggcggaggttgtggtgagctgagattgcgccactgcactccagcctgggtgacagagtgagactccatctcaaaacaaaacaaaacaaaaacaaacaaacaaacaaatctaagtttatagacagagttttttttttttttaaatgatatcttcttaccattttttaatctctgggattttcattatgttctgctcctcccccccatggcaatattgtttatttattgctttactatttattttcttagtgttttcaaaagaccagttttaggatgtattgttcctcttttgcattttattttctgtttcatcatttcttgctcttaccttaattatttcctttttcattttctttggagtttattttgttagtttcattttgactttttaagttggttgtttgtccttggatcatcatttttaagcttttaaaaattctaatatgttcattaataatgccctgtatttccctttaaatgctattgagcagcttccaaattttaatttgtattatttccattcgtttgtcattttgcacatttttctcttttcaaaaaattaaaaaaattttttctagaggcagggtctcactctgtcacccaggctggagtgcagtggtgtgaccacagacagctcactgcagcctcgacctcctagtctcaagtgatcttcctgccttggcctcctgagtagctgggactacaggcatgtgccaccacacctgccccacacgtttttcatcgtcaatacttctttgttgagttatttttaaatgttttaagatttccaaaaattgagtttttttgtgtgttatctttttgatgaagatttttaatttaatgtcctgtggtcagagagggtggtacaaatgatagaaattcctgaaatgtgttgagacttgattcatggccttttctcaaagaaaagcatatcagtcttaactgacctccacttatatgactttgcatattgaccagcatttccaacttttctataaatccttggatgttgacagcatctagtttattctctgatgagcagactttctttggctgctccagcagagtgctgctgaagtgtcaagctgtttgctcctaaatgtatgtacttgtttattataattgcatgatttaattaaaatatgaattaagaggttgtacttaaacatgaataaagagggagtacttatagctacgaaactttgttaaatgctttagaaataatctatatagtttaattgctaaaataaaaaaggagctgtcaatttaggtgtgggtgagatgacttaggatctaggaatcagtggtagattgatttgtaaatatctttaaattctcatttgctttaaaacagttggaggttgtgtacaatgtattatatgttggacttacataagaaagacttagaactccatcaggtgtccctaactgcaaataaaggcctcagctgaaaaccttcctgggggaaggttaaagcaagtaacaggttggaagctgggagaaagtcaggatttagggtgttgggcacttgtgtagagtaatttttttatttcctcatgaactggttgttcaaaaatttttctttttttttttttttttttagttgatagtaacacttgcagacctgttgtaccatgtggttgaactaagcagaacaggggcactagaattaaacaacaacaacaacaacaacaaaaaactacagaggaattacagttgccataggcagcaatgaaactagaactaaccaactgcagttttttgttgtaggcaaatccacaaatcttagaacttaaaaaaaatacttttttttagtgttttacgagatgaactctgaattatagaatatctcaccattaatatgcaccttcagcatagaaacagttaaagaaaataaacttacctgaaactattgtattccctgtgcattgtcttcacatcctttttctgagtacctgagacaaagtgaactacaagtaggataagaactgaaaagttttcaccagatttatgaatacagtttcatcaatgatcttggtgaatagtagtagcagaagagttgaccatagaccttatagctagctgttagaatagctaatttaatgaattttttcccaaatctgaaactcaaagctactgataaccaaagctagttccctgataagtaacttagggaagtgcactcttatttcaataattaatgcttccatgaaattatataaacattcatgcattccgacaatatctgaatatttctgtgtgctaggtgctgtgctgggtgttgggtatgccattatgaacaatacaaagaagagctctgttttcattcaaatgaggataaagtttttcaatagcaattatttttaaaaatgaaaataaagatccacaaatttccagaaaaaaatgacctaaaagtcatagttttaccattgaatgtaatatccttcctgtaatccatgaatcagagtatgtaaagagatgtaaaagatgtaagaaagagttttgagttttaatttgggaaaagaagtataagacagtagtagcagtcatataaaatagaatagcatcaaacatttaaaaaatagtatcgtgatagcatagagcaaaatttacattttaaccatttactaaactttggtgaaaactatcacttaaaaaatccttaattacaaggagatagtataaaacatagtttgttgctgttgtatatttgtttttaagtatctcagacaaatcgaataattttttaaattagaaactaatatatgtcaggcatatggctacagttaaaattttttttgaaaatgaaattatggatgcagaaagcaaacaagctgtggcagaaaaggatggatctaaatatgaagaggaggaggagataagagcaatccagctgcaaaaattactcatgccataggtagttttagatgccctagaaatagttctatgttgtattgaataacagcttgaatcaggattcgatattattacaacatgggaaggaacaatgccaagaaaaattgtatttattcttataacttcaaagtgatacaggagctcgaaagaaatttaggcagttagtgaggctaagagagtccttggcaaggtttccttttaaataaaaagcagcccccaaatcatttcttttctaacaaaagagcagcctgaaagatcgagctgcagacatagataagcaagctggaagcttgcacaggtgaatgctggtagctgtgccaatagtaaagggccacttggaagccaggtatgttcaacatggaggctccaccttcccttttctttgtcaccacgtgcacagtaaagaggcaggcaacatggtgctggccaggtagcaaacccatctgcctagtaaaagattagggtggaggccggcgcggccggcgcggtggctcacgcctgtcatcccagcactttgggaggccgaggcaggcggatcacgaggtcaggagatcgagaccatcctggctaacacggtgaaaccccgtctctactaaaagcacaaaaaaattaggcgggcatggtggcgggcgcccataatcccagctactcgggagcctgaggcaggagaatggcgtgaacctgggaggcggagcatgctatgtaaatggcacacctggtctgatcaatctctcgtgccctatgtaaatcagacaccgcctcctataaaaccaacctcttcttgccctgaacccggaaacccgttcgggaccccttcctctgcacgagggagctttcctctttctttttcctttttctttctttctttttttcttttttttttttttgagacggagtcttggtctgttgcccaggctggagtgcaatggcatgatcttggctcactgcaacctccgtctcccgggttcaagcgattctctcacctctgcctcccgcgtagctgggactaccggtatgcgccaccacgcccagctaattttcgtatttttggtagagactgggtttcaccacgttggcctggctggtctcgaactcctgaccccaagtgatccgcctgcctcagcatcccaaagtgctggaattacaggcataagccacctcgcccagcctcctgtttctttcatctattaaaactccactcttaaactcactccttgtgtgtcctcgtccttcagtttctttggcgtgagacgataacctcaggtatttacctcagacaactctgctacttcagaagtatttactttattaaatgaatatgatttattgttttgaagtaaaatgtttaaggtatgcatgtattttttatgatttcccactttaactgatttttttattaaatgaagaaatggtctcaatcacattggctaacatggcctctatttatttaattcatctgtttttcccactttggggcatcaacagcatggagtatttggaaaactacttgtatttgtaaagagtaaaatgcagtttaacaaagaagttagtttgtcattgtatagttcaggaactctggcctggatgagagcatgagtttgaaattttgtcctcaagattttgtttttatcttaccatcaccttttatgcttaagtttatgattggccataattatcaaattgacacattatgtcatgtgaaaatctgtttaccaaacttttctattaataaacttgatgtttaattgtaatattaagagtcacagagtgctgtagattctgtttgtcatagttgtgtagcttttagagtttagggaaatctagtttttagaattgacacaatgatttttaattttagcagtgtgttgaataacctgtgatataccattcacttattaacttcacattgttgtataataagttataaattttagatcagataagaaagtaaaactggtattaatttgggaagaagaaattgcagaacttgagtgatttttccaaataatgtgtcagctgtaacttgaatgtgttatttttatccccaagggtattttgaaatatacttatgtgaatttcttatagtttattttaaccataaaactattttgatatttttataatgccatcgatgatactgtatgcatagtgagggcatgggttgtctgttcttaccaccatattcccagcactagcatggaacaaatgaataagaacggagtaaaaatgcataatctaaacttgactatgtgtgtcttcaaaataatacctttaagttattttgaaggaaaaaactatgtatccaacaaattcaaacagatacttacaaaattaagacgattgtaaatgtgtgttgtcctccttctcattgtttttcacatccaaaaatgtcctcttggagcctcttatctgagtagcttctgtggatctgatgatgctaggattttattttttcttttattttaaagttcttctgattacatcatctctttgtatagacatcattcttgacagatggcatttattaaatatggacagtagcaggcagttaaaaagacctgcatgagataggcaggaacctttcttttttctttctgactctcagaagcaataccagcattagctttatttaacttctagattaatttaaaaagaaacctctttaaattatgactcaacaggtacagggtgaagtgggggaaatgtatgtgtgttttaaagcttcccaagtgattttgaccatcagttaagtttagaaaccactgattacaattaatttccttagaatttgctcatatatttaattccaaagaggaagaaaattgaaattttaaaaaacatatgagtatttttggagatgacataactttccttttattgtgttaaaaaaagctttaagaactgtttttttctgcatttttattaattatcaagatttagtgatggtttagagagctaaaaacacctttagggtgaattcagaagatctagcagatacaatgatgaaatatgatcagcaagctttaggagaggataacaaatgtgtgattttgaaatctcttctatttgaaaccaatccagagtcttgaatttgatccagtatatagtatgctacaaatggaaagattaaactggagcaatataattagggtaagccattgcatctgcacttgtatcgcagcaactgaatttgaaaccagctgcaaaatggtgactaatctctctggcaagcccacatgagagtgtagtacaataagccagcttcagcctcatgagcacatgtttcttcaacttgcctctgagcaggtgatggtgatgatgcaatctgattatacttttgaatgtattctaaccacagtcaacagtagagtctcacaagggatttcacaaaagacttcaaaccgactgtatatttttcagagagttgagctatagacagccatggaaagtagtagttttttttttcacgttagtgactactgtactttgcagtactttataatcttaagtttaggaggctttagttttcatatgtgaactgaagatgagaagaataatgtggaaagaaagtacttgtacttggagcttttattctgaattgttcacaacaacttacactgatcaattaaaataattaaattgtctagactatttaattctgtacaaacaagagatggtaaatcagtgtactgtgtttaagtggtacactaacctttccatattcagagaagtacctccctgggtcttgaacattaaaggtgtttaataagtactcagtttgacttggacttgagcctttatttttgaagggaataaagtttcttcttccagtgtacctcagagggacttggtaagcatgaataaagccatctgtttgaaaatgtatgtcatttttggaaaagtgctacagaacctaaaatacagtcacaagtattatttcaaatgtatagttcagaagtagaatacttagaaattgcttgttaatcttaattgtaaatagctaaaaaaaatatagcttgcaataaaggacacaagagcattaaaatataaaagtcacaaactatacatctctgagaataaagggggaaatgggatgtaaaaaccctaggctggtggcactcacagttggtatacagcagaatgactttggctgcttgtcagaagcgaataaccctgggcctcttccccatcacttctgattttataggtttggagtgtgtcccaggcatctgtgtttttaatcatttccccccctaacttactctccccatctaaacttgagaaacacccagactactgtagtattatggtactatagactactgagtattagtacagtactatagtgctgactagtaagcttcctaattgccaaacaaaagaaaaattttcactgtcatcaaaagaaataaactttcttcatggtaattataaaaagactttttgagaaaaaaaagcatcttcaatagtgattttgtagaagaagccaatttgtttttttgtgtatttttatttaaacatttttattaaaacaaggggcattttactgaagaattaagagccttcagtgaaggctaagtgcaggtgtgctgccttctagtaatccagactaggtggttagtatgagttatgggttgaattctgtccccccaaaaaggtatatttaagacttcacccccagtacctatgaatgtgaccttattttgaaatataatctgtttgcagatggaatcaagttaagatgaggtcatactcattggagtgggccctcctccttcactgactgatgtccttataagaagagggaaatttggacacagggagacacagaggagaaatggccatgtgagagaggcagagatcgaaatgatgccaccacaagccaagggacaccaaggattgcaagaaaccaccagagctaggaagaggcaaggaaggattctgccctagagacttcagagagagcttagccctactgacaacttgattgacgatttctagtctccagaaatgtgacagaataaatttctgttgtgttaagccaccacgtttgtaccattttgctatggcagctttaggaaactaatacagtatgtgaatctctttttctgtcatttggatttttgacaagtttcttttctcacatattccatatgtgtgcagaggttcatgagctctggacctgtcattgtggtcaaatttgaattctactttaaatgttaaggcacctgcgtgaaaaccacactactgctgcataattgtgagccgtaggggatactgccattaggagccatttttccttaaaaggaagctcatgcatttgaataagtagtaaatggtgatggcagagttatgtttcataaaatatggaggagacttttgtcatcagcaggaactgtcacttttatgatcttctactggaatgaaaactcacttccaccccaggaaagatctctgcagaggcagtgaatcaatctctgtgctgcctcttcctcctccttgatcttttttgtgattgtccatgaggattttgctacctgccctctcagggattttactgaactccccatctgtgatggttaatactgagtgtcaacttgattggattgaaggatgcaaagtattgatcctgggtgtgtctgtgtgggtgttttcaaaggagattaatatttgagtcagtgggttgggaaaggcagacccacccttaatctggatgggcactatctaatcagctgcccgcttggctgggatataaagcaggcaggaaaacgtgaaaaggctagactggcttagcctcctagcctacatcttttcccatgctggatgcttcctgtccttgaacattggactgtaagttcttcggctttgggacttggactggcttccttgctcctcagcctgcagacggcctattgtgggtcttgtgatcatgtgagtttaatactccttaataaactctctctctctctctatatatatatatgtatatatatgtatatctatatatctatatagatatatagatatatactattagttctgtccctccagtgaaccctgactaatatagattttggtacgaggagtggttctagaggaacagaatattaaggatggagttccttcgttggttttggggattctggagttggctgcttaatatgattagacccaataatgcgaaggactctacttctaatggtatagagaacactgatagtccttggcatgaactgtttagacagttatgcaaaataaatgcatttgacactcctgatttaccgcccatgtgagacaaggggtttagtgactctgtacataataccttaggctgtatgtggagaactaaggaatgtaatgaagttggttggttgctcctaagttcactggacaaagtgatgaaggaaaatgatgaattcagggattctgactcctggctacagaagcatatactgagccttaaatctcctaagactgccctcagtgagagtcttacctcctgtagagaaagagctgaaattgtggcaaaacagacacaagctcttatcatgtgggtggctgacctgtaatggaaggtgcatgcacagcctcaccaggtgtctactgttaaagtgaaggcattgattggaaaagaatgggaccctgcaacttggaatggggacgtgtgggaggaccctgatgaagctggggacactgagcttgtaaaccctgatcaatcttttttgccagaagaaacagcttctccatccccagtattggcaacattccctctccaaccgatgctgccatcagcctttccacctttgtctgaggagataaaccctgcactgcctgaggcaacagtgatggcctcccctgagcagttgccaggcaagataatgttgattctcctcaggagccactgccaacatccctgtttgcttctagagctataactagactaaagtcctggtgggcccctagaggcaaggttcagagtgtgacccatgaggaggtgtgctacacttgagaagaactgcttaaatttttcagtttacataagcagaaatctggagaacaggcgtgggaattgatattaagggtgtgggataatggtggaaggaacatagagttagatcaagctgaatttattgatttgggcccactaagtagggattctgcatttaatgttacagctcagggagttaaaaaatgttctaatgtagtttatttgcttgattagctgaaatgtggattaaaatatggcccactatgagcgagctggaaatgcctaatctcccttggtttaatgtagaggaagggatccaaaggcttagggagattgggatggtggagtggattagtcactttagacctactcttcccagctgggagggtccagaagatatacttttgaccagtgctttgcaaaatagatttgtgagggcagcacctgtatctttcaagagcccgataattgctcttctctgtatgtcagaactaacagtggcaaccatagtcactcaactacaaaatttaaatatgatgggaataactggatcctgaggtggcaggggccaagtggtggcactcagccgtcaaaggcaaggtaggcatagctactgtaatggacagcagaggcaaagcaacaatcagaatagtctgactcgtgtagagctctgccattggctaattaatcacggtgttcctagaagtgaaattgataggaagcctactgcatacctacttaatttatatgagaagaaaattttcagatcgaatggacaaaagactaatttgaattataaaaacagaatcatggctcctcaatcaatttccagaattgagccagtttacagacccagaaccccttgaatgaaggggaggccgggtccccttgaggaaggatcccattatactaccgacaatttatgctgttaatctttctcccatcctcccccaaggagacctccagccttttatcagggtaactgataatgtcatttcagatagtccctgaaatgcctcatcatttccctttctccaatgcacggttgatctgaggtgatgttgattccgggggacccaatgtggtcttccagttaaaatagggccttatggaggtcaggtaattaatggagttttagctcaagtctgacttacagtgtgtccagtgggtccccagactcatcctgtggtcatttccccagggccagaatgcataattggcatagacacacttagtagctggcagaacccccacattggctccctgacagtagggtgagggctattatggtgggaaatggaagctattagagatgcctctacctagaaaaatagtaaatcaaaaacagtatcacatccctggaaggattgcagggagtagtgccaccattaaggacttgaaagatgcaggggtggtgattcccaccacatccccactcagctctcctgtttggcctatgcagaaggcagatggatcttggagaatgacagtggattattgtaagcttaaccaagtggtgactgcaattgcagctgctataccagatgtggtttcattgcttgagcaaattaatacatctcctgatacctggtatgcagccattgacttggcaaatgcccttttctccattcctgtccataaggtccaccagaagcaatttgctttcagcttcctgttctacctcaggggtatatcaactctctggctttgtgtcataatgttatttggagagaacttgattgcttttcacttccacgagataccacactggtccattacattgatgacattatgctgattggatccagtgtgcaagaagtagaaaacaaactggacttactggtgagacatttgcatgccagagaatggaaaaaaatctgactaaaattcaggaaccttccacctcagtaaaatttctaggcgtccagtggtgtggggcctgttgagatattccttctaaggtgaaggataaattgctgcatttggctcctcctacaaccaaggaagaggtacaacacatggtgggcctgtttggattttggaggcagcacattcctcatttgggtgttttacaccagcccatttatcgagtgatccgaaaggctgccagtttgagtggggtccagaacaggagaaggctctgcaacaggtccaggctgctgtgtaagctgctttgccacttgggccatatgacccagcagatccaattgtgcttaatgtatcggtggcagatagggatgctatttggagcctttggcaggcccccataagtgaatcacagtggaggcctctaagattttggagcaaggccatgccatcttttgcagataactactctccttttgagagacagctcttggcctgttactgggctttggtggaaactgaacgtttgactatggatcatcaagtcaccatatgacctgaactgcctatcatgaactgggtgctttctgacccatctagccataaagtgggtcatgcacagcagcattccatcatcaaatggaagtggtatatatgtgatcgggcttgagcaggtgaaggcacaagttacatgaggaagtggctcaaatgcccatggtctccactcctgccaccctgccttctcttccccagactgcaccaatggccttttggggagttccctatgatcagttgacgtaggaagagaagactagggtctggttcacagatggttctgcatgatatgcaggcaccacctgaaagtggacagctgcagtactacagcctcttcttaggacatccctgaaggacagtggtgaagggaaatcttcccaatgggcagaactttgagcattgcacctggttgtgcactttgcatggaaggagagatggccaaatgtatgattatgtactgattcatgggctgtagccagtggtttggctggatggtcagggacttggaagaagcatgattggaaaattggtgacaaagaaaattggggaagagatatgtggatggacctgtctggtcaaaaactgtgaagatatttgtatcccatgtgagtgctcactaacgggtgacctcagcaatgcttctgccaagactatcatccatggactcatggaataccttatccaccatcatggtattccacacagcattgcctctgaccaaggcactcactttacagctaaagaagtgcagcagtgagctcatgctcatggaattcactggtcttaccatgttccccatcatcctgaagtagctggattgatagaataatggaatggccttttgaaggcataattacaacgccaattaggtgacaacactttacagggctgacgcaaagttctccagaaggccgtgtatgctctgaatcagtgtccaatatatggtactgtttctcccatagccaggattcacaggtccaggaatcaaggggtggaagtggaaatggcaccattcaccctcacccctagtgacccactagcaaaattttgcttccttttcctgtgacattacgttctgctggcctagagctgttagttccagatagagatgttagttccagagggagaaatgctgccaggagacacaacaacgattccattaaactggaagttaagattgccagctgtaccctttgggcacctcccacctttaagtcaacagtctaaggagggagatacagtgttggctggggtgattgacctggactatcaagatgaaatcagcctaatacttcacaacagagataaggaagagtatgcatggaatagaggagatccatagggtgtctgttagtattaccctgccctgtggttcaggtcagcgggaaactacaacagcccactccaggcaggactacaaatggccaagacccttcaataatgaaagtttgggtcactccatctggaaaaaaacccatgacctgttgaggtgtgtgctgaaggcaaagggaatacagaatgggtaggataaaaaggtagtcatcaataccagctacaaccacatgaccagttgcagaaatgaggactgtaattctcaatgagtatttcttcctctttttgttaaaaacatgcttgttcatgtatacactgtgttaagaaaatgccttcattttcctttttactttatcatgagacataagatttattggcttcatatcaacccttaagtattgttaactttatgtaatagcatttgggttggggattggtgtgttttcggttgtacatagcatagttgaattatgttaggcataattatgaccttattattgtctttatttgaaaattatatatgatctcaggaaatgtgtatgagttcaagttgacaaggagtggatttgggatggttgatactgagtgtcaacttgattggattgaagcatgcagagtaataatcctgggtgtgtctgtgagcatgtttccaaaggagaataacatttgagtcagtgggctgggaaaggcagacccacccttaatctgggtgaacaccctctaatcaactgtttgcttggccaggatataaagcaggcaggaaaacgtgaaaaggctagacaggcttagcctcccagcctacatctttctcccgtgctggatgcttcctgtcctcaaacatcagacttcaagttcttcagctttgggacttgaactggcttccttgctcctcagtttgtagatggcttattgtgggacctttgtgtgagtttaatactccttaataaactctctttatatatgattgtgtgatttaatgctccttaataaactttttttatatacgattgtgtgatttaatactccttaataaactctttatatatatatatctattccattagttttgtccctctagagaaccctgactaatacaccatccaaacctattttcttctgttggccctatttttaactcttgggacctccattctgtggtaaaatgccccattcagagtaccagcttgaagccaaactggtacatgttcagatatgtgtgtacatgtgtgcacatctagagttgcttttttgaggataatttggctttaactgtaggaatctttatagtcaacttgacataaagatctagggtacctctacctgggaaaatcctggttctcgctgttcacagctggcggccagcaggcaagtgatttaatctctttgagtgttcagttttctcatttacaaaattgagatgataaaacctatctcaggccgggcacagtggctcacacctgtaatcccagcactttgggaggccaaggtgggcggatcatgaggtcaggaggttgagaccagcctgaccaacatggtgaaaccccgtctctgctaaaaatacaaaaatcagccaggcgtggtggcgtgcacctgtagtccgagctactcaggaggctaaggcaggagaatcacttgaacccgggaggcggaggttgcagtgagatgagatcacaccagtgcactccagactgggtgacagagtgagactccatcttaagaaaaaaaaaaaaaacacctatctcagaggttgatccatggattaaataagtagccatatctgctacacaggaagcactcaagaagtggtatctcttgctgctatatgaatagtattaagattccagtagtcttttcactatgttccttctcatttgtggtgtatccatgttttcattcatttattcaacaatatttatagtgggcctaccgtatgtcagtgactttgctgggcattaggaatgtatggtgaatatgatggatacagcctgtgccctcatagaactgacagtccagttgtagagacagacattacatatacgacaacctaaataagtgtaaaactacaatgttcataagtggtatgagagcagctgaccaaatgtggaagattgagtaaggcttccataagtacataatgtatttgtgtcggaaatggaaacgtgaatgagttaactggatggagaagggagaggtgagtttgagactgagggaacagcaatgtttaatggctgtttggtgggagggaacatagcacatttggtgagtgggaaaaggcccttccactgatgtgcagagagccaggatggagcatggaacatgatgaggctcgggagttaggcagaccctggtcatgctagaccttgtaggcactggctgtgtcttcatcttaagagccatggaagccaatgttgaacattaagctgaagatgggaatgagctggacaattatgggtttgaaatgatgtttcgttttcatcctttgagaggactttgttctctcagacagatgctctccattctgtcacacacgtggtacttggcttctgtgattagggtgccagtctcttgcagtcattctgccacttcaggctatttctttgctacctcattgataaggctgccatcttctgagcttgcatttgcccattgttatcctctactcactctggattgttccccagacttcatagagccctttgacttgatttctttcccttcctagatcctatagttagcctggacaactctaaaattcaggatgccctggtgaacacgctaacctcagtctccaaagactttgtcagtggagccagccattctcttttctaccccagtcattctctgctgtggtcttgctccagattatataatcacacagagcagtgctaccttgaaaaacgtaaattttaaacccagaaatcctaccctctcgtgtcaagttgtccctctttcctgccactattcccactcgttcactgaattcattgacagctgtttgctcagtctctcatcactgtctgacttctctcacccagtctggagcctatggtcaatagttgcagtgttctaagatcaggtctctattatttaggaccctgccacttttcaactctggataaactcgacttttccctttttctgcccttgctcctacactattaagcattcctggaaaaaatcacaactgtcatatgggcacgataatgtatctttgctttccagttatgtgagctgtcagctctcttctgtggtcttttctcatcacttttgtcttaactgggtgaatttcaaccttggctgtactttggaatcacgtggggtgctctaaaaaataccaatgtctgcgatttactcctagagattttgatgtaattggcctgaagaacacctggcagggacgttttagacactccccaggtgattctaacatgcagctaagatggagaaccacgtgctaatgtgcccacagagactgatggacatgtttgctgcttcttgcactctctgctagtcctcattttaagcaattgatcttgtctcatccagttctcgtcctttttctacctttaaacttacctctgattgcattcatacttgcctagttcattcttaatctagagaaaaacaattgcctacatcctcacgtataagcccttcaaaaggtacactaggtgtctgtctcaccctctctgctcctgatctgagccagatgagcttagtggctaggtttaaataataggcatgtactaataagcatgcatttctcttaaaaacaaaacaaaacaaaaacctgggggaaaaaaaaccctcaaaatctgccaaacctaaatctaagcaatattaagcagaaagatgacaattttcaaagcaaataatatttgatgaaatatactgagatatgtggtatttaatagatggttggggctggataggggcagtagtcggagtggaagcagtggcgggaatggtggtggggctttgtatattacactaaagttgttgaactttgagttttaaatgtgttgaaagttcctcctgggggaaaggagtaaaatgatcaagtatgttttttgtttgtttgtttgtttgacatggtgtcttgctctgtcaccaggctggagtgcagtggcaccaatctcggctcattgcaacctccgcctcccgggttccagcaattctcctgcctcagcctcctgagtagctaggactacaagtgcgtgccaccacgcccagctaatttttgtattttcagtagagaggggggggttccaccatgttggccaggatggttttgatctcttgacctcgtgatccacctgcctaggcctcccaaagtgctgggattacagccgtcagccactgcacccggcctcaaatatgtgttttaaggatggaactattgtagtagtgcagggcatggtctgtaaaggaaacaggttagaggacatttggaagcagtgttcagcggtttaagcaagaaatgatgatgtcctggactaaagtgatagcagtgaggaagaaaaaggaaaaggaaaaggaaaagcaaacaaacaacccccccccaaaaaaaaaacacttctagaggtattgttaaaactagaatcaataagattggctcattttgcattctggagaattatgccaaagactcataggcatttaagttaattcgcttatggtaattaacccaaaagactgctaaattgcctatttgtttataagctgccgcaataaaagagagttttcagaaaaattttttttaaagaatagaaatctcttctatggagtgtaacgctagagcaaatttgaaataagctgtttgatcagtgactcagaatctttataatgatccattaaaatgtgtaaaagaagccttaagtataaaaataccataatcaggagaagtgtagtagctaagggcttggactgtggacacagactggctttgaagtttatttcctgccttaactgacctgatgaccttgagcaaattgtttaacagtgctatgattcattttccttatctgtacaatggagacagtaagagggtccaccttagaggattgtgaaaaatatctgagataaatattaatgaccattattttgttttatatagtcaattttagatagatattcttacatcttctgcttggattacttgctctagccattgagattcactaaattattcttgttatttagtaagcaaatgcaatgagtaattcctgttccttttaagaaaatattcattggctgaatattagccaactgatatgtttttgttaaacgtaaaagagtagatcctcccatgaagttccagttgagtgttttttcttgaaatttactaattgtccttaacttctataatcaataaattctgtgaagtgaaagaagtagggagaacagtaaggtgaaaaggcaaacattttctaatgagttgctattagtcttctaacctgggataaataataaagtttctaatagatgtgtataacatcatagccatttggggtgttttaaaaatttccatgttaactttaaaccttaatctttgttgtatttatgacagaaaaaaattaaaaatgacttaaatcagtgtgcctaagactttaacattgcagtttaaatttatagacttcaacataaccaccagtttttggtgatccaacattcagtctgattttccacctcattgaaaacattctacagctgctgccgagtgatttcataaattgcattcatgatcctggctggaagttctcttaaagaatgtggtctggatgaatacacaacagttttaacacagtcccataaaatatagttcagtgggataggtcaagtttaaagttgcacaaggatttcataaacaccctgagtagatgggcactaaaactttgaatgtgttatatggaaaaaccttataaagggtggcagtgttccaaaggtagattaagttggtcatctatgaaacaattcctactactgatggttcttaatagtaccacctgctagttgtttcatattaaattgtgtgaaacaacacattctggaaactgatgaactacttatttatttaataaacccgtcaatgaaagaaacctctgtcataagtaatggagttatttattaggcccaaaaagtcttaagccagaaatgtcaggcatttttgtggacaaagagtgttgtaatctcgtattgttttttcaaacagcagcaagtagcacacgatacccagttggtatgtttgtcctttatttggatggaaactccagaatctctgggtagtcagctgaatgccaatttaaacctcagaaagacatcagtggtcttggtgtatagtttcaaagataccactaggctttaagtatgccctgaagcctgacattttgggtgcttcactgatgcatttcctttgctgatcttatttattggtttagtgagaatatcttcaatgacatgacagttgctatcttagaaagcaaggccaaacaatctaaacttcatattcctgattgaaggaattcctcctgcaattccgtacattataattgtggtcccttgttagaatagatgttgctcatgttttgaattaatatgatgacatgaaatgagtgatacacagaaaacattagcaatatatggtagttatgactttgccatctagtatgtcaccagacattgtacagaattatcccaggccagtttttaatactagccagtcatgtcaattgaagttagatattctcccaaaatattattttcagctctgtcactaaacttttctttatttataataatatatgactttttatagttgtgcgttgtatgggtctaaaatagtccatttgtattagtagctttgagctatcttgaatctagatagcatacaccaagacagatttcccacatatttttaaaattgattatagacttctgtcacacataatatgaacatctctctttagagaagaaaatatgagtgtaatttcaggttctttcagataatcatgagattttaatttccttggattttcaaaggaatgtaatctcttttcatttttttgttataaatagttaaggattaacagtgtgtgctttaattacaaggtatgtataaggttattctcccccccgcaaccaaccctttttttaaacttttgatgtttttgatcaatgtcattattatcaaagttctttcagagttactgcagggctataggcttaagttctttttgagatattgttcctagttttgtaatcgtaggagactttgttagctcatgacatctcagagctttgagccccctgtggtatgattttgggtgtgccaggtcaaattagactgttatatttaccctagtgtggacgtgaatcttctcttagttcccagaaattctttggttcctgtgccttggtgttgtagctaacctttatttattattaagatttttaaattttaattaaggtctttaggtttgaaaccttaagaatttcatgataataagaagcttaatacttttgaaattatcttttctatttaattaagctgtattttggtgcttttactttcagagctaaacctctctccctattcagtgttcacccaagtaaatttgaaagatgttattcttcattatattcaaaagtatataaattttactgtacatttgaagtttcatcataaatactcaagatcacaaggaattttgttaaaataaagcccttcgccatatcatgctgaaactaaatgcctatcctcaaaggcttttttgatctctcttgttttccattcttcccttaaaatagttacctatcatttccattaatttgcattaaccaccttatcatatcttgtggtctttaaaggaaaatgatatgctagctaactttatttttttcatacataaaacaatgtgtttaaccccaagtgtattaacaatgctttgcaatttcctgcaatgctcaggaaatatctaagactactataccaaaaagcagattgaatttgaattctatttttacatagtaaatataaaattgtattttatagtcctaaaattatatttaataaatatagtgtgaacagggtattattttagtagtttctgtcatgaaatacttatgcctcacaaaaccaatagtgtaaaaaaaatttcaagaacacatcaaataagttacagtttaataaacaatgatttgtccatgaagagtgattatgccttaaattaatattgttgcaaggtcaaaaagttgacattggtaacacaccactcttgaggatacagacattttggcaaaaaaataacccattacgggatcaaattagaaggaaagttagtaataatttaaaggtaattctaaaggtacaatatgtgcagatacacacatactctaaagacttctgcagacttttaatccaagcttaattttaatgtgttgtagacatttcttggaaaaccactggggtaaatcccacatcctcacctttttttttttttgagacagagtttcacacttgttgcccaggctggagtgcaatgacgtgatctccgctcactgcaacctccgcctcccgggttcaagtgattctcctgcctcagcctcccgagtagctggaattacaggggcccaccaccatacccagctaatgtttgtatttttagtggagatggggtttcgccatgttggccaggctggtctcgaactcctgacctcaggtgatccacccaccttggcctcccaaagtggtgggattacaggcgtcagccaccacgcccggccacattgttatgttaaatatgaatttcttcagagttaatttctatcaaggcagttttgattattttgacccaatagttttagtttccccgaagtcagcctcactgaatttaggaggacttggaaacacccagaaagtatcttccacaggttttttgctataggaattgtgtttctaaaagtttgtgccatcattaggcacatccataggaatggatctacattgtttgtccatgattagagaattgctttccctgatgaaatatttagatcccctggtaaaggagaagctgtggtatttcttagaaagagctttaccatttggtgagaaagagagatgtcttttgaatgttgcagtgaaatgcatgaaatgcagtttcatgttgtcctccccaatgtcttcaacacattctcttgggacaaaggccttcctggttgtagtaagaattttcagtgttcttagtagtcatttctctcttcagttcccaatataaatgttgcatattatgacttgaaaaacttagtttttgaaagtgtctgctggtcaggccttcttcctgagatggatccctttggatttttgcagctctattttgaaattgcacgtttcttccttataagtaccagctgtcattctaaaacatggatcttcagatcacagttcaattttccacctcccaatttgatgaaggtgggtttaaatgactcttcacctgccgagtttctacttctgtgcataggaggaggaattcttcttatttagattacatttattcacgcactactttcagagattcagtcgtctttatttatttgattccagtgtgctcttcaaatgatctccatcaatgcaggcctcctgatgtgcatgatagcccttatttactggttttcatttcacagaacatgtttttcttcatcttatttactaaaaatgtttcttccaaagtctgattcttttctttaagaaagaattctctctctgaatcctaaagccctttcttgatgtcttcatatccagtgactgagaaaataagaagcaacagactcattggtccatgttgagatgggagtcactgtatctctcctctgagcttttccacaattcagaagacagatgtcacatcctttaccaatgcatctctgacagctgtagcctggcttccagcggcctcctgctgagctggctgcttttcattctccagtggtgggaaacaatctgaaaacaacctgggtcaccagaggtcaccaggcctctggttttcctgaagaccccactgcttctccagaagctgccatggccaccttgctctgagaggggttttccttctttggcgtgggccatgcccctgtccagtaggttctctaaagctacattttgcgaatctgtcgtcttttggagagaaaggagttaagcttacaaattatatataatttctgtatattaattgaggggaaaaccccattgtctactaagtcagtcccttggagctgaatctcagctctgccacttgccagctgaaactttggtgagttaattaacctctctgggcttcagttttctcagccgtgaaacaaggatgatgacatggactcagtagggctgttgtgacgtttagatctaataacttatgtaaactaaaataccagcccagtgggtgctcagtcaatagaagtttccccttctctccagcagaaacctcaggtttctacctaccaccagttcttacctttggattttgtttttatcttgtgcattattcaatcacaagaacacataacatttagtcatgttgtaggattaaaagcctggagaaaacaaactactgccacagcatgaatgaagaacttaaccactgggaaaaactcagtattatttgattcatttcacctatgacagtttatgtattttgggggacagcagtggttgtactattattttaaagtgtacattgagatttataaagtgttaattgtgcttatattttcacccatcaaaaaatgattgtttttgcttgatttacctacctaagtttttgctaaatttggtctccttgaagctgggtatattgtctttttgtgtatagtaacttaagaatgtggaatgtgggcagacagcataatctatggtagttaaacttttattagattgttgtgaagattaaatgagatagtacatgccagaggcctagcccagcacttgcatacactaagtcaataaatattagtcattattctgcagtggaaaatttagtgtcactaaaactttgtcctgctagtcaccttaaaacagacagcataacctagtttttcatgttatcaattgagaaaatggattctaaagtcaagctaactgaagaatgtcactttaatacataaacgggtatattttttttgaattgataaaagggtctgtagaatattaaacagtagttattaaaagaattaattccatttcttaaagaagtttagtgtgaccaaccactagtgtaggcattggaagaatttagtatattttgtaaaattttttccagcatgggatctgactctctgaacctgaaaatgaagcaaacaaaacagaggcttgttctgcctatgcccttagtgccaaaacataaatcattgctgtattcatcaagtcataaaatttaaatcatctctatttgagttggataacttgctgcggtatttgatactaaccactggttcaagcaggacctggtgatgtttaatggactattgttcaaagttgttggactaagttgttgcattaatataaaagttttgcaaaataacatggttgtaaaagaaatcttccactaagcaatgaatataaatgaactttatttgtccttgtaaccaaatactgttcaggaaaattttttgctttagctttacagctaatttgccctctttctgggatacttttagggctgtggctaccgagtgacatcatatgtaggcatttctgtatatgtttctcttgctttcctattttctgtaggacagagttgccagctgtcatcctctctgggagggaaccgatgctcaaaaaatggcactacctttcctctcagcagtaaagtgccagtgtttcttttacagctgccatgtgcaggtgccttgacatggctgcatttggaatttagacgacagctgcagaaggtggaaccattggctgtagggtgagtggtcttaagttttcagctgagacataggtaggaagaggaaactgaaaggaggctcagcacagggaatgaaatcctgttgtttggattcttgaaagaacagggagaaatttcaggaaaaaggatgagaaattatttttacttttcagcaccattattcaggcacaaaatctggacaacaaattataaacttaaagcatttcaagtgtcacttaattgttacctaagtatactttaagtagcttagattaatgtattttaatgtaggaaattagcatagtttgttaaaagattttaattcgacagaccacagatgagtacacgtaaatacttagtaatgaactgctgcatcagcaggcatttgaggtttaatcatgcagtcaataatatagctcactgtcattaccttgcctggtccctgtgaaatttatcatatttttagtaagttactgtagccttaggtgagatttggtatttttcttcgttactaacacctgctcttttcatggtactctcaacaaaataaaatagttttgttttgttttggtagcaagcttaacaagtggttttttgaagtaactgattatttgctcttgtgcagtgtggtttgacctcagcacctttgctgtctaaaaatggtcagaagtattttccaaacttaaaatagatttttcaagatctatttttctcaaggaaactgtttgatgttcctagtgacgtaacaaatcaatcaagcaaaagctttagaaaatctggatatttatattagggtcaaaaagcacttaatatttcctgatattatgttaaaaatggaaactgtaagtttatactaatcgagttattttttgcagagaaattatgagatctttgatttttcactttgtaatgatgacagattcatgaagagtagaagaaatggctcagctggctatttagtagttagagaaacttgtgaagaagacattcagattctgcttatttgtctatacaaaggagagcacaggaagattaaccaggcaggcctgaagagaaatctgagtcagcatccttgctacctgtgtcaatggggaaaataggaaggcagcttaaataagtcaagactgttaagcatctaattactatacagtgaaccctttttccccttcagatagaagcatgattgttaaaagttcttgaaaccctggattgctactgctttcaaggcatgagacagatttgaaattctgggcagcaagctatcactttcatttgaaaactggcttctctttctttgtttcttcctttccccctttctcttttaaccaaaatctaacttatcaatcacaaagtttaataagagtaaagaatttcagtatttgggtccaaacctataaaatgtttacaagcacctccaaggatgtattgtgagcaatcacgtctatcctttgcgataaccttaaaaaaagttatctgttttctctccccacccaaatggaattgcaagattactttgtctataaatccttaaaaaacaactaaatccttcttcaaactgttataattttagctttatgctactttttatggtaagattgacaagttttctatcaactcttaaaacattcttttatttgccctaaattatttcaagtataagttggtattgcttttcttctagaattttgaaatttagtgaacaaattcaagtaggacacacccttcatactgttcgtaacactatatactcttttaatctgccttttgcattgccctttccctactgagaagtcataaccctcggttgtaatttacctcatacagcaatcaatgattttgtgatcactttagtttctttggaccttatccagcatctgtttatgtcttgacatgtagataccagaattgaagacaatttgaaaactggcttttctttgtttcttcctttctccttttctcttttaacccaaatctgttttatcaattgcaaattttaatgagtaaagaattccagtatttgggtccaaacctatataatgtttgcagtcacctccaaggatgtattgtgagaattcatgtctgccctttgtgggaataagtttaaagttttcttctgttaatgttgaaattaggaattcattttttctttaaattcttgcaaagcctgacttttagactttttttaaaattttacattccatttatttgacaaaaccattaacgtagctaatagcatggcagtgagcagttgtgcagttacataaacttcttcaggttataaagcttctattttgtatgatgtggcagtaattcagggagtaagtctttataaagtttctctaggtgctcaacttactaggagaactttggattcctttaaagagcaaggaaaaaatagtctcaaaaaaaaaaagactgtggcctggcgcggtggctcacgcctgtaatcccagcactttgggaggctgaggcgggaggatcacgaggtcaggagatccagaccatcctggctaacacagtgaaaccccatctctactgaaaatacaaaaaattagctgggcgtggtggcgtgcgcctgtagtcgtagtcccagccacccgggaggctgaggcaggagaatggcgtgaacccaggaggcggagtttgcagtgagccgagatcacatcactgcactccagcctgggctacagagcgagacaacgtctcaaaataataataataataataataataataataataataaaaataataaaaaaacactgtaatgtaattagttgaaacatgattagaatgacagttgaggtcctccctgcttattgaaccaacaataacttaaacaaacttaaaccactgatttgctaaaaacaactgtagacttttcagttaactacaattagtatgataagagcagagaaaaacctgcatttcttcatccttgtaaaacttaagtaaaaggctttaagtcaacttattaaaaatagaacacctttgtaaaatgaaaaaataaagtcattttttactactaaacaaaaaatatttttatttttagcgtaataaaatcaatcgttttatagttatagtgttgaaaaaatatttcttaccaactgcctctgaaaaattttcataaatactatttttaaatgaatactgatgtgagacagttccattgtacagcacagggcttggtacatcatagatgtttagtaaacgcttgttgatatgatgaaagtttggcaacatccaaagcatcgtaatcaggaggcagttgaatatatgccttctctccatcaggccgaatcaggtgttgaccttggccacatcgatgtcacagagcttcttcacagcctgtttgatctggtgcttgttggctttaacatccacagtgaacacaagcgtgctgttgtcttctgtcttcttcatggccgactcagtggtcagcggaaatttgatagtgtagtggttaagcttgtttctcctgggggcgctcttccgaggatatctgggctgcctccggagtcgcagtgtcttgggctgctggaaggtgggtgacgggcagatctttctttttttctttttctttttttgtggttgtggacacctttcaacactgccttcttggccttcgaagccttcactttggcttcagctgtaggaggggcaggagcttccttcttcgctttcggcgccatcttgtgaaaagggtcaggacaatttctagaaggattaaaggatgaatgctgtttagtaataagccgaaaagaaccataattttcaagtgattcttcatgattgccaactaagaataaaataaatatgaataatcaaacatttgaaattctgtatttatttctctaaaatcagcttgattgatgagaaagttactattgcttgacattttaatttttccagtttctgatattgatgctttattttgtataaaatggcactgtgatagaatatttactattctttctgtcataatagacttgctttaaactaaccccatcaaagtgctgtatgttcaaaatatcatcatgttaaggtaataattttcagtgtattagaaaagatttgtatagaaatatttattgtaaagcacgtgcgttttacactccatgcactaggttgtttttgtttggtctctgtgtatatatgtgtttacattcctgttgaaatctgaagaaggtggtgtgtatttaaatgttacttttagtttattcacatgaatgtgaatttctgtgtaagtatgtatctaaaattggtttagaaacaacacaatcagttttggtctggtggtgcaggatgaaatttatatacatttacatacttacaagtaagttgctttaaaattaaagtaggggataaaatgtagtgtgaattgttatgcaaaatctaagcacagcataattagcaagggatagtagaaatgcaatttgttaaaacctgaattgtaacagtcaattaatttcctcacaacgtgaaatagcaaaacaattaacaaacatcatttgtcaaaaacagtattaaggcaggttaaagaactacagatacaaaatttataaattataacattgaaaacagaatgttcagtagtgtttaaagatgttttgatatcttttacagatttttttaactgattgatttatttcaataaattttccaaaatcatgttaatactttccccttatgtatgtttggacttataacacgttttagatgtgagattttcctactctggacaaagtgagtctattggagaaagaatctattcattattaaagcaggggaaagtaagctaatatacatatatgtgtatatgtatatgtataatatatattatacatatacatatatattttccattctgcacttttaaaaaaatattgttttaaaatatatataacaaaattttccattgtaaccatttacaagtgtacaatttagtagcgttaattatatttatgatgttgtgaaaccatcaccactgtctatttctaaagcttttccatcaccccagagaaactatttttaaaataaaatctttattgagatataattaatataccataacattaacgtaaagtgtacgattcaatggcttttaacatatccacacaattgtataaccattaccatagttaattttagaacattttcatcaccccaaaagaaacctctgtatccattagcagttactcactatttcccccaaatcctctttcccctaaccctagtcactcaggaatctactttctatctctatagatttgcctgttctgggtgtttcatataaatgaaattttaaaataggtaggtttttgtgactggcttcttttttgttttcaagacctctctatgttggagcagatatcattacttcattcatttttattgttgaataatatcccattgtacggctatcccacattttatttatctattcactgattgatggacatttatgttgtttttgctttttggatataatgaataatgctgctgtgaacatttgtgtacaggcttttgtgtagacatgtattttcatttcattgagtgtatacctaggagtagaattgctaggttatatggcagtcctatgtttaaccattcgaggaattgccagacaatttttcaaagggatttgctccatttcatagtcccaaccagctgtgtacaagggttctcatttctccacgtcctggtaacactaattgttactgttttttttttttttttattatagtcatcctagtgagtgtgatatagtagttcattgtggttttgatttacattgacctgatggctaatgatgttttcgtgtgcttattggccatttatatcttcactggataaatgtctattcagatattttgtttatttttaagtcatattatttgtctttttattattgaattctaagagttctttatatagtctagatacaagcctattaccagatatatatgatttgcaaatattttttcccattctgtaggttgtcttttcataatacagttgacccttacaacatgggagttaggggcactgacccctgtgcacagtcggaaatctgtgtataagttttgactcccccaaagcttaaactactaatagcctactgttgactggaagtcttactgataacgtaaacagtctattagcacatactttatatatgttttatatactatattcttaccataaagcaagctagagaaaaaaagatgttattaagaaaaacatagagaagaggaactattcttactattcattaagtggaagtggatcatcataaaggtcttcattcttgttgtcttcgctgtgagtagggtgaagaggaggaggaagaggggaggttggccttgctgtctcaggagtggcagagggggaagaaaatacacgtatagtgtacacctgcagttcaaacctgtgttgttcaagggtcagctgtactttctttttgagattctactgttgcttctctctgatttctaattatatcacgactttattttgggaaactctgaactccttacggggtgtgcctatcattgataagctgagaaaggcctctgtgctggccaaatccatttcttaccccttggctctgtgctgtagaattcaggaagcatttattttggtatctgctaatgtactagacactgtgaccaacttttgggaataaatataagatggaagccattctcagtaagcttatagtctagcgaacaggtcagggaaagctgagttgtcaggaaaatcactgtctttataaaccaaggagagtttattttattagatttatgatattaacttgcagatcatagaaggagacttgaatatcactgagtatattttacttcgtggtctgtaaaaagtagtctagtacgatgacaaatggcctgtttccccacattttctttccattccccctcattggagctctttgctcagtctctctgggccctgaaagtttacattgattccttattcttgtcttttcctgggctgtttcttttctctttccttatccaagtctgtctgggaccgagacttaccttctcatggctcactgcaccctcaaacttctgggctcaagagatcctcccacctcagccccctgagtagctaggactacaggcatgtggcaccacactcagccaattggtgcctttctgaaggtcttcttttcctctcccattagcatagtactgttaaaccttgcgtcttgattaatattctcgtgtttgaatgcttagttgctctcgtggtttgcatgcaccgtagagtttgtactgtttccttctttggtgcactgtgtgtggagctgagtagaagaaacatggtaaaagcacagtgtactgttctcactttgcaacatcagttgggaaaatgatagagggaagcacttggggcaaatgggcaaaatagagcaatgggttagcaaatgcagaaaatgatatagttaattaaacaacctgatatgttgagttgaaggcaaagaaaatatacaattttataattgcattttagactatttaaaaatgctcctttctcttatccccagccttttcattagataagcagttttcgtgtgctaacttggaactcacatacgtttaaagtctttcatttcacacacgttgcttaaatatgtgcatgtagtttttgccttagctactggcctaataaaagcctcttgtgaatgcttatcaccttgtaaagtagttaccagagctacagtaaaattggcctgcaagtgaaaaggctttgacttccctagaggaagaataaaaaacatatgagacaaatagcagcaactgaaattatctggtgcagaatgtggcagaatgccagccaaatgccctgtccctcagatgtttcacacctttatcttaattcgctaaaaaggccaccttatttaaagaatttcaaacacaacttgagaatgccttattattggctttgacacagtttacacatacaatcctgtttcttattgctatcttctggtattaaggccctatagatttaagagattttaaaaaaatgtttatatttcttttaagtggagtgcatgtttgtgtgtgtgtgtgtgtgtgtgtgtgtgtgtgtctgtgtgtatgtgtgtgaactgttattggaagttattgccatgtttattttaggcacttcatatatctaattagaaatgatgtttattgttaagtaggcaaagttgccttcgagtgcatggtgagaaatagtaatgagatactttagccattaggccatgaagacttttacctaaataatagggaaggaataaatcctagtattgttttggagttgctacaggagaacagaaattgtttaaacgagagagtttcaaaaggccccactacagttaagtatatttaatttaattaggtaatcagtattattcttgcaactattaatggcacctcatttgtttaacacttgctatatcatagagcatttcatacgtgctactttatttggtcctttcagaaatccctagaacaaggcagggcaaatgtttccatcttggttcatggatgaggaaaaccaagactcaaagatatgcagtgacttggtcaaggtcacagagtagtagaggatggctctctttccattacagtgacagtcagaaagcgtcaaatcttaggttatcatgacacttagtaattatgaagtatattttttccaagaaataataagccttttaggcaattgaaactgccgagaaggctgccagaggagtaactcaaaacagaacaaacatggaggtttttggtcctttcatctctagcattgagtccactaggtcagggtttcaggaaatgggaaatcttcattgttacctgctaggttgccttatttctccatttaatggaaaacttagtcttcattattttcagtttaacaaataattttccttagaggaaaagaaagttttgcctgtattttggggaaaatgtatagaaattaaatctaaatcattgaattattagatgatgtgccatttctgagccaaaaaagtaggaaaacaatgcataatcatctaataaagtatatgttttatgattatatatgtttcttgttttgttttgtttacagtggcgtgatctcggctcactgcaacctccgcctcctgggttcaaacgattctcctgcctcagcctcctgagtagctgggactacaggggcctgccaccacgcccagctaattttttttttttttgtattttcagtagagacggggtttcaccatgttggccaggatggtcttgatctcttgacatcatgatccgcccgcctcggcctcccaaagtcctgggattacaggcgtgagccaccgtgcccggcctatatgttttattttataaagttatatgttttattatttactttttgttatgtaattgtttatgtcataaaattataatataataattccttaaaccaaattatattccataaattataacatatgaattcaatatgcatttataaaataaagatttctagacatatggtagactaacagtgatattttgaaatctacttctgccacagaactagataaccatttccagattggaatataaattaatcaatgtctcattgttagagctgctgtaattttttgaggggatcaagtgaggaaggacttatttttggcttagatttacatttacagcaaggttatcaacattttcctgtggtggcacattaatattaataatataatcataatgccgatttacacatttaccaaattcccatctattaccttcattcctgttaaaatacaacctatcatgttgttctttggggatgagtagtacatttatagacatataagtatatgtgtatatttatatatttgtatatataaaaatttaaaaaattcttttatttttaggagcaaaaatttggggaaaataatgtaatatttatcagaaggatactttaggatttagctctatcagccaggcagggtcatcagtaaatctaagaactgccaaacttctcacactcctaattccctcttttatccctccttttctggctgtgctagagatatcctattacacatgattttcttttactctgggctcttcttcgcccagatcagtgtgattgctttgcattgatttctgtatttgcttaaaaaaaatttcccttgataatgtttttaaactttctagcatgagcctttccatacttggtattggtgttttataatagatttgaggacaggtttgtgggggattccataacaaattcaatttatcagttacttctttttaatgttaaaataactgcaacaattccacaataaatagagtgaaatttgatgtgctaaattaatttaaatggttttgacacattttccttgaaggactcttttctaggtttttataatctcacctcagtgagagtacagtatggtttaattactttccagcagtgcacactttaatagcccgtattccacgtgaaagctatgtgtcttctgtgggtttgaactgtttctgcctaatccaaggaaaaatatttgaggaacattagttaatgccttttccaggaatgggagtgggtaagcgtttttttcatggcttatagaatatttagcaattttagcttccagtacttaattttatagtgttctcagtactggtggcaaaggcttccttcagaaaagtgagaaattatgtgaattcccctcttggcatgcttaggagggcaagtcatgaatctttactctcatatttttctaaaataaaactgggcgttgatatttgctgtgatctaatatgtagatatgatgaaaagatttataaaatagcatatattgagatttttgtatgttctcataaaaggtgctataaattgaaacatttattacacagaaaacgtctaagataagagtattattttccaggatagtttatctaagttctgtaaaacttttaataatgtaagtaactactaatgaaaggacgttatgtgtcacatttgcattcataaatatccatgaaggatctctttcaccaatgttattcagtctcagtccaagacaaggtcagacattgattatgtttgacatcttaacaaaagtgaatagggaagataaatattcttaattatactgctagaatggtgagaagcagtggtctataatgtaaggaggaatattagcaaaatagaattatggtcaattgcaattataataacttctatgcattaagtatcttctactacatattagctctttatatatgtcttatataatgtaattttaactaatatcttaagaagtctaggtagtatttatacccatttgcccaaatctggaaacggagtttccaaaaaattaaataaattccttaaaactgcccagctagagtccatttcacatctgtcaggctctactaagctgcttgtcagtctttgacttcctcattatcagagatagatatggtattgataatgtacaaattgtttatttggcccagaaatgtgtttgtgcttttaaatttgaactaattgtctttggcagtttgaaatgtacaatacttgatggaaaataataaaactccactccaattagaataactacctgatttcttgattatagcttctttaatgacggcccattttatattatacacggtttcatatttttcttatatttaacaaacacatatacaacactactgtgtgtaaggcactgttctaagtagttacaaacatgaattcatgtaatcctcaccagtatacttatgaggtaggcattattttatccccattttacaaataagataaatgaggcacagagaggttaagtaacttgctcaaaatcacacagctagaacatggcggagctgagatataaacccagtcagtttggctgcagagtgctcttaactgtatgtatttttcagatgtttcagaatttggtgaaagcaataattgttctaatcctattgctggatttaaaagtaggaaagggtaaatagagatagcaaacagtgtcaataaagtatttaataagaagtaatgacccccataatactttgaaattccctatattaaaaatacaagatgaattgtaaagagaaactgaaaaccagctttaactgtgttaaaagccagttgagacttctactttatttatccatttgatattatgcaggcttctctttgtgtatatagctgagcaatgtgaatataatgctgtcattattgttttctgtgttataccactagttacattacttcagattatgaagtacagtattgagctctgtcgttgactatatctctccccaattatatgtatcatgattttagcccatattttataaatgagagataattttaatgaatgtgtggggcaaataaaacttttagagttggtatgttaaaatagggctaaagttaaagtttcaagaattgtagagagagagagactagatgtgccaatgcaaacaatggattggtgaaactgaaactgaagaaatttctgataagttagagatttttggttaactaagatttcaacctgtgtgaatctcaattttggcagaaatgaggaatgtaagcaattctagctttgcaatgtggaaaagtcagggaaactaaattagactttgcactaacacttcctataagcatatgtcaccctgatattgaatgttgtatatgagggtggagggacaggtggggacaaacacccagctcctcctgggcttgagccaaggacctttggcttcagttggatcttgtaactgccctgtttacctgtaatcagaggcaaatttaccaggagtaaatttactgggatttaggtttcaggacctctgacttgcacagacctcctccaaggctctgcgaggacctctagcaatgtgttcacgtgatcatatggttttgcaaaatttgaggaatttaaaggtatttaagcataattagttaagactgctatctcttttctactctgacggtccttctatcacatttcctcacacaggattgctttggaatgatcacaggcatttatcagatctggctaaagggaaattgagttgagaatatacaactttaaactatagtttgaaagatattttgaaacatttcaataagacaagggagaaattatagactcctaatttaggtacatagggttcattattttctcatttttgcacttattttttaaagaactgagataatttagataatggaacataaaactaaagcaacaaagatgaatgatgaaataagtagaaattatttgatatcaaaaagcatgttgtaaaaaaatagattataacaaaagcagtaatgcattgaaaagaaaagtttctaatagagataataaataggcttgatagactacttgaaaacttagttaataaaaaagagtgaatcatatgaatacactggggaaacacttaagtttctcttgatttaaccacaaaatacgtatcgagaaagacaacataaaatgtcataatatgtaactataatgagctttataattaatgagtatcttcaggtcaaagagtatatatattagttgccacatatgaaactttgaaataccctgaaattttgcaactcataaaagaaaaaaattttatgaaagttttcccaaattttacagtgatcctaaaaacccgacatgagttgtgaactgaaaagaatctttccttaacacatatttctaaaaattctttttatagcataattagaagagatgccaaattattttttaatttcgtatgtggaaaattgtgttataaaattgtcatttgtcaaaatatgtataatcaaaaattttagaaaaaagcattatagaggtttgttggataaataaaaataagatggtatttttctgaatttcatgatgtttattttcagctatttaaaatttgtaatttttctgttctaaatatacttccactttctcttctaattttgtattcataattttgtattctttttctttaaaaggtctagaaaagttgcataagattcagttaccctacaacctggatccaccctggtctgtagttaatggttttaaacatgaaaaaatatatttattatgtagcatacatattccagaaggcataaagtgagaagtaaaagacccctcctccactctcatttgtaagcccaaaaagaaaatacttgaccttctttatgtattttttaaaattgttgtcacatcatctttttatttattttaatttttgtggttacatagtaggtgtatatatttatggagtacatgagatgttttgatacaggcatacattgtgtaataatcacatcacagaaaatgaggtatccatcctctcaagcatttatcctttgtgttacgaacaattcaataactctttagttattttaaaatttacaattaaattattgttcactatagtcactcttgtgttgtcaaatatttggtcatattgattctattatttttggcacccattaaccatccccatcaatccccccaactccccactactcttccttgcctctggtaaccattcttctactctctatttccataagttcaattgttttgattttgagatcccacgaataagtgagagcatgtgatgtttgtctttctatgcctggcttatttcacttaacataatgacttccagttctatccatgtagtcacaaataactgggtgtcattctttcttgtggctgaatcatactccattgtgtataaataccacgttttctctatccgttcatctgttgttggggtgcttaggttgcttccacatcttggctcttgtgaacagcgctgtaacaaacatgggagtgcagatatctcttcaatatactgattttctttcctttgggtatatacccagcggtcagattgctggatcatatggtagctctatttttagttttttgaggtacctccaaacggttctccatagtggttgtactaattcacattcccaccaacagtgtacgggcccggtgtggtggctcattcctgtaatcccagcattttgggaggccgagacgggtggatcacctgaggtcgggagttcgagaccagcctgaccaacatggtgaaaccctgtctctactaaaaatacaaaaaattagctgagcgtggtggcgggcgcctgtaatcacagctactcaggaggctggggcaggagaatcgcttgaacctgggaggcggaggttgcagtgagccaagattgcgccattgcactccagcctgggtgacaagagcaagactccgtctcaaaaaagaaagaaaaaaaacaaagcaaaacaaaaaaaacagtgtacaggggttcccttttctccacatcctctctagcatttgtaattgcctgtcttgtgaatataagccattttaactcaggtgacatgatatcttattgtaatttttgttgcatttctctggtgatcagtgatgttgagtacctttttatgtgcctgcttgccatttgcatgtcttcttttgagaaatgtctaatcaaattgtttgcccattttttaatcggattattagttttatttcctacagagttgtttgaactccttatatatactggttattaatcccgcatcaaatgggtagctttccttatgtatgttttacagttgttcagatctgctttgttcagtagggtggtgtgcactaaccagccacatgtagctatggagaacttgaagtgtaacaaatatactgatttttaaattttcatttcaccaaggtttaattttaattcagtttacattttaaatgaataatttcattattggaaaacttctaagtatatttaaaacaacttgggtttgtggatttatttttttcagctgtaaattttctaaaatccaaaggacatcactgcagtatgtgtacatgtggtgtgtctgtgtatatacatatttttttccacaaacgagatcatactctgcatcttagcttttcaacttaaccgtatgattgcacatcttttcgcagcaacttacagatttatttcatttagttattagcagtataatattctcttctgtttttatagtcttttttcatacagctgctggggtgattctttttaatttaagtgtaagtgagatcatgtcactcctttgttcacaacccttcggtggcttcaaatctatctcaaaaccaaattccaagtcttcactccacatcgaatgcctgccttgatctgttttctcactgctattttaatatggggattagacacaaatattttattctttaaaaaatccatcagaaatgttatttagtaaagcagagactttccacgtacaaaatttaaggtcttgtttagtgtctcatttattttaccaccaccagttccttttaaagacaccccatttttccttcccaatagcactcactgaagtaatataaaccttgttaactgtagtaaaaaatgatgcagactttctctaatcaagagctcatttacaagaggaaatggtgttatggcagatagctgaagtatactgtgtcttaagaatttgttgcctctttcttgctagattgaatttcagaattcagagtctaaattttctctttcacatctggtggcactttttaaaaaatcagtgtgcaaaaaggagaaaaatctctctgcttcctctttatgccactcactacagtccagcctatgccaggcttaaagaaaaggcttttgtattggcaaagacactccaaaatggtttccaagtgcattaaaagtcaaggagagttttgcagaaaaatttaagattaaaaaaaatccgagtggttacaagttaagaaaccatttttaaaattaagcaatgactaccaaaaacatgctggctaagtacgtatgtaatgttagcatcccagtgccactagtgcaaggcagactcccatgagccatttaaacataaaagttaagaaggtagaattttagaagttttaatgattatttgaaatctcaagggattcttatacaagatatggtgatggttataaatatatggactgacacacacttatcactaaataaatgttttacatgaacaaatgagtaaacaagtaaaccacattgcttggaataagtagtgtttgttagagctttgagccctgggagcgggggactcaagaaatagggagacttaatcagaaagaaaggactatgaagtgatatcagagtaaatgctaaaactaggcatagtgtgaagttggaccccaaagggtaaagacggttgttggaaaatgaagatagccttttctgtggaagatcaggcaagtaaccaccccagtttggagttatcatgaaatcagacttgaggacatgtggatttacacctggtgaattgaccaaaaaagagcttgttaatgtgctcagagagttgagaattaaagtgtgagtggttctgaactgagtattgtttgcaattatttatgaagaaagtgacagaaaatctagcttatcctggcttaaatgaaaaagggcatctgttgacacatataaccaaacagtccatgggttggactcactttgggcatatcttgatttaaggttccaaagatggcccaggatcttattctttgtgtgaaagcctcatcttagaccagccgcccctttctggtggcaagatggctacagcagctccaagccccttactctgttctttcatgaatgtgctggtcactattgtctcccacatcatgggttgctttttactagatgtctcttgttaaaaagtttttaattttagcgttaagtttctcaatctgtttcccgtttggttagcactttctgctgtgcaagtaatctttgcctcccccatgatcaagaaaatattcccttacgtaatctgctagacacttatactgttttaccaatcatatgtagagttacagtctgctcagaattccttaaagtctgggtgattctactgggcagccagggttgaagacctcaggctttgatgttgctgagttttcctgggagtctttggcactgctacagtgtgtggtacctgcttgcctgagagggaagtaccagtttgacagaatagctacacattgatctgttttgtggtaaactaatatgctccttctttgttttaaatgaatgggattttgcctttctttgagacatgagttactacttttattaacagatgaatgatgtaaatgtgttagttgttagtaaaaggagaaaaatccagagagagtatccattcataagcaactatcaattatattatgtattcaaggtgtcatcttggattctgagatgttgagactcttcaacttcaagactccctgatcctttattttcacattttttcacactatgaggtatccaagatgtgagaaaataaaattattccagatggctttccttttctcattttttagaatgtttccgtctaatcctctctctcaaaagaaacattccccttggaattgcttctgttattatttgtattcatttttaaaccttgacaaccatgtgaacgtagtacaggtgttttttttaagagagtgatctataaagtaaagttctttgtgctgtgttgcagaaggagaaatacttaagctaccaaagtaaagctactttaatctaattaaacatgctttggagccagatgtaaatgaggtaacttttttgaagagttagtttacagatatttggtcattctcattttagataaacagaaagccatgttgattattatctggatctggctagactcctgttcaaccacttgctagctgtggggacttgacaatttctttagcttctctgaaatgaacatggtagcaattcccacgtttagggatgttgtgtggattaagtagagaatgcagagaatgcagaaaaagctcaaagctttcaatgcctggtacgtaatatatgcccactaagtcttagttatgctgttggttccactcccgccaccattccagaggccgcagcagggttctgtgttgtgttgtgtttgatcctatcttcttatggtttgtctagagtggaagttttggggtaggggtcactcataaaacagaaatgcaaaagtagagggaggaatctgggatgtggtttatttaagatttttaaaatgtgcttgcttgtttgggtttttttaaaattatttttacattattattattatttttaattagagacagggttctccctatgttgaccaggctggtcttgaactcctgggctcaagcagtcgttctgccaagcctcccagtgtgctatggttacgggcatgagccaccgcgtttggccttggctggatttttggtttgtttttcttaccttattttgagaactagagtcgtctttgctttccctttttctcacgtagcctatcccagtggtcttgaatcattccctatgtagactgcctaatctttatttccctctgtttatgctgaatttttatagcgaagatcttaagaaagtgtaaaagctgtttttacccatctttttatctttaaatttttttatataataattaagctttataaaagttataaagtataatacaaccaacatccacatacctaccatccagctttagaaagaaaacatagtgggtggatactgtggaagctgcctctgcaccttcagcctccattgaagaagccattcattcccatgccattttcttatacttttaccatatatggtgtgtagttccaacctatttaaagtaccgttttacttatttaaacattttatataagtcttgtcattttctttgtattctgcaatttaccttcttattcaatgttgcatttttcagatttatacatgttgatgtttgtagctctagttcattaattttgactcctgcgtaatgtttctttgtatgaaggtaccacagtttatcctttctccgagtggtgggcatttgtggacactctctctctccccaccctgttagagacaatactgccacacaagtttttgtacatatcttgcttcacggatctttgtagctttggttttgttgtgtttgtttttatacagaaaatgagttctttggggactagtcaaattctgtgggcctcagatttttcatcataagattgaactagatcttttctagctcaaaattgcacttcttacatggttatttaaactggatagcttgaattactggcttttgttgtttgtgttacctcacaggcccattagtatatctcttcagtagattatgccggatatggattttactctgacatgagaaacttccatttgcaacatttttgaggacaaaagtgtatgtagtgttagaaactatcattaagcaggacacaggacactaaaccttccttctccccaagtttgtttatctttcctggactctacaggaattacaactgctattaatttagaataaacatataaataatatattttaaagtatgttgtctacatgtgctgggtcaccttcatccggcatcagcctggacagaggactcaggccctctacttgattccataagagtccggttacatcgagcattttgcgccctctttaaacttgactgagaatttacaaggccacggggcttacagcattctatttttctttttgcctttctctcttttttgcttcgtacataaatgaaaatctaatgtaaaattgtaaatgggaaaagtactatcatgaagaaaaaagtaccagggaacctgaaacgagattaaaactgactgaaaggatctaggaaggagtcttggaggaagggaaatttaagctggtcctttagggatgaagaccttaaaggtgtatgacaattagacatgcttgtagggaagaaggaggaatggagatgctttccaggcagaggaaagatatacgaggggaaaaagtataagaccatgacatattcagggaacagtaagagaagtggctcagactttctgggagacagtctgccatattatcccccttcttccctaacttaggcagtgttaaaacatggctgcatattctttgacactctcccattgaaaagttgtgtcgacgccccctcctcttgaatctagacgagctgatgactgcctcagtcaatagaatatggccaaagagaccctggcttacaagggtcagttgcaaaaggccatgtgacttctgctttgttttctggaacacttgctcttggagcccggagccaccatttaagaagtccaaccagcttgaggccatcatgctgtagaggcatgtgtatagatgatctggttgacgttcccagctgaacccaactttctagccattctaccaaatgtgagtgaagttgtccttcaactgttttctgactaccagtaccctagagcaacctctaacatcactacacagaacagaagaaatgctcaagctctgcccgaatttttgactcacagagctgtgagatataatacaaataaccatcctggctaacacggtgaaaccctgtctctactaaaaatacaaaaaaatacaaaataataataataataataataataataataataataataattgtcttgagttataagtagtttattatacaccaatagataactggaataccaaccaaagccaaagtgaggggatttttctttagatgcttgctgaagacaatattaagtcatccaaaaacctctccccagaatatactactgaatgtaatttagcacttatggcaggaagactgagtttggatagcattcaaggcagaggaaatgacatgaacaaagatagcaaggcagggaaggacaggacatatgtaaggtagagagtaattaggttcagctaggagtagggcacctcctgggcacagtgaaagaatagactaaaagagaaggttaaggacatgctatgaagggccttgaatgtgagattgaagaaaataacagtaccactgaagattttttgaaaagttttactagcaaaacagcacttttgggaattttttcaaatgcttgtgggatggactgaagtatggagaaattaggggatcattttggaagctattgcaagatactatgtgaatcagatctgtggtagctgcagccagaatgaaggctggaaaatagataggaaatactgtgggcaggaccaccactgacctgcttagtgcattttgtgaattatgaaaaggtcaccccagctgggcacggtggctgacgcctgtaatcctagtactttgggaggccaaggtgggcagattgcttgagcccaggaattcaagttcagctcagacaacacggtaaaaccctgtctctacaaaatatacaaaaaattagccaatatggtggtatgtgcctgtggtcccagctactcgggaggctgatttaggagactcaccagagtccaggaggtcaaggatacagtgagctgtgatcgtgtcactgtactccatcctgggtgataaaagtgagacctaactaaaaaaaaaaaagtaccacttctttaagacattttacttccatctgttagaaaattgttgtaatatgtttattagaataagacacttgactgccatctgctggaaaattattaaagatatgtctttggtttcaatgctcctctccttttcacatccttgtgcagtacacaaattttgtgggtgcgagtaataggacttggtaacggatcacatttcttattaaaaggaaaaggaagaaatctcaagtttggatggtagggaggttagtagtgacattaatagaactagaacttattattggggaatagatttataaggcagaatcattctttacatggaaagacactcatcttattatttattgatcccaattgtttgcatttacttagtaagaattttgataccttttcttctagaatctcagctctccccccttgtgacatctgagaatgttgaccagttcctcttttgtattccatacacccctctcttctgtatcttttctttctattctgaacgttgcttcttatccgtctcctttgcaggcccttttccctcagtttccattcttgtgcttttttatacagtgggcgctcaataaatgtttgtttaattgaattgcattgcttttgaaagatcagttgcaggtttttcaggagactgattcataggcagttagggactaagggcgtgccagaattcagaaagtagaaacctatcctaaatacagttccttgtttcgggatgtattttttacacagtaggtcactcttccttggggaatatctgtactgttgatccgttcatcattgttcagcagtggcaacaccaggagaacaaattatttacattggctgtgtcatatgggtgtgtctaattcggagaactttcaaacaaaataatgaagcttccccagcttctaacttgggaagtatgaaaagttacttaaaaaaaaatcttgactcttgtttaagtacatcagtgactgattaagtcacaacacattttaatattttcattcgaggtttcttgctaacattcttaccaccactaccactaaccccaccccatgtgtgtaagttacttttcctttcatttttcgtgggtcttgtgtgttaaggcaaagtcaagaactttgctcttctgataacttaacattgattgtgtgactgctttgtgcaaattgctatgggatgcctcatggaaattacaaaggtttcgtttgcttctgcccttcaagagagacttgcttagtgggagaagtagatgcatatgcaactgctccagggcaggcgatgacaaggatcataatatagtgcagacagagacaggattccctgtcttagagtgatataaacatcactcgaagactgagtcacatatatggacttgccatatttctttcctaaattgcacacttaactcttcactttcctgggctggattagaatttgttttcgtcgaaggcttcatgagttgaaagcacattacatatatgtaagatttaatggatttaatttaaaatgcattgaataacattaattttagcaggtttgattgttttaaatgcttttaagccggcactcttaaacgaaaatagagaatatcagagtgatattaaataaacaatgatataaaacaggagttttatgtttatggaaacctagtatttaggaaataaatatcctgaaattctctagccaaattatatttttaaatgttttgagcataggatacaagttataaacagcctagtagggaaaaatgtatattactgtcataaacataggtagtatttaaaatattaaatatggataattgatatttaattgaagtgctttttatttaattaaagccaatgacattttaaaattatttctttattaatttttcttcaattaaattttagcctgtattttagatacaaggggtgcatgcgcaagtttgttatatgggactattgcataatgctaaggtttggggtatggatcccatcacctgggtagtgaccctagtactcaataagtggttcttcagcccacattctcctccctcctccacccccagtagaccacagtgtctgtcattcctgtgtttatgtccatgtgtgctcaatgtttagctctcatttataaatgagaacatgcaaagccaatgacatttttccagtcattggagtaacaaagacgtttgaattttaaaaatttaaatatatttaagattgaaatttaggccgggcgtggtggcttacgcctgtaatcccagcactttgggaggctgaggctggcagatcacctgaggtcaggagtttgagaccagcctgaccaacatggagaaaccccatctctactaaaactgcaaaattagttacaaaaatagtagagtgatttatgtaataagtaaacagttcaggtttacttgacttaatagcataatgatttacagcttttacttaaattcattctgagatgaaataatacagcctctaggaagatacattatctggttttcctttgcattttcattaaaaatctaaaattggaaatgaagtatgtcaactagttttagaaatgatagtaaattgggaagcatctcaaatagcagtagaaaagaagataccaaaaaggtttagaaatatcacaggaaatagtgagattcagcctaagaaaatgcaagctaatacatgtaagagcaaataatctgaaatagatatttaatgagagacaatgcttagtagtagtgaaagggagtcaggtgctatcagacagcaaagcagatatgaggttgcggtgtgatacggcagtcacagagctgttgccatctggggggtcatcttgcaagctcattacaataaagcagggaagcagaaatctcttacaaatgtcagtgttaagaccacatttgtcttatatcaacttaagaatgtccagacccatagctatcaatatattgagtgctgaaagaatagaagctgcagttcttagaataggggagaatttaatgtaataaaaataattttaaaaaataaaatatctttgcttcggttaagtagtaaggcaatatgaagttatacagtggatataagcaacttgttggaagacaaatttgtttagatgaagctgagactgtggaaggtgagagtagtgtgaacttgttcataggcagttctcaatacctaggccaattatgcagatagtgaaataacatcttaaggcagtgatgggagctggatcacttgaggtaagtttggactgtatgaggaactccattaggtaacagtgccggaattgattggaagcagtgtgttttaacaatgaggtcatatttttaatgttgtctatactggtccaattactctgccccttgtttacaatatgtgattcagtgcatatactcaagaaccattcttatgtcttggcaaggtaccctgccctttctctaagcaccctttttgatcttggcttctagaatttctttgactgctttacttctgatctccaaaactggcctgctgtttcttttgaagcacttccttccctgtatgtacctgctgtatcttagctctgatcatgtttgtacttcagctgtcactgcctactactggtgacacctctgctctgctctattcttaatatcattctttttttttttttaaaggacatagaaaatcaggtattgtcttgttgtctttaagtgttgacacacttaaattcttgaagtcctgtttttagtcttcccttcccaaatctgacaaatatatagctttctacttatgtcagtgaggacaacatctcactgatcaaaaatctcaagttccttcactcatatcttgcctctcatcagtttactctatgtatctgtctcttctgtgtctgtcctttttcttccagtagccaaatttttaacctcgccttgagatctttctttcaaaatactcctttggcttcgagtgcagtactccagtgcttaaaaacaataatatttaatcaatcataccatagcttcagaaaccattgatgacttgtaaaaagttctaattctgattaaattttgatttttggctactcttatttaaaattttatgaaaagtaaatttatcatattaaacaaatttaataattttggtagcttaatattacaattctaaaatttgctttttaaaattgaaactgtttaggtcattgactttgtatacttttactgacccattagtcatttcttgagttttgtctctgtgtcagggattgaggtaggcctgccctgagggttatgaatgaggtgtggtctttggccttaagaagctcacattcttgttatgagcaatacttttgttgactgagaaatcattaatatgttcagtcaatatttattgagcttcaaactctctgttaggcactggggatacagtatgctaagcaagaggggaaactgggattcctacaggcttgtttagtaagcatatatctatctggttttataaatagaatgttctactcaaaattttggaaataattttttccctctatttagtatctgagttttttttgaatacttattaatttcttagtcaacaaagtagtccttgtatatataacaaatggtagaacagttctcctcagttacatatcgttgtaatagtggaataagaattgtaatcagaattagccttctggtcatttgtttgggatggatcttctgttagaatccagatatggcagatagaaccgaaatgtagcagtttccttcttttaatgttaacagtgattgtgctaacacataagattataatagagcagccttgtcaatagcagcaaaatttacttgtctgtttttctcccagagtacatgtgtagttaatcaatttttaaaaatatattttactacaagttattgcttattccaggcatgcccaatgacatgctatttattacttctttttgcagatccacagtttatattaggaaataaaacttctactgtttaaaattgaagttcatctgattaataaactgatattgcctcaggtttcaaactccgtagtgaataaaataggtcctcgtgtagtttagaaatagtataccagctgcaagtccagaaaatacttgctgttactcacataataaaagaactcccaaagccttataatttatatattcataactgcttcttgttgaatttcttcttctcaatcatacaggtgctgctttggtttaaaacttacagccctctttaggcaatctacagtttctccaaagtgtttaatttttttccttcttatattgtgagctggttaatgttgaagatagcacttcatttaaagttcaaacctgtgattgttttaaaaacttacctagtattcattttttcatttaaatatatatgtaatttcctacaaatgtgtacttgtttatctaagatttggacaattcattttaaaccatattattcatttattttgaaatattaagatcctgccatgttccaggcacagatccagatactgactgcacattggtgaactcagcaaaaatccttgcctttatggaaacttactgtctggtggaatttatattttggtggattctataggcattcttgcctattctgctttcataaatcctctagacaggtataatataagcaacagtttcaagttctgtcttttaaggtcctttcacccaaaaaaaagatggcatgagtgtattgcttcagagatgatcattactgtttattgtgaatagtgagcatttcaagaaattaagctcttttttttttttttgagacggactctcactctgtcacccaggctggagtgcagtggcacaatctcgcctcactgcaagctccgcctcccgggttcacgccattctcctgcctcagcctcctgagtagctgggactaacaggcacctgccaccacacccggctaattttttgtatttttagtagagacggggtttcaccatgttagccaggatggtctcgatctcctgacctcatgatccgcctgcctcggtctcccaaagtgctgagattacaggcgtgagccaccgcgcccagccagaaattaagctcttaaacaaaagtaggattaaacaatgtgcgttgctaagcatgtttattttaggtttcaattccagagtaatagtagctggaaagcagcatttttacacaatttaataaaaggataaatattttttcacgagatcatcagtagtttaatatggattttgtagtaaagtgccagctctggatcataatagcaacaataaccgttaccactcacaacagtaacagttaggggccaggtactggtttgaagagccttgtttatatttatgagtttaagcctcaaaataattctttgaggtagataccattattataactctgtattacatataaagaagctgagcctaagcaacttgcccgaggttacaaagctagtgagaggcaaggctgagatgagatcccaagcaagctggctcttcacctctgtgttctactgccttatatccttaaatactgtatatgctttcttgcttcttcattctaggaattagctgtctttcagatatgtaaatattaatttgtgtagcacatgtcatactctgaatgtgaacatgaacatactggtttttctattatgacttttttttcttattcatgactttcctatcttagaaaggcttctttttaaaatttctagcccataggaacctggaaatttatttgtttgggttcttgtgtttgcttactttttaattaattaatattatgatttgtttttatatgcccaataccctggcagatttatcaaatttaaaatgaaaatttagtcaaactcattgcctaaaaattttatttttctgtacctctggaaaaaaatggaaacagaaaagcagccttcattcttcccataaaaagagaacaagcataattttgccaaatgtgtgttttgagagggatttcctcatttcttaactgcagtctaacagaaggttatttgggcttacttgtcccacttcagacttcttactggagcaagtatttctgccgttctgaactccacacactgttctcttacatgtctaggctgtttgcttcctcggaccatgttcctggatcactttcttcttctgcctatgcatttctgctcatcctccgagattaaactgccatcagcttctctgaggaggcctgaaaactcctcctgctctggaggaattgctgccttcaatgtcgtgcttcattttattcgctcatgtgtttatcaattaaactccttgaagacaagtgttattttttttcctcctacttgtttcactgctgaatcctcagcactgaaagtagtgcctggtatatattagatatttcgtatttgttgaataaataaataaatgaatgcatagtatattatcgcactttactatattatatgtaataattttgtactttctcttcttccccagacagtaagcgtcttatgttattcatctttgtatgttttccagtgtctataacatattaattaagtcagtagctgtttgctgaattaatgagtgagcaactaattaatacctatagctctctgtggtattagatggagatgattaaaaggagggggctagaatgagtggtgactaaaaggaccagtgcattgtgaatttctgaagtctgaatcaagaaaggaggagcagaaacaccaagaccagatgtcccttttcattcatctgtccagaaatttagcttttgtttggctgcaatttgcacatttgggcataccagtcaagctgagctccagatactcatttgtcttttagggtaacatggttagggaaatagttgtagagataggagctctcagtgaaaactcaataaatctgcttctgtcaattagggagactaagtagctttaacttccataaaaatctcaaaaataattgccctttaatgttcttttttttaagttttggagaactttagaggattatgttttgaatttagattagggaaacaaggacctgaggaatgatatacaagtttattaaacatgatggggtggaggggatgcttgatgatacccattatccccttttcttcatgcgccttagagagcctcccccactgacaggatgggcgtttgctgcatatcatatgattccttccccagtgaaatgctcgtcgagtgcttgctgtgtacccagcttattggtttggtgggctgcctacccaggccaatcaaatttattgtggaatgtttctttttggagtgaaggaagacagagggaaggagaggggagtagggggaagtgcatttatgtagaggaagcagcatgtcctacgacggagtcctgatagtgtggcatgttctggaaatggtacagtatgttcattatggttggaacacacattctaggagaggaagagggactaaattgcactggccctggggaaattgagctaaatggataaaagtaggcattgagagctgttggtgatttatagcccatcagcaccatgatcacactcttcccgcttctcctgctcaccacctttgcaaccaactttcctctcactgtgctgattgtctctggtacagatttatgatttccagcctcagctcagtgctcaggatgacttttctttcccttttttattctttcagacttatttctaatcagctgctttcttcattattagtagtgactgttccaaactggaaccgctgttctcaggcagtcagccctacttatcccctcattttaaagtaataatttacctcccttctcatatttctaaggaaatagataatatctggcacatactccctcggcttgcctcccctccgtattcaaacttaccttcatcacattcatccttaccgtctttctttctcccccagaggcaagtgcatctatgaagccatcccctcctccagggctctggagcctgcctagcctgcctaatgctctgggaccttgctctgtttatcattgactctcattcctttcttaccacagtccctttccttccatcttataaacatttcccaatccccgttggcataaaaacaccactgttctcaagatactgcttgcttccccttgtttaagcaagagaggtagatggtctgagtatgtaggaacattggctgtgatgttgaggggtgagtcagggaaggcagaaattagagagaaaagaccagttaggagggtgtcgaattaaggtgatggtgatggagaggagacaagtttgaaaggcatctaggaggtaggattaattacaatttgacattcagtgattatgagagttgaaagaatgatgattcttgtgaattgagaaagtacagaatgaggaggtgcacatgtaccctaaaacttaaagtataataaaaaaaatgaggagcaggttttatggagacgatcatgagttcacgatcgtctggaagtgttgaggtgaactgctcttggacatctagttggagaaatcaggtaagcagttgaaagtatggggcatatgatgtataacttaagaaaaatattcgttatttagaaatggctttggtaattaaagatgtcttggtgtatcttgagttagtcttggataagatcccctagagatggagtgagaagagagcaaccctagagagtaacacaggaggtggaggaagaggaccctgtaaaggagcctgagaacaaatggcagaaagaaagagggcaaatatgaggtaaatttttgttagatggaggtttttgttagtttttttttttttcttggaacgctttgaggacaaggataattgtattgacagcttctagcaaaaccagcctaagttgtatatacccaataactatgtattacattgcattattgacagggcttaattaaaataaagtctcatcacttgttgagaacttcctttgcctgaaatcacatatagctagggtttttggaaggaatgaggttgtaaatgagacagtttggaaaggtaaaatatcaatatattggagctatatggcaaagctgatggttagggggtgccatcgctgcggcagccacaggatgttattttcagtataaacctctttgctgattgaggtgattttgattgctgtcaggtgtgagagaataatcattggctgctagcagttttgccactgaagttgggggttcacagatctgaacattttcttgtactttaaatctccataatgttttatcacatttgaattccattgcaaccctccagtgatgagtcagaattaaaagctgttctaaactagattatattcttatgtttctacaaacaatcttcttaagggcagggatagaaattagagcaatcaaataattcatccaaagccactgagggcatggtttggcctcacattagctatggcccacttagggtctccatgggtgggggtgagagtggaggggctggtgcctcaggagctgtgcaaggttacccataggaggtgtgcaaagtcttaaaacttctatttataagcaattttatcctattcttaacaactatttttgtatatgtttaaaaatgtgcattagatattagtatagtgctccatgcttgtaggtatatatatctatatatatatgatttacataaatatggcagaagcatgctctaacattttgaaattgacaagtgtgtgtttgattaaaaaaaaatactttggagacctcaagattaaattgtgattactgtttgagcattgtaaattaactgggaatatttagaagtttcttaacaaacttgtgtcaatcattttagctattattagatttccagtaatagctaaacctttgtgttttagttgcaaaatgcagatgtgtttcttgaccttaattccttactatggattttaatggagagccttaaaacacaagttgaaaaccgtttgttgtactttttgtgaatatgctgaagttttctcatgaactaactaatgcctctccacatacggtatgttctttgcagtcattctttagtcacaggcagtttaagctgttaaatagtatcttgctttgaaaggtaggcggatggcatttctatcttctggtacatctggtaagttaatatatacagtctctgagtatcctgcagggacctgtttttacatgcatacagggatgtttatgtagaaatcaaaggccatgaatcagaagaacacaactcttgtttccagtgtactggaggcttgaaaaaattggctttgaaaaattgaaagtagtgtggtttgtttttattgtggaaccgatcaggaagaacaatttacagtcattgccattcttcacagatgaatggagtagaggtgcctgcctcgtgaaatggagcagctgcgcccgttttctctgggctcacaaaaacatttgctttttaatcgagaactttagatggtagggtacagtttgttttcatgatggaagtggtcagttgtgccttaccagacagctgtagtgtaattaagaaaaactgtgtgaaagtggattagatataacacaagaagccttttttatttttttttaaagaggggtttccccttaaatttattcatttttttctttaatggttcaaaggagaaatactgctatcattctggtccacaagatttttgctacttcaggatatcatttagctctaggaaacatgagatgctctgctatagaataattgcttgtttttgtaacaagtgcaaactaaaaactacaggttttaaagatgatttagtttgtgagagatttgccttcaaaacaaagcttaaaataaagaattgcacagttatatttacattaactttaatgcattttaaaaagtgacctacttttataataaagttgtgaggctgctttttagacctgctttgtacacaagttgcaacattaggggatctttaaaaactgttagggtattagctttttaagaccagaaaccatgagaggagaaaattatacttttcttgataaattttaaaatgagttagtcaaataataatgaaataagctgttgaagtgttgatgtagctaaatgtgcaacattaggctgtcaatttactttgaagagcatacacttactttatgcagcagactttgaaataagaatagaaatgccttaatttgcatcacagtctacagtagcaaaatgactttcaaggtcagagggagcttaatttctaaaaaaaaacacaataacaaaaccaaacaggaacctattgtgttcacaaataaccaagatttatttgtactagacacttaacctttataactttttatacagattgcccaacacactagaaaccaaacttttcatcctaagcaaagtaaaggtgccagtttcaggtttgctttaaaacatttttatatgttgattttctggaggagactcttaggctttatttcagttaggggaatttggaaggctggttgaagggaggaggtgagtgaggagttacagcccaaatgctcttaccatttccagccttgcagccctgccctgggaggtattataaggaggacgagtctatattagattggttggtttagagaagaaccctggctgctgtttctctctggctcactgatggcggctctctactgatttcttttgtctctcctcaccacagaccctaagaaaacactgagaatcaggccatccattctaaatggcaaaccatggctgcagcttgatagctggtgctttttctgtttgcaaactgagtcctcaggtgcaccaaaatcttcttcccctttctctgagcagcttctcaggcttagatgctactctgacttctcgacagacttctgcttctgtagaacatgagcaatgttgtttaggaaagaatggagcagagtgtggggtggattagaaaggtagagtaacaattaagaaactgaggcagtttttaaggtcagaacaataatgaagagcattgaaggtagatagcagcaggatgcagcaatagaattatgggacatgctaattactagaatcagaatcaaaaaatctggattaaagttccagctagcctagcgttgtgggaaagccattccctcactttctgtttcttcatgtatagagtggaacctgttctacataccaaacaagttgtaagtctcaaaaaagaaagagagagagcttgagaatgtgaaagtgttgtgaggtagtatagttatggaactgtttgacccatttatgtcctttttttgggaactcttgacaaccaaggaaagagaatacaagaaatattaaattttactaacatagattctttgtgagtgctcttaaagctgtttgataatcccactacttatctctgtttgattcccaacccactgctttctcataacaccaatttcaactcttgtcatccttctcaagccccaggcccagttccttctattttagtctcagtagataagttcttccccaattttgccaggaaggttgagcaaagcccttgagtttccctggccaccatctcaaaatgtatttcttcacttaatttccatctcactttctgtctcttcctcgcaaaggtaacctgtatccttatcacattctcatcccatttcttctctaacctttcttcatcaattatttcatgtctttctcttgttcttttaatctcctctaccggtccttcctcatagccaagaaaccctctttaagttcactgtcatatgtgtttcttccattttcactgccaaaattttccaaagactgatttgagctcattctttcttcaccattcatgctttcttttggtccatttcagtatggcttctgtctgttcaaataagcacatgaaaagatgctcagcatcggtagttattagggaaatgtaaattaatactgcaatgagatactacttgatatggtttggctgtgtctctacccaaatctcatcttgaactgtaatccccataatcatatgtgtcctgggagggacccagtgggaggtaattgaatcatgggggcagtttccaccatgctgttctcatgatagtgagtgagttctcatgagatttgatggttttataagtgtctggcattttccctgctgtctctcattctctttcctgccaccctttgaagaggtgccttccgccatgattgtaagtttcaagccctccccagccatgcagaactgtgagtcaattaaacctctataaattacccagtctcaggtatttcttcatagcagcatgagaatggactaatacactactacacccactagaaaggctaaaattacaaagactgaccataccaaatgttgatgaggatatggagaaattggaattgcacatattgctggtgggaatataaaatgttacagtcattttggaagtttggctgtttgtaaaggaggtaaacatatacctactatatgatgcagctattctacttctaggtatttactcaggagaaatgaaaaaatatactatgtgattccatttaaataaaaatctagaaaatgtgaacctatagtaatggatagcaaagtggttgcctgggaatgagtgtataatgttggaaaaatggattacaaagtaatacaaggaaacttttcaggggtgatggatcgttatgtaggttgtgatgatgccttcacaaatatatataaactcatcaaatttgatacttgaaaatgtgtaatttgttatacactataccaaaacaaaactattttaaaaaatcatagaactgcacactgaaaagggtgagttttatagtatgtaaattatccctcaataaacctgacttaaaaaacaaaacaaaacaagacatatggaaccaggcacagtggtatgcacttgtagttccagctacttgagaggctaaggcagaatgatcagttgagcccaggaattcgaaagcagcttgggcaacatggcaagaccccatctctagaaaagaaataaaaatatgaaaatgcaatcaatatggggaatgagagtgcaaaaagtaattgttaaacgctaatctcaaaatattgcatactttgtaaatccatttatatagtattctcaagtgacagggttatacagatagagagcagattagtggtagccaggtttagggatagtaaaccatggggaaaactaggtgacgggcacacaggaattttcagtgttgtttttgcaattatatgactaaagaatctgtatcacaaaaagtttcttttgaaaaggccttttagatattgtattctctaatgtgaaacaaagacagcatgccaaaaaataatcaatctttataattaaatctataataacggttactctgcaaacacttgaaactaaatttcatagagatgattacaatttaacattgtattgttgtagacagaaggcacaggaagaatcattttccaatttctgatcaccctatctaaatgttcaaaatcttaaattcgttttgactagataatacatataaatggctaaaaaatatatgaaaagtaatacactgaaaagccttcctccaacatctgtcatcgatccacacagttcttcctcctccaaaagtaaactactactgttcatcttttatgtattctttcagagtttatgtctacacgagcaaatgcaggtgtatctttttaccctcctccatgcttgtatgcaaaaggtagcttactataccaactcgttttgcgccatacttttttcacataacaatgtatcttaagacattttcaaggtggtatgcagctttttaattttttcttttgacagttagtattgtattatatgactgtaccatactttatttactgatctcctgtctagccatttagatcatttccagacttccgcttgtaaaaacaatactacaggctgggcgtggcggctcatccctgtaatcccagtactttgggtggctgaggcgggcaaatcacaaggccaggagttcaagaccagcctggccaacatggtgaaaccctatctctactaaaaatacaaaaaattagctgggcgtggtggtgggtgcctgtaatcccagctactcgggaggatgaggcaggagaatcgcctgaacccgggaggtggtggttgcagtgagctgagattgaaccaccgcactccagcctgggagacagtgtgagactccatctcaaaaaaaaaaaaaaaaaagaaaaactacagttaatattcttatatttatgtcatttcatacatgagcaaatatatatatatatatatatatatatatgtaattgccagtatttggctttttaacctagaaaaaaatttatgttgttcagtctaatatctgtagagtaaatgttcacatatgtaattctttgagacaaaatatttagcatccttttgattttctgatctacttccagatactcgtgatagtctggatgtttaaaatttgtaaaagggagtggggaacctttatttaaaagctccttttcaatatagttaagggggaaatacccatgtacacagggctatttctggaaatcctttaccagtaacttcattcagtaacatatctaactctaaccctgatctagctgtgttaggcttccttgcctgctagtgaaagcctttgctctccccttattaaaaggcctgaacataaaactctgagactgtttatccttcccaagtggggcattgcagaaaaatatcttcttattcgctatcagtgttactctctattgatcatcacaattattgcaactttaatattatgacattgtatgtcttatgcaatattaggttctctgaaaaaggctttttgtacatatgacaaataggtggagtatgctcttctacacagtgagccaaccagccgtcatcttggcttctccaaaactggttttgtgtgtgtgtgtgtgtgtgtgtgtgtgtgtgtgtgtgtgtgtgtgtgtgagagagagagagagagagagacagagagagagcgtaaatatggcaaagtttaacaactgatgaatataggtaaaggtgaacagtctagagtgttcatggtactgttctttcaaattttctgtagatttaaagtttttcttttttttctttctttcttttcttttttttttaaaggcaggtcttgtcacccatgctggagtgcaggggtgcgatcacagctcaatgcagtttcaaccttctgtgatcatccaatcttagcctcctgagcagctagggctacaggcgtgtgccaccacaattggctgattttttatatttttgtagagatgaggtctcgctctgttgcccaaagtagtttcaaattcatggcctcaagtgatcctcctaccttggcctcccaaagtgctgggattttaggtgtgagccaccacactcagcctaatgtttttcaaaagaaaaagttgagagcatattctttgttgagattatttattgtgaattaggggctgctgcttcgttacctattgtgttcttttttgttttgttttggtgtttctaggtttgaagacatcttagaaattccacttctaaataaaaataagaataaatgctaatagcaatttatacttattaagggtttcctctgtgccacacgttaggctaagcattttatatggatgatctcatgtaaacctcttatcagtctattattatcttcatcatttttcagatagggaaactcaggcacagtgaggttaaataatttgcctaaggtcacacagctatcatatggtagaaatgctacttgccaccatttctatctctatatttctgtacttcacctaggtttcatttgccctggtctttattttcctctgaagtattttgaagtgagagataggttatcctctggctcaaatttttaaagaattaacctaatccagataataggatgatgtgaaggcctcatgaaaacataaaaattgatataaacaggaagaaaaatcttttttttaaaaagagatagtctagctctgtcacccaggctagagtgcagtactacaatcatagctgacttcctgggctcaagcagtcctcccttttcagcctccccaagtagctgggactacaggtgttcatcaccacatccagctaattaacaacaaaaaaagtttctacagatggagtctcactatgttccccagtctggtctcgaaatcttggccttaagtgatcctcccactttgttttcccaaagtactaagaccatccttccactttaaagtactgaaattacaggcatgagccaccatgcccagccccgtttttttcctcttcattttcttttcctttatttcctttattttactttatttatttatttttgagacagggtctcactctgccatccaggctgaagtgcagtggcacaatctcagctcactgcaacctccacctcctgtgctcaagggatcttcccacctcagcctctagaatagctgggactacaggtgcacaccaccacacctggctaatttttgtatttttgtagagacgggattttaccatgttgcccaggctggtctcaaactcttgaactcaagcgatccgccagcctctgcctcccagagtgtcaggataacagacataagccactgtgcccggcccaagtttcttaatatattaatttgccaagctctacaaacaagaactgctttgtgtacatacagtagtcaaaacttgctggtcccttttctgagtttgcttatttgtttatacactgactggcctgccaaggggcattattgttctttttctgtatatttcctgtacatttccctctctgttgactctttgctttcagaacttaaacaggttccagtgttcctgtcttaacaaccattgccatttactacacacatcctctaaccacccccatctctcttcttcaaactaagctctcctcataaacaattcctatgagagaccataggggtatttccccatttcctgctggctcctctgtccctcccaactacccccacagactgtgctcccagtgacctcctttccttctagcaattttcctatgctattcttttatttacaaaactggaactgtattttatgcacagatattttatagcttgatttttttcctactttaatattagggactttctttttccaagtcattaatttttaaaaactttctattgatgaatagcatacatgcagaaacatgcacaaacgataagtttgataacctttcacaaaatgtcgttagcgtccaaatcaaggaaaagaaattgcagaatcctagaatctcctcccaacccactcctttcagtcacttcatccaacttccaaagcaatcctgacttctaacagcacagattgttttacatatatgaaatgtatgtaaatagaatcatatagtgtgtaccttttctgtgtctcacttctttcactaaagattatgatgtttgtgagattcatccatattgttccatgcacttgtagtttgttattctcactgttatatgatattatattgtgtgtttatgcattaatatgttttaaaacataatgttaattcctatgtaatattccattgtagggataattaattaacttattaattacccatcatttttgccaggttttcactattagaaataacactataataaacatctttctgtaaatacttgaagaaatttctgatcattccttagaataaatcctggaagtggatttaccagctaaaagcttatacattcttcaaaagttcttgatacatattgccaaattgccttctagaaagcttatacctgtttactttcctgctggcacagtacctgacacataaacattcaataacattttgtttacatgaactggatgaactaaattcttttatatcttagaatcctagaagctgagttttctgtgtctttgatctgccttctttccagttcatttttgttttaatgaatttatactaaaaacaatttaatagtacatagggcgcagcttcccctcccgaccttattctttttcaaaaataatctggttattcttgctcctctttcttttttttttagtggaaatttaaaatatactgctgcattctggaaaaatcactggagatcttatgaaattgcattgctggcattttctttacattaatgtggaaaaaaatgtcatatttatatgtttataatcctatccagaaatgattctccatttatttaattattttttatgaaatgcatttcagtaaagttttataggtttattgttgcagtaaagtttgatagctttattcttaaaatttaaaaattttatttgtgaatattttatattttgtgactactgggaatgagatattttgtttccattataatttcgttatgtgaaagctattgtatcttctatattaattttgtattcatcctttttagcaagctcttattaatgttaacagtttttcccttataatacttttgggtctgtgaacatttaatttataatttcagagagggagaaattaatatgtagaataaagaaatagaaaaatggtaaccttgaaaaaattaaaaaatagaaatgtagaattctgatctgttcttttaatgcattgaggtactcatttttatcagttctcaactattttctctagctttgtattttgaatgaagcagcaagtcacaaagttaaacataaaactaatgaagttgtagaatgtaaaaataatctatcattacgttaggaaaagtagttacgaaaaccacattatttacccattatactactctatactttttccattctcttatttttaaaaacttctctttttattatctgttctctattttgcttctctgttttgtttttttaagaatacaatagcttgggaataatttttttaaatactaatggaaaataaactttaggataaataagggaaaaaataaaaatctttcagttttcctctcggatttttttctcacgtattctcatatacttttctgttcttttggatcactttagtgattctcttccttcttacagcatgtattcatctgaatgccttcatacatgcgtgcatgtaagataccagtatttgtgtcaggggttgtcttatctcatctttttcctcagagataagaaaatgtgtctaagtcgtgtgtctacatgctattgcatagataataaaataattttttatcagtttactttcaatttttaaaattttttttattttcttttttattcattttaaattgtagggttatttttttgtttaatcctaaagatagttttaagtacctgtaaacttgaaccacaaatgtaatcagaaaataatactttaatcctagttaatccacgttattgaccgtctgtgcctacaagccgaaacaatagcagaatgtcttgtgtataacctctctcttttttttttttttttttttgagacggagtctctttctgtcacccaggttggagtgcagtggcgtgatcttgactcactgcaacctctgagttcgagcgattctcctgcctcagcctcccaaatagctgggactacagatgcacgccaccacacccagctaatattttttgtattttttatacagacagggttttgccatgttggccaggctggtcttgaacgcctgacttcaggtaatctgcctccctcagcctcccaaagcactgggattacaggcatgaggcatcgtgcccaacctagtgtataatctgttatgtggacctacatactcactggcaaagtctgatctagagattaactgtcttcttttgagatggtggttttgctgatttttaggaagagactatctagggtctcatttaatccttgtaagagacaggctggttgcacccatcttgtctaagtttgtaaaatgaaactaggtcagatcaattacagatagttgtaacttcctcagaatagtctgtaagccagggctgttggttattaaaatacattttttctcttatcaaaatcaaaggaattaattatttctcatgactgtagaattggaatatgacaacttgagaatcctatcttttgtagaatagaatagaagttgtttttttttttttttctaaaagagaaattcagatgctgcacggtttgtgtctttgggtgtttgctgagctacgaggctgggaagtgagaatcagaatggacaatcaggacactgtattcagatttcacttataaaatgggtttggaaatgaggatgaagggcactagccaaaataatctcaaaggctgcttccaggtcttaactaccaagatttgtagcttaaaaacgaactattgggaattatagaggtaaactgatgtgctttcattagagaggcgtaaaactggttctaagtccttaaaagaaagtagaaacaaagcaccaaagccagaaacaattacaccagcagaatacttaaaaactaacaacaaaaaactgttttcataggcaccctgttatacgcggtaatgcagtttgttttgtacaatgttataaaatgatcagtatactgtacttctggttaagcaaaataagaccaaagactgacacggtatgctgtctactctaattcagtacattcaccaaaaggagatgaaattaaagatgaagaagaaattaaagaattaaggaagaaattaaagatgataaatggatccagtttgcctatggcaaactgatagtatgccattctgaaggtggatattgcttatgaagaaaattttgagtgaattgtttccttttataattgtattagaagaagtgtggatcttgactgtagacagactttagtttaaatatggctctgctatttaggagttttgtgacactgggaactttttaaactctcttttgttatttgcttcacttattaaatcagcaaaatcattcctacttaataaagttattggaaagagcttattataaggagtttgtcccctttcatgaaattttcaaggaaattgtgatttccatgacttaaaattttctacttaaaatctctgttttttttttttttttgagacagagtcttgctctgtcacccaggctggagtgcagtggtgctaccttggctcactgcaagctccgcctcccgggttcacgcccttctcctgcctcagcctcccgagtagctggggctacaggcacctgccaccatgcccggctaattttttgtattttttttttttttaagtagagatgaggtttcactgtgttagccaggatggtctcgatcttctgacctcgtgatccgccctcctcggcgtcccagagtgctgggattacaggcgtgagccaccgtgcccggcctacttaaaatcttttgaggaaaagtgctatatcagaaaataaacaagaccaacccagttacatattaccatatcatctgaatatgttttacattagcttctgcccttccttctttttttttttttttttttttttgagacggagtcttgctgtgtcgcccaggctggagtgcagtggcgcgatctcggctcgctgcaggctccgccccctggggttcacgccattctcctgcctcagcctcccgagtagctgggactacaggcgcccgccacctcgcccggctaattttttgtatttttagtagagacggggtttcaccgtgtccttccttcttagaaaggttccctaattgtctgaactgtgttggagatttcgtggcatgtgtagtatttgtggagaacttttcctgtatggtcatttccaagtgtctaaagaatctggtatcagtccttcagattttagcgggttaagagaaaaagacaccaataaatcaagtaggcatagaattttgtataagaagtgaatctgggtatggtaaaaagttgtgatagaatgaaaactttctgaacagtggtttgggagaaatgcagtaagacttttaagaagtcaatcattcatttactcattgaatatttcttcaatattgattgtgtgttcagtggaaagaggtgacatggaatggggaagaatgttcaagacacacagagtagcacacctgaacggaagcagatttgaggatctgaaagttgttttatgattggagtgtagagttggaaccgaagggatgaaaagggatgagagagttagtcaggggaccgatcatcctggacttacaagccatgaaaaggaatttgacctttatcctaagcacaataggggccataaaataattgtgggatggggcaaaggccaggtctgtgttaagaaagagtaggagaatggattgaaggaaggagaacaagtagaggaagggagattgattgcgtggccgcttgtggaaatcacagaaatcatggtagcctaaacttgagtagagtcagtggctttagaaagctgaacgtggaggccagcatacaaaagagccagctagctgactgacatgatgtggggagtgagggaggaagaggaagcagggcaattggtgatgctttttcttccttgacacaaagagtacctaggaggagaaggtgaaaggggtaaaggattagttccattttagttggtgggttaaaggaacttgtgagatgtatctatcaatatatttatctgtgtacctatctgtatatcatattcatgtattctaatcatcctaactactcctctcatttattttttattttgaaataatttcaaacttaaaaggtcacaaaaacagtacaaagtgctttttgtttttttggaatcttttgagagtaaattgacaatatgatgtctcattactttccaatacctgagtgtgcatttcataaaagcaagggcatctcctacatttacgttttgtcccagtgatgtcctttacagcaaaaggatccagtctagaatcacatgttgcatttactcgggatgtctctttaatttccctccatcttgaatggttcctcagtgtttccatgaccttcaatatctagacatttttgaaaatcacaagctaattattttgtaaaatatccctcaatttgagtttgtctgacatgttttgcaattagatgcaggttatgattcaggaatttttgctaggaatatcacaataattatgtgttcttttcattgcagtctatcaggtggtgcacagctcctgttcgttacattactgaaaatgtcaaccatcatcatttactaattttgctatgagatggggaggtagatgcgtagtgtacagatcagctgatggtttacagaagagtaaacattcagaattccctcccaccccccgtaagccttgttcagagaaatattttttacataataactgtagtctttactgttattataatttggattattgcccactgaatttattatcagtttagtgcagaagagaaatactttgctcttgccttagattgaaaggctctccctgttgccactgtgctctggtttccagatgccttgctctcactgggattgatgtgctttctcacagagtgaagagagaacctgacagccataggaggaggaaggtttgcctcactttaagtccggatgtggttaaagcatgggagtgggagaagagaagggatttgactgagacaagttgatttgagtgaagccgctactcttagacaactttgcgtaaaacagctggttagttaatatgtttctcttttattccatgctagtcctccaagccttaaaacaacttattagagattagaatttttaaaatctgttttgcaataaggcacgtgtccagttgaattctaatttcactaaacctgccccctagaaaactgctgaacttatttgaaaacactgagtcatgatgatataaatatatgatggggatttaatgaagtaggtctaatttcaagaatatctaatttatgaaaccaagcagtactgtggaatttgttggtaattagaaatacaggtttaaagtatataaaccatatatgattttcataactttaaaggagtaaatgtttttactctttaaccagtcttgatattagtgattccttctttacaaactgaaatgactccagattttttgaaacagtactgttgtttttagaggaattaaaaaatatattgcaagtttgctgccatgtgtttctagtatagtactgctttgaaaatataggtgtttaaaattaatcaaatacatattagcaacctttaaaatacagcattgaatacaatatgataaataaaattactttatcaaaactcctttggagtctcagccaacttttatatttcatgttatttacctcaaactccattgtaactatgcagaacccagtaaaatctcttttctttctcctttctcccatattgtcttgtctacagaataccagagacctatcagttttcctaatgcagcttcaaaggcactattgactccttgccctgtttcttctacccttgcaaacttctgggaagtatttccaagtatcttatagctgagctaccctgtccttattgtagaaatcccatccaaatttcacattagggttatgattgtagatctctccttaagccttttgttcagcttctgcctttcacccaggtcaaagtgctattaataagcttatttcctattaccaaagtgtatcatcttaaatttccttcacctaacctatagcttcatcagaaacttaaatttttctgagactattgccaccctctcttgatcataccatgtttgccgcaatgcaccagtcgggaaacagccgtttagtcagagcctacttggtgccagtcactttaccagatgctgagaatactgtggcaaataaacacattattgtcctcatggaactgatagtctggtgggaacaacaactattaaacaaggtagtgcgtgtaattaagtgattgcatatgtgtgaagtggtttggagaagaaggagaacgtatgacttgtaaagcagacatgcgttttattggggtagtcttgaggtagttgtgttgaagctgaagcatgaagattgagtacatattgttagctggttgaaatctgggttggggaatattttaggctaagagtggtcccttctctatcatcacattttactctgtaatcaagcaggttctcatactatttattctcatactatttagccgtgccacttgctcactgtcacccagtgcttcttctttcttaatgagctcttgcttttatacctttctatatttctgattttatagtatcatcctattttggaattcctgaggtcagagttttcaagctgttagattaggatctaccagtagcaggctctcagtgtctgatttgtccactgcttcctacctggtgactctccttttccttctctcaactcctcagattttctgtgatttctgcaggaagcaaagccagcagtcaggtaaaggggttggggagttggtgggggtggggacttagaatatttgttgatatcaaacctctccccaccaaacacttgaatttcattttcagcaacctcttcttcccattctagtgacatcaagacttaagaagattgaaaaatgtcccatcttcagaggaaatctaggtattttgctctagatcattaaaggttacacatattcgccctgaaattctccataatctgtaactgtgcttcatctgttgcctaatactttatattttaaatttcttcatttacttaaaaatttctatttttgtaactagcagtttacatttttttagagtcaagcatattgatatgcagtatcactaacattgtcagtactggtgatatacatacaagcaaacttgcagatatatatcaacaaaaacaacattattgtactagtacaaagtggtcaaagtgtgttcctctgacactggttattatttttttgctgcaaggcatagtagctgggcaggtggtcaaactatttcttgtagccaggtagtaaggctttttattgagccgtaaccaattctatggctgagagaaaaaaaacacatttccctcgcatgactttccttttccctttaaatacctatttattaaaataacaatgtgaatatggagtagagacttattataacatctgtatgaaaacaattgttagaacaaaactaaaattgaaaaagtaccaatttattgttttaaatagagaaaaacatcttatttctttaattttttaattactagtaataaaaccaatgtaatatttgccatcttaaactatttttgagtatatagtttatttgtggtaagtacattctcattgttgtacaacagatctctagaactaaaactgaaactctgtactcgttaaacaaaataccccttctcccctccccacagaccctggaaaccaccattctgttttctgtctgtatgaatgtgactactttaggtatgtcatataagtagcatcatacagtatttgtcttgtgactggcttattttacttagcaatgtcttcaagtttcatccatgttgtagcatgtatcaatttccccttaaagctaaataatattctactgtatgtttatactacatttttttaattcattcatctgtcagtgaagactagggttgcttccaccattggccatcgtgcatggtgctactgtgaacatgggtgtatgttcagatatttctttgagactctgctttcggttcctttgggaacatttacttagtgagccccaatcttcttacagagttatttattttttacgtattagaatgtgggcggaattgatgaagggaaggaggcgatagtgactgtaaaaagtaggcagataatagtctgtccattgtttaaggctctctgtctgcttcagtgtttctcaaagtgttgtccatgtaccacttgcattagaatatctgggatattttgattcttaggcctttcaccagacttttcaagtcagactctcttgtgagactcaggaatttgcaccccaggggattcttgtgtacaccggaatgtgagatgcattgccctactggtaactagacatcccaggatttatctgtgtttatgcggatgaaaactctgttccctgctactaatagcaccttgcttttggggggcacatccatcccatgccagcctatgattttcactttattctgtctgcgtattgtagcccaactaaaagtctcataaatgtagtaaaggagggcagccctgagttcataaccctaaacttggattcaggcccattcaggcccttcttctcaggctcctaatggtgattcactattgctgtgtctgcttctgatcagtgggccagtgaacaggttagaacttcctccctctggccttgtagtgtttaggcttacctgagttcttaaagggaccaaatctctttcctgatacgaacactttaagtatggcatagcaaattgtgatcctaattaaggcagtaatttctcacgttcatcttgtatagctgaatgacatgtgtgacatctttaataaaaccaaccagcttctgcattctgaaactgaactctgtcttcatctagttatcacattgtgctatctctaacatgtgttcttggcttctgattattacatgatctgtgatttgcaagtgactgtttttcattttttgtttttttgatacagaatcttgcttgctctgctgtccaggctggggtgcaatggtgcgatcttggctcactgcaacctccgcctcccgggctcaagcactcctcctgtctcagcccccaagtagctgggaccagaggcccacaccaccacacctctaatttttgtatttttagtagacatggggtttcaccatgttggccaggctggtctcgaactccccacctcaggtgatgcacccgcctcagcctcccaaagtgctgggattacaggcaagagtcactgtgcccagctggagcatattttattttctatttacatatttaggctttaagctgtacacaccaaaaatatttttttatggcagtcctgtttgttctcagcagagcctgtagagcctgttgtcagtggaatgctgagaacagccctttgtagagctttctattggcagtattttgggattcaggctgaggaatggttgacccaacttatacttccagcagtatgtaaatttactctgacatgggaaagatattaacagcagcaacaacacaaaatctttcaagatgcagatttgtacagcataatacagtattgtacaaatgtacatatacaaaattaatttggccttttcagtttctagtcttccagcctggaagtaagaattgtttttaacaaagtgttaaacggctaaattgatgttttggggttccgtcaagatcttccagaaaaattattaccccatagctacaaagtaacaagactgagaactaaggacatcagtgaagcccaagacaagttaattaagagcagaccggtaggactgaccggtggatatgacctcatttagatttgttggtgttcttactttccagattaagcatgcttaactattcagtgtggcccaatgcttttaaagtagtaagcatgtttttgagctgtatgattcgaacagcaatcacatttaaaatctaacatggtgcctaaaagttgtatagaaatatgtatgaaaattcacactaatatattttaacgtagactacctgttctggtgaactcttagtttgaaactttctttatattttagcaatcgtttgtaattctttttattagctcttagtgagtgtgtatgcagcattttctttcttactgtccttctcccacctacagtcaaatcaacagatgtttattgagcattcactttgcatgtgccaattctttcctttgccaatttcgggtgttaataattttggtatgctaatttattacatgctctgtgccattttaatttgcttttctttaattcacagtcagcttgtaccctttcctatatttgtttgctaactgcattccttcctctatggcttagctgttcctgttcttggctcattttcctttgaggttataacagttgtcaacagaatcctgaccaggctcctgggcaagccatgtcttaaccaattagtacttttgttttctctctattcctcttttcttcattatggtggaaaacagacagggattaaatggacagaattagaaaaagtaggaggggaaactaaactgaattggaagagatttaaatgtaatgtgtttaaaactgaattggttaacttaactcaagctttgataagtaatgggaagcaccatgatattatggaataatttgtcattttcaacagacttgggttttagtaccaggtctgcctctgttacatgaatgcaataaagcctacctcacaatgctgccagagcatttaataagattacatgtacgggccttcccctcccatcctctctgtcttagtttgtttggactgctataacaaaataccataaaccgcgtggcttacaaacaacagaaatttatttctcgcagttctggaagttgagaagtccaagatcaagatgctggcaggtttggagtctggtgagggcgcactttttggttcgtagaaggcatcttcttgcttcattttcacatggcagaaggggacagcccagctctcttcaaccccttctaagggcactaatcactcgtgagggctccatcctcatgacctcatgacctcccaaaggctccacctcttactaccaacacactggggattaggtttcaatatacgaattttgcagggatcggggaggacacacactttcagtccatagattctctgatgctgaacgagcgtgtcgctaattgctacacgcaaagacagaatagcagtcgaaaccaagaccttaccccggcttcccatccttctctgcaattagtgtctaatatgttttcccatttaatctttataacagccttagtatgtatcattattcccatttttcagatgaggaaattgaggcactgagaagtaacttgtacaaggtcatagatttggtagaggatttgggtagagttctgtcagatttcaaatccattctctttccacagtgccaggctgcctagaataatgagtgtgactgaagaatgaaaaggagttaatggtgtggccattcccctgttctttccactacttcacttggtgaatgactaataggcaaacactcccagagggtatttgcattttaaaagcgagctcattaaccctaatgaatctctaattggtggaatttgtgggggagatatttttaagtactggggctttctcctgtgtcttcaaggtgcctggctatctttttcttctttataggttatcaactattctggaatcagaatcgtgtagcagaatgcagtcacatactgctagtctgccccaaatgcattaacagggagtcatgaattaaaaggcagccatgaaaaaacattgaaaggaaaaaagtgtgggttagcattgtctaaaatgaatgtccaaaagcaaataaatttggccatatagagagtcttccgaagagtcagatgaaaagaatatattttataaccaaatttaactttagaaatgttatatcagcatttcccatggtgtgttaatgaagctctgcaagatgtttaataggtgtcagatgaataaaatggctccacagtcaaatacacttcgaaaaaaaatttttttttaagtttcatcactgcagaatttcttagatgctaaagtgcattaggaaatcaactggaagagaacttgcattctgaaggtttttctcatatttttgaccatagaaatatttttttccatgtgaaccccttggaaccagtgtttcatagattgcattctcagatacagagttctagataaatcatctttaattaaagaaaagaaaaagaaaaacagttttctgtattcacagccctttgcatgcagacaggctccaacccagtccacaacagcccatttccagtcttgttgggctcaagggcatgccaataataacagccctcttccccagatgagatctggccaattgaggggaggaaaaaggaacagatggagaccaaactctcatctttattgcctataaagctggtgttgaagaatgtggcttataacagggagcaaaagggcgtcctaatcggaatcccagaattaggttgagtgtgtaaaccaaaagtaagatcctaaacccccacaacagactgaacggaccccctctgggcctcaaaaactgaattccccattatgacaggagagatcttggtataccccctcccttttggagtttaggagcaactgactagcattaatgttaaaagagagattataagactgacaaaacagactctttgtagcagtaagataccaaattgcaacctgacactggtataggacctcatgacagatagcagaccctgaaggaaataaaaatattttaccctagaatatatttccttgacatacgttgaaatggccctgcaaagctgtcttttgtgggggagattacatccgtagagaatctccttccctttctagatctttcccagatctaggagagatgaaatgaaaggctgacacctttaaggtctgaagagagacgcttaggatattctctatagggctgttacctgaaggcgtcatctacttaacaagaaccttggcttccacaatgccctttttcttaactcaagcatttacttctagtctttagacaaagctgaactccttcaaccaactgccaatcagaaaatctttgaatccaactatgacttgtaagaacccctactttgagatatcccaactttttaggctgaaccaatatataccttacatgtattgacttatgtctttgcctgtaatttctttctctctaaaatatataaaaccaaactgtaacctgaccgtctcaggcacactttctcaggacctcctgagactgtttcctgggtcatggacacacacattggatccgaataaacctctccaaatattttacagagcttggcttttttgtcagctagttccactcagttacagaatatgctgagctggtcaggcttttccccaagtgggaggatgtttctgtggaggatcagagcagacagcaacatgctgcctgtgttccttgattcttaagagagagggaaggagaagttactggaaaggaatcctgatcttggggagggttcttagatctcctgcaagaaagaatttggggtgagtccacagagtgaagaaagaaactttattaagcaagtaaaggagtaaaagaatggctgccccacaggcagagcagctgcgagggctgctggttggctatttttatggttatttattgattatatgctaaacaaggatgggttattcatgagtttttaaggaaaggggcagggatttcccagagctgagggtttctcttccttttagaccttatagggtaacttctggatgttgtgtaaacagtcatgacgttggtgggagtattgtttagcaggccaatacattataattggcatataatgaacattgaggatgaccagaggccactttcatcaccattttggttttggcttccttctttactgcatcttcatttatcagcagggtgtttgtgatgtttatcttgtgacctcatatcccatcctgtgactaagaatgtctaacctcctggggatgtggcccagcaggtctaagcctcattttatccagatcctattcaagatagagtcactggttcaaaggcctctgacaaggggacagaaccacttgtggccaagtcctcccaaatgcaacaaccagtggacaggagagtggagagaggcctggagtgaatgttaatggaatttcctccatgttgaaggaagcataaggcaagtgacctcacagggttaacaggaattctgaacagaaatatatagatatacttaagcattcttctggctgtactttgacccatttctattttctttcttttttttttttttttttttttttgagatggagtttcgctcttcttgcccaggctggagtgcaatggcataatctcggctcaccacaacctccgcctcccaggttcaagtgattctcctgcttcagcctcccgagtagctgggattacaggcgtgccctaccgcacccggctaattttgcatttttattagagacggagtttctccatgttggacaggctggtttcgaactcccaacctcaggtgatccgcctgcctcggcctcccaaagtgttgggattacaggcgtgagccaccgtgcccggccgacccatttctttgtaaccaaaatttatgtaacaccagatactgaccatttgtatccccattgttcctatagataggattctggttttcgttcaagatagtgtccctgacactagaatcataagctcttggtgaagaattacttaagcagatcctggattctagtggaacaactaacaccaaccagtttaaagacccccacagaggaaccaaatcagcaagagaataccgtttcttcatctccctgccccatgacttcaccccacaattttcaaccaatcagtggtctccacactttggcccactccaaaacccttaaaaaccctacccccaaactcctctggggaaaagatttgagctttcttcatgtctcctcatttggtggccctaagattaaagttctttttctgctgcagcccagtgtctcagtgtattagtctgtttatgttgctataaaggaatacctgagaagggtaatttataaagaaaagaggtttattttgcctcagggttctgcaggctctacaggaagcatgatgctggcaactgcttctggtcagggccccaggaagcttacaatcatggcagaaggtgaagggaaaccagcatgtcacatggcaagagtggaagcaagagaaatgccagactcttaaacaaccacctctcacatggactaatagagtgagaactcattaccacagggagggtacttcatgagggatctgtccccatgacccaaacacctcccagcaggcccacctgcaacattcgaggttacatttcaacatgagttttggaggggacacacatccaaatcataccactcagtgtattgacttaccacatgcatgaacaatgaacctattatggttacattaaggagtgggaaccaagtgtctgccccatcacccacctaccaccaaccccttcagacaagcctcctctgggtgacctaagtaggtatttggttcttctcccatcactggaaatttctgtcctgtccaatttcctttatacatagtgctcactcttcagcattatttctcccctcaaccatcctcacccagtagaatgggatcatgatgatactctaatgaccattcctttctcacatccttatatagctaaaacatcatccaacatttttttttttttttgagacgaggtctcactctgttgcccaggctggagtgcagtggtgtgatcttggctgactgcaacctctgcctcccaggttcaagcaaatctcctgcctcagcctccccagtagctagggttacaggcacatgccaccacccccagctaatttttgtatttttgttagagatggtttcaccatgttggccaggctggtcttgaattccagacctcaagtgatccacctgcctgagcctcccaaagtgctgggattataggcgtgagccaccgtgcctggccatcattcaactttttatcccggaaatgatggaagacatatatttctctaatacagactggaaaactacaggctgccacttgtttttgtaaacaaaattttattggaacacagccacacacattaggttacatattttctatgactgcttgtgactacaatggtagagttgtgaagttgtgacagagaccttatgacctgcaaagactaaaatgtttactatctgaccctttacaaaaaaaatttgccaacccctcgtctaaaatatagatgagtttcacatcagtcctttaagttctgaaagagcttcattagtatgtatatgtagcctttatcatttactcactctaaataaaaactacatttgaaacaaagaaaatcgcatggctgtactataaggataatttttacatcttgtaaaattgtttccagccttaaaaacttcctgaaaaatatgaagggaactgtgtatttgctttgaaggagcagaaggaagaataaagtcttgcatcagtcagaagtatttgatgtcaccattgaaaagggaagaaaacagataatctatggggcctatagaagcaaaaaggagtaatgaaaactgtctgcaggaccagaaggcacaagatcctgccttcagagctccctatcagagcccttggctcctctcttcacaccctgttccctaactcagagtctagtttcctcccaccttggccctcatgcattggaaccgttcaccagaccacagagtccccagagatgtcaagagactgggttctgctcccattgtgactgctttctatgtgggagaccttgggcaggtcactgagtgcctctgccccttaggtttcactctcctgtaaattgggggtgggcagagttatcttactgtgcttgcccaacagtaatcaaatctgatgttttttaaaagcctatatgaaaggtaaggtattatgaaattgtcagtgtttttgtttttgttgaaatgtctgagttgcaaatgaaatttttttatctatccaagatataaattagagttaactgatatttgaaaacttaagtaccttatttcatatttctcatacccatttttgcttatttatttttatagtatttaacttttatatggattagagaaaatatagaaaataactgaatttttaccataataaaataattcttcaaggggtggaaaaaaaacttcaaaaattgtatttcattgtgacccattcttttctgtttgttgtttattcagctttcatttttatgcctttgtttacagagaaacaatcttgcagatggcaattttccttgtaatcatttattgtcctatctgagtcatcgccagacatggcatttcagtaaacagtgattctgcaattgcttccaggcagatgtgttgtgtgaagttaagaacgctggctgataacctttctggtttttcaagcagcagggagaaagttttgtgtagatacacacctcgaaatcagaaaatggcgaaggaaggactttgtgctgcatgattttaaccaaatatagtgtttgtgtgatggatggaatagtaatctttttaaaagataaataatatttcttcgagtaaaggactttttatagtgcgttatacgtattttcttagaaacatcgtgcatgtgcattgttaaacacaacgttgaccttgttgtacagacatttgtatcaccttgtccactcaggttcctgtggtctcatgcctgtagctaagcaaaccaaactcctcatgcattggtttttccagtgtaaattggaggttctcttatccctcactttcagacataggggatttcttttgcctcacaaatatgtttttacaaacacgtatgctcaaatataatttttattatgtatcataaagtcttatcttgtcactgtttttatctgagatggagtttcgctgttgttccccaggctggagtgcaatggcgcgttctcggctcactgcaacctccgcctcctgggttcaagtgattctcctgcctcagcctcctgagtagctgggattacaggcatgtgccaccatgtccagctaattttgtgtttttagtagagacggagtttcaccatgttggtctggctggtctcgatctcctgacctcaagtgatccacccaccttggcctcccaaagtggtgggattacaggtgtgagccaccatgcctggccttgtcacagttttaccatcaactacaaagagaagttcactaatttattcatctaatgtttattgaacacctattgtgtgctgggccctgcccaacaataataatgttgcacaaaacagagaacaaagtaatagggtggaatatgcattgtaaacattttgtgggttaatttatcttaaatatataagctaccaatttagttcttgtttcatgattttataatttaacaggcttataaatattttttattactttaatcactttttttttattgcaataggttttgggggaacagatggtgtttggtacatgagtaagttctttagtggtgatttctgagattttggtgcacccatcacctgagcggtgtacactatacccaaagtatagtcttttatccctcaccctctcccaccctttcccctgagtccccaaagtctaatgtatcattcttatcaacaggcttatattaaatccttcacaattttcatgagacttttccttgattatagccatgagtaaactaaacttttgtgttgcatatggagaaattaagcttagacaagattttcatactttatctccagtcaagactcatgacttttccttacattaacaaatttctaaccattagtgtcagctaagccatcatccatttctttggtaatcttccctgctgtggacattcctaagattgcccaattttatagaaaaagcaatttacaaatggctaaattagcgtctgattatgcttcaaagaagtaggctaataggtagtctctatcatgtgttaatcacaaaccattagtgataattaataaattaaaatgggccaattatgaaattctgcttatacttacccaagtgtgtttgtgtctatcctgtgtccttcaagccagcctactcaccaacttcatttagtaatgtaacccagtcaggcactagccttaggaatcaaagtattaagtgaaggctagtttatgcatttgttcattattctttcctgctgtaaggattatctgtcatctggttaattattacatataaacatacacatctactccaaggcaaatccacaaacgcttacaaagagtaagccttatgaaaaactaacttggaggacagttatccatatcataaaagagtttttatttcaacataatttgccttaagtcataagctttccaagtttgtttgaaatatgacttgatttataaaatatgaatttatttgatttttccagagtaaatctagataaaacaggatacatttaggttgtgtgtgtatgtatttatgaatgatatatgagacctgtttataattactgttcttaaaaagttagcttgtttactttgaaacaagggaaatagtggtttcttccatgatgtgaaacatataataacaaaagatacttcaaacaaatagcaagtagtttggcctcagtaatatggtcaagttttaaaaatagacatatattttacttcataggagatacaacagatgagcaaagaatgacagcaagaggcaaaacttcggacatagaggccaaccaacctttggaggtaagtgaaacagagtaagtccttttcggtgaaactgaacaagtcactatgattacttatgcctccgaggataaatagtaacttctgctcttgctatgccataggtgcctgaatacagggaaacaagtggtctgctgaaagtcagtggagagcagtacagggagtgccttcccaagtgctaaactcctttagtgctagaaatgaaaactttctgttaaaaacaaaacaaaacagaaatcaagtccttaagttaaaacatttaaactatttttaattgagtgattatgtactaatatatttcaataaataggcagtatattaacttgtagagaaaggcttaaaaataatccattcagccgggcacagtggctcacgcctgtaatcccagcactttgggaggcctaggcgggtagatcacgaggtcaagagatcaagaccatcctggccaacatggtgaaaccccatctctactaaaaatataaaaattagctgggcatggtggcatgtgcctgtcatcccagctacttgggaggctgaggcaggagactcgcttgaaccccggaggtggaggttgcagtgagcctagatcgcgcctctgcgctcctgcctggcgacagagcgagactccgtctcaaaaaaaaaaaaaaaaatccattcaaaatcccgttgccttactagttccagcatcaaagtacactccttgaaagtattctgtagaaaaactagggtatttattctttttcacatgagaaaactatttgctctctaagagtttacatgaaaatgtagttaggatacttttgaaaactatatagaaatatactaacattatttaatcaccaaaataatcatctttaagacttaaggggaatgttaagtactagggtggaaggattatcttgaaatgtgaaactttctacgtagtgacacacctctacctgtattctagttgtagcatatgagggtattgctgcatacaactagagggaggtcagagacctggccagtgtgattcaccatggttccctaatgcctagcccacagtaggtagttgaaaagatttgttaaatgaataagtcagtacaatcatgagtaataagtagagactaatatacttttaagagatatttttattttttatatttatatttttcaccgtgaacaaatattttgcaatcaaggaaaaatcatcctatttaaaacatcttatttaaagatgtgatataggaagtaaattcatgaggaggaagaaaatcatctttctcatgaaactgtgcattcattctttcacttatgcatgcaacaagtatttattacactgaccgtactcaagatactgtgcatggagctgaatatataatggtgaaaataggacacaaggacatagaaaaatgtccatcttatatgttgaagcaacttgatctctttcatttattcaaacatttggtgaggctgggcgtagtggcccatacctgtggtccctgtgctttgggaggccaaggaaagaggattgcttgaggctaggagtttgagaccggcctgggcaacattgagagactcatctctacaaaaaatttaaaaattagctgagtgtggtggcacatgcctgtagtcccagctactcagaaggctgaggtgggagaattgcttgagcccgggaattcaaggctcccagcctgggcagcagaaacatttagtgagtgctggccataagtagcatctctgataggaaataaaagttgatatgtttgggatttgggagataaccaccaggatggttcaaaaatcatccacaattacttgagtttcgttgcttagtgtcttcttttatatgggctgctacagcaaaataccataaattggataccttatgaacaacagaaatttatttctttagttctggaggctggaaaggccaaggtcaaggtgctggcagatttgtgtctggtgagggccctttttttttttggtttgcactctggctgtgtcctcacatgataaagggagaactctagtctcttcagccccttataagggcactaatcccattaatgcaggctctcccctcccaccccctaatacagtcgccttggggattaggtttcaacatacgaattttggagggacacaaagcattcagaccatagcacttagttatgtgattcattggaaatgtctgcagaacttgactatttttcaaagttgattcattgatagaaagaattccaagactaattcttaaggaaagatgcttttaagattacaatccacagagctttcaaacaagctcattattgtgctactttctagtctctctattaatatagtcagttgttaatcattaaggctggatgtacatactcatgcagtaacagatgtttcaaaagtgccttctatgcaagtaccggctgggcaatgagaggacagtgtttgctatcagacagctcactaatgtagaaaaaaagaaaagtggagtgggagactataaatgagaccacagggttaaatcgcaatgcaagaggaaaacaataaaatacttctagaggctatatatgttttgccacagaaaagccaaatagtaatttaccttgacagtaagcatctaacatgggatttgttattcctcccctttaaaatacaaaaatgagactgggcgtggtggctcacacctgtaatcccagcactttgggaagtcaaggtgggtggattgcctgagctccggagttcaagaccagcctgggcaacatgatgaaaccccatctctactaaaatacaaaaaattagccgggcttggcgccgtgcgcctgtaatcccagctactcaggaggctgaggcaggagaactgcttgaaactgggaggcggaggttgcagtgagccaagattgtgccactgcaccctagcctgagcaagagagcgagactccatctccaaaaataaaataaaatacaaaaatgaggccgggtgcggtggctcacgcctgtaatcccaacactttgggaggctgaggcagccggatcatgaggtcaggagatcaagaccattctggctaacatggtgaaaccctgtctctactaaaaatacaaaaaattagctgggcacggtggcctgcgcctgtagtcccagctgcttgggaggctgaggcaggagaattgcttgaacctgggaggcgggggttgcagtgagccgagatcacaccactgcactccagcctgggcgacagagcggaactccttctcaagaaaacaaaacaaaacaaaacaaaacaaaacaaaagtgaaaacactgctgaacgctcgctacccttcatatactacctagatatagtcaaaaatgagtcttatccagcctcctcgatttaaattctgtgtagaagttgatgactcctaaaatatgtctctacctagacctctcccctgagttctagactctgtacccaactgcctatgtaacatttcacttacaaatttctacacagttcagcctttccttaacccatagaagaactattgatacctggccccaccaccctggagcctctctgtgcccaagttttaatcattcctgtttaatatcaccaccctatatctatatagtgatttagaaccaattccccctgaggtacccttggctcctgtctttccctcacactgcacatccagtctatcagcaagtcctgccatcttgccctctatatccggaatgtgactgctgctcaacgtcatcactgttagaacagtctaagccaccccttttactagggccccattctttctcctccagcccattctccacatagcagacagaaatatgtcagatcacatcactccttggcttaaaagctctatctactgtaactagaataaatgctaagctccttgcagtgggctacaaggaactccatactctctctaatctcatttttctccccatccccatccaccagccacctgccgttctgtctcttgatgatgttaagccctttcctatctcaggctttgtatttgctagtcattttttaaaccagagcttcacttggcttcctccttatcattcaagtgtcacttttcatgactacctcagctaatgtgtccttcccccagtcactgtcacataactctgtcttattttctccattacacttaatcactatgtcggattattcatttgctatctgcttctcctgactagaatgaaaacaaactttgtatgtctagaatagtgtctggtacacagaagttacccaataagtacttgctaactgatcatctagattttatttaatgtctttgtccatctgccaggttaaaggcctaaatgtcattttgactccttcttctcactccctcattaaatctataaccaaggcctaatgtttctgcctatcaaatatcttccaaatgtggtttctcctacaccaactaggtcctcatctgttcactagactattattagatgagcagtttcttccccaaatctctttctaaaaaagaacagcagggtttttttttttttacttcccccctctaaaatcccttgaaacctgcacaatgcagctgaaaccttgaaccctgttctaatgtcacttcctttgtgaacccttttctctgctcccccagccagagacaaccccaatgtcctcttaatgcttagattgtcttttatgagttcactatagtgcaggtttttgaaaggcaggggctatagcttaattagctttatgacctcagcaactatcacactgttagacatatgtgatgtaacataaatgccctgtcaatgatttctgggtagataaatgaaaaataaataatccacttatctttattaaattctgttttctactttacataataaacagacagttgtatcttttctcaccataaaaaaattttcttgcatttctttggagttatccatttaaaaatctgttaatttacattatttttggcactcttactacattagcagggaaaagtttaataaattcagttagctttaaatatatatatacatctgattaagaaatcataactatttgctaactggaaagcctctaattattttaatttttaatgactaagcaatgttgaaatattctctataacgagaacataattagtaaattagcatgggttccataaagcttaaaaataacatttgtagttgccaaaatatagctcagttttctaagaacctttggagaaggtggcttttagtataccgaaagaggtttcttttggcaagttcagataaacatatagattgcctcttagtttcaagggattgtgttagacatggtggtagggaggatacaaagatacctaagacccagtgactctgacttactgatgcaggaattctccatctatttgtggaaaatttagcaaatcactgtactgtaaagtgaaataaaataagttccttacgcgtcataactacaaaggtagctgtgagatttcgatggaagaaggatattgtctgggggagtcaaaaaaggcatcatgcattagatgagctttaaactatgaataattttgtctacttgtatgattaattttttatgattaagaagttcctgggaaatgaaattcttcattaagaacattttagaaatacagaagcaaatcctaatgtgaaattgctttacacacgtgaatctcaatggctggtaataaggggttaaaaaatgaaatgaatgtagcgtggcctatgctacattgtaattttaatgacagttaaaatatttgttaagtgtctgtgatatttttcattacacgtcatagcccaagtatatttcaaaactgtgttctccattcaagtacatctctcgaccttatggaaattctaacatctagatggaatagaatttaaaaaagatctggtttgggcatcaaataggttagtttttacagagctagattatgggatattttagcgcatttacacgaatgattgtctatggaaaacagcgtatttgtattaagtaatttgagagactttgcagttcatgaaagtgatgataatttagcattcactccagaaaaatcgaaagttttcagtacttcctgaagtagtgtttgtctcttcttcacctccctgtttaggtagtttcaggtttctctcaataataaattaattaatactgcatctacatcatagtttcctatgtatcatcctaagatattatcacctaaaatagggtaactttaggagacacgtcactgaactatctaatcatcaaaatgtgatttttactaagttgtgcattactctgtgttttaagagtcatttgtaacttttaacaaagttcaccatgtttttggtatggagagagtgaatgtgtataaatccatgtttgggcttattaaaattaatgtcattagactctgatatttgagggaagagttacaattcaacctaattatccaattaaaggattagacacatccttttcattcttcttttttccttcttgcccttctgggtaaattttgatagtgagttgtaatgatgttgcatctacttctactgtgttctactagtcttggagcctgtaacttacagctcagggagataaacctgtaggggcccagttttgagtttttgccattatgactcatctcttaagagaataaacattacatgtaagcaagtcgtcattctttttcaatttgtagtcttggaaagtgttttatattgtgaaaactggaaccgtattagctaataatttaccagcggacctgttctttttggctttaaggtgtattttgggaatcgagaatgttagttttagtttttaatataactatgtctaattttggtgactgaattttaatctagttttagcagatatttttaggttgtttattttaagtgttggttgaacttaaatttcttgtatttgtaactgcagttttttaaaaatttgaacttatttttgatctcaaagactgagggatatttttatttacttatttttatttacttagtggcttaaagataataaaatacaaaaacaagccaataaaatgctccccacaaaaccataattccatttgtgtatttgtcttgagtgataacgaattcacatatgcatatggagacacatataaaataataactaacagatggtagagctgcaaagtaggatttataaagattattatcagctggtggtattgagatactcctgtggttatactgacagaagacacaaaaattatttatattaagaaactggcactaacaccttcccccaacttctgttaccaaagtaacttattgcatatttaatataaatttcttaatgaagaggtaaaacaatcttatggccaatttgtactagcaaatttaatagagtagcagaaatagtaattaaggtagtagcaataacaataaaaactgttttgctaaaattgttaggggcatgatatttctagtaggtaaaggaaggatttaagggactttgtttattcaggtaatttcaaacacacttctcaatttagtacacagcggtcactttggaatattgtacaattgtaaacaaaagcttgagttcttttgagctaggtatggaagctgcattgtatatgaagctgcattatagaattcatagttcagtaatttagggaaaagttgattcttttgttcatttctttttaaaaacttttatttttaatggacaagtaataattgcatgtatttatggggtacggtgtgatgttttgacacatgcttacaatgtgaaatgattaaatcaggctaattaacaaatctatccccttacgtgcttatcttttttcatggtaaaaacatttaaaatctcttttagcaattttgagtatacagtgtattgttatttattaaagtcaccattctgtgcattagattactaaagcttattcttcctgtcttactgagactttgtcccttttgatcagcatcttccctttccctacccactcccttccctcagcctaaaatttgattttctgaaaaaagtatgagatgcacattttaataaaacatgttcactcttcttctgatgtgttttcatacatccattatgtctttcatagagctataggagccttcagattctgtagggacgcgtttccttgttgcttttatttcagatagttattgaaatgaatgaaaatatccttgagatttgtgaatcccatgtgatacagactttggttactactcctcaaagaatggaataagattactgcattaaaaactgggttttgtgtagaaaggaattggggactcaaagtatagaaaaaaggagactggagggggagattttcaagaacaatttcaaaaatagcaacagttcttctagtggatgccaggatttcagttttaagaattttttagtacaaaatggtatataataagtatattaatttaaagcatcggggggttacaaagatgattatgaaactctttactcacacaagatattcatagtcaaaatacaaatataatggatattgctattgaaggcagtttaaattggtacaactattcttggagagcattttggcaataggtattaagagccataaagatgttaatatactttgacagtaattccacttttaggattctgttctaagaaaatagtcttttaaatccacaagttgtatgctaaaaaagatggcatattcagtcagtgcaatatttttcagtttttataaatgacactgatgatgagttttcaataaaatatacagatatagtacttaattttataattttagttaaaaatgcaatatacaaaattgtatatacagtatgattgctgctatataaaaactatgcagaaaaagatgatgtaatacataaaaacattaagagtacttgcatttgggatgatagctacataggttaaatcattctttccagtgttctgatcttccaatttgtctataatgaatgtatcttatattttaaatgatagtaatgttggtgatgaggaaacaacgtattcactcaaggatagtttttgcaagaactattttgtgtgatagtaaaatagtgaaacagtcggtctgttgagaatgatcatgaaggagatatgttggcactttgctcccttgactcatttaggtttaaggtctcttaattagttgatcacagagtaccacatctgaccacaatttgtcaaaacatctgtcccctgacacccagggacctttccagcagggagaagagtgaggtgatttgggaggttattcttcctatctctttggaaatcacatggcccaaacttttctcattaatcaacctgtcaatgtcattgaatcacttataaaggcatattttcccccgcaaaagtgtatgggttactggcttggacacatatttgtctaaacatctcgcttctttctttttatctatgatgctgagactcctaatttaaagatatgaatttctagctttatgataattagctgatgagaacataattttatcaaagacttgccaggatttttgttcattctttgtttttcctaatataaaaccctttctaatttctgatttctttggatatgaagcatagttagattattgcactgtgtcatttgaacagataaatttaattctttgatgtgtttatcctcttatgcagcataccttttggtaagaagattttgtagaatgcatttctccaacctttattttcatctgaattgctgggtcatataacaaaatagaaagtgcacttttgttggactccttagctcactaagtatgatctaggatatgttgctgagatttcttcaacttcaattcttagtccatgaagtcgatgaattaggtgcaatgtttgagcgccctccctgcccagaagtcatgactgtttacctctttggaaagcgaactggggttttgccacaaaatgccaacctttaaaataatgctttgataggggagaaagggagatgcgaatctgctgcttaatgaagagattttaggcattgattaatcaagctttatggcctgttgggtggggaaaattcaatggtccttgcaggtaaattgtcagacttcaaaaattacttcaaagattcttgctcttcctaagagtgtttgtcttgggaaatgataaatttggtcactggtagagaacaattaaaaatacgttgttatttcttttagtctataggtaatcttgacttattttacagtaagattagcacaggttgtttacccagaacactgccaagataaacttacagcctgcttctcaaagtttgtgaaggtctttttcgtaacttcaaatttgtacatttttgttaccacaacatctgtatcctaacttcacctttgctggaaaaattataattgaaaggtcataattctggtgctttcttctggcttgcattggggttaactagcacactgaaacataatgttcattcaccctagccagtgagtccaaaccatgtgaggtgtatgagagcaaccctgtttccatccaaactgcacatatggtgtgggtaagccagtaatgtgagttttatgcaatgtttctgctcatgtacacagtctgttgctcagcaccaattattccctgccagaaacccgctaacctgctgcttttgtacctctgctggatgaagttaggtagcttaaaatgaccacaatgatatttatttaactttagcaatctttgtttgttaaagttatgtaactttaagtgcccaacacatctgttgattgatcacaattgattgcaattagaatctaagaactggaacattgttactgcagtttgtggagatacacatgtgttaattatatatatttagaaggaggaatcaaaatgtggaaatactagctttttgtttatcaaatctagttttatgtcttcaattgagatattattatttaaaaaacgatatataatattctgtttatactttggtagtcaccttgttgtcattgtttccagtttctacttttatagctttaaaaaccacaaaatcagcagggtgagaggtccatgttgggagaacaactgttccctatttcacacagccatcttttttttttttttcaaattctgttttttaattagtggcaaatggtccttattttgtcctcctttggtttatattaccattacaacttcttgagactatatagagagcttaagtgcagccatttttatgatgtcttccgaccactagagattccttcttgaaggataaatttcatctgaatcttcaggcagtggaaaagtaacatgtaggtatgcacctggtctaactgacattatctgaatattccactttgtacctactgaggagtcttcttatgaacatgcctacatgagtgcaccagcatgaatacatagaaaaaaaattatactttagcttagtacaatttacgtagattttccatttttctccaggcgtagccagccccattccttactatgtgccaggtttctttgttgttgttgttgttgtttttagatggagtctcgctctgtcgcccaggctggacaaccttggctcactgcaacctccacctcctgagttcaggcgattctcctgcctcaacctcccaagtagctgggactacaggcatgcgacaccacgcctggctaatttttgtattttttagtagagacagggtttcaccgtatcggccaggctggtctcgaactcctgacctcatgatccgcctgccttggcctcccaaagtgctgggattacaggcatgagtgactgcgcccagcccctttttctgcctttttatgccacttgcagagggagaaaagattggtgtatgctacacgtaagagcacagtgatagtgtactgaagtaccatttacattaaaaaaaagcatatgaaaactttctcacaactttttagctgagaagttggtaaatggttgtataaccctactttttaagatggtttctcttggaaaatagtttgaagaacatgctgtttatttgttcatcgagatattctggcatttatgactagctcaaaccaacccatcggagagctgtatatttctacctcattgccttagtcctgcacagattgccttccttgtactgttgttcagtttgattgaataacttggtgagaaactgctgtgtggaatttactgatatttattatggaggtgttactaaggcattgtcaactacattagatagtttcccatgtgaagtcctacttaggtattctaatttcatattgctttttatttattttttttttttgagacggagtctcgctctgttgccaggctggagcacagtggcgtgatctcggctcactgcaacttccgcctcccaggttcaagcgattctcctgcttcagcctcccaagtagctgggactacaggcacccaacaccacgcccagctaatttttttgtatttttagtagagatgtattttcaccatgttggccaggatggtcttgatctcttgactttgtgatccgcctgcctcagcctcctgaagtgctgggattacaggcgtgagccactgtcatattgcttttatactaacaaaatattttgtttttcttgaggtggtaatagtctctttttctcatggccattgtaaattttgtgcctaactttgttttttcccattttccattggctagggggaagctcagacctaaatttacagttcagttttagtaactatttaagaccttatgagatatgcatctgcttgctttattttcctctcacctgatgctcctgttctatatttttcctggacgtaatttttaaatttattgtgagtctttttagttgcctcattcattttgtagaggaaagggttaaaatatattcctatatgtaagtatatttatgtaatacttctacaaaatatatttatatttagagtgtactttttattttaataggttgtaagtggtatacataacctctaattttaatcatcttttgctcctctttcaaatctctgataaaatcatacataggggtttgactgcgagaacgtgtgtgacattgagtaccttccttaacctgtctctcccatgcctcaggtggagtatggcagtcagctacacacttacctccagtgcgatgtgatttcttcagggtccttattgatttgaagatgcaggtgaaaggagcctcctttccaggtcatcaaccttgccaagctgctttcgggcagggtgtaccgcaggcatcttgcaagtctcactacttgtcacatcagccacttcatggtctcccttctgtatacactttcaatcctagatatgctttttagatggcttaccagttggatttttgatatcagtatagaggatgtaggacaagtgcctttctaacttagagagaaagattgtctcgggagtgatggttcctcacagtggcagattttcataacccttgctgtagtatggatagctgtaagaatgtgaactgtatcagacagacttgtagctcagatcttggctttaccacttattgtacagggttactataagaatttggtgagtcaatatgtaatatttatttgtatgtctatatacacagtatctgatgtatactagatactcagtaagtattagtttctttttagattggaaggaaattatggttaatgccttaaaaatcatgccagagtagagtagaattgattaaatcatttaggaattatgctcaattgagagttacagtaaaaggcaggggtttaatttggggcttaatttttctcatgtgacaagaagtctcatagaaggtagttaaagtattgattcaggagctcaggaatgttaagaccaaagtcctatagttcctcatagttgcaagttagctattgcagctccagccatcatatctattttccaggaagcaggaaggaggaagacagcaaagggagaataaaactgtgtccagaaacttttcaaaaaatctctaacagttttactggccatattataacatatggccacccctagtggcacgggagcctggtaaggagcctactttagcttggtactttgctactacccccagaaaaatcaggattctattaaagatgaaaggaaggatgaatattgggtaggctacaagaggtctctgacatagatatcaacctattttgcttttagaaggttcatttgtccaacaatagatatcagtggaggtgggggaggacaaatagagagaagcattcattagtgatgcctggattctatttagggccacgaagtctttgagtagtcatagtgggacaagaaataaagaaggacattaatttaaaaaaaaatcttggataagctaagcacaatgctggtaggacctttacatgtattaactcattaatttttacagacgaggtaggcaatattatctatatatcttatagaggaggaaaccaaggctcaacaatacccatttcccaaggtcacaaaaaaaacagtaacattaatggaaccggaattgagacttgcgcctgactaaccacaaaacctatgctttgcatcgtgttgttttcctgtctccactatataaataacgctgcagaaacctgctgtttcactttgcttctcttttccgtagtgccttctcctgtgaggtccacaataactatatattgacttcaatgatttgtgtgcagaactaaactgagtgttctataaaagattgctgctgttagttgctgaaggctgtagagatgaggccgggagaggaagaagtggtgcttctctcttatcaccgccactcagaggtgggaatgactgccttgggatatatgccaccagtgtcggtagcattcaaggacattctttgggacaaagagaatgtggcaaagcagcagtgaccaatctgagtgagccaaagtccaaaaggaaagctgatagaatgagttggcatggaggtgtatcttctcaagtcagaagcctgggaattatctttgacttcttcctctttcattctcaacccaattgatcaccaatcactttatttctacctcctctggctaccttgcttatctgtcctttcctctacctccccactgcaactacagtggttctggccttatctttcacatggattattacaaagagtttttgtaatagcccttaatgcccagtcctactttcattcaatccattcacccacaaatctgaccatgtagttgccttacttgatggcatcagaggctcttcagctgcctgtaggataaaatccagtaatttgtgtctactgtgcatatatggtccttcgtggtctggtcctgctcctctgtgtaaacgttcaggtctgttctgtgtcaccatacagagtttcttaccatttcttgagtatattcctttctcttgaagtttgtgcaatttctgtcacttctctgaagaactttatcccatacgtcttgtgttcactgagcaaattcctgttcatccttcaaacccctgctcaaatatctttcatcttcaatgccatttagtctcccctctggtcccttaacaccttgtacatctgaccaggagtgccatgaagtggggattcgggttgactcatcattgttccctgtgcgtggcatgcatcagccactcaataaatatttaatgtttgatgtgtgcaggaacagtcagactagacaaaagacagaagaacttgttatctaagtattactcttaaccatgaaaagctctaactttggataacctccttacctttcggtgctagagtaatgggaatatatttgaaacattacttcatctctccgaagtgaattattctcaccaggttcttaacagtttctgttagtttttcaggttatgtttaataattcccatgataccagctgaatgatgattctaattctcaaatcctaaagtgactcttgcctctcttgtccaatttaacctgccacattgattttttatttgttatgtattatgactttcctcaaaacttggttgtattttggattttcttttctgtatctcatccgtttttgcatccgttcctgactaaagacacattttcaatggtactttttaccttttagatgtttcagtatgttccccccacccccttttctttgagacaaggtctcactctgtcacctgggctggagtgcagtggcatgatgtcagcttactgcaacctgcaccttctgggctcatgtgatcttctcacctcagcctctcgagtcactgggactataggcatgtgacaccaggctcagctaattttctttttaaactttcaggttcagaggtacatgcacaggatgtgcaggtttgttacataggtaaacatgtgtcatgggggtttgccatacagattatttcacccatgtattaagcctagtagtacttagttattttttctgcttctctccctcctcccaccttccaccctctgataagacccagttgttcccctctatgtgtctgtgttctcatcattttaacaccctcttataagtgagtacatgctgtacttggttttctgttcctgcattagtttgctaaggataaaggcctccagctccatccatgtccctgcaaaggatatggtcttgttcttttttatggctacatagtattccatggtttatgtgtaccacgtgaacagacactttgcaaaagacatacacctgtccaacaatcatatgaaaaaaagctcaacatcactgatcatcagtgaaatgcaaatcaaaaccacaatgagataccgtctcacatcagtcagaatggctattaataaaaagtcaaaaaataacagatgctggcaaggttaaggagaaaagagaatgcttatatactgttggtgggagtgtaaattagttcaaccattgtgaaagacagtggtgattcctcaaagacctaaagacagaaataccatttgacccagcaatacctttactgtatatacccaaaggaatataaatcattctattataaagacacgtgcacacttatgttcattgtagcactattcacaatagcaaagacatggaatcaacctccatgcccatcagtgaaaggctggataaagaaaacatgctaatttttgtattttttgtagagacagggttttgctatgttgcccatagtttttcctctgtttttttgagacggagtcttgctctgttgcccaggctagaatgccatagcacagtctctgctcactgcagtctccacctcccaggtccaagcgattctcctgcctcagcctcccaagtagctgggattgcagatgcatgccacaacacccagctaatttttgtatttttagtagagacgggttttcaccatgttggctaggctggtctcgaactcctgaccccaggtgatccacccacctcagcctcccaaagtgctgggattacaggcatgaaccaccttgcccggccctctcctcttatttttaagcagtgattcctaagggtaaatttgtgtatgatttttagccccatagtacaggaccttcttgcacaaaaattaggaatttgacaaaataagtaaatgacaagcatctgaagattttcttcaaaccatgaatatattacttctcaaaattttaagcccccatttttgatgtatcaaataacattcagcagttgtttatattacgctgtatctggtaagttgtaggtaattactagaagaatataagattcttgagagctgcataaatgtgatttctgcagggtctctttaggtatgctatgctatacacacgctgggagcctgcagaaatcacacatacacaaaagggccactgaatcagatctgaaagaggagggccattttgagttggataaagctacgtgtatattacttgttttttccacgcctgttgacatggagaaccaaaaccggtgtttcgtgctttcaacaaaaatagttttagttttgctctgaaagaaaaatgggttcacattctgaaaaaggtgattttgtcaccagaatatctgatgagtaaatctgcatttgcatttttatcattgcctaactaaaacctgttcagtttggttaataaattattaatacagttctctaacttctcatccgggtacactgttgaaatagcagaccatcccatttatttcaccaaatatttcttatacacctattttggatgaggctctgttaaactctgttctccatatctgaaaatgtatgggttattactctgccaaagatttgtggttaaaaaaattgtgttaagttctaagactcatcatatcaagatcaagcaaaacaattgaccatgactaactttggggttgaaggctacaactatgtcttttagaggtagttgtcactcaggcaaattttagggcatcacagggctaaacattaattaaccaaatgaatcagttttaaccactgcttttcctcaattcagttaagggttaaggagttactaatacagaaagatggtgatacaggagagtatgagaattattgattaaattatagataaattatagactaaagcatagtaatatgagaatgtttcattttctgacgtatttaacttaattacctaatctcattagaagtgattaagatgaatactcagcttgtatctcaagatctttttaggtattgattatagcatctataagtccactgactttttggtttctacatgcattgcctggcagtatcagtcagttcacaattcaagttgaaattaaaattttctaacaataaatgagaaacaaaaagtaacatttattttaaaatattatgtcttttaaattttgaatattcagatttgaggattgaatactggcacctctctgtcacttatgttttgctaatgatcatctatgcttcagctcctcaaaatggcctgtcaggtgtcagtttagcatgcgagactttaagctgtcttttgtagtttcataagggccaaagagcttgttagcctggaatttagtgtattttggtactcatttgcttttagttattcttttcttgattttttttcaaactcttctcatgaggaaaatgtacaattcctaccaattagtcataagccagtttggatttaggaattgcatagtttattactttgaaatattattttattcaaatatttagcaaatagtaaagatgtgaatatttcactgaatgttgggtgatttggctgataattagatcctcagagaaaaactgaaactcctgaagtttgttgcagaatctgaaaagtaaccaggaaaacagtagtttaatatgttaagtactagttattaatgaaaattaagcgtgacttttttaggattcaattcctgtttttagtggtatagctttctggtattttgtagcttactgtgttcatgaacacaaaagaacaagtaacctcactagtggcttgagatctgactcgcaggaaaacattaggtagtaattaaaacaaagctttccccccacccccaagtttgtgaaattttaagcacactgcctaatgcagtcaccacttgccgcttgtggctattgagcacttgaaatgtgactagtctgtattcagatgtaaaatacatgctgggattcaaagacttagtatgaaaaaaaggattgtaaaatatctgaatattttatattagttacatgttgccatgataatgtttttgatatattggatttaaaaaagaatattaaaattaatttcacctgtttaactttcttaatgtggctatcaaaaaatttaaaattatatgtgtttcacctcactgatttattggacaatgccagtctaatagatttaaaaattcttaatatgtacagtaaatatcagatattaaaagcttatatgatttggtttttaacctctgaacagtcaattctttggaaatctgagaagcccaattattctttggtctcttcaagggctccaggttgaagcagctgttctttgaaattgccagtcctgattcagttgactaatagcaatcgatagatacggaaggctaagtactgctttgcggttgtgcagccaaatgagtgaactgtacctactgtttctctcctttctgcctcttcccctgatggcttttatgtggttgttagtattcagttgatgtttatggtaacataaatctaaattggttttcagagacccaattcatgttttactatatcccataaattatgtcataaattaccatggctgaccatcttatttacaacccttgagtaataatctatcacttattatattattacatattactgtaatattacattaatattacttattagtaaacaaaaatgagttgttgatgtgcttttgtatgatatcagccaaagcaaaacctacatatggtaggaactggaaagcaagcatttattaataatcagcctctcttttccaggggggtttagctatttacctgtgaaaagcttgtgtactttatttaaaatttttgatgtatgtattgtttgacaaaaacttaaagggtttgggcgcactgagaatagtacagtgaagtcacactgtatgaaaaagagagaggcagttgggtaaatgctgataataatgaaatctgtaaggtcagtctgtgaagataaatgtaatatttgaattagtcatctagtttctctgaaaaggtagtaagttaatcttgttccaaaaaaaaacaacccgagcctggtcgttttgtttttcatgcctttcatcttgggcaatcttttgtatatcatgcaaaggaccatacaattagcatgaaatgagagagcgctttttaaatttgatgaataagggctctttttcttcagctgatatgcatgcaaggtggaggtctatatcccaccagcacacagaccacttggtatctgccctgtaagtagctctcagtttatatctgtgccttaatgaggaaagggttctggaagtaataaaagtaagcttaaaatgcatcagaaatagccataacgctttagtgtaaatacagaaaaattcctagatttgaacagttcggcttcctaccttgcttggattccagagatgcccctgtcattctctttttctagcaatcaattgaagacatattagtaagacttctatgaagacgaaaaactttttttttttggttgtcttctctgtcatttataatgaaaatatgctttgttaacaagttttttttaggtgacatgtgtttagaaaaattttcatgcctctatatttttatgggctgtttgcttttcagaatacttgtctgtgaggttatagtgctaatatgtgtcaatgaacattatttattctttctttaaggttttaatattctgttttattgattaggagtgctcctcccttgatgttttatacagagcacagtacttaagagatgagatcccaatgttgttgggaaagtttttataattagtcatttaagctcacacttttatattgttgtgcttcataatcccctaatatgtagttaataacactccttattacataaaggaagccaaaatgtcacccccaaaaagataaataggtcattaattcagccaacttttttcccttaactatgattgccagatttagcaaataaaattactggatgcccagttaaatttgtgtttcagataaacaataaataattttttagtatgtttgtcttgtgcaatatttgggttatacttagaccaaaaaaagttatctatatttgatctggcaacccccgccataactcagccctcttattaactcaaagaattcccaagtctggcaaatgtgatgtttggccctcctgcactccgtttgcccaatttttttgaagcccaaagtgcctcaggtatgctttctcatttgtccacatgtcttttgggagataggaattgggaattgggcaggctctattcacatcttacctacttttcattttttaaaaaagagaaaatgctttcttttttatttttgaaaaacatattagcgtatatatttctggataattttcacaataatatgtttaaagatggtaataaggatgatttaaagacagatttcaatatgagaaatctaatgcatcccctctccattccctttaggtgaaaaatgcttccttgtaaagtgataatattgattcgtaaagctaagaagacacctacagcaaaaagcttcagcttctccttctcacatctctttatttttggttcatttagtattaaatgcctagcagtataatcccagacaaaaacctttgaaagagtgaattcatagagaacgtgcatttcctgggtgccttataaacaatgttgagggcaagtggataaaaagtgactattccaaacaacaaacattaccatcagctgaatgatttttaaccttcctttcctttccctcccgcacctcccaccttgccctccgctccacagaatcagagaggaaccacttgtaacttgcatgtcctcatcctttgtcatctggattattactaaggcttcccaggtgatattccttcctccagcctcactccattccaagtaccccggctcaccttcagtaactacttatcagataaaatccaagttgattagcatggcatccagcaccctccctgatctgtgttctaattaattcccccttcttttacttcttcctcagtgctcaatgctacagcaataacaaatatttgtcatacataaaacattcatatcatcaggttttgttcatttttccctctgactgcaatgcatatcctctttcatctccatagcaaaatcctatcatcctggaaaatcctgtttaggtatcattccctgtgtgaggctttctctgaccactcttcatcatccttagaatgaattctgctatcctacttgagcttttgtatccacttgtggtaccacatgcttcacagtgttttgtcatggtttatttacatgacaatcaccagtagaagtttggaagatttttgaagataggacactatcatcatcattttgaatctctactatctagtactaacccacaaataacaagcacttgagaaatgtttgagtgcctgagtggatcagctttccacttggtaaaactttaggtaaatttcatcctgttaaactggtcctgtgtattagccgctcacttaccaccatttgtctctctttcacatcaattggtgaatagaaaaatggctcttgatttttcaccaggatagctagtccacctatgctgtttattagttaactgggttttgtttttttgtttttgtagaataaataaagtaggcccatatagaggggtggtcatgggtagcattatgtaacagaggtgtaagtttgcctttggcacactttccattcaggtttgtagctctcctttcagtttttatatccttgacctctaaggctgcctgtcaatatcttagagatgggaatagagtggataggaggtgggcgcaggggggagtgtaatcttcctacaggaaaacttttctattaatatcttgtgttccatcccctcagggcctacccatcactgaagttaattaataagtccattcacaacgagatagtcaattatattgatacgttaaagtgtaactcttctcagatagcatttttatttttacagaaactttaaatccatctgtattagtccattttcatgctgctgataaaaacatacctgagactgggcattttacaaaagaaagaggttttaggacttacagttctgcatggttgggaaggcctcacaatcatggtggaaggcaaggaggagcaagtcacatcttacatggatggcagcaggcaaagagaaagagcttgtgcagggaaattcccatttttaaaaccatcagatctcatgagacttattcactatcatgagaacagcatgggaaagacctgcctcttcccacaacatgtgggaattcaagatgagatttgagtgggaacacagccaaaccatatcaccctatttccaaagaatgaataatattggcatgatatattttataacaaatatgcactttacagtaccaaggaaaaaggtgtttgtgaaaaagctgaggaccttttaatcaccactcaaataggattccctagattgtgcctataacgtgtataattgtccctcagtatataggggattggttccatgacctctgcagatactaaaatctgagggtgctcaagtctcaggtataaaatgggcacagtatatgcatataacttacacacatcctttcctatactataagtcatctttagattacttgtaaaagttaatataatgtaaacgctatataaatagttgttatgatgtagtgtttttaaagttatactttattgttgtattggtttttttctaataattttgatcagtagttggttgaatccatggatattgaacctaaggatacagagggctgactgtatgtacatggatgaatcagaaattgcatttggctgaaagtaattgatattcctgaactggtggccttaacaaaacaggggtttgtttttctttatctagaaatgtctcacgttaggcaattgagggctgataatagtggctccatgatactaacagtttcctcaactttttctctttctgcatcaccacctttaatttttgaagataggacacaatcatcattatttcgattctctagtatctagtactaagtctcacaaatgacaagcacttgagaaatgtttgagtgcctgagtggatcaactgtccacttgataaaactttaggtaaattccatcctgttaaactggtcctgtgcgttagccactcacttcccaccatttgttatttctttcgcctcaattggtgaatagaaaaatggttcttgatttttcacctggatagctggtctacccatgctgtttattagatgtgtgatttttatatatcagattgcctctagattacaagatggtcactgcatcttcaaccatagcaggaggggactagggtaaaacccacccccctttaagtaattttctgaaagccccatataacagctttcatttacatctcattgactatatctatcagcaaggaaggctcagaaatgttagctaggcacattgccaccccatcaccatacttacctgtaattaaagaagaagaagaaacgtccaccaatacacaactactaatcttataacaattcaaattttgcctttatggatcattcaattcaaaataattagaactaaaatttagtttattttcattaatatttagagaacattccataagatgcagttactttaatgaattataaggaattataagactattcagaaaatatttatagtatgccccatttgcatagtgctgtgctcagtgccaaagaagatggattaattctttttcccctgaagtgttttatcagtctcacagtccaggatatatatatatatatatatatatatgtgtgtgtgtgtgtgtgtgtgtgtgtgtgtatcacatgaaaatttaaataatggaatattatagcatatgattttgtgttaatcatgtagtaaaaataaaatcacgtagtgtagactaaattctataggaaaaattccagatacaaagagtaattgctgtggctgcagtggccaacgaaggtctgcaaaaggtagattagtagatttggcaggcaaacgagaatagcagagggcagtcctcctgtattcaacttgtgccacctattattttaggatatttatcgtactatatctctgatatattctttaaaatatttttagtattttaaaatattatttatccacagttttaaaattgactcatgttttaatacatatatttgaagaggaaattttatgccaatatcatatacgtaaagctgattttacttaccaactaaagataacttttgagaaaatacagtgatactaaaaattttaaatgcataatgaactagaagtaatagtaagatataacttctagttcattatttaatagtaaacaaattaagttcttcagtgggcaaaatggaacattttgtgatcagtcagtagtaaagggatatatggcttaatggcatgtggtttaagacaaagatgaagttctacctccaataagacaattctgccttttaatgaaaattactaccagcagcaaaaactccaattcacatgtacatgaagttggaaatatataaatatgtttaacccctcttcttataggttgttcatagaatcagtttttaaccaaaatgttatagatgacttttgtttggcaaacaattattcaagaagccactataagaccattttcaaagtctttttcttcttttgaatatgtcaggttattgggtaatgtttaaaaagttgtggaatgaaagagactctttgtcattcaccactaccatcttgtttgtgaaaatacttatgaaaacctttcatcaatttcaaaatatcttcacagaattcatttgaatttacaacctggccagggtttttggatgtttgatagtcgctggttggttaaaatggatgaatgagatccggcattcagtaataataataaaagctattatttgttgttctactgtggttagagactgtgtggagtacagtgcatgcacatatatcatatagctctccctatttgaggagttgagaaaactgatgctcagaaaggtgaaagtttgacatactcaggtcacatacctaatctgtggcacaaactcaaattctgatttgttgggttcagtccaaacacttaagccaagtcactgaatcaaaattggggaatacagctctgactcatgcttcttctcagagcccctggtcccgagcttcttgcggctatatcaacccatagggaccccatccctgctgacttctgtgtgtacacacgcatgctagtttgtgcaggggctaaggggctgcctgtaaaggctttgatccagaaaaagaaaggggatagctcttgacctgtcttgcacacaaccttgcgtttcatttttccttctcctttttgcctttgaagctctcctgaactccagcttcccagtgctcctcctcctcctcctcaatgcttgtacaaccagtggtactctccccactacttaggaattactgaacagatcagagggaattacgacaagaaaatcgactggcccaggtcttctaggtctttgaatgtcaaattcaaaagtttgaactctattttgtatgtggttaggaggtcattgacaataatattatcttaaattaaggtagataaaaatcagtggttttcctcaaaatgcaaacatggaacactattataagggataacatgtctatataatattgatcatatagtcatgtcactgtctaaggaaatgtaagtgtgttgtaatagctcccaaacattttcttgtcaatgttctttttctagcagttcttaccactggcattaataaggacttggccttgtatagggcgtctagcaatttttcataacaacaaatttggtgataaggataaattatttaggaaatagatctttcctgatgaacattttaaattgttactgaatgagcagcagcaatcacttgcatacctgcactgaacagctagtccagtgctaagagcaataactctctacaagtttggggaacaggtgatttctgtttgactttaattcttgaatttattcattcagcatgtaatttttaagcatctactttgatcatagttttgtgttatccctggcaatgtgggaggtagataataagacacttagtgcaaatcatataaatccctggataaaaagttaaagcccattttccttttcgtaaatataaatggacaaaaaaaggaatgtgctgaaacctgagctagaactatagccacagtgctttaggtctcatataatgaatctggctgaaatagcactttatatttttattttaaagaaacatacgtttcatattctgacatgattttaaatgtaatgaacgagcattttacaaaacaattttgtatactttccttgatggaaaatattatgacacaaaggtatatgttaattttgttgtcaccaaacctagtaaaacattagaaaaagcatgtagtatcagcttctggatctccttggtcacataggattaagaggcaaggcaccctcaagtcatgtgtgactgactcatctctttcctcacatttaattatattcactaggagctgtcagagagtctcctacctgtcctctcctttacctttcctgtgccaggaccagagatcaggcccttatcttccctcattggatttactacagagtcttccgacaaaccttcttccttctgacttttgcctttctggtctattctttacacagcactagagttttctactttaaaaaagaaaagttatattattttcccacctctccctcaaaaatctactatgttatttgttccttaagaggcatttgccagtggacctgcaggtctggccaagcccctgctaggactgtgtctaccttgtacgttgtgctggaatcaacttgccatttcctaaacatgcgttgtaatcacacggctctctgtctgcttgctaaagattgagtgtggaataccttttttgtagcagctgctctggaggttagccctgcccttcatttccagcctagaatgtgactgtttgccctggagcctttccaggttctcccatcagaagttcattctctgcttgaagcacgttcatactatattgattttttacctctattaggtaaaaaattatatgttttggtttctctcttttgtatctttctctttcttttccctttttcgtttcttttctttcttttaacatgcgtgtttttcttctttgctctgggtgcccaaaaactgtgagccaacttcaaagtgtggaaaccacagtcatactgattcttaccttcagcatgttttggttcattttccttgtcccagactttctatttcaatggttttctttattctaatgtcagatattgcctcagaacctttgtaagaagagatacagtagggttttgagtcaatataaataaacacatagactaagttctatgaatctttacttgccgatcttgtatctttcagtactggataagtgaagtgaatgtaaattgaagcctgtttatatcttcccatctttttaagtatctgcatagaaaaatttgttattagtttttatgaataagccaatcacccaaacatttcctcatgtggctacaagaatattttttaattataaaaaatataccagtccttaaaatatgtattttattgataaaaatcaatgcttgtatttctctgattcttaaagaagataatattacaacaaatactaatgatatacttatgcatttataaggaaaattatttgtatgaagttagatattcttggctagtattaattggattctcctgactattaatttgatgtaaatcctcaagagttacagttaaggtgacattagttttactctgttttagcctctaacccatatttttgtgttcagcatgtccttatcttaaaagttgctgtcgccaggatattctaagtatctatatcttacagaaatttattcttgttatatatttttggaagtaccattcattggtgatgcatcatatcaattctctgtactcttaaaaaattatctgaaatacttgatcataaaatcaaactaaggaacaaagaagttctatttgttagctccattctggagcctgtctttctgggtacctttcaatgaaagaagtcaatgaaagaagtcaaagtggcctctaaatcacaggccactttttactcttctgaaattggattacttagttttgtgttgtttttaggctcttttttgttgattacgtgaaccaagctccccattgaacctccctggtgacttgagtcagcgttgagagcccggaactgggagccctgattccctttgtggctttttgacaattacctaactttgctgtatttcttcattgacaccgttgggataattgcctttcatacctcgtgggagtattgtgagattaattaatgtttgtaaagtgttttcaggatcacgatgaaaggtattaatttataagcatgtggtattattataattattattagtaatagggatggttgtttaatgcaaattttcttctaaatgtagtgtcatattttcaaaggacaacttctttctttgtggccagatgtggatacaattaaccctttaccctttattttgaagatacaattagccaattgtgtgtgcaattagatgtgtatgcagtttttgcctgaacaactaattacagccctggtaaaacttcttttgaaaaacgctggccctttgaatgttgactctgtctatctgtgtaataagcaatttgtgctaagcatattttggggccatggaggctcctgaatattgaagaattgcttttgcagttacttgagaaagattttatgttcttcataccatagcattgtattttgccattgagcctacaagtcctctcacatggttctagtttcaaaggttttattggtttttcttaatcttgacattcagtggaaatattttccacagactgcattttgtgaaacaggtttttcttttggaatttttttttcccttgaaaattccatttcctttctgtcttcaattcaaacatgtcatcttatatcctccttactcactaaagaggactgatcctctcttcccagatatggcctggtgaaaccatttttacagggtgcttttaatcactacaatgtaacttctacttatacggaaaagtaggaagaaaaatgaggagacccagaagatagtgttatagccatttgtctccactaatctcctaagtgaaaggggaacgtttttggcttttaatggtgagtttagtaacggcctcttttaagacagctactctttaacagtgctcttcagtgatgatcattgaactctgctttgcataatgtaccatgctaccacgaagggggatccagagatggccaaagtacagttgttaacttctaggattttagaacaaactgttgacataagaaaggtgcttctgtctgcaagctgtagtaagtattctacagagtgcaggtgggattcagtggaggtggtgatcacattgattggaaacatcaggagaagcttcttcgtagttgcatttgagataggacctaatgggtcggtcagcttttcatagacaggggggaacgtttgatggaaatgagggaaagtgtttgtctgagcagaggattggatctactagaacataggttcagaaaagagtgatttgtcttgctagagttgtagttatcttgcaaaggaagggataggagatgagactggaaaggcagcttgggaccacagtgtggagggccctgaaagtttggcaggaaactttttacttaattcagctgacactgtggaggcactgcgtggttttgatggagagtgatagactagagctgggctgtgaaatcgggcaggcctcaccatgccagatgaactgcagtggaacagactacaggagaacagatacactcagcaacgttgtggaaattaagaccagagtcatctctggactgttggcattgggagtgaaaaagagagttactacacacatgaggcatactgtggtgttagtatttcttgatatcggcaactatcctgacatgtgaccaccgagggggattcagagatgggcaaagtacagttgttaacttttaggaatttagaacaagctgtagacataagaaaggtgcttctgtctgcagactgtagtaagtactctacagagtgcaggtggtcaacatgactgggaagaaagaggtaagtaccttcaattaaaataggttgtcaggaagcgggcagatttcagagaataactcttggtaattaccatactatggcacatttacacaaataggcaaagatggcaggataggaaatatagttactggagcctattaacctttacactgtgaaaaacgaattagaaaaactacacatatatgctaaatatacaaaaccatagttctatgtatgtctttaatcatggaatagcagccagaacatggtggttactttttcaggttttatttgaaatacttgaaatgaagatgccagagaggaacagtattctcctatctaatcttacaaaagtctgcttcccatcttattctgtcaagcactggtttccaaggagattccgtgggtaacctatcatgtcatcagtctcaagaatgtggagatctacccaagtatccctaacatttctttctttttcttttcttttttttttttttttttttttttgagacggagtcttgctctgtcacccaggctggagtgcaatggcgtgatctcagctcactgcaaactctgcctctggggtcaagtgattctcctgcctcagcttcctgagtagctgggattacaggcacccaccaccacgcctggataaattttgtattttttattagaggcggggtttcaccatgttggccaggctggtctcgaactcctgatctcaggtgatccacccgcctcagcctcccaaagtgctgagattataggcatgagccaccatgcctggcctatccctaacatttctagataacctgatatgatctgtcatccataaatttcctatcctatttcccaggctttttatatttttagactgcactccaccatgtcattggacactgtctcagtctgctcaggctgctgtaacaaaataccatagactgggtgacttaaacaacagacatttatttttctcatggttctggaggctggtaagtctaagatcaagattctggccaattcggttcctgatgaagaaccccttcatggcttgcagatggccaccttcttgctgtgtcttcacaggcagagaaagaactctctccctcttcttcctataaagccacaaatcccatcatgagggccctacccttatgaatttctcttaccctaattatctccctaaacacctgatcttcaaataccatcacatcggcagttagggcttcaacatatgaattgaacgtatgggtgggggtgtgtagggtagaggaagagatacacaattagtccatagcagacagtgagcttgtaattcagggagatactaccaattatttttcaggacacttacaatcagggcagaaggcgaaggggaagtaaggcatgtcttcccactgtgaagcagaagagagagagaaagcaaaggaagccacacattttaaaaaaatcagatctcttgagaactcactatcacaagaacagcatgggggagactgcccccgtgatctaatcacttctctcaatagatggggtttacagttcgaggtgagatttgggtggaaacacagagccaaaccatatcattgatcctattatgttttattcacttaatctgtcaaagactatgagaagtatattagtcactcatcattgtaattctatcattttctgtctgtatttctgcttttttattgttttgtgtgtatcttgatcttgttatttgaagcaagatttgtgacttaaattccattataggttttatcttttatcaacagcaaaaatgtctttatgtattctaaaagcattttgctgtcacttttatatgacattttcattgtaacttctgctttcttttttttttttttgctttaaaaaaaaatcttgctctgtgattttcattcattcattcactcattgaaacagcacttttttttttttttttttttttttttttttttttttttagctcttagcaatatatagaagtgagcaggacagccgtggtcctttcttgggaagtttattttctagtgtgggaaattgtacaataaataaaataattctaatagtagtaagtgctatgaagaaaacacaatagtatgctaacatgataaacatcatgataaaaggcctttaagtagcagtggagattatttgtcagttaataaagggatttaaaacaattacatttactgaaatagctgatatgtgtatgatcttacatcagttatcttattttaggttttctgaggttttgtttccatttagtttgtagtctatttagtttttagttccatttagttatgagtaatatcttgctttatttgcttgttttcttctcaattggtttggaagatgatgttatttttatttacataagtggatatttttacattcactgaaaacattctctaatctaaattttgcctttttatcaaatcaaacaattatatcttttgctttcttcctgtaacatgagaaatttaatcatccacggtcttgctattttatggtctttattaatatagtcttaaagattccatttaattaattgtattaactgtacttaataggttttcttagctacaataattataccgacttccatatttaacagcttttaatgcttactgtcaatttgtgtacaataatttaacctttctgaatttcttaattttagtggtaaacgtgtttacatattactttataaatgtcttcagtatattcttaagctcttggatatttaaaagtggttttctatggtctttacaaaggaacagtaattttactagctataaaagtcttatgttataatctttggtttgctcaaaatgatcactctatggttttctggccaacctgatttttcttcattagtagggaatatgttttatcttttctgtttcatgctataatttattttttatacctttgaagtttagaaatttactatgtatcaagataggtgtgtctcaaggccaagtgagagttagcaaaaacaggttacagagtcagatctgcaaaggtctcagatattggtatatctcatataacacaaactaaatatgtttactatatttaaataaataaaaggcaaacttaaaatattataatgatcatgagaattaaaaattaagtgtatttgggaaaaaatagaacattagaaattaaaaacagttattcaatgcataggttaaagagtatattagacataagcaaagagagattttataggctagaaaacagatctgaaggattactcagaatgtaacacagagagacatagaaatgcataatagtagcatgaaggatataatgaagaggtgtgtctaacatccatcttaatggagagacaaggtcagggaatggggcagggacaatatatgaaaattaggagctaggaattttccaaaactattaaaaaaaaaaaatctgtcttcagatttagaaagccccccaaacacaaagaagaataaatgaaagaaatccacattagacatataatagtgactcagtataacaccaaagacaaacaaaatgaccttaaaagactgccttaaaggaattaacagaactaaagctgatttgtcagtaacagcactggatccaaaggcagtcaaataatatcttcaaagtggtgagaaaatataactcaatctagaagtccatgttcagcaaaaatttgaagattaagggcaaaataatttttttcagatatataaaacctgagtgaatatgcagcaagagactctctctaaaggaaattctaagtgatgtacgtcaggctgaaggaaaatgatcccagatggaagatgtgacctacaagagggaatgacgaactaagaaagtggtttatatgagaataaatctaaactaaaattgattggtgaaacaataatgtaatggcttatagccaacaactccgtagagaagtgattagagtgaaagcattctaaagtccttgctttatgtaggaagttggttaaaacaaaaacaaaagccactgactaagtatgcatgttaacatttctagggtattcactaaagaaaagaaatagtataactctaaactagtggagatttaaaaaggaacaaaaaaagttagtcaacccaaaagcagttaaaaaaagaagagaaaaagaaagggagacgaagcataacaagatgatagaacaaatgtgaatatatcagttactatactatatgtaaattaaattttcctgttaaaaagcacagtttattagattaaattcaaaagatagactagctttaaaaatctaaatacagtactgtggtttacgtgaaaaccctacataagggtacgtaaaggttttgagaaatagggtgacataactacaaatataggtggaatgaactttaaggcaaaaggtgttaccagagatagagggtcacaagataatggtaaaagattcatttcaccaggaaaatatgacacttctaatgttgtatgcccccaataacagactaaaattatataaagtaaaaaatggacagaaacacaaggataaaaagaaaaaatgtcatcagaattggaggttggaatctacttcttttagtaattgatttattgaataaaccagggatcagcaaacattttctgaaagagaggccagataaatattttaggccttgcagggcgcatatagtctgttttgtgtattcctctttgcaccatacttagctcattgggccatacaacaacaggctaaacagattgagtccacagggtatagtttgttgacctctgaaatagagagtaaaaattagtgagggaatacatgatttgagcaacagagttaataaggttgatattgaccatacacgtatggaagagacattcttctcaaggatgcatggaagatttatgaaaataagaagcatacaggaccatagagcaaatatcaataaatggtaaaagattattatcttacaatcaacattatccagtcaactaatacaattagtaaaaccacttttagcaataatctggcatttcttcattaaatacgtgattctttcatgatccagcaagttcattcctggtcatatgctctggatgaactcttgtacactgatagacatacaagaatgatcacagtgctattcatggtagaagaagctagaaacaacacaaatatccatcatccacagaatgaataaataaataatgtttattcacaaatgaaatactcttaaggatatgaaaatagatttaaaactgcttcacatagcagtatggatgaatcttaacatagttttaagagaataaagcaaaccacagaagaataaatacaattatgaaattcaaaacatgcaaagctatccgatatattatttagagagaaatatatagatatattgatctatatatttgtcatgtagctataaagaagagcaaaacaagaataaacgcaaaattcagattagcatttactttctagcaggggaggaaaaggaatagatgggagtgagagcagactccagagttcctggtaatgttctgttccttaaattgggtggtgaaacacagctgattgttgtattttattctttatgccttacacatattatagtatctcgtcattgtttaataaatgaaataaattacacagtggggatggagtaaggaagtatggaaacagcaagggtgggcactttttttgttttttgagactgggtcttgctctgtcatcacccgttctggaaggcaggtgcataatcatggctcactgctgcctcaatctcctgggctctgccagtcctcctgcctcagcctcccccaagctgggaccacagacacatgccatcatgccaggctaatttaaaaaaaaattatttgtacacatagggtccccctatgttgcccagacggatcttgaactccggggctcaagcccttctcttgcctcggccaccaaacccggccagatgaacacttttttttgagcctttttactcttgctgtacacgagagcagagcaatagaacagtaggttggagggagacaggagtaaaagggtttctttgtaaataggacttacaatagcatgttcgaatgctaataggaatgatccgggagagagggggaaaagtcataataaggaagaagagaaggtagtttcaagaacaaagttcttaagaagcaatgcaatctacaaatgagtggtttggccttagggtcaagttgacaagtttaatggggattggggaagaatatatgttacagttgcatgtaggttggtaggtttgtttgtgggaagatgaagatcacatctagagatttatgaccataaatttaaaatgaaactagtcatcatgattctgtgctttcctccaactcatatccagctgctcaagtgcctgcaggtttgcagttggcagaaaattgggcttaactgaggttgaggttttgctagctgaaaacatggtcggaacaaacaggcaatggaattggggtgtatacaatgatgaaacagagaattcaagctggatgaagaaagaatagacatgatggtgacctagacagtgcaaaaatggaccccccattttggggggcagggcaggtcacaaaattggcagagtgtagcttccagagtatgtgaggcagattgttaggtaaatagggttctggggttagtgtagttgttagtgtcagggtctaagatgatcatgggaatacccagctcggttgaaagaaaaggattttggaggacatggaactgagaggatgaagtgttggatgggttgtatatgctcgtggtcttcaaccccgactgcacatcagaataatctgagggactttcatagaatattgatgccccggccccaccccagaccaattaaatcaggatctctgggtgtggtttctcgggaatttatattttaaaagagctccctgagtgattgtagcgtgcatttaggttcacgtagctacgtgaatgttggcattgccaagccaataaaagaagcagtagagagaactgttgtagactgggggactatgggaggaaggaggattgattcagaggatccccgactacttgaacagcacttagcacaatttattgtatatagtgtgcactcaattaatggtagctctttttatttttgttattattgtcatcatcattattattgacagtggcaatagcagcagcattatcctggggaaagtctccagatgttttatcaaaggttcttcacagaaggttaaaaagcactagttttagatgatcatcaaggaaagttcctaataaagtttggcaaaaaagctagaagttagcaatattctgaattgacgttctacagttgttgtgaagcttggaggagttgtactccatcatagcctggcttagcagtctgcacttgtcagaagccagcaggttaggagttgggtaccttcttttcttatgtcaaaaacctaaaggctaagacagctggttgctattttcctgccaataggaaccttagagccttttagttgtgtttcagtgtacctgtgccagggttgggattgggaagaggagacagggattaaacatataacattctaatattttattttacattcccaaattacttcgtgtgcatgtatacactcttactcccttctctgcaaaaggagtattatgagtcgggtaaacagtactatttaaagctaatgtgtacttgtgggtactttagtgactcccgaagatgtggttccactgaagaatgcaaggaattatagctacgaactgtcaatataacaagtgatcttttttttttttttttttgaggccaggtgttgctctgtcgccaaggctggagtgcaatggcacgatcatggctcagatttcaggctcaagcgatcctcccacctcagcctcccaagtacactgggaccacaggcacacacctccacactcggctaatttttgtattttttgtagagttgggttctccttatgttgctcaggcaggtcttcaactcctgggctcaagtgatcctcccaccttggcctcccaaagtgctaggattacaggtgtgaaccaccacacctggctcacaaattatcacatttttgtacaattgcatacgaaaatatattttaatatacattcactggatcactgggaaagctggcatgcaagcagcttagaaaagacaatatcaaagaaagaattcgaaaatatccccatttggaacattccagaatagttccgctctaatttgaagagtaatgagatacatctctctctttatatccaaccagattttagcttgctataaagagacatacctcctatattttgtttccaattgtctttgcactccataataattcatgtcagcttgcattataaatgaataaaagatctaatttaaaaacctatcatctgatatgggatgccatacacttttctccatggccctgtatgaaacaaaaataatgatgacaacattggacaatgacaccaggcagtaaacaatgtaatttctgtacagtgtctctgtcgggtatgttaggtaagcaataacagcaaactaaagtttatgttttataaaccaatcatttttgatactttcagcaacatctttgtcctcatttcaagcttgaaattcccaactgttcatttattattacgtgacactgagtggcttagttctgtgagccccagttctttctctgtaaaatgaggataactctgccttctgcgcagggatgatattattaaaagcaaatgattgtggaaatgctttgcaaattagaaatttctacacataatggtttttatcatcgtttattttttgttgttgtatttctaatccaaaacgtggaccttattttgataagcacaaccgagacctagacagctttaaaacctgatttggcattaccaatatgacacaaggtcttaagatgtcttatttccaacttgtgattgtgatctgtcaaattttagaatgacttattaaggtctaaaagagaaatattactgtattttctgataacctgtgggcagttccctgatggtattgagtaaaatgtggcaaggcaaattaagttacctttttttaaaaaaaaaaaaaactaatatgggtatttcactaagaaagcttattatctgaagaaagctattattaaaataaagagtacatcccttactcaatatgtattcttcagaatattggtcactggtgatccatccttgtttcttttagcctatcctgagaaaattctttttcaccccattcaataaatatttaagcacctgtgatatgccagccatggtactcagggaggaagacagaatacagttattgttaaaaaggtagacagtgtccatgccctcccagacctctcagtctataggggacaaaggtagttacaaaacccagtagggtctgtcctgtgactgtgaagggggacgctgtgggccaagtggatactcttgccatttcttaaataatatggttctttttgagatggttcatccagtactcttagcccttcaaagagagatttttctggacatacaaatttaagaatctagttagtgagtggattttgcagaaaataagtaaagtctctctgccactttaagaaagaaaagcagaagatgccattttaagttcactgctttttaaagttgagcatttgactgcaaagtttgtgaaaggtcaattgctttagcatgtaggtgtccctatcagggcccatgtttgtctattctgagattcactgcgaagttgaacctctttcttggctgaatcagttgctcattgggtggttctagaactaaaatgattgctaaagactggtagattctcctgtgaagaatagtaaacctgttttaaagtgaaagattgttagaacttagagtactgttcttccgattgcttagagagctttgtgtacctccctgtttatttgaactagtctttgagtggattggcaatgaagaataatattcgtattctaacacgcacataatatatgaaaggagatgaagtatactacctatagttgtcttatttattattacctaacattttattgtgctgtttatttggatagagttcaaacttgttcgtgaatatggacctagtaggctggaaataaacttaagacccagtaaaaaagagttgtaacaaaagagttgctatgttttctgcagtgaggattccttatcactttgtgattcttagataaaatcctttccatccaggaaaaattatacttccagaatttaccaaactgacagaacaactaacatgccccaggccaagtaatgtcagttctgtaatcccctaaagccattccttcccataattgcaaaaactaacagggaacccccacaccctggcccctgcacccttgcctgccatgctatatgtttaaaattgacatttgcttgcaagagtaaactgagtgagatactaattcttggtttatgacaaagtgttcctttctggcttgccagtgggaatgaaggaatgcttttgcgtaatgcctgaatacttatcctaaattcatagccgccttctacctgactaaataaaaatgtatgccaaaattattttgaggaccactctggtcgcctcttctttctcttaacaagaggctggcacagcatttcccacataccctgtatgccgtcacttgcagatgtgattattgcagaaccttaatctgaatctcagagtggaaactggttgacatgagggcacaaattctgacacagtccagaattttttttttctttttgctttcaacagcctctttgccgcagacttaccatttctcctttcaaggtggagctaaatgtttaaatactatcacataggtcctggttgttttaaagtgtcctacctagttatgcctctgctattaacttttattttgtattgttagtaggtcctcttaaaggagcccaggtgcattttatagcagtgactggcgttggtagtatcttccccaacatcactgtgttggaattggcattcattgatgttaagatcaaaatgacagctcttcttttgtatgacttcacctaacacatgattatctggattcatttttcttatcttttttccattttagttcaaagttagactgtaagaaataaagttagactctaagaacacaaggctgattcattaagtaagtacattttttcttaggcatctaccatccacaggtttctcatccctaccctccagtgccatgtaagatgctagtgatccatctaatatgttaaacacattcacataaaatattagggaccccttaatttactgtttacagcctttatgcttctaaaaagatttttagtttgcattaagaacttatctttttacaatttatactttaaaacagtagaaaagacatagataatttctgtttagtacaaaagaatccccacccaaggtaaatcttttttacgtaaaaaaatttacataaattattacataatagacttctagggctgcactgtccaatatggtagccacagtcacatgtggctattgaacatttgtaatgtgggtagtctgaattgaaacttgctgtaagtgtaaaatatgaactggatttcaaagtcttagtgtcataaaatgaatttaaaattttcattaataattttttataccaattatgttttggactgacgttttagatatattgggttaaataaaatatattattaaaattaattttagctatttccttttccttttttactgtggctactgggaaattttaaattacatatgtagttcttattaatttctatttaacaagctgctctatagggatcaagatcttctcttctaaccctgtcattttagacttcaggaaacctcatagaatttagagaatttaagtgacttgctttaggtcacatagcattttagtatagtagtaaagcttgagactagaaatttcttttaaatgttaagactagtgcccttctcagtgaaactagctttttgtgactctgacacttttattataagaggaaatgtctattcttcagaatttttcactgaactctttaaagcaaagagtctctctatactgtaggtaaatgttcctttttgtttgtttcataaatttgaaatatcagttattagctattcttaaaatggcgatggttttccctatgaaaaccttacatacagaaccgttatggcagcagaaatattttttaaatagatctagttaataccgtagtagagttttcaaatttccttgcacacttgtaatacaaatatgtcataaattacaaatttttattgggtatcttccaataacagctatcatgttagcatataactgggaaatgatgccagtaagaataaggcctccaggctatgtatttccttggtaaattgttaatactaggcaactatttattttctcttgctaagctttaacactctctttgctagtattgtgagaacagtctatctttgagtgagagatttactcaatcatagtaaagtaatccagaattcagttcttaagaacagtgtcgagtagtgctgcgtgatgtatgaactgtgaccttgggccatttatttaatgtgtctgtgtctcaccttcctatctgtaaattggggttaatactatttatctgtaaggtagttgtgcagatttcaatgacacgtgtaaagaatatatagcatgatattccataatatctcatagtgtccattttatctcaaagaaaaggtaaagatcaagtatttattcttttctttaaaatatctttagtcttctcctgttccctagaaatcctctaccactgaactaacagtttttggtcaaatctggtcatagtgacatcttattttccatagatacgtaaaaatttgtaattattacctgcaagagatattacaattcatacaacactaatagctggagatactttcattacaaatacaatgttcataaaatatcacatgtataaaataaatgtaaacagatgatactatcttaaaaagctcagctgagtagtaatattttttaattggattttcaaaatcatggtaaaattttgatatgttttgatggctattccaaatactgctattataacattgaattggattttaaaacttgatgtgtactgagagttagattgtcgaaaccaatacttttcaataataactcttccagaatttcaaatattttaacatggaagtatggaaattgagtcacataagtttacttaaaagacttttcattctattttaaaaatatatttgatccaccgcatattctcactcataggtgggaattgaacaatgagatcacatggacacaggaaggggaatatcacactctggggactgtggtggggtcgggggagggggtagggatagcattgggagatatacctaatgctagatgacacattagtgggtgcagcgcaccagcatggcacatgtatacatatgtaactaacctgcacaatatgcacatgtaccctaaaacttagagtataataaaaaaaaaaaaaaaaaaaagacagcaatgcaaaaaaaaaaaaaaaaaatatatatatatatatatatatatatatatatatatatatatatatatatttgatcataataattgttttaaagtgatacagcttagggtgaccaatgaacatggtttgcctgggactgtccagttttagcattgaaagttctgcattccaggaagccgtttagttctgagcaaaccaagatggttttcactctagctgatgcttcacagtttacatagctttgtgtatatatatatatattctcactggatctctgtgagataggaatgacagtattgtcatcaccatttcattagagaggccacatgctcagttaccctggctacctgaattagcttcaggtcccattctttatgacattgtctcctttcctccagatttcagttgaaacctcccctccccagtgagcgtttctctgaatgtgcagtcaaaatgagttgtctttttccctcttcatccctactgcccatcccatctcatttcattgcatgttactcccccttataacacttcccacagttggtttcctagtgttttgcccaagttccacactggactgtaattctcaccaaggcagcatcatgactcttcccgactctggtgccgggcacattatagggactcaaatctaaatgaagccttgctatgttgcccaggctggttttgaactcctggctcaaagcaattcttctgcctcagcctgtcaaaatgctgggattacaggcatgaggcacccaggatgcacattttttaactgcaaaaaccgaaaccattatctatacccatttggccaaatttctcaaagccacttggttttttctacatgtagctacaaaattcttaagatatttttagttgacagtcatcttttgatgtatcgaaccaatatgaattaagccaatgaggaatttttaaacttattaaataaagaagtgaattgttgaaagatacctgtagaagctcctttgaactaatgatgtattacctggcatagtattttgaaaaatgataatttttaaccattgttaacattattaatcaactacagtataacctgtttcaatttactagtctctgtttcatttttccctcaaataactgattttaacagactctgttgtactactaaatgtttcaagatatatattatggccaatctgtgttttagtttgccatctcaaaataaaatgacacatgattaatgttttcagaaagaaaacacattttagcaatttttgatacattgctgtgaaattggtaattgggctgaagttacacgagtgttggttggtttcctgcaggaagtcttcactttctatatcaacagttgatctggtgtctaaagtgttcacagtttggttaaaattatactcgataccaaagatagtacttccaccaaggagggtagagtcaaataacacttatggtgttctcaaaaatgacaatagaggatatgccaaatcaagcttactattattgaaatgtttgcttgaaaaagttatttttctgagcattgttaaaggaagggaaagggagagatttatgaaatcttgcctggaaggtgacacaggggtttgaaagccagtaaataattataaaaattataattattattcagtcatcaaacttaaaggaaaagacaaccagaaagtcaagtctgcttttaggattattaggtcaattatcagtatttttgaaggaaagaattttttaagctatccatatgctggcaattttttcatattttactgccaactttatttaaactactttctcaatttgcaaggataacaatacaatttctcttgttctttgaaaaactctatatgccacattcttaaagtattattgttctacctgttatgtaagttatggttcgattttatattacgtgcacttcttggaatgaaatatttcccttatgttgaaatttgggataatgctgagtatgatggacttgatggacatgttcaaatttcattgtagagagtgaggtaatagtgactaacatttattgattacttactgcattctgcattctgtattgaggatctttgccaacattatctcattcaatcctcacatcttacaaatagattcacttattcccattttgactgcccatcccatttcttttcattgcgtgctgctcctccttataacacttcccacagttgcttttcttgtgtttgagaataaaaagtgactgaggtacagaaacataaggtagcttttctaaggtcacacaaatggggagctgttaactactatatttatgttgtgtcctgcagttcaacacagttcactataaaagtagttgtagggttatgcacatagaagtttacccagtgtaaagctaaggagtgtggccaagagcaagacaggtactgtggtctagtgaattctgggaggtcttctgaaggaaggatagaggatgaaaccactctatgacccaaccctgcgatggtcattcaacagtatttattgagtgtctactgtataccaggtattctctcatatactgcacatacaacagagtggacagggaccctgcctcatggagtttaccatttagtaggagattcagaccaaaaactaaactaaaataaaaataggcaaacaaataaaattacatcagaccatggtaagtacagcaaatgaaataatctgtggattgaaacagcagtgtagagaatggggtgaatggggtcacatactttaagatggagtggacagagcaggcctctctgagtggttttaagctgagacttttaagagttaggaggatatgctcagtgggaagcaaggagttttagatagaactgtggagcaaaggcaaattaaaatatgatgccttttcacattcagattggcaaagattaaaaagtctgaaaacacccatttttgatgatgttgtagggaaaaggaaaaccttcatgcccagtataagtctgtacaactactctagagaccaatttggcaatagctagtaattgtgaagatacaattttgtatataaatcctagagcaattattcttaaaagaagttttaaaaactatctatccccatgacatttttaagctatcataaaacttttcctttataactttaatagttacaaagataagaattttttacaaattacaaatattgatatttaaatatgaaactcttacatcattctttcaaacatatttaataatatatccaatggaattgagatcccacagcaatttgatacattacatcatccatttaaaaaatacatgaacaagctaagctctttctcaattcagaaattttgcatcgttcctttttctccttgaactcagatttccatctacttccccccaaagaattgtatcttttatcttgaatgtcttttattgatcacaatatcatatttcttggcaacaaagaaaactgatataagttaatttaaaatatatgtatatttaccatgaccataaggccaagtgttataaaatttcttctgacttattattttaattatttctggtatataatcagtcaaaacaatataagtaattccatgttttgacaattattaaacatgaaggtaattttttaagaaacatatatcttaatgtgatggaagagcttgatatttttcaattaattcatatatctgaggacaattattactagaataatgctaacgataaaatgaagtgaaggatttgggggtcttacaaaggtgtattagtgatttttaagcaccttataagtagaatatacatttcttttaagttcatctaaatattatagatgggttgcaataaattttaaaatgaatgtggatttatgatatccaaaaatatttggggaaaaaatgaaatacttcttttatgagtctaattaagtgttcaaagatatataaaacctaacttatgaccagtatatatatttttacttgaacatgtagctttgatatgttggaagtaaaagtgaaattttcacaactaatctattctgtctcttatagatttacctattctgactggttcatacaaatggaataatataatatgtggtcttttgtgactggcttctttcagttagtgtaacgttttcaagggtcatccttgttgaagcagtactccattccttctcattccttttattgttgtataatattccattgcgtggctataccacattttgtttatctattcatcagtctatgaatatttgagttgttttcaccttttgactattgtaaataatactattctgaacatttatgtacaagtatttgtttgaatgcctgttttcaatttttttgatacatacctaggagtagaattactgggtcttatgtaactctgtttaaccttttgagaagctgccagaacattttctgaagtagctgcaccatttgcactcccaccagaagtgtgggagtgttccagtttctccacatcctgaccagaagttgttattatctgacttcttgattataaccatcctgctgggtgagaactggtatttcattgtggttttgatttgcatttccttggtgactagtaatatgcttattgggcttttgtatatctgctttggagaaatgtctactcatatccttcgcttattctttttaattcattgtcttttgagttgttgaggtttctaaaaaatatattctagatgcaagtcctttatcaaatatatactttttaaatatttcctctcattctgtgggttgccattttactttttgataatgtcctttgaagcatagaagtttatatttttgatgaggtcttatctattttttcttttgttgctcatgcttgtggtgtcatatgtatgaatccatttcaaaatgtgaggccctgaagatttacccttatgttttcttctaagagttttatatgttagcttttataggcttttgatcaactttgagttaatttttgtatatggtttgagataagggtccagtttcattattttgctgtgactatccagttgtcccagcaatatttgttaaaaagactattctttccacattgaatggtcttggcacccttatcaaaaatcagctgaccgcagatacgtggctttatttctggatgtttggaaaaactcaaactgtttttcctctactctcacatcaacataacagcagccaacacagaagatttctgtgacctcaaaatatgtggggatatcactctaccagcaagcaggcaattagttctgtagaagacacctgctgggtgtcctccagttcaattttacttcatctttttcgagatagtgtcagatcccacagattgtgggctcaatccccaagattgccccacacctcagacaacagtcacaagtccaggcccctggatcttctgacagaccagctttaagttggggttcccacaaccctctctttgggtttgactactttactagagtggctcacagaactcagggaaacatgtttactgattattacaaaggatattttaaaggatacaaataagcagccagatgaagagatacacggggtaaggtctggaagggtcatgagcacaggaactctgttcctgtggagctggcacgtgctaaccttccaacacgtaaatgagttccttcctgtcagcctccacatattcagctctgtagaagccccccgaaccctgtcctcctaggcttttatgcagacatccttggatagacaattgacaactatgtagaaatgtgactggacaaaatggatatgatctaatattaataaactgagtggggaaacccagcaagacctgtttgttcacattcttctcgcctctctgtgcagcatttctttcttcaggatatgaggcaggaccctctctggaatgagggtcgtatagcccaacattcagagtagagtcctgccttgggccatgaaaagagggcaggagaaggtcagaaagagagagtttttttctgaggcctaaagcaccccgacattatataacaaatgctgtgggagttatgagccagaaactgtggacgaaaaccagtatatatgtatatcataatatcacacaggacatttaatcgatttcattgatctatatctctctgcttatgtcaataccacagtctcatgactaatattgcctaaaattttgaaatcagagagtgagtcctccaactttgttcgttttcaagattgttttggcaattctggattcctggcaattccatatggattttaggatccacttttttacaatgaaatcagttgggattctgataaggattgcattgattttgtagcgcaatttgaagagtattgccatcttaacaatactgtcttctgatacatgagcgtgggattttttttttccatttatttaggtcttaatttttttctattatcctttgtagttttcagggtatgagttttgtacttctttcattaaatttattcctaatcatgttattatttttgatagtattgtaaatgaaattatcttaatttcatatttggattgttcattccaagtatatagaaatacaactgatttttgtatattgatcttgtactctgcaacctgctgaacttatttgttccaatagtattttaatgaattccttaggattttctacatagaaaatcatatcatctgtacatagagatagttttccttcttccttcctaatttagataactattattattgtcatcgagatcttgcttaattgccctgactagaacctctggtacaatgttgaatagaagtagcaagaatggataccttgtcttgttcctggtcttaggggaaaagcatctagtctttcaccattaataatgttgtcagctttggttttctatagacacactttatcaggttgctgaagagcccttctattctttctttgttgggtgtattagtccgttctcacgttgccataaggaaatacctgagattggacaatttataaagaaaagaggtttagccaggtgccatggctcacacctgtaatcccagcactttgggaggccaaggcaagcagatcccctgaggctggaagtttgagatcagcctgaccaacatggagaaaccctgtctctactaaaaatacagaattagctgggtgtggtggtgcatgcctgtaatcccagctactcaggaggctgagtcaggagaattgctttaacccgggaggcagaggttgtggtgagccaagatggcaccattgcactccagcctgggcaacaagagcaaagctccatctcaaaaaaaaaaaaaaaaaaaaaaaagataagagatttaattgactcacagttccacgtagctgaggaggcctcagaaaacttacaatcatggcagaagatacctctttatgaggcagcagaagagagaatgagtaccagcaagggaaatgccggacgcatataaaaccatcagatcttgtgagaactcactatcacgttaacaacatgggggaaaccacccccatgattcaattacctcccactgtgtccttcccacaacacttggatgttatgggggttacaattcaagatgagatttgggtggggacacagagccaaaccataccatcccacccctggccgctcccagatctcatgtcctcacatttcaaaacacaatcatatcctcccaacagtccccaaaagtcttaacccagcattattccagcattaacccaaaaatccaagtccaaagtctaatctaaagcaaggcaaatcccttctgcctatgagcctgtaaaatcaaagcaggttagttgcttcctagatacaatgggggtacaggcattgggtagatatacttgtcccacatgggagaaatgggccaaaacaaaggggctacaggccccatgcaagtttgaaatccagtaaggcagtcattaaaccttagagttccaaaatactctgctttgactccatgtctcatatccaggttatgctgatgcaaaaggtgggctcctgaggccttgggcagttctgcctctgtggctttgcagggtacagcccctcccagctgctttcaaggctggcattgagtgtctgcagcttttccaggtgcatggtgcaagctgtcagtgaatctaccattttggggtctggaggatcgtggttctcttctcacaactccactagacagtgccccagtgtggactctgcatgagggctccaaccccacatttcccttctgcactgccctagcagaggttctccatgagggctccacccctgcagcaaacttctgtctggacatccaggagtttccatacatcctttgaaatctaggcaaaggttcccagacattaattcttgtcttctgcatgccccaagaccaacaccacctggaagctgccaaggcttggggcttgcaccctctgaaggaacggcctgagttgtaccttggccccttttagccatagtcggagtggctaggatacagggcaccaaatcccaaggctgcacacagcagggggggccctagacccagcccaggaaaccgtcttttcctcctaggcctccaggcctgtggtgggaggagctggtgcgaagctctctgacatgccctgaagacattttcctcattgttgggtatttgcatttggcttctcattacttatgcaagtttctgcagagggtttgaatttttctccagaaaatgggtttttattttctactgtatcatctggatgcatatttttcaaactttatgctctgccacctcttgaatgctttgctgcttagaaatatcttccgccagataccctacatcgtctctcaagttcgaagttccacagatctctagggcaaggacaaaatgctgccagtctctttgctaaagcatagcaggaatgacctttactccagttcccatcaagtttcttatctccacctgagaccactcaccctggacttcattgtccatatcaccatcagcattttggtcaaagccattcaacaagtctctaggaagttccagactttactacgtcttctagtcttcttctgagtcctccaaactgttccaacctctgcccattacccaattccaaagttgcttccacattatcaggtatcttaagctatgccccactacttcaataccaatttattgtattagtttgttctcacattgttataaggaaatacccgagactgcgtaattaataaagaaaagaggtttaattgactcacagatctgcatggctgggagggcctcaggaaacttacagtcatggtagaaggcacctcctcacaaggcagcaagagagagaatgagtgccagcaggggaaatgccagatgcttataaaaccctcagatcttgtgagaacttactcactatcacaagaacagcatggggaaaaccaccccaatgattcaattacctcccaccaggtccctcccgcaacatatggggattgtggagattacaattcaagatgagattttggatggcgacaccgccaaaccgtatcattgggtgtgttttttttctttttatgaaagggtattggatatttttcatatgtttttttctgagcctattgagttgaccgtatgagatggtcatgtggttttaattttttattctattgatgtgatatattacattaattgagcttccctaaactcaagtaagccatactaggggacaatacaaagctcatgctacagaaaagcatatactttacatatattgaccatacaggtctcttttcaaaaacaaattaacttttgggtataaaaggaaaactgaaggaatagcatcagttgggcacatttttgtgcaagtcagaatagtttttatgtttccttctcactgatcgtctactcagaatttaaaaaatttttcaacttgtgatttgctttactttttatagttgatgatcccaggtattttcaataatttttcaagcaaccaccataaaattgtattttggactatatcacattattcggtttttgtttaggttttagttcaaagcaattaaataaataggaagtaaaatatacacacgggtcttttaaaaaatcaactgtactctttgagcatgaaagcaccactcttttttgcactattttgggcataaatgctgatgatgtacttccccttttcttccacagttaagggtccacccgggagtttacaactatattcagtcccggaaatgttctcattctcttttctagcctctgatataatctcttagcataattggttcaggaatcatgttaagtgggcccagatcatgtgtttcagcctgttaaaggcaaggtatattttcatttcctgagaacagattgcagcctaggtcccaaccatctggcactttcttgccattgcttgccaagtgctatgggctagagaatgtgggcagttgaatgcagtcagtccctgttactggacaactgaccacagaggacttgtctcaggaagagtcgtcctcatgaacacaggacactctgttgtgactttgagttcttaaatttcactggaatacatttaggtaaggtaaacagttatttttaaaatgtattattcagggatcacaacagtgcttttagggattaaaatagtccaaacagcctgtaatttcagggtgtctaagatccacatagaattagcatatcgagctggatataaaaatgacacataatacaacagccaacaatgtttttccccctccaaaaaaatggtgtcctccagattccatctgctttgtttgtttgttttgggagaaaacataagtatgatcattagaaaagaatctataaccctttctgaaagagaagataatctttggtctctagaaacaatagctttgcattttaaaaggcatgaagtgaaatgtccttatactctgttggatttgggaagcagcatgaaatagtggttaagcttatgactccagagttagacggtgtgacttctctgtacttcagtattccccatctgttaagtggagattaaaatagtacctacctcataaaggaaaaattaaattagactcaggtagagagcttaaaacagtgactggcaagtaagtgctcattcagtgtgaactgataacggtggtagtagaaataggcacactatcggaagcttaagaccgatttgatgtaaagttaatgaaacgaaaatcagtaacagctaatataatttatttattagtatgtatcagggctcgtattttaaaccaccttatttttaccctcaggagtgaaccataaattatttagtttcttcagagaattctgattatcaactcacctgcaaagagggcagaggagggaaaaacaaaagctctgttgggctgtaagcatagtttctatacacttaaaaacactttgggaaattatagctgttcacttttaggtcactttggcagttgaaaccatagcaatgatttctagaaggctaaaggaaaatctggtactgggttttaaaagttgactacctagaaactttggtgaaatacgtaatcatctgggtcctagagagctgtgtgatgttgcttcttcctctcagtcattccaggcttttctcttccctagttcggccatcagaaaaaccagcctgacccatggaaaagtcacatggtggccaggaaggaagtgtgtgaggttcttccctataacatccggttttccatttctgacagttagcagacggattatgctcacactttcacttcttgtaaccagtcatttccacctctagctaatggctttctttcatacatgtacatctttcttaatgcccttctctttccagattttgccactaatctcaggaaaattttactttatcaccttgctgtttatgggagtaaaacaaaaaattttaaagaacacaactcatgtatttcctagagatatttctaatgaaaataccccccagcaaactgaggccagcaatcttgaaagtgttcctaagttcctttgccagagttcagctcctccaaactaaattgccttttcaagcactagcattcaggataaattttaatttaatctaatttattgttttcctgatttcaaggcatatattataataatttttctacatctgtgtgttagaagcatataggatttttgtctctattgtgaactcattagcctaagaaaatacattctgacttcttaataattataaagattatttttaggccgtgcttatgagaagattggcacttatctgtatttttcttatttgactcctaagtgtttatgtttcttaccataatcaagaacagtgtgaagttaggtattcttccattatatgagtccttcacataacctttggaatatctttctgaattacgagtatcttttcagtaattactttctttctattgttaccatttatattgatttaagtactatttccttaagaatttttactattgcagatttgtggtctaagtctacttggaagcatggcatttgagagctggatcatctggttcaattatctcatgtttcagaggagtaaattgaaacccagaaaggttaaatgattcgcttaaggtcacacggtttaggtagaggcaggggtcattgagacttgagaccagtgctctttctactaagtcttgcagattaattttcaacttgacgtacaagtaacagaatatattctgataattacctttttcccaaaaatgctaggaatcctggaaaaagatgaccttaagaattgattatccattaatcaacttttctgttgttgatctgaaagcattttttcactagactgtattttcctttaagaaattccaggttgcttatgtaaagtttgttactttgttgaagcattataatttttgaaatttattaagctatgtgaactttaaattttcctcttatgatttttagacaccattgtggcttctcatttttaatcacttcttggtattatttactctattttattgggtagactttctccaagagcgggtaaggacatcttgtacccttataataaccacagaaaagtattgtagtgtagagttccagtgtgtgtgaaaggtcttagggattatggagctgtttcaaacaagattgaaatagtgtcaattatattcagattttaatttataaaatattaaattgaacagatttactttaattatgatttttaaagacaagcaaagagtgtattataaaaatgtacaaatttatcttacccaaataagtttataattcaaaataagcaggaaccatggtttgtgtttctctcacttcgggcccttgctaattgtcttccatctacttaaatattctgtattcctatattcatcaaatcctaatgaatctgttagacttgtttctcaacttttccaccttttacttaaaaatattgtcctggccgagcgtggtggcttatgcttgtaatctcagcactttgggaggccgaggcaggtggatcacggggtcaggagatagagaccatcctggctaacactgtgaaaccctgtgtctactaaaaatacaaaaaaaaaaaaaaaaaaaaaattagcaggcatggtggcgggcacctgtagtcccagttactcgggaggctgaggcaggagaatggcgcgaacccaggaggcggagcttgcagtgagccaagattgcaccactgcactccagcctgggcgacaaagcgagactccatctcaaaaaaaaaaaaaataacaaaaaaaataataataataataattgtcctacattagacaaaagatggaaacaaccaaatgtccattagtagataaatgaataaacaaaatgtggcatatacatacaatgaaatcttattcagccttaaaaaggaatgaaattctgatatatgctacaacatatatggaccttgaaaacattttattaagtaaaatgaccagacacaaaaggatatacattgtatggttccatttatataaggtgcctataataggcaaatatatagagacaaaaagtgtttacaaaaagcttacccagggcttggggagaggagggatggggagttgtttaatgggtatagagtttctgtttaggattctagagatggagagtagtgatggttgcacaacactgtgaatttacttaggccactgaattgtacacttaaaaatggttaagatggtaaattttatttttgtatattttaccacaataacaaactactgtcctgagttagccatgaaatgaaataatagctctgagtgtgcaccaagaagggactcagcctcctgccattctgaatggccacttcatcctcatactggggtggagaaaacacagctgtgtttacttttccaaccccatcttctattttgaaatataaccttttgcaagtgagagccaaggtcaagtgacacagctttctgctcacctcttcagtttgccaaacattgtttttctagtggagttctgggttaggtgcagcaagtgtgagtaacactatcactcatacgcccattggaatttaattagtctaccctcataatttctgtactcagtttggtatgacacatttccttactttcatctgtatatgaaaacacacagttgtgtattcaccaactatagtgtttccaagtatgtggattactctatatatcaaattcaaattacacagaaaataaggcttttcttctccaatattttcccatttcttgaagaattatttactttttgagattagagagatgtttatacatagggtgaacatgagcaattctaagtacatactaagtattagatatttatgtttttgtataataattgtagaaacagtggcaaagcatacattttcagcatatattaagagcagcagaacagattagtttttgtgctcagacaacagccttaacatgaaataactgtattcattgttgtttgtcataacatttaattatttgttcttaaaaatatatatcatacttaggttatgagaatggcaaatgttcattctatcaaagcacacaccaaaaaatccaacatgcagctggtacttaatatttttagatttactttcttcttgtatttttgactgtatcttatgccatttatttgcattcagtcgatatcatataagtgatgtcaatttatttatataaaaacaaattagtataatatatttatattttcttaccaggtttaaaatggaaagtgttccattttctttcttattgtatatgtagatgattgaagtactttatgtttcactgaaatgagtattattcccttcagtgaaattaatgttcagcaatgctgaggagatgggcaagatcatttctcattgttttccttttaaattatctggaaaaaatatgatcttgttgcattacattctgaagaagttgaatagatacttacaataaataaggctatataaatgggaagttaagtattaatagaatccagtgtgactaacaagggatatcaagttcttcagacctgtggtatacataataagcttgaagaattcgtgcacaaaagtcttaactgttttgcagccttggttgtggttagatgctgtagttttctaagctactacatgttgtaaccagcttggtagatttaacctagtaataagatgcttagtttaactgttagtttaaactcagtttctatagcggcacagtctttatttttggaccttcactttccaatccagatgacacttgtccataaagaaattgctaaacttgagacctaaaaacaaaacaaaaaacaaaaaaactacagacaagtaacctttaaaattatttcgcttgatggaaatttaccggaaggctttaaccaattcagtttgcttagactcataaagaaaattatgataatgtctaggtaaacttcagtaaaacatttttttgtgaaattatactatagtacataaaattgaaatattgctgatttaatgtaaaaaaaaagaaatcagcttggccaagttggattaccttgttagagattgcttatgtaggtggcatcgacattgttacgatctggacacaggggatacatacttgttttatagtctatatgtgactgtcattgacttggagtatgggacagggagcattggattttaagtcagaagacccaaagtgtaagtctctgccagttagtggtggtgtgatagtcactaacctctgagcctcagaagattagaatgaaataatagcttccctgtcaaatttagtgagttgtgaggttcaaattaaatacatgtgaaactactttgaaaactgtatagagcaccatacaaatgttatttgttatttttccaaggttctgatgagaacttttctgatctcttagatctaactgagttatcatgaaactttgataaaattgtaccagtatgttgtttcgtatagtactatggggcatgcacatgttttaaacccttagtttgttatattttaaatttccagatcatttaacatttgctttacttcggtttttgttttgtgttttgttttgttttggtgtggttaatgtgccttttttatgtaaatgggcagtagaagttggtgggggtcttaagtactaataaagggcactctttttccttcttgcatcaagagccaatggagaaataagatcaaagagccaccaaacagagaaacaagatacataaagctgtgggtggatagtgtaatagctaagatggacttgtgcactcccactgtcccatgtctacatctgtggggaagtttaaggcaccacaacagactctccctttggccactttttttccccagtccaagtagagagataaggagaaagagactctccctgggccttaggatattagggtttagcttagcccacctagaaatacaggcttacgcctgtcatccactgtgataagaagaaatatatatctggtctttgtctctggttcctgacactgagcttctagaacactttgaatttcctgagtaataggggtgagaggagcatcttttgttatccataacaagttcctttcaaccatgcccgattttatgcagtaaaccctctattgacatcctcgataggttcttggaagctacaactttaagcaaaacaacatataacaaaaccagttttactgtaggttgattgatagaaataagagttaagttgctatggtatatttgtggtcacaaaaaatcaccaaacttctaaataaagatcaaaacacttctaatagtaaacactgaaataaatgtgagctctacatttagaaatattaataaagacaagtaagaacattactcacccagttatttgaatttggacttgccagagcatatcccagcagctcagggtgtgagggggtacccagagctggacagggcaccatcccatcacagggcacactcatacacacccacactcaagcagatggggacaacgcagacacgccagttcttctaacatgcacagcttggggatgtgtgaggaaaccagggtacctgaagaaaacccagctagacatgaggagaacatgaaaactacacacacacacacacacacacacacacacacacacacacacacacacagtggcgtcttgaagaattgagttttttttcttatccatgttgtaacattgaataaaaacaatgttatctgaggacccactgtactaatgagatggctcttggtggtttctagatggcatcagaatgaaggaccatttgccagaggaaccaaccatgtaattagagggttggaaccatcagacccactccttaacctctgggaaggaagaagagctagagattgagttaatcaccagtggccaatgatttttatgcctatgtaataaaacctccataaaaacctctaaatagtgggttccaagagtttctggattggtgaacacattgaggtgctagaagggcgaggtcccggaaggggtgtgggagccccaaactccttcccctgatcttgccctatgcatctcttctgtttgactgttcatgagggtatcctctgtaataagccaatagtgtgaagaaaattgtttttctgggttttgtaagctgctctagcaaattatcaacctggaggagggggttgtgggaatccttgactttatagctcgtcagtcaaaagtacctgtgacctgaatttgtgattggcatctgaaatgggcgcagccttgtgagactgatccctgaacctgtggggtttgggctacctccaggaagttagcgttggaattgaattgaattgtagaacactcggttgttattcggggagttggagaattggttggtatgaggaaaaagcccatgtgtttagtgtcataagtgttgtgactaaaaacaatatagacccaccaactaggtaactcagcctacctccttggggaggaataaggggtggaggagaaggccagagttccttacagaaaaaaatccctgtttatggaaaccagagaagtagatatgaggcttttcctctaacagaggtgaacagcaattaaataaatggaattcacctgcccatccccttgcctaccctcctttgcagctctcatctctgaggctctccttccttttcagtacctacctagtcctgccaccctgttgctgttcatgtccattgtccccaagcataggctacaccacagcccctccagattataccatgtagctggagagaaacactgattcctgggagagaagagttgtgtaaggcaggttggttaaggggactttggagtagatgaggggactttggagtagatgaggctagctcagtgagaagatgggtctgtaggaaaaatctttccccaacaatttcatctacattgtggcaggaccccattaaacttcctttaggagatgtatttgtaaagctgttcatttggcaagtcaaggaataacttatctcatgcttgaggaaatggatgtagctggagtcacaaaccagtttatctctgcatttaataccatccatagtttatcatgttggtgataacgggcaaaatgggtttggtaaaatcttagaaaaacaaagaaacaaatgcaggaattgagggccaacatcctaattcctaacttatttagaagaaatgtgaatataaaatttatgaagagatttagattattcagtcattcagtaaacatgtattgattatctgttatgagccccacattgtgctggctgggaaggaaatgggaatgaaagctgtagtccctggctttgaacagcccgtaggtttgtgggggtgacagggaattctagtcgagtgtgatgtgtgctgtgagggaagtatgcataagctgttaagggaacacagggatggttacttggcccacgtttggggagttagttggggaagtctttctaaaagaggcttgtgtgacctggaagggcaaattgaaataggcaagatgaagggagtagaagagaggatgtcttaacttaggtttaagtaattcaatgagccaaggctcagaactaaagagaaagtgtgtgtacacacacatgcatgaatctacatacatgtctacttttgagggagtggaaagcagtaggcaccatgaaaaggtttggttaacagcggatagcttggtatggatgcagtaaagagtttaggaataagagtacaagaaattggaggggtaagcaaggccaggtcatgcttgtgtgtcgtgataaggagtttggtcttttttcaaaggcattgaggaatgttaagcaaggaagagaatgtgttttatatgctacaagtggtagggagagtgtagtgtagggtagtaaagctgtacatgggaaactcttgcagcattccaggaagaagaccttagtatcctgaatgaagagaatgacatgaacctgaagagaaatggatgaattaggggagatattaaaagcagaaaagtcaataggactcagtgatttattgcatggaggaagtgagagggagggaaacgtcaaagatgatacaggtttctgtgctgggcaactatataggttctcttcactgatagagaaaatattggaagattggaagagcattaagtttgaggtaaggttaaggtaaggaagggactaagctaagagccaggtttaaaacatgttgagtgtaagatgtcctgtggaatatgcaaaaggaaatgtataataggagttgaacatatggatcaggaactctagagagaaatccgagtttgagattggtatatgtgcatgtatctacatacatattacttttgggggagtggaagagtggagcagtaggcatgctccatatcagataagctcatccgaagaagtgtgttgagattaggaagagtaaaggaacagaaatggaaccctaaagaacaccatcacttgagaaatagacaaaaagaataagcagctagacatgtagaaaacaaaactaacaagtgtaccgaagccaagaactaaaaattcagagtcagtagcagtaagtgctacaaagtggtcatttcagattagcacttccaaacattttctgaatttagcaagagagtgattattagtaacctttgtgaaagcagactcagtagaggggtgcaggcaggaggcaggttgcagtgggtgagggaggcatggcagacagtgtgtgccaacaatggtctcagcctcgctgtgaaaaaaacatagaaagatagtatgggagttaggaaggtgatattccaataggcaatatagagttgagtcgaattttaaaaaatggttaattgcttctaggaaagattagcaattaggagactccccctaattgatgaagccatgtccttgaagagtttgcactgggtggatctgcagccctggaagctctggggaaggggttggatacaaatgcagatacatttgttggggggtagagcagatagaggagatcctcactcggtggttgctgttttctctgtgaagtaggaggctggcccacctgccagcagcgaggaggaagctggtgatatagggctagaggagagaagagaaaggggaaatgtgtgctgagaatcatgaggcgggaaggcctactgggaaaatatgagctgcctggacagcttacggttggagtttatgaatttctataaagcaactttaaaacaatttttaaaaaatcactgaaacagccttttgtgttttcaaaaccagtattaaataggatcctgcatttaacgcactatttcttgcctggttcctttcctgaagtgcttctctttcctctttccaccgcgcccccactctagttggctagtagagaagatttttccagcttcagacaaaccacttttccaagaatacatggaacagattacagaagcaagtaacagcctgcttacttccccttctgcacttgtatgtacgttcagctggagttctgaaaagaggaagtcgggagaacatttttttctttttaaaagaaagattggagaaccacggagcacaagcaggtagaaatattgaaggaaagagaaagaagagaaaatggaaaaaatactgaaaaaaaaaaaatcatgagccagaaggtaaaccaaaatgatgtcagagactaggaaaggaacagagaaaataatctgccttctaacctagcctcttagtttgctactgaaatacagcgttcttgaactggagccctcacttctaggcaaaactaacacctaggccacatggagatagaaatcttctgtgaattcagcttctcccccctaatttctgtatcagtgacaacatatcctgggtttttatttctttctttgacctaacctttcaattttaaaatcaagtctgagtgcctagagtatctgaaaaagaaggggaccagatctagtgccattcaaaaacatttaatgagcactttgtatatataggtgctgttctgggtactgggaacttggagaaaaagaggaaacaatctttgccgttgcaatatgatttctcccaagtgaaaggagactattgcttaggaattacataggtgcaggacaccaactctcaggcatttaatagctagacagacatttattagtgaccagcttcttataaaaaataaaaagcttgagtactgccttaactgtgccatagcttatatcaccttctcctaacctctgtcccctgatgcttctaactcagatttgcccctccacctcaccccacagtaatgcaagcagataccagctgaagccagaatagaatggatagttatctagggagataaagtgacagtgttgcttgttcaggctattgttcaaagaagcacgtcttttatttatagacattagaatttaaaggcatagacagccagagcttgatattacctcttctttttgtaacttgttttctagaaatatgcttgatacagctaccttctttgcatgtaaattgaatgtgttggaagagtgttttatacctggtttcatgttcttttaataggttctattgctgttttagttaaggctggtttctaaattttaatgcatcaatattttgcttttatagcatactactttatctctgtctgaggcataggttgcagaaaaaagcaggaggttttaaaagaagccaaatatagatgactttcatattaataaaatattcataatttagttggatatagctaagtagatgaggtctccaattgttagtgcgtctgcaaagttggcgcctcctaatagacttcatggtggttactggaattttgtgccaggaaaaatgtagttgtctgttcttaaacctgaatttccttgctttcaaacacccaagagcgaggttcacaaggatgccactaaccttctgttgctctggggaagtgacttcatttttccaaccctttgctgaaaagtgttatatgccttgtattcttggagtgtgttttttcctaagctctgagaagatttttaagattgaacctcatgaatttttacacccctctgcaagaaagggaggaacagtgcctgtaaacctctttgaattacttgaaataaagataatagaatgtaaggaatgaaaataaatttggccagtcaattttttaacaggttaactgatgaacaagaaatagtttttatacaaacatatgaaaacagcttataacagcaaactttatttgttgtaatgatataaataagaatattaactttctttgtaagattaaaaaaatctgacacggtatgctcatatttaaactaggtaagggcaaccgctaataatttgaaaaagaagtattaaagctaggtttatgaagaaactatactcagaaacattatgatagcatttctgtgaacaggattcatcacaaaaataacaaatacgctttatgaacttagtatttgaattaattttctgaaatttggctattaaccaaaaggttaattgagtcttttcttcttgctctattgtggttaacatactaattcttcccattaaagacccattttattatgcaaatgaaaaaaatcacaagactttgtgtctaagagaaagctgcttttttggaggggaactcatgcacctgtttaaacccccagcccccaccactgcttccattggctgccagacttagtgatcaggtttataggctgtagggtccttgaattttgactcacattttctttgtgacttactcttgttttggcttatatttctccccttccagctctcagcatgccaacagcagctgcatcatggcactcaccctgctgccaagagggcaggcagcctccttggagactgtaatgttgcactatagccaacagttaagagatagatgctggagtaatacttacagcacagctgaaattcacatcatcctaggaggcatttggtggaacactttgcccatcgtattgttaaactaatttttaaaaacttaattatgaaaaattttcaagcttatacaaaggtggaaagaatactatagtgcattcccacttaccttcatgtctgtttcaataattatcaactcacagacaatttttcactgtccacggtgtttttcccatggtcttatccagactgctggtagattcatttccagggataaatatatcttaaactagagttgcttttccatccttcttcagcctgtctgtaagatctgtcaccttaatgattttctcagtcctttcttctttaaggtacaaaatattagcatcttttttcttcctaaattaagccaagatatgctactttaataactgttatattttctaatgctgtaccctaaaattgttgaagcactgttcattcagtcaatcattctatccaaagcatgtctgaaatgtgcaggatcttggaatatagagctttaatggtcattgggtttgattatcagtttcaccactgacaagctgtgtaatctgggacaacttccttaacctctctgtgcctcagtttcctcttgtctttaatacgggactaataggagcacatacccttacaaggctgttgtaagacttaaatgagcaaatacatttaaacagcttagatacagcctgacacagtgttccgtatatgctagttgctgtcttgtcatcattgtcatcctagttgtcttcatcatcttcatcttttgtccctcttcactcattttacataatagtgggttgaggctcaaatgggtaaagcaacccccttcaggtcagatggcagttttatcaggataacttgaatgagaaagcatgtcccaatttttttactgtactagatatagtttgatacattcttgtcctcaaggaattacgttctcacaaataacagagaattgtcaaaaaaaaaaaagaggattaataaaaatatgaggaataaatattgctgctggagagttaagccttaggcactgcgtgtttcaagaggaagagagagaacctcagctgctggggagtccttgccacactcagtctcccaccacatcaagaatctcccctccgcagttccatgcagacctccgaaagaggagggggccttcatgtcccatcagtaaagtctgctctactcagccataaaaaaataaaaaataaaaaataaaaaaaaaaagaagttgtgtgtttagaaagcaaaatgctacaggtaatgtacaggcatacctcgaagatatttcgggttcagttctacatcactgcagtaaagtgaaaattgcattaaagtgagccacataaatttttttgtttcccactacatataaaagttatgcttacactatattgtcatctattaagtgtgcaatagcagtatgtctaaacaaatgtacatgtcttaattaaaagtatactgagctgtctcagggaagtctgaggagaggcagataggggaatggccaactagttggtggaacaatcagaacacacacaacatttatcagttaaatttgtcatcttacatgggcatggttcgtggcactgcaaaacaaatacaataatagcatcaaagatcactgatcatgcctcaccaaagcagatagaataacgaaaaaatttgaaatattgtgggaattataataatgtgacatagacacacaaagtgagcacatgctgctggataaatgactccagtagacttacttgatgcagggttgccacaaaccttcaatttgtaaaaaatggagtatctatgaagtaccgtaaagcaaagtgcaataaaagaatgtatgcctatacctccactttagtgcagaatgtgggatgtcaggaatgcttttgtttaaaaaaggagatgatttcgctaatgaaactctagaacattctatacacaaccaaaaaagaaaagaaagtttgagtgggatgagactaccagatctagggaacatttacacatgagattaagagagaaagcaagaaataaaaggagagggaaaggtattatttgaactaccagtgagtgtcaaaagagatgaatggattctaaacttcatctaaacccaaatgggatctggcatttctaaaatgttatttattcacttactttaacctgtgccgagcactgttctgcttacttataaatataactttatttaatccttgcatttaacaatcctatgaaatagctaactgttatcaatctcataatacagctaaggaaactgaggcacggagaagttaaatattttgcccaaggccatttgcttattaataaacaagagacctgggatttataccaagcagcgtggttctggaatctgtgctcctaaccactttgttctcctgctcacaggtgatcaaagccccggtgcatatggaatcttgaggttttatggtgcacccaaacgttgcttccctttcagtttttctatataaaccagtgtatagagaagccctttaaagagaatagaatggtggtgtcattactcatacctgcactcttggctgacccgaggataattagcatggtgagtcccaattagatttcaggagacaggatctgcccactgcagatgtacatctttataacaagctttatcataatagagtatgattacatttgttagttgcagtcctaaaacagtactctggtgttattttcacatgaaattataagaccactcttataggcatgtgctttttaactttactaattcgaggtcatccactaaaaaatatttcttgatggcctctgttttaggtattggagatgctttgtgacgagttccttctctataaattctctatggattttttcctttcttatgagctgtttcttattagcttataaattgtcattatttctcccaacttgaaaaacaaaaatcaaaagaaacttttcttgactacacatccctttttaactactggcccatatatgtttcttcatttacatcgtaacacctagaaaatactgtctgttctaattttctctccactttctccaccagatctcgtccagctgcagattcaaattatatccccctgcctactaacagctccacctgatgtccgctaggcactgaaacttccaaaacccaactcttgatcttcccacccattcctgctctctggtactctttcccatccctataattggtgattccatgtgtctcatcgctcaggccaagagctttggctttatccttaactgtgctcttgttctcatatccccaccgtccattccatcagcaaattgtgttccttttacccttaaagtctatccaaaatccaaccattttatctcacctttgctatccctgctctaatcgacttcataagtaatctgtcattcccagctatcttcccacttctttccccggccaccccacctctactatctgctgtcaacccagcaaccagggtgattattttaaaacatcagtcagaatatatcacctttccaacaatatgttcttcaagatttttttcatctaacatgcaacaatttagatgaatctcatccacataatgttgagtaaaagaagccagaagcaagagttcatactgtatgattgcattcatttaaaatacaaaatcaggccgggcacagtggctcacgcctgtaatcccagcactttgggaggctgaggagggtggatcacctgagctcaagagttcgagaccagcctagccaacatggtgaaaccctgtttctactaaaaatacaaaaagtagctggacattccagcctgggtgacaagagcaaaactctgtctcaaaataatacataaataaattaattaattaaaaaacaaaaccaggtaaaaccaattctgtgttgttagaaataaggatagtgattgacaggacgggggttgattgtgactgcaagagaacaccaggagggcttctgggggctggtcttttctatttcctgatctgggcgctggttgctcatgtgtattcagtttgtaaaaatttagcaagttacacccttatgaagtattttgtatttttagtacagacggggtttctccatgttggtcaggctggtctcgaactcccgacctcaggtgatctgcccaccttaacctcccaaagtgctgggattacaggcgtgagccaccgtgcccggcccagaaaattattcttctcctttagacttacagtctaagaatttgtcagcatttataaccattagcatttataaccaaagacacaacgtaccagaatctctgggacacagctaaagcagtgtgtagagggaaatttatagcactaaatgcccacgggagaaagcaggaaagatctaaaatcgacatctaacataacaattaaaagaactagagaagcaagagcaaacaaattcataagctagcagaaggcaagaaataactaagatcagagcagaagcgaaggagatagagacatgaaaaacccttcaaaaaaatcaatgaatccaggagctggttttttgaaagattaacaaaatagatggaccattaaccagactagtaaagatgaaaagagagaagaatcaaatagacacaataaaaaatgataaagaggatatcaccactgatcccacagaaatacaaactaccatcagagaatactataaacacctctatgcaaataagctagaaaatctagaagaaatggataaattcctggacacatacacccttccaacactaaagcaggaagaagtcgaatccctgaatagaccaataacaagttgtgaaattgaggcagtaattaatagcctgccaaccacaaaaagcccaataaatctttattgagcagtaggcactgatctaggcatgtggaatacagcagtgaacatgagctacaaaagcttcttggctgggtgcagtggctcatgcctgtaatcccagcattttgggaggcaggcagatcgcttgagtccaggagttcaaaaccagcttgggcaacatagtgaaatcctgtctgtacaaaaaaatacaaaaattagccaagcatggtggcatgctcctatagtcctagctacttgggaggctgagacagggaggatacagtgagccaggatcacgcactgcgccccagcctgggtgacagagcgagactctgtctcaaaaaaataacaaacaaaaaccacgtaaaagtaagttttatataagtgagaaaaggcctcattgagatggcatctgggctagcgcttggaaggagataagggaagtagccctgtgtatgtctgggagaagagcgtcctggtctgagggaatggaaagcaaaggccctgaggcagaagcaggctcggtgtgcacgagcaagcacttgcaaggagcactagcaaggagacagtgggattgaagaggaataggccagggcacacgagctggagatgagggcagaagcacacctggagccagatggcgaaggagctagtaggcctctgtaaagacttgggagtttcattctgcctgagattgagggtcaaggggggagtcatttttttgcccaggctggtttgagttaggttccaggtgcttgtagtggcaggccattcatcttcattgctgtaaataaatttcagtttattatccattcttctattgattgatatttaggtgatttgcaagacatattaattgtaaagaaattgaacaagatatatccttttttaaaaaattgcgtaacttttatgacataacaggttagttccaatgacaatcagacaatcagtactcatggtatacattagagataaattatgagtacatatatattactgtcaaatagtaaagtgtgcaaggttgaaaatacaaagatatgccagatagactgcttgccttcaaggaccctatagtctagttggagataagatatatttgcatatggaacagcaatttgcaaggacacatataggcaacaccaaataacatcttaggcaatttgccccataagcattctgaaataggcaagatcactttgtactccattgatacaagattttatagggcagctgagaatttagcagagcctgaaaacgtacataggatttggaaaagcggagacagaatttgcagacattatctgagcaagggaaataacaagaaggccagtttgtgtttaaggggtctgtgggtggtcagtctgagttaaagtttaggattcattttaaagcctaacagagatttggatgaatgtaattctaaagtaaagtaaagagctgcgttcaaatctgggaatatttatatagcccacattgctcaatcattttgatgtattaatgccacatttaccgttattcaacctcaaagttcacaaggcctaaatgttttaaatgtatgtatttttagaccaacaaagaaaattcatccagtgtgactgtatcagaccctgagatggaaaataaggcaggccagactctggagaacagctcattaatggccgagctcctgagcgatgtgccgttcaccctggccccgcatgtgctggcagtacagggcaccatcactgaccttcccgaccacttactctcctatgatggcagcgaaaacttatcacggttttggtatgatttcactcttgaaaattcagtgctctgtgattcataacctttatgtctgtttgcaccttaacagctttaaaatatgttcgcctattttatctaacctgtttgatgttctttgccgtttcactgtttaaggtcctcagcaaggatcataaagcaaagaaaatagcattatgttcactactctatttttaagaaaaaggtacatttgtatacaaattgaacttaagttctacttcctttctcccatataataaatatacaaattaggctatgaaggttttaggaaaggactcgattccttcagatggtctctcaaaatataacacctcaaatttatcttagaagaactgtgaaaaagaattgtggcatttttcagtcactacagctccgaagtctgagcaagaagtgggtgtgaagtctcctctctggtttgtaggaagttgaattggtgttattcctgcatttttttcttccacagtgtttatgaatgaattcagaaaaaaagttgccagttagcttaatttcttcagatgcattgatgtggaaatttaaaacttgtcctaaacagcagtgctagtttgctgatacaaggatgctagacctgctctgcgtgctctttctggagtggcccatttcggttttctgaaacccatggcagccctttccatcgtgaataatcgttgtgttcccacctttgttctctgcctttttgctacttcagtgtgctctctgaccagctttccaaagaactttccctgcttctgcctcggttgccatttgctctccttaccacatatgttcccagtttatgaagagatccacatttcctttcaacccctctgcctcctgaagaaaaacatctcatgatgatacatattattgctgataacacccttatttagaaatttgttggccacaatagagatggaaatgttttactgctggaaaaactgaaatcaactcatttccaattagagtataggcagaacacctagatatgacttttagttcttgaatatccattacttactttaatgaaaacagaactgccattggtcaataaactgtaaagggaagaggtaaattgtgatagagaattttctatgtcatgggaaattgaaatcacatttattttgattaccagcaatatgatttgttaactctgtgccaagttttaagtatattttttcacaaagatagagtgccatagtgaaactaaacactgtgcataaaggtacatgaattattccagttttaaagtattatgcatgtttgtttaataaatgtggcatggttttaatacaaatgctatgttatttaaaagttagaggaacatttctattgacaaaaatatgcttcatttacatataatgttaccatatggtgttaatgattaaattagatctttacatagttcttacaaagcatcagtctaggaaatatgacttattactgatgcaaacgtgaacattttgtagtagttttgtaaaagaacatccttttcaaatatctgtgttaatgtacccttgaaattaaatgcaagcacatagtcagtttgtctaattttgtgtgaaattttgtcgaaaatacctaaacatttcatctatatttgtgcctaccatgttataaatgttcataagtaccttcatgtgtctataaaaaatgttatatttaaataaatgtgaattaaaataaaatttttgattattttcagatccagaaaaatgggtttgattgcattatttatatctgaatgcaagttgttaattctttaggagccaaaaagtttaagtatatagtttgtatagtgctgggaaaaatatacgatttcctcttacatgtaagttttaaggaataacattaaaaatggtaagatccctagtcctggcttaacaggactggagggatttgagagagatgacatgagcatttctagattgataccatcatcacaacatttagtaagggccaatgttaatgatcttcttctttaaacaaaaatattgtgaaaattaccatttaattttttattctgtatataaattaatatttctatgaaacattagaaatcaatacgtcaacttcattttacccaagataaaattgaagcctagaaagactaaatgacttaaatcacttagtgataaataaatgcctactttaatagtgttagtaattataatatatgataacaaagctgtatgatatggtgggagagagttcaggcaattgaggcagccagacagagtttgtaatggctccctcctttataagctgtggggctttcaatcagtcccctaacttctggtgccctcagttctctcaattgtgaaacactaattgttcataacttgtagcgttgtgttaagttataggtggtgtatgtcaaatgcctggcagcctaaagccttgcacatcatcggtattctgggaaagggattgttataattctcgttattgaccatacacacacaatactataatgaaatgcaaaatacatattaattgaacttcttgaagagtaacataaataaaacagctacctacgttaactgtagatccccctccttcccagttatttttttccatattaaataccttactatgagaaatattcctaaaatatgttagttgactgttctgccttaactaagaattccatagtgaacatttttttctttttctcgttattacagtctttttcctaatatatgttattgttgcaaagtactatagatatggaatgtgcaggtgattttactgaatcttatttatttatttgtgacagagttttgctcttgtcacccaggctggaatgcaatggcatgatctcggctcactgcaacctcctcctcctgggttcaagcgattctcttgcctcagcctcccaagtagctgcgattacaggtgcctgccaccatgcctaattttttttttttttttttttagtagatacagggcttcaccatgttgactaggctggtctcgaactcctgagatgatccacccgcctaggcctcccaaattgctgggattacaggcatgagccactgtgcccagccttgaatcttatttttagccctaaaatatattcaagaacttgcatgtatttttttcccaagctttctttaaagacatttgcattctttcctaaaaacagaatgagagaggcgattctgaccaatttattatcctggctaattaaattttgatcaactgaacttttaaaattgtaccattaaaatgttaacaaagccacaatttttattaacaattgcaaatcaaatccgtaatagttttttaaggtaaatattcattgacgtcaacacttatttttttcttctcttaaagaaaaatggtaaattcaaaacagtatgaaaaaattcttctaaaattcccagagatttcatttctcataattctaaatgacagataaggagaagcaaggaaagaatctcactcatgttctgaaaccgtagtacatcagactacctctgtgcctcccatggtaacaattgatcaataagtgaacactgccctcagtaatctagcaaagaatatgtttctttcagagattagtgcgttatcttattaattatgtcaataactcacacaaaatataagtttattggaaatgcagttgaaggatggtttatcttttaaagtttttgggaaatacaggtttattgacattctcttttgagcatttgtcccatattactgagggcatgacctaggtattattgggaaatctaaaactttcagaataagtccaattccattcatactacagtggcttgaaggattaagtattcttatgtttcaggaaaaggactctttttgccatatggtttggcagataggcgtgtgtgggaaagagagaaagaggtattgattgacgcagggaactctgtttcagtcgatgtgacaatatgtcagtcttttaaaaatttaaataaactttttattttggaatagttttagattcacagaaaaattatgaaggtactacagagagttcccacatacccctcacttagtttcccctgttgttgacatgtcacgtaactgcagtacatttgtcacaaccgaggaatcaacaccggtacattgcaattaactacactgcacaccccgttcagatttcatagttttcctctaatgtcctttttctccttcagcagcctacctgggatagcacattacatttatttagtcgtcatatctccttaggcacctcttggcttcaacagtttctcagactttttatttttgatgaccttgacagttttgaggagtactggttaagtattttgtagaatatttctcaagtggggtttatctgatgttttcacatggttagactagggatatcggtttttggagaaatattaaaaaggtgatacccccttcagtgagattatatcgtattgagagtagtataagctatagacatgacttattactgatgatgctgactttgaatacctggccaaagtagtgcttctcaggtttctccactgcaaaagttattccccccaacctttctatactctttggaattaaatcacaaagcacagcccacactcaacgagtgggtaattaaactccacctccttgaaaggcaactatcacataaattatttggaattcttctgcatgagagatttgtctcttttccccaatttatttatcaattatttatattagtatgaactcaggaatcttcaatctttttccaagtcttaatcagtgctatccaagagacatatttacatttttatgaaagtcgataaaatttggaacattttacatggtgcagatgaataccattttatgttggatacgatagtatattctatggtttcctcaaaatttatcttcctgttaatgtcaggcatgtatctccttagcttgccacaaataactatatataccacagaccttcctttgtagggctaacagtgttgcattgtaagtggaggcctcatagatacctggccttttcctaccttattccaaagatggttgcatcttataaataatgtcattcttcagcaaatggtatggaaatgagattgtaatgtcattatttcctctttaaataatcaggacaactcatgatacaaagagctcttctctataaaaggtgggacttttttttttagtaatagcaaaaataaaattgtacctccttaatcttctacagaaagatggatttcattttcaacattaagaggtagttttaagaagcagtagaagtcagcctgggcagcatggtgaaaccccgtctctacaaaaaagttagctgggcttagtagttgcaatcccagctactctggaggctgaggttggagatcatctgagcctggggaggtcgaggctgcagtgatacagtgagccgtgattgtgccactccagcctggttgacagagtgagaccctgccaaaaaaaaagaaagggagaaggagaaggaagcaataagaggaagaagaagaaggaggaggagaaggaggaagaagaaagaagaagaaagaagaggaagaagaagaaaggaagaaggaagaaggagaaggaggagaaggagaaaaagaggaagaggaagaagaagaagaggaagaagaagaagaaaagaagaagcagcaataaaaggaaaccaatcttcttttggaggggaaaagtgcccaagaatctcataattttacttctcattagcgaaagctcactgcatgctaaaaggtaaatttgatgagtggatctcattcagtttcctttgggaaagacacaatcaaaacaaaaaacaacttatttagtctttgcaagaaacttgaatataattccttgtcaagaatttacccaatcccaattttcacccttacaaaaaataaataaataaataaatgtcttacaatcaaagctaaagcaaaggataattgcatccagaacaaaccgtcagttgcccagccccaacagagagcttgcaagtcactacccaggccagaaagggagtcagacaacagagcatttcagaggtcagttaaggagacaggttccaacttaggactgctgccagggatgtacaatccagtgtctgacatctgggttctacagctgccaaatctgccccttgtgtggccacaggtgttggctataactctgaggcacattggagaaggaacagggtaatgtcaacgtcattgtgcatatgtgtgtttatgtgtatggtttttcttttaattttttcaaaaggtacataattaattttgttttaaaatgaatgtatttctacataatggctgggaacattcgggaggctagcaaagaagaagcttttgttcaagaacaagggcaaaacaaagctgaatttttacacctacagggtacattgtacgctaacatgttgtgtgtgatattgttaacttagtcatttgaataggccttctcaggacaaaaataaataaataaatggatgccgaaacgcacacaggcagttggtataagatgaaacctaaatactcattctcttcctgtaggcttctcccctcatccttcttttggatcttcaggagaatttgtgtttatccacacatatttttgagcctggaacagactagactgtatgtagtcttctatctcacactataccagttgtagccatcaattaacacagcttaaaacaggaacactaaactttcctcttctttttgcaggaaacttagctactgtctgtaaagcaaatctggaagtttctacctcaggtagctgtttgagtttcctaaccctaaagatgtaggcaaccctaaagatgtagaagaaatgaagatgatttagagaatggaatgatcccggtaagaaacttaaagaacagatggtcagtaggttagagaaaaaaaatacaggtctatagctccacaaattaattggatatttcttccatgttttgcctattccatatcctgaaattagaaattgaacttcaaggaggaggaaggaatctacatattttatgttcatattgaatcccttctaaagagaaatgcttcagtccttgggccaatgtctgtcctgcttttaaaactaatgtgacctgcagtgttttttcactgtatcctctatatattccaccagccaagatttctgacaggttatagtttgtgttttctattacaaagatcataggtaaattgaatgcactttttcaaagattaacccccatcccctatttcacttaacaatcagtgctctgactgggcttgtgcttagcacatgataaatcctcagtcaggatttgttgaatgaatgagtgaaccaatgaaatcaatcattaagttatttatacaggagatttcccaaaagcaaaggaatagaatttaaaaacttttgtcatttctccagccttgggaagaactgtgtttgtgcagttgaaaataatgcttagctcaccaggcctctacaaattgtgccttttatctgttttgggtattttccatgtttctcaggttgtgttttcctctgcccataatgactacgtatgtcttcatgatgagtaagagctgattctagacaatacagtgtatgttggtccgaggttttatctagctgccaagtttcccttgtgtgttcttggttatggtagtgtgtattcctgtcccagaatttattagtccgatctgacctgtccttgaaaaatgttttcctttttcatttgcttgcctccaagcacatttgagtatttttaatgaccttgtttttttttaaaaaaaggtttttccaggagcagtagtgcacctttgtttcagtactctcctacatcgctgtcctacatttcctactcagccagttctatcccttcgtcatacaaacatgtttagcgctttcctgtctaactccaactatcaactcttttttctttctctttagagtcgagcttcttgagagagtggtctatatttgtgcctccagtttcttactttttattcattgtcaacttctgcaatctgattttgcgtccctcattagaacctcccctgaactggtttatactcggcccacctctaaagcctgccaaatgcctttatctctcttttttttttttgaggtgaagtttcactctgtcccccaggctggagggcaatggcacaatcgcacaatctcagctcactgcaatctccacctcccaggttcaagcgattcttctgcctcagcctcccaagtagttaggattacaggcatgtgccaccacacctggctaatttttttttttttttgtatttagtagagacgggttttcaccatgttggtcaggctggtctcgagctcctgaccgccggtgatcgactcgccttggcctcccaaagtgctgggattacaggcattagccaccatgcccaggctatctctctttgaggcaattaatcactattgattaatcctactctcttgaaattgtcttccacccttgatgtctatgacaccttttctggtgttccttccatctctgtaaccattccattttagacctttggggacttgttttcacttctacttgtaaaattttggtgttcttcagaattctgcctctgcctctcttctctaccttttcttttgcctacataatcatatccatgtcttatctgcataatcaatcttcagcccagaactctctcaagttccatatccatatacataatttgctatcaaatatctcccttgacccttgttctcagcttctataacagatcacagtagctgctatttttatttgctctacactctttttcatctctctcccctctgcccactttcctttgaggaattctgcaccactttatgtagtcctgttgggagctgtgatacttatggccatttctataccacaaggtgataaacacgtaacctagcctagtccaagtatcatccatcaaccagtacatagattttaggagaaagaaacacctattttgctgggttactactgacagccatccttccctccatgtttcatagtcttgaccatattatttgaggccctggattacccaagcaagaaatctaagaatctatccattcttctttcttacctccatactcaattgatgataaacttttgttaattatacatctaaaagatttgtctgtcaaatatgtactccagacctactactactcctgcttcagtcccggtctttatcatttcacccaactgatctccctacatccagttaagcctccctcccatccatcctctactctaaagccagatgaaatatattaagaaatacagataaattcctcagggcttctgtggtgtctctggaaaattgaggcattttaaggcaaacaagggccccccacctgcctctccagcctccgcaaatgatattgcaattcatatattctgtgttcttgccctattgagcaatgccctgcgccatttaacatgccataatttctttgattatccttatattctatttcctttccctggaatgccctgaccttcccttcttcacccagctaaatcctattacaagactttttttttctgtatcatctcctctaggagtcttcctttatttttgctgagctgcactgatctctttccatgtttttgtgctaacctgtgctcccctctttgaaggttcttgatccatagtattgtaattgtttgttccctgtctgattcataactctgaattgataccaacatatagacttctgtgcttaacatgatgcctgacatacagcgtgtgctcggtaaaatttgtccagtaggtgaatgattgagtcactattgattcaaggaaatacatgagtttatatgccatctatattagactattagatgttgcccttgtgtctgtgttggaagcctttaaggaaacctttcagatatccctattagaatatgctacatttctttaatgctcccaaacatatcttgtattctaaataaattagctttttaaatttctaccccttttgtttggtgacctgtatcagcattaatacaataaagacattttatatttattataatctttcagacagtgttaagtcttcagattaaatttttgggatgtaagttactatgaatctatgtattaatattattattttagacacagggtcttgctctgttgctcccaggctggagtgcagtggtgtgataatagctcactgcagactccaaattcctgggctcaagtgatcctcctacctcagcttccccagtggctgagactataggcacctgccaccatgcctggctaatattttaatttttgtagagatgggatctcactttattgcccaggctggtcatgaactcctggctttaagcaatcctcctgctttagcctcccaaagtactaggattataggcattgagccaccatggctggctggatctatgtattataacttcagttttattttttggtttactttattttttattttattttatttttttgaaacggagtctcacttactctgtagaccaggcaagagttcagtggtgcaatctcagcttactgcaacctctgcttcccaggttcaagtgattctcccacctcagcctcccaaagtgctgggattacaggtgtgagccaccgcgcccagctaattttttgtgtgtgtttttagcatagacgggctttccccaagttggccaaggtggtctcagactcctgacaagtgatccacccacctcggcctcccaaagtgctgggattacaggcgtgagccaccgtgcctagcctatttttttggcttattttaatatctacctgggaagacctttcttcctccttctattaaattaacattatttaatgccaattaagttacatggctcttttcaaagcatggacttgaatagatttaaatatgtaccataaaatggaatacctgattttttaatgggctgtagcattttgtttttatgtaatctaaccttactgaaggatttggaaatgttaacccttttggtgatggcccatattgaaagataagctcattttgcttttgaggaaaaataacaattatttgagaaaggaaaaccacaatttcgatttttcatgcaatcaaaacaggttctaaaatattctttaactggtccatttatttgatagccagtttactgactgaatttaactttttaatttctgtaatggattataatgattttgtgcactattagttaactgaatttctaactagtgtggttaccacattagttattgcaacctcttcatgggtccccttctctcccaagatgcaagtgcaggtatgcaatacatcattttcaataaatggggaatagtagccaatctcttaaaactttgatttagccaagaagaagaaggaggaggaggaggaggagggggagggggaggggagggggagggggaggaggaggaggagaagaaaccctgttgttggttaacaaaattctcatttctgttacctaaataacaagttgcaaatactttgtaacatcaagaagtcatacaatttttcattagaaagagtttcagcaaaaatagcctccagaacttaaaaacaaattcttttttttttcttgagacggagtcttgcactggcacccaggctggagtgcagtggcgcaatctcggctcactgcaagctccgcctcccgggttcacgccatgctcctgcctcagcctcccgagtagctgggactacaggcgcccgccaccatggccaggtaaattttttttgtatttgtagtagagacgggggtttcaccgtgttagccaggatggtctcgatttcctgacctcgtgatccgcccgcctcggcctcccaaagtgctgggattacaggcgtgagccaccgcgcccggccttttgactaaaatgctagattaaattagtgtcaggggtcaatagtttcttcttttccaaattgaaagactacctgctgaaactctctatacccaccttaggtttcccacttgagtaattttaagcaactcttaagtttctacgcttggcaatatttaactatcagagagtggttgtaggaattaaaccccctttaagcaaaccagttgtcttctgggtgtaggttatttccattcaggcttgtttccattggggcttttctagtatatgtagagatacacctgaggcatgatttcttttttatgtggattgtgataagggcctcatttcccagtgaaatttctaaccactctagggggcgagaccactgggcttgctgcttttgttgtgttgaagtacagcaaatgtgatatccttcagcctgggtgtgctttcttatgcttgttaaatacagagtgccagaaaatgtaccctaagcatgacaaaacataatacacaaaagacaagttctgtatccttagcacttttcattctagagtctaatattacaggtagcagtaacagtatcaagttgaccaccaaagacaggtttgatcatcatgaaatgccaagtaagtgagccagtttaaatgaaagtcagggaaggaggtgattcagaggccaagcactggttattcagagcatccaagaaaatttgttggggctagtttattatttttttaattaccttgcctggagtgtgtgatttataatgcaacaagatatagaaagaatggacaaatggacaggggtggtggtgataaaacagaatgcaaagctgcagcacctagacatgaagccatattctcgtcactagcctggaaataatgaactattgagtacatgtctcctttttggccccattctcactattgaaccttatttcccacagggcccagtcaagccaacctcttttacacctactcattccttatctcctttctggtgccatgtcactcctctgttgatggtattgctccctcttttggtcttatatcctgcctgcacacatactaacgctcactgcagctccgttttcagccccctcatgaatgtgttctccaggaatggccgacacatgtcatctcagagcccctctggctctggcattcggattttcccactgtttcttccacttgttttctcacaatattgtgtgatgaatcttaactctctaagtacattgtaagatatgtaagggcaagctgattatgattttatgtaataaaacacattgcacacagcaggtgctcaatgaatatctgacttccaaacattattggagttgttggatctcaaatgattgaccgcctatgttagtgtcaaaggtcttcaatgccgaagtaagatgtgttatcaccactgtcactagagggggattaccttccctcctccccacctctttcccactccctgtttaaatgtgttctttagtatatgctccttcccctaaagcagatcctctcccagagatgcacctcttataatcaaagttttgaagctcacgattgattgtagaactatttcatcatcattagaaatggttaagtgctgccccttttcttctttgtcatttaacaatttaattatgtgtcacttcagcttaggtttgaagcatagtatttttcccataggaggtactcaataaaatctggatggatggatgggcagacggatataagtggggttgtatccattatacctgcaccacagatggccacagacctatgaacatatcatttgctccaaattgtatggtaggtcttcatgacactttcagtgtatccgcatactacttcatttccccttgaaatgaaggacagttgacaaagtggatgtggtgggttggtatttagcaatagtaataatagtttttttagcttacatttgctgagttcttaggtaccaagcactgttctaaatgctttacatatattacttatcttttaaaaccctattattgccaaaagtagaaataacccttgtcctgatatcagttgatgaatggctaaataaaatgtgaaatgtttatacaatggaatattattcagccacaaaaaaggaataaagttataatacatgctacaacatggatgaatctttaaaacgttattctaagtgaaataagccagacataaaaggacaaatattgtgttattcaacttatatgaaatatctagaatttgcatctctatgtgtactcataaagatggtaatttgattataaattaccaaggactttagtgggagggatggcagttattacttaatgggtacagtttccgtttggggagatgaaaaattttggaaatagtggtaatggttgcacaacattgtgaatgtaattaatgccactgaactgtacacttaaaaatggttaaaatggcaaattttgttatatatattataccacagtaaaaaacagttttgcaaaactctattcctaacctaattttaatttgactatatctggaatgtttaaacaaataggagttgtgtatactaacataatgagaagtctaggagggtgctgtggcactggttcagggtcatcctctcctcgaatctcttggctgaccatccacaggcctttcctgagtgcttattatttagcaataacctcctacaatttagaaggaatagagtatatgatggaggaacaagggtcaagtcactgtaacccaagtattctcaatgggaagactggttttggggagaccaaaaatatcttaaatattaaatggtttgtggccctccaaggctcatccctacccaacaaatcttttcccttagtatttaattctctcataagagagtatttaaattaaattcttttttcttttttggagaagagtaatgaaaaaaaattgagaaatacttttgtagcctaaggaagaaggtggagcaagggatatttttcagagaaggtgagaagtactgtttcctaaaatgagatgatacagttctgtagaatatgaatggtgagtgatttttttttttttttttctgagacagggtcttgctctgtcactcaggctggagtgcagtggctccatcatgtctcactgcagcctcaacctcctgggctcaagtgatcctcctacctcctgagtagctgggattgcaggcgcatgacaccacgcccaggtagtttcttttattttttatagagacagggtctgactatgttccctaggctggtcttgaactcctgggctcaagtgatccacctcaacctcccaaagtgctaggattataggcatgagccaccatgcctggcagtgagtgaattttcaaagtcctgctgggtgttttcgttagatgcatccctttagctgttgttaaagtcactattcatcccagtgaattcactttcattctctctgttcatgaatgagatgttcagagaatacttgctttttataaaggatgaagtagacatggacactagatcacttttgagagtaactgtgtctgctttttaaatatcttatctgaaaataactgtactatttagttaagatttctttgagtcactaaatctgtagttgggggttggaagaggggacatgtaattctttctgtaccctatcttttcgacacttttcctaggttttaaaatatatgtgagatgctaacattatggagatacaataatataactcatagctgcattttacatctatgacttcatctggctgtgaaacagatggctcacagaatacagcagccactcttatattgatagttgtggtttaaaaatcattgtaacaactactagcaactactgtatttgctagaaagcacatagtccagactacattttggcctagggaactgttattaattcaaatataggaagagtcactggataattttagaaatattcatagctaagcattggatttttgtcttctctgacactgtaccaaattccataacgaatttcttcttgcttagatgtgactgggacaaagcctccccacatttgacttaattgttgctggtcccaaatatttgactgaaagtctcattaccttttagccatcctcgcaaaaacataattgaatatgtattttcatctctactgaaatatcattttccttcaaatcaactaaatttgcctcttcccccaattcgttgtaggattcattttatcatatatcagcttttttttctctaaactataggaagggaattgtctgatgataaagcggaaagcacaaaagtcatgaaatgctaggctaaggctctcctgtcaataagcacccactatggccctttctgcaaacctcagtacccagttagtgccataactagtcatcgtccatcctttgtaaggaaacagtttctggttccctggcctttgcatgattgtgttcaaatgtttatttcacttttggatatttggctcatttttttctttccaccttatctcctttattctaaggcagggtgaggttggagatgatatatattgaggaagaaaaatagaaaaacatacactctctgaaattccctggaatttaagttagtttcctttagaaccagggataaaactctttgtccagatttatccatcccttttcatttcttaaatatggtaaggaattcttacatctctggtactggcctttggtatccagtaaaataaatggagagacgctcagtaaatgtcttttaagtgagtgtcctaataaatgttccctaaagtgtttatttgagtcccgtgtcttatatcatttgacagaaccacacaatttgggttctgtgaggtggatgctagggtctaggtgagatcgttctggttaggatttcctataggcatgtatcaacagagccaaagcacaattattttctccaataaaatagaacttcatttaagcacataaatacaaacataaaggaacattctgtgtaattaaaagacacaatatagagctcaagctaaagacattcatgtgtctaggtgtagttaaatgcctcactaacattcagccattctcagtcactgtaatccaaacccaatatttccctgggcttaagtagatcctaacttgtatatagaactttctagggcttgtccaattgaagctctgtgggtacatttctagtaagcctttcatttctctctaataacaatgatctttgcccactggttttcaattcaaaaggggaaagaagcctatttgccattccaagactaaagatatatttgctttcctaaagttgttattctctcatctaacttgaaacatacagaaagtctaaaaaaggtgataccactaaacctaatcaaagaggaaattccctgccacttttaaaatccctacatcttctgtatctgctctgaattcagtctgccttataattcaagattcaactagttcaaagaactcactctgtcataacattacatagtattaaagtagaaatatgagatttttttcacagcgtattgtcatgcttatagtacattttatctactggagtaatctaataacttcatactctcttaaacacagcttcttgtaagcacattaaaacctatcctaggaagcccttccaaaggaagtgacagcaaaattccccaaaatgttgcctgcttggaaagttacctaaaagtttagttctgaggaagttgacattgagtgtttcttggtttgtaccgtgctcctctctagaggctgccccgtgtgcatagctggcagagagggacatggacaggcattagaagcagctccagccagtcagaattggaggtcttgatggcattggagctggagttggggggagcagtgagaaaaggaagcagaaactgtggttgatttcatgctcctctggcttgcctctcttaccctaggcacagcccagagatgctctggcaggggtgggaggcagctggatagattaagaaagggcttttgtccctgcgattctctaacagaccatatttgagatgacagatgcaaaataaacaggcatgactttagacaggtccagaatggtcttaatatcctgaagcttattcttattcaaacttcgcgttttaattgtttggaattcttagacagagtaggtggaatttcatcctttgtatgttttaaggagagcttcgctcctctctttaccacccaccccccgccacccagtaaaatactgaactttcattttaatccataacactaaatgcttttgtgtttttctttcttcaaagactgtcattaagaatgtctacaaggaaatcatgggaaatgacaaaatctcccccagattgattttttacgtgttgttggaaataaccacataactaaaaaaaaaaaatgctcattctgggaaaaaaatctgtccaaggatgtggaaaacctcagcattaaaaataatatcctaagtaatccaaaagggaaattaactttcactttgaaggcgttcactagcacaaacactaaaataatgagtaaactgtctctcctgagaaaatgccagctgtcacctgctgcctcccactgggctccaggtctaacaagcctcgctccctgccctaacttgtgactctgtgtcaggagacttttctgaaggacattttttcaagcaattagaaacaatctactgtgggccaggcacggtggctcatgcctataatcccagcactttgggaggccaaggtgagcagatcacctgaggtcaggagttcgagaccagcttggccaacatggtgaaaccctgtctcttccaaacacacacacacacacacacacacacacacacacaaatcagccgggcatggtggtgtgcacctgtagtcccaactacctgggggctgaggcaggaaaatctgttgaacctgggaagaagaggttgcagtgagccaagattgtgccactgcactccagcctgggagacagaacaagactccatctcagaaaaaaaaaaaaaaaaaaaaaggccgggcgcggtggctcacacctgtaatcctaacactttgcgaggccgaagcgggtggatcacctgaggtcaggagttcgagatcagcctggccaacatggtgaaacctcatctctactaaaaatacaaaaaattagcggggcatggtgctgtgcacctgtattgccagttactcgggaggctgaggcaggagaatcacttgaacccgggaggcggaggttgcagtgagccgagatagcgccactgcactccagcctgggtgacaagagcgaaactctgtctcaaaaaaaaaaagaaacaatctattgtgttattaaacaccaacttctcttattgtcaaatcactcagaattggccaatttccctattaagtaaaactgtcattgttattaaaacataatagcaatgcaaggcactgtggagtacagagggtgtttaagttgatgatgcatattttacgaccctgcagaggggcaaacatgttcaggtatccattcacacccacaaacagtgagtagtctcctagggggtgggtttgttgaaaatttcagagatcacctagggtctatgaaatatatcaataatttcacttttaaattgtatagtagatttacaggtatatgtaatataagtaatttaattattcattgtgtataatgtgacacattatcatataaaagctaaaagttagaaaaaacaaaggtcctgagcaatatcttgagtgtataatcatttattggaaaattagaagttgatttgtgaatgccattgtacaggcttgacttgttgaaaccaccctcttccatgttaccctccaccgagattgacatatcttagtgtcttccacacttcacagggtgacacaggttctgccactcaacgctcacttcgaccctcgcccataaaattcctaaacagcttcatctgttagtggttttcaagagtagtagcatatgtggaccatgctgtaataatctccgaaagacagatttgttaaaggttcacaaatgcttaagcacaactatattcaaactaatgttacattagactaaaacaatatctgcttttgagaagtggagctacatgctggaagttttttacgagtagaggctgagctgaaagggatggagaatgaaaactgaacaggagagaaaatcaaaggagaaaaaaaagtaactacattatcttcccttgcatgttaacatggaaataacaaagacactgaaacattcttggagaattttaagaaggggtgtatatggccaagtcacctgaaaagaactttaagaaacatctgtctccaccctcaaccctcaaaacatctaaaattaactttaggacataaacccaattactttaaaaatacgtttcctagacttaagctgtaaagtttaagtgttctcaccacaaaaaaatgttaagtatgtaaggtaatacatatgttaattagctccatgtagccaattcgcagtatatatgtatttcaggacattatattgtacatgataaatttatataatttttgcctgttaaaataaataaccaaaataaaatatatctaagcaaagctaataaaatagaaattaccagatagtatttaagaaaacccaaggtcgctactagtggctatgtataacttcatggagtgctggcatatccaacggtgtgtttgtaatcttttcctctcaggttctctgatagcaagattctctaaattgaaatgactgctttactgattgcctctagttttcccccttgttctccctgaactatattaactttgtgctatgttagtgactgtgtatgttgacagatttcctagagaactgctgatgaatactgcccacaagaaatctcacttttccttttcattgacgtatttgtgtaatttataattctaacccatgagttaattcaatgcagagattatttaaaagactacttgagacatagtgtatagctaatccaggtcctcataatctttaccagaagttatttgctcttgtgcataattgaaaacaaatgttctgtgttgtgtacaattattttgatcttaaaggctatgcttcgtagaaaaagagaaggttaggattctgtagtttcccttagtgctttcaaggtatcttctttatagtcatacttatctatatattaaattataatagtttatatataggcttgagtttatgtatgtatatgattgtacatggatatatgtatctagatttgggaatgcatagacttaaaaataaaattgtagaccttgtcataacttaaaatattacagatggaatttaacataacatgtcttttaaaatcaggtctaaagattattagaaggatttgttgcaaaaactaccggattggacataaaacatggtttccagtcttcctttgttatgaaatgagtgagtcacttagcctatttgggccccagtacttatttttaaattgaaaatacaaaaataattgtagatacttgaccctttaaatgataatgtgctgagaaaacaggcagaatggtcagcacatttattttatttcttgaatttcacagatgaagaatagcactttcacttacagcagcaatggcagacaagacactctgtactcgaaaccaattatatccgaaataaaacattctggtttgctgctggacttcctggaagtgggtaaaaccatctgtaagtccaacctctcctcccctccaaaaaataaaaaggaacaaattgagacaatgttggagcttagagccatgagcagataaatgtcctgagcaagaagcaagggagagaaactgtgattatattgaggggaaatgccaatagaagcactgtaaattgcaaccgggatactgagcttggggtcaacagcaaggaaaaggaactgaatctgagattttgcattaacccaggtccctcaaagagtagtaaatggccccaggttagtagtcctcccacctacttgcagaaacacaccaaatcaccataggaaagaatcttacggatatttcatcagattcccacaatgtataatcagataagtattagttcacaaccaaagacatgaagcgacaagaggaaataagccatctatattagaactgttagacatagaaatgctgtttatgaagtacttaaaaagtaaaatataggatcaaaatagtgagcaaacaacagaaaattatcaggaataatcaggcaattcttacaaataacacaatggaatgtctacataaaatacgtaaacattgaaagaaaacacaagacatgttaaaaagcagactagccacagatgaaaagagaattaatgaatttgtaggttgaagtgaataaattaaccagaatataatcttgaaagaaaaagggccagaagaagttagaataatttaaaatgttgaggataaaataagaaggtctaacataagtcaaatcagagtcgcagaagaaaagaattaagtcaaccaagaagtgataataaaattaatcaaggagaagtgttcagaaatgctgaaagctgtgaatccccagtttcataaaggacagtattcccaagcaagacgaaaaagaaaaccaatagctggcatagtggtggctctctagagaaacaaggcaaaaatgtttaaaagagccagagagtaaagacacatcacataccaagaaatgatcatttcattggcagcagagtgctcaacagtgataccagaaaacagaaagcagtggaataataaagtgttgagagcaaatagctattatctatcaatcatgagagtaaaaggcatttgccgttaaacaaaaatggagaatttaccatcggtagactcacactgtattaatagtctgttctcatgctgctaataaagacatacctgagactgagtattctataaagaaaaagaggtttcatggacttgcagttccacgtggctggggaggcctcacaatcatggcagaaggcgaaggaggagcaaaggcatgtctcacatggcagcagtcaagaggatgtgtgcaggggaactgcctttataaaaccatcagatcttgtgagacttattcactatcatgagaaaagcacaggaacaacctgcctccatgattcaattatctcccactgggtccctcccatgacatgtaggaattataggagctacagttcaagatgagatttggatgggaacacagccaaactgtatcaaacactaaaggttattccttaggaagatggtattttggggctgggcacagtggctcacgcctgtaatcccagcactttgggaggctgaggcgggtggatcacttgaggtcagaagttcaagaccagtctggccaacatgatgaaaccctgtctctactaaaaatacaaaaattagccgggtatggtagcatatgcctgtaatcccagctactcgggaggctgaggcaggagaatctcttgaacttgggaggtggaggttgcagtgagctgagatcgcaccactgcactccagtctgggcaaaaagagcgagactccatctcagaaaaaataaaataaaaagaaagattatatttttgacaaaaattcagttaaggtaaaagtcaatagcaaaattatatttttacagtcctcacatctttggaaatagaatacttaattattcattgctcaattaagaaatcataatgaatttttaaaaatacttaaagccaaattgtaatgaaaatgtaacatgtcaaaaccagtatttttgagggcagtctatcaaccataaatacatacattagaaagaaagaagtctgaaaatgaactaagcaccatcataagtatttggaaaagaataaaaaaaataaaaaggaagcagaatcccctaagttgaaaatgatattacaaaagaaaaaattatgaagataaaatttagctttttgaaaagactcataaaatagacaatcttttgctaagactgagaaaagagtacacataatgtaaggattaagagagaatataaatatagctatagcacagattgaaaagaaaatacgatgggcaatgttaagccaataaattgaaggtgaagtgaaataatctttagaaaaatagaatttaccaaagctgaattaggaattaagaaactttaatgattctataacttttttttttttttttaagacagagtctcgctctgtcacccaggcaggagtgcagtggcgcaatctcagctcactgcaacctccacctcctgggttcaagcgattctcctgcctcagcctcctgagtagttgggattgcagatgcatgccaccacgcccagctaattttttatttttagtagagacagggttttaccacgttgataaggctggtctcaaactcctgacctcatggtccacccgcctcggcctcccaaagtgctgggattacaggcatgagccaccactcccggccgattctataactagtaaagcaactgaattagtagttcaaaatttcctacaggaaagaccaaaccatttaattttacaggtggaattactaagcattcaagagttaatttctatcttttacaaacttatacagcaaaatggaaaagaacaaatactctctaaatcattccatataacctggacaccaaaaatagacaaatacagtttaaaaaaataaattataggccaatctcactcaagaccctaaataaattataccaaatggaatacagtggagttaaagacaaaaaaaggtgtatttatcatgaccaacttggctttatcccaggaatgcaagggtagtttaacatttagaaatctagaattgtgatttacataatagattaaaaggggaaacccatatataatctcaataggaacagaaaaactttggataaagttaaccactgatttagtataaaaagtcttagcaaagtatgagtaaaagagaattctctttacatgaatgatgttatcagccaaaacctcagtaaacatcattcttgatgaaaatctaaaaacattccatgtaaaatcacaaatgggatacgtttgctcactatcatgtttttaatcacaattaaaaccgaagcttctagccagataataacatgaggaaaataaataaaggcataatgattagaaaggtgcaaataattcttctatgccaagtttgctttaaaaaaaagaaagaaagaaaggaacaaacaaacccataaatatttgcagataatatgataatatacaaagaaaatcacaaagaatctaaaactaacgtgatagtaattaacttagtaaggtgtcaggcctaaaacccatatacagaaattagttgcctatttttgtgtttgttatgttttattttatattttgtttgctgtttgctttgggtaatagtttcagaataagtaggaagcaggaggtcagggagacatactgagttgctgagacatctgcagaaacagcacagagactgggaaactgttctcccagtttgcttggtactgagggtttcataggatgcaggactttcaggttcaataccatgactatcccagtctgcctgggactgaggggctcccaggatgcaggactgtcagtgctaagaccagaagagtcctgcacaaaccaggaggaggtggttactctgtgggagaactgtaagtagtccagtgtcattgcaacttaaaatgcagggcaggaagtggtgacagacaagactggggagaaaagcagggaccagatcacaaagggcctgatgttccatactaaaggaacttgtaccttgttctccaggcagcggcaagctgttgaaaggttttaagtggggagatatgtgacggtgacagtttgcattttagttagaccacttcagtagtagtctagaggctggatttgaaggggctcaggctggaggtaggaggtggttgctatagtccaagtaaagatgatgaaggcccacactaaggggcggtagggatggagtggaggggacagtcccagggactacttaagaggcaaaatttgtagagtgactgactggatgtgggagtgatagacaagagttgacaatgatctctgcccttcagaaaaatgttagacaacatgttggctaaatgaaaatacaggctgggcatggtagctcctgcctgtaatcccagcgctttgggaggccaaggcggtcagttcatctgaggtcagaagttcaagatcagcctggccagcatggtgaaccctgtctctactgaaaatacaaaaattagccgggcatgatggcacatacctgtaatcccagccactcagaaagctgaggcaggagaatcgcttgaacctgggaggtggaggttgcagtgagccgagatcgtgccactgcactccagtctgggtgacagtgagactgtatctcaaaaaaaaaagacagaaaatatagaaagagaaatataaccaacactcatatgtgcatcatccagtttaaggaataaaatattaaagataccattgtatccccctgcatatacctgatcccactcccctgataccacttccccttcccttcccagaagtaacccctacattacactgatacttctaatcgccatgactttctataaaattctgctacagagatgtacattgctaaacaacctatactaattgcaacgttttgcatttttctaaacttcatagaaattataagtattagtctgtaacatgcagtcttctctcaccattgtatatgagatacagcccctgcacaagagttctctgaaaaggaatgtggaagaaagagactatattccagtgaacagtttgcaaactagggagatgcaaccttcagtgtaaaatgaaggtgcattccccaactgcttttctaaacagtggtcatggacagttttaaaatgtaatataaaaaaggtaaagtttatagttacaacaaaaatgtacacatcagttgagaaaaaccaatagaaaatgatcaaaacacggtaacaggcatatcaaaggagaaaagtgaatggacagtatataaaaggatgctcattctcatcagtaataaaggaaatacaaattaaaactgaagtgaagcaccatttttatacccagaattggcaaaaattaagaaattggacaatgtcaagtgttggaaaggatgggggttaacaagatctcttatatacctttgtcgggaaggtaaacttgtataattgcttcagaaaacaatttggccttatccaataaatttgagaatgaatgtaacttactcctagatatatatcctagagaaactattacccatggttacctaggaacttgttcagagcagcacaattcacaaaagaaaaaataactggaaatgactgaaatctccatcctttgacaggagactaaataaattgtagaatatttacttggtggaatattatacagtagtaaaaatgaatgtttttgatgaatggataagcaatatgtggtgtagccatacagtagaatcatattcagcaataaaaactaatgaagtacagtcatgtgctacatagtgacgtttctgtcacaatggaccacatatacaacagtggtccgggaggattatagtaccatacttttactgtaccttttctatgtttagatacacaaatacttaccattgtgttacagttgcctacaatattcagtacagtaatatgctatacaggtttgtagcctaggagcaaataggctataccatatagcctacatgtgtagtaggctataccatctaggtttttgtaagtatactctgtgatgtttgcacaacaatgaaattgcctaacaatttatttctcagaacatatccttgttcttaagtgatgcatgattgtactgatacatgctgcagcatggaagaacctcaaaatgttattttaaatgaaagaaaatcacatattgaatgattccatttatatgaaatgcctaaaagaggcaaatcaataaagacagaaagtcaggccaggggatagggaaggaggggagagggatactgggaatgactgccaattggcacaagatttcttttgggggtgatgaaaatactctgaaggtagaagatggtgatgaatacacaactctgtatatacactgaaagccattaaaatagatacttgaaacaggtgaacttgatgatttaaattatgtatcagtaatgctattaaaagtgagtactctatagtaacacaatgcaacatgagtctgtaaaaatttaaatagtaagttgaatgaaaaaagttccaaaagacaatatatggtattataccatttctgtataacttaaaaataagcaaaatgaaataatattgtatattttttaggaatacatacttacatgacaaaaccatatggatattgaaaggaaggataaccatacaggaaagttgctgcctcagggggcgaagaggcacatgggacagaggaggaatccacaggtagatgcagtgctattggggattcttttagttcttcagttgagtaattatttaaaagctgaaatcttattttgattataatttacatattttatatttaatcttgtataggtatcaaatatattacatttgagataataaagggaaatgctttaaaaataatagtagtatgggtatactagcaaaaaacaagtcacttatgaaagagaaaataagattgaccccagatgtctccacaccatcttccaagccaaagacaatgcagcagtatctacaaagttatgaggaagacagtgaatggctttaaaattttaagcccaaattatcctcctaaggataaatgcaacagatggatagtaagcattaaagaatgtaaagaaataagaatccatgagccttttatagaataaaaataagtaaatttaaaacttttgtataataaaatctaggcaactaagtagacgaatcaaagagtataaaaatggagaagccaggcacagagaagttagatgatgaacaccaaattatttaaaatagaaatgaagagtaaacagtggtttgaattacggtttcagaacaagatgtaaatgttaaaaccccagatgttatgaagaataatataaccaataaaatgcatttggaagagggagagaggaggaagaaagtgaaatgatgtctcttttatcaaatttcataaggaggttgtcagatattgtaaaaaattgaaatataatttttaaaatatgttgattggttttgcagcagatatactaaaattggaatgatacagagaagaccagcatagctcctgcacacacagggtgatacacaaatttgtgaaatatatttttcatttaaaatgaattaatcttttccccctctaaaatgtcatagaaatagtaagtgcagtaggatataactatcagttgccaatcctaaattttcatattcaatatctaatagatacgttgcaaattttgtaatttaagatttgtttatagatgtgcatatatttacagtatgaactttaaaatcatttaaaaatgaatggtggtaaaatctgtgaattatgtgaaataactgtaatgtacatatatttttattctaataaacttttgaatcctagattggattttattagaaaaaataaaaataaaacatacattgactcttccccagagtcactgggggagctattgacatttcggttgggtatgttttgatgtcaggtctgtcaggtacataataagatgtttgacatctctggagaatgccaggatcctcataattgtgacaaccaaaaacatgtccatgcatttctagatgcaccctagggaattggcactgccatggattgagaaccactgctctaacttcttacaggttttcacatctgtcctattacatttagagcaatgttagagaattaaaatctcttaaaatctcaaaagggaatcatttacctgaaattcgttcagcttcatgttggtgtccttttctcctattaaactaaaataaaaaataaacttaatacagaataagcctgtttatagaatgcaacaattttcattaataaaaaagtatttgttgaaacaaggaatctgaaaaaatacacagttactttgcgtatttttattgtgataatatatgtgtaacacacaatttaccattttaaccattttaaccatttcaaagtatacagttccatgggattacttacattcacattgttgtgcaatcatcaccactttccatctccagcactttttcatcttccctgatatggtttggctgtgtcccccacccaaatctcaccttgaattgtaataaaccccatgtttcaagggcggggccaggtggagataattgaatcatgggagctgttccctcatactgttctcatggtagtgaataagtctcatgagatctgatggttttataaatgggagttcccctgcacaagctttcttgcctgctgccatgtaagacatgacttagctcttcctttgcctgccgccatgattgtgaggccttcccagtcatgtggaactgtgagtcaattaaacctctttcctttgtaaattacccagtcttggctatgtctttattagcagtgtgaaaacagagtaatacattccccaatggcatatttaacatgaattatatatagtcatttgccatttgccaatcttttaatttggggccaagatcttttctttgagagtggtcccctgattggaattccccctcaccatcttttttgcatgaattacctaccactctctaagattatcagttttcaatttttaaaaaatgaaacaagacacttggaaaggaactgagtgtagaatcctcctagattcccccaaccccctatgtgtcatgcatcatgctcacagctattttgaaagcaaactaaaaaaaaaaaaaattgagaaggattctcgctgtgttgcccaggctggtctcaaacttctgggctcaagcaatcctcctgccttggcctcccaaaatgctgggattataggcatgagccactgcacccaccccgaaagcaaatttttaatcaccctatatttatccagtctttctaacatactcaatctagtttgtatggaaacaaaaatttgttctttttgcatttatattttgtcagttttcttaacatttatttaaattatataattaaaaaaagtttgggttcaaacacccaaattgaatcatggaaaacttccagctgaactggtggggacagaagtatagggcatctaaagagctatctgcttgcacatttaaagtgaagggtgacacggcatgatctggcaagtcagatattatattaacataatagattgaaaatagtatgtatacttgggatggttaattttatgtgtcagtttagctaggccacggggtgcccagatatttggttaaacgttaatcttctgtgtctgtgacagtgttttttgatgaggttaatgcttgaataggcagactgagtaaagcaaactgccttccataatatgggtgggcctcatcctatcctttgaagacaacatgaataaaacaaaaagactccgtaagggggaactcctcctgcctgactgctttgagatgggacaccagtttctttctggcttttggacttgaaactgaaacattggctgtttttttagtctccagcctgctaagtttcagattggaaatacatgtcaccttccctgggtctccagcttgccaactgcagatcttgggatttcttggcctccataattgcatgagccaattccttataataaatctcttttaggatctctctagtaggataaattggtatattgttgtttttttttttttttaccttaagaaaaaccaatagcttaatttttcctcgatatatatttagaaaattggtctgagaagagttttcatgaaacagaccagagaactatgtataaaattaagagttctaacccagtaagaaaaagtgcaaaaatgaagcacacattcccaggggccactgcagcctaggaccctcccatcagagggaaggcaaggtctttgatggcttttgagttcagctgagggatcatgctgatcttcaggaatttgttgcttgcatacttattcttgatggcgatgaatttagttaagttttcatttactttcagcacatttttggccacgtgctgcatgacttccaatacttcattctgtgtgtatcctgtataacactgctgctttaagttccattttccttggcccagaaccttctgagacaagcaggaagcagctgttgctgccttagaaggatgataatgcatcatatcgtagtcaatgagagtcagctccatcaaatatttggctaaagtgtgctgttcaacatcagccttcccggcttttgatgcttgccttaagaagtgtagtggcaagggtccacccacctcaaatttcagttctttcaaaattagtttccatttcttggatttggaaactagtataagcattgtctgtgatgtaaacaaagccttcagtatttggagaaaacatctcctcatacttggaagccaagagcagagcagtaatccaaactagttgaagcttcctctgggaaactggctgaaccagtaaagatcaatccataatggcaacacacacatacagagtctcctgaagaagcctaaacttggagtggatttgcaccaaccagtctaccaggatggtatgcttatgtccatttacatctcatccacctaagacatgtgggtttatgaactgcaaaatctccagctgcctgaggtactgatagatacccttaaatagtcactgcagagctgagggttattccaatctttgttatcaatatcctcaattttgtagagcaaagcatcagaaaaagctcggcagatgttctcttctttcacggaggcatcctcaggtatgggagaaggaccctttggagccaacatttccatctgtactgtttcacagaagcagtaggtttcagttgtttgttgacatttgttgtttccctgggttgaactggcactttggtgttctgagctttcttagctacttgtgctgctctggctgtaactctatttccaatttattctaaaatggaatgcctaatagtcacatgactcttaggtttagaattaactcctgtctctctgtctctgcatatacccatttaccctattggttctgtctctttggagagtcctaatagaatacctgacaactaaatgcaatgtggatcttgggacagaaagaggacattagtagaaaaactggtgaaatttaaaaagagcctggaatttagttaatagtaatgtaccagtgttggtttcttagttgtaacaaatgtaccatagtaatgtaagatgttagcaatagaggaagttggttgagagctctagaacgctctgtattatctttgcaacctttccataaacctaaaattattcaaaaataaaaattttgttttaaaaaatagcatgtaccatacaatctctctctctgaaactgctcctaattgtctagctttctatttgtatttatggattctattcaccaaatgttagtaatctttactttgggaagtaatttacttctttctttgtgcttttctgtattgtttgaattttaaaaatatatatatatatatattactaaaatagtgaagtcattttttaaaacattggaggctgttttgaaaagatgacttctaaaaatcttccagaaaactctatgatctttgatttggtgttatttttttaatagcactgtctcacctataacattctccttaggcacccaaaaatgattttatgatgaggctccaagattgatactctgtggcaggacttgaaaaatgaccaggttgtgttaccataagaacatgttcctgttttgttttgttttcttttttatttttctagttcattaaggctgctataacagaataccataaacgacagaaatttatttcttacagttctggaggctgggaaggccaacatcaaggcaccagcagattcagtgtctggtgagggcctgttccctggtttatagatagctgcattctcacccttacatggtggaaggggcaaatgaattatctggggtctcttattcataaggacactaatccccttcatgagggctcttacctcatggcctaatcacctctcaaaggccatgtctcctgataccatcacattgtgggttaggatttcaacataagaatggggttgggtggggaagcaaacattctttaaatagcaccgacccatacatagcttaatggtttatgtcagtgtgttactatagctatttgctggcgataagcatcgtaaggaaatgaaaggcttttggttgcaattctcctgtggttctgtccagtgaagcaatgagtcagggatttttatctccaaatcaaagcagagctcaccttttagtaattggaggaattaaaagaacaaatttcctaaatgttctatgttctagtacaaataaaattttttaatactctgtttatcctcatatcttctattttctttgttctcttcatcttgtctctatgtctcctgatgtccaacctctctcttttgatccttttttcttttgagtcagggtctcactctgtcacccaggctggagtgcagtgacgacatgatggcttactgtgacctcaacctcctggactcaagccatcctcccacctcagcctcccaagcagctggtaccacaggcacacaccactaagcccagctaatttttttattttttgtagagacattgttctgccctgttgcccaggctggtccagaactcctctaggctcaaatgattctcctgtcttggcctcccaaagtgctgtggttacaggaatgagacactgcgcccagcctcctttgacttaaaatattaggtctattgtaaattctcaagggagccatttttttctttttccactctaatactgtgaattctttgcggatggagagactgttctcttcatttctgtttcccttcacctagcacagtcctcacccatcaaatcatggaggattgtagccacagctgcaaatggaaccctggagttttccagttcctcctactcattcaagttctatgtctcccttcttccctttgtttttctttctcaggtcctttttcttcttgtaatgtagttataggcttatcgcctgtattctgtgccttctgaatgtccaggctctaaggtcattctgctgattatatgaggccaggtcttccctttaacttgtgcttctgtaaggtaataatctaagctataccagtggttcttaaactctagcaggcattagaatcacctggagagcttgctaaaacagactgctgggcccactcctagagtttcttaattagtaggtctgggatggcactggagaatttgcatttttaacaagtttctagtagatgctgatgcaaatactgatgctgctagtccagggactacacttcgtacatcgtggatctacattctacagaatcattggctgggctagctcctcctttgcaaggaggcaaaaagaaatgcagatgttcagtgtctagaacttatccataaagtaaaaataataggaagaatatacatgttttattttaaacccaagatataaaggcgttttttcccttataatgattattcttcaaatcatctctatacaccataagtaaagttaaaagtgctaaaggaggaaaaactattgatatttctatcagaacacataaaaaggttaattatggcatgcacgtcttaaagatctccttgccatctgagccatctccagaaatacttgccatagaacagaaatagaaatgattatatgagtaaattatcacccacactcctcgcatgcatcatttcataccacaagccttttctcttttcaaggaataatggttttacattttactttgtgatggcactctaattgctaaatataataggggcattatgctacaaagttaaaagactccaagtgaaaagataagtcaaatatagtaatttcacacagccaatgattcttcaaagtatgcttctctttttttccagctgtctcccaattgtgaactctcacagactcatgaaaattgaatactaaggcagagaaaagctaacagggatcctagaatatttctagtccaggagtctgtaactatgatctactggccaaatctggcccaccacctgttttcataaataaaattttattggaaaataggcatgcccatttttattgagaaacagccgtacccgttgtttacatattctgtgtggctgctttcgcactataataacagagttaaatagttgcaacacagaccatgtggtccaaagctgaaaatatttactatcttgacctttaccaaaaaagtttactgactcctgctgtagttccagctactcactggacagattagaaacctgtctagagggagagagttggggagggcaggagagaatggagggagaggtagctcaggtttccacattcaaatagaaacaggattgcagaatgtgaggcttctccctaagcaactcctgtaagagctttggtccactgaaagccagtcacagctgcccttcatgtattagtagagaaggggacactggagtaagtttgtatctcgttataattttcaaagaacctcttcaaatgtccaccccaaaaagaagagcagtgagacagaagtgtgctttgatgttagtccaaagtgttatttatggcatttatttgcacacgtatacaaaaacacattagcagcctaacctttggggctcatttctaataatgaaaaagtcctttttcattgatgaggaaatcattaggatcatcttgtctttcagaaagtatactagcattctgtcatgtagtattctccatagtgcccaaagctttcaggagaatatgccttatagtgggaattcttatttcttcaagttattagtcactaaattgacaaaagtatgtgagtgtgtgtgtgtgtatgtttacattgctattttacataatttatatatccacgtctaaaataaaatgatatagtggtgctaggtgttccctaatctctctcatttatatgttaaaaatatatctattctgtaaatgaacagaagccccaattccatggtttcaggtaagtgcaaagatatttacaatgagttaaaatggagtattgtcacaaaaaaggaccgttattttatttggtcattcatcagttctttattgggtacctcttctgtgccaggaacccactgtactgacatgatacgcaccaagaggctaagaggatctcgtaatctgatggggtgatgggggaggtcacatgcaatacaatgtctgcaagttctgccttggagagagccctggaagagacatttgagtgaagtccaaaagatgaataagggcttgccatgcagatatgcacatgctagggaaatgaaattcacttttaatgttaattctcctgggagatgttcttgactccttagtccaaaccccttaatatccctattctgtgttcctatagcatctatctatcacaggacttttctgtctgcctggcattcagtaggtgtttagcaaatgaatgaataataagtgagtgagtgaacacatggagtgagtgaattatgagtatacaaaagtcagaggtgtgaaccactatggcctattcttggaactgcatatatggctagaagatagggcatggggaaggagggacagatgtaccgggatatgaggctggagaggtaggtcagggtaagattgtggaggaccctatatgccaatctaagaattgaattgtatttattatttcagcaatttcatgttggcccccattctgtgccaatcctgtgttaggctctggagacacaagattcagcccttccccttgtagaccttactgtttcactgaagctacatatatatatatatatatatatatatatatatatatatatatatatatatatatattttgtttgtttgtttgtttgtttcagagacagagtttcgctcttgttgcccaggctggagtgcaatggtgtgatcttggctcaccacaacctctgcctcctgggttcaagtgattctcctgcctcaccctcccgagtagctgggattacaggcatgcgccaccatgcccggctaattttgtatttttagtagagacgaggtttctccatgttggtcaggctggtctcaaactcccgacctcaggtgatctgcccgcctcagcctcccaaagtgctgggattaaaggcatgagccacggcgcctggccactgaagcaatattaattgtggataggatatgggccctggatgtagactgcctgggttttagttttaatttactccatactagctgtgtggccttcaatttctcaatgcttcggtttccttatctttaaaattggagtaataatagaacctacctcatagttactgttgtgattaaaatgagataatatgtgtgaaacttcctggcacatagaaagtacccaacaaatattaagcactctttttactggggaaaatggacattaaacaagtaattaaaagtgtgatggggaattgcagaagatgaggcccatagtgcaaagacaatgtaatggtggcaggtggtggtgtgctgtggaaatgatctggagattcaaagaagtactctctaatggaagaatgggtggaaatgagactggaaaggaggcagcagccagctcatggagagggtcagggtcagattttggacttcattccagggtcattgagagccactgaagagattaagcatgggtatgacaaaatcagagttgtgaatttttttgtttttgagacaggatctctttctgccacccatgctggagtgcattggcatgattaaagttctctgtagccttgatctcctgggctcaagcagtcctcctgcgtcagccacttaagtagctgggacttcaggtgcatgccactgcacttggctaatttttttatttttttggagagatgatatcttgctgtgttgctcaggctggtcttgaactcctgagctcaagcaatcctcctgccttgaccttccagagtgctagaattacagatgtgagccaccatgcttggcccagagttgtgctgttaatagatgaagagaagtggacagatgtaagagattgcaggaatcgaattgacaggaattggtgattgattgactataagatgagaggggaaaaaaaagaatgtaagatgactcccaaatttctggattgagccattgaattaatagtgtgccatttactcaggatctatgaaaggaggagcagactttcaggggccgttgaagttgaactgccagtgcagacggtgatggagcttagaatataaatgggcatggaacctggatgtggatgagattgtcaaggaaaacatttaacaagaaaagacaaccaagatggaattccgggtgtagaagaaaaccccagagtagactgagcaggagtactcaaagaagttggttaaaaactaggagatggtgatatgacagaaaccaagggaggagaaaggagggcatggtcaacattatccaatgctgcttcattttttaataaggattaaaaatcgcccactggatttggcaattagatctcttatcagggtcatttaaaactcttctagatcctgaacacagtggtttctgaggatccaaccacatattacagcaaacattaaaatgcaccaaactccatattaaatttatgtcataaaaatttaggagattaacctttttccctttgaaattattacaaattaaaatgttctattttcttctgtatttgagtcagtcaatttttaatttttctaaaatgtttttctaaacattttttttcaaacattttataggttcttgaaaatgtggaggacctaggctgtcataaatagtgaccatattcaggctgggcacggtggctcatgcctttaatcccagcactttgggaggccaaggtgggcagatcgcttgaggtcaggagttcgagaccagtctggtcaacatggtgaaaccttgtctctactaagaatacaaaaaattagccaggcgtagtgggggctgcctgtaactccagctactcgggaggctgtctggagaatctcttgaacccaggaagaacagcctgcagtgagccgagatcacaccactgcactacagcctgggcaatagagccagactctgtctcaaaaataaaataaacaaaacagatagacccacattcagagaaggctacaggggccatggagtgaatgagtgatggagccaagacagttaagtatgaacttctctttcccagacatagcaaagaaaggaaagaaagagatggagagagcaaagaaggccgtaaaatccaggtagaacatgatttatttaagattggagtttttcacatggcttagaagaaaaatgtagcaaaaaaaattgatgactcaggagggagtagtaatatttgatcaaaatgctgcttaaggagacaagaagaacagatccagaacataggtaggattcaccttctttaatgtccctctttgtctgaatccagatggaaggaggtgtaagaacaggtggtggataggtgctcacatcctatagctatcattaataatgaaatgttaaaatcacaactctctcaagtaactgccaccaccatttggcattgttcttctaaagatcggagactacaataatggcagcaaaaggtcccagcagttaacaactctgtttcataaataatttcaaactactctgtgatgcagagtgctgtgtagatgcctgttggggtttggcccctgattcctttatgagccaagaagagtcaatgtactctctctataatagatgttggcagtaaaatgcccacctgtgtcaagcaaattgatttgtcaaaagcaccatctgataaatttgtcgatttacagagaaggcaggagctttatgggaagtgcattaactctttggggcccttggggcaacagaactaaatcattgctgcagtactaaatgatttctctaatggccccaaaagtaaatgcgtcccccaaaatctcagatgttcccaggtggtcattcaccctctgagacttaaaatgattacaaatacttttcaagagctatatcggtggcccagttctcactttgcagataggggaactgaagttcattctaggccagttagtaacagtttagagtagatactagccagcttaagtggccagctaataattagcattgctgctctgacaccaatagatattccagtgatcatctcagtaaatatttgtcatttgaagtgtaactgctcacagtaaaaatactccatattcattcccacagagtagacaattagctccaataagattgacttattgaatgtccttttgcaaaaattttattttagttgtggctttttttgttgttgttagatggttgtcaattgtagaaatagaaatgaaaactcaataaagaagataggaaaactttgtgatagatgctggaagtaggtctcaaatttcatgagcaagtttattaagctcatacactgaagacattgggtcatctttggaggtgttgcttaacaagccatgagtgtttcagagctgaagggggccttgaaagccttaactcaagagtgcttattttacaaatgaaaaaattgtctctaaagtggcccagccaggccttttgccttaagcttgcaaagtgagaaaacctgtttacataaagacaacacagaatgggggtcagggactcccaagacttgaagactagtggccacagaaagggggagaaagcattgtacatggttattattattatccagattgattgtaaaaaggcccaccaattcttgggcctcttccctcaaaaggaaaagacaacacatacacacacatgcacacatacacacacacacacacactcacctacacacataaagcaaaattagttaccaaatgataagcatgtaaaacttgaggcaaagaagttctattctgggcttatccacctctaacctcaaagcttacttgcatggctaacagcttttaggaacttcatgaccagatactcaattgtaaatttctctagaaagaaaaaaataaaagctacaataacaaaatgtactctgtaagcacagttgaaccttgaatatttttgatgttgcttcccagtgtattatgaatgtgttattataaggtttacatagaagagcaatgatctgtgtaatttcttgcctaaaatggtagtcttttggtcagttgaccaagaatgagaacagcttagggttctgggattgcatggaatgagacattggttttgtttgtttcgttttatcttgtcattggcgattagatttaggacataagtgccaaaataggccattttaatcaacattgggacttccctgttaaaatcttggctgagttcagtgagtttcacaaacacataaaaagcaagcttaaatactggcagagggtggcctgaaaaggaaattcagctttcttgctgaatattattattaatcaaaataagtataaggatcaaataattataattgcattaaactctttggggacttgagacttctgtcatttctataaactaagaatagctattattgaattcacttatgaatcacaattccttacacttatttgtcatcttacacatcacaaaatgctttcacctgttatgatttggtttgatgttcacagtgcaaatgtgcaggacaggtattattagccccgtttaatagatgagtgagttgaacttacgaatggtcaagagctctttccataggcaacattgcctctaagatcctcttagctgtccctttgtgatgaataatcacttctttgctcaaggaagaactaggccttcaaaggttgctgtcattttatataaatgttgactgaaggtgtgcacaacctgacctggaaatacaagaagtatgtcattgacatatctttatgatattcaagcaggttaccttttttctaccaataataattgaaataaattaaagagagtacagattaaacatatgttttcaattgatggtgggaatgtaaagaggctcttaatgaatttgttaacggctgtttccattttgctcaatgctcggttatcaatgccaatgagttttggactttgatcataataacatttacctgtttctttaaaagctgttttttttttcatactgaaggttaccctagttgcatagtgcacttttgccagcctgatgacgcttctgaatgcctccagaccagtgctccctaagaatctgtaaactattcttttcatgccagctgttgtgctccttttattcccccaatttgcatatggtgctttactgaacaagagagtttttctttcggtttcacccaatgcaggtgtgcagtcattctgtgagagcttttgtaattggctatgtaaattatctctcaggtccaagggccaaaaatatagtttttcataaagacaataaaaaaccacaatatttatattttattttttttcagtcttctgagaaaatctttctgccagtagcaacatcacaaacggcatcagtcattgtgggaagagttggcaattatttttctagctggtgtaggttcgtagaaaacaaaaattttcaaaaaccataaatacgtaataaaatgtattggcttactttgctttctggaaaagcccaccaaaatttcttttttgtatttacttttaaaatcttcccagatacttaagaattcctggactctatatcctctcagccactgttttttattttctcctgcagtcattttctataatatgcacttatctcagactcagaacaccaaactgaaataggtggaaaatttttcttttttcctcagttatatttatgtgtacggatgctaattggggtaaaatgaaggtactgtgaatcttcagacattatagaagatctgggcttgtcaaaatttaagtgcccttaacctttattaagtattgtaaccagaagtcctacagatatataaaaggtcaaatatttatcatgtgtacaaatctgaccccaataataatagattatttatcctacagctcttttaaaatgtcaaaaatcatatcacatctcatataaagaaaatatgtgattttcatgaaaactaatttcattaattattcagatgtcactagccaccaaattttagatgattttggacttaattccttctcaataaacataaaataaattaaacttttattgatatgaactattgctttactccaaattttcacagtccttaaataaaaatataaagcaggaactcagacattttcgccaaatggctcctttcacccttaagctttgttcaaagttttggccaattctatgaaagccccaaaaaataaaaaataaaaactttctctgctctgtccttaaaaacttagtttccaagttaaagtttataatcacgttaaagtcacttgacttttaatgtttacattttatagaaagaaaaaggagtatttgagttggcttctagtaggttccaaatgaggcagagtagagccttaaatttcttgtaatgatcagaaggcaatgcatcctttttattatgtggtaatctgttggctgagttcagattgccaacctctctgtaccctgctttggttgactagttggctcactcctctggatgttacataatagcctgtgctggtagagaaggggactcagacaccaactttaggctcagactgacttgagagagccatagtctcaattggctttgcagaaaaaaagtcatgttgtaccatagacatgagcagtttttctaaattctgtcattttaaatatgtcttctggtcacttctcttagttctctattgatcaggccactggagaaacataaggatttttacaaagtgtttgtctttccaggagaccgcattccggatatgaaagtatctaatccccacacactttcctaaagatggtgctaagtcatcttccctcactcattcttgctggagctcactcccatgttccttttgtaggtggcatctatttcttatccactgtaaattgtgccaacctgctttcttcagcagattgttggtgctaaataaatggtgtgatttgtagtaataatggtgatgataatgactcttaaaacacctaactaatcccagtgaactctcagtgatgtttaggctgtggaacacatggttgactaacagtgataatgactgaaaacgaggtgataaattgctatgcagattgttgatggcctataattgccttaaaagggggatattttataacagactaatcccatttaaataaatgtgtgtgtagcattttagatatataggactgtatctgtattttttaataataaccagctccctaaaatacaagatgcaaaacaacttagataaacactccttaggtcaagggccatgggaggtaagaattaaggttgtgtttgctctttcttgagtgttgcattgttcctgggtcggtaagcataactttagagactccaccaatataaacacgaaactacctagttatgagcctgtgtttacacagtccggatcaaaagcacagacactcaggttcatttgcatttgctgccaaaaatgtcctaattcttcttttgaaaaggagcaataattcatattttgatgccatttactcccaaggttaatttatatttacaaattttataacaggcctcatgttctttaccatgttgccagcactttcttttcttttgagttgcattgttcttttctaaggaactgattgtgtggcagatcgtcggatcattgcagggagcacagatgaaaagcctgttattccaaaggattaaattgcaattcttagtgaaccattgccaagcgattttttttttttttttttttttttacaaacccgaggaggattggaaataggaaatgttatgccttgaaaaggggtgggaatggttgaatggatgaggaaggacaatcatcctagtaagtgttattaaattctcttcaagtaaaatcatggagcaaataaatgataaaatctgtaaaatatccaaatggtcaggaataataagtaactgagtttgtaaagaagtaataatatcatgggatagattttgattgaatctatcccatgattcagtaaaaatttactcctgatttttattgaatgtagcatgtagcattaatacacaaaaataattaaaattccagctttactttagcattttcagggttcaaggactatgggggcagaggacctaagatttgcaaatcacttcaatacgacctctttggggaaggatagaatgtagtaggaaaaaaacaatgaaagggaatctctatcttggagcatgataactgagcacattccccaaaatctgacctgaaattaggaagagaaattagttccgtttgaggttctaaacaccaggaaagtttcatataacctgagaggggacaggataagtaaattttggaaagaaaacaccataaagaagagatgtttcaaaattcaattctgaaatatgttaatgaactcagaggaagataaaggatttaaatgcccaatgtaatggagaaattagagtaaggaggaaagaaactgacaatttaccgtgtgctctttgcaacaggcagcctacaggatgccattgtggtttctgtttgtgtattactctgagaatcaagaacaaactccacatgaaatgctgtaataaagagttgaaaaatatgcactgaaagtataccatgtttcaggcacatatcaagcatgatggtacatgcttgggattaaaaagatggatgagatacaatacctgcactctaaaagttcatagtatttgggagaaaagagagacatacaagaggatgattgcagtcaaaacattggagcagatgctacaaggatatgtaatacaaatgaagttcaagaatcacaacttgctttgcctgggaaaatcaataaatgcattgaaaaaggggtagtgtttgagttgggtcctggaggatgagtagttcttcaggcacaaagaagacagatgcaaaggataaggtgcatgcagtgtgataagttcagagttgcctgggttgaaggagtcagcaggagaggagtttggaggttggtggggttaggctattgagggccttttgtagttgctgaggggtttaactttaaccagttaggtgcaagacagtgttaccagctttaaaacaagagaatgatccaatcaaatgtgtgtctcagaacagaagctctggcagggagggataggatgaggctgaagtctgcaggtagcagtcaggaggcagttgcagcagggacaaaggggagatgagagatcagattccatagatagtttggagatgatatgagtagatctttgggagatattaaatgttaggagtgaggaaaaggaaaagttgaaggggtttgcagctcctaaggttgtgataccactaactgaaataaagaacactgcaaaaggaatacatcatttatgtctacagcagggcagtatggggggtggcatgcagggaaggctagcagataggttgttaaaatcctgcctgtgtagtggagaagactacagcttggagagaaccaaccagaacagtgttcttaccctgccccaccctattgtgtccctgaggagaatcatgggtcaagaaacatttgattggaattttgctaattttttatctattaaaaatgctatttatttttattgatttatttatttgtttttttgagatggagtttcgctctcgttgcccacccaggctggagtacaatggtgtgatctcggctcaccacaacctcagcctcctgagtagctggagttacaggcatgcaccaccacaccacgcctggctgattttgtatttttagtagagatggggtttctccatgttgatcaggctggtctcaaactcctgacctcaggtgatccgcccacctcagtctcccaaagtgctgggattataggcatgggccactgcacctggccacaaaatgctatttttaaaacaggcacattcaagcctgccatgtactgaatattattacaatagagaccaacaacatgccaactcgtctcagactaacctagaatgtggctctcagaacaaatgaagttccctctcattacttataaatggaatagtgtcctgatattacaaggcaacttgtttaaaaactcatatttttaccatttccaacagcttatttttgttgtcaagaaaatctcaatactatgcaactagtaagaaatcacagaaatatcaaaacagtcttacttttccaattcattgatatgcataaatatgataaatttaaactaatgaaatgtttatgaaatattcttatttatttctcatagtctatctgatatattaatagtttggatatttgttgctgcccaaatctcatgttgaaatataatccccaatgttggaggtggggcctggtgggagctgtttgggtcatgggggcacatccctcatggcttggtgctgtctgcgtggtagtgagtgtgttctttctgggcccattccctctctgctcctgctttcaccatgtgacatgcctgctcccaatttgccttctgctttgagtaaaagctccctgaggcccccctcagaagccaggcaggtgccatcacaatgcctcctgtacagtttgcagaatcatgagctaattacgtctcttttctttataaataaccccgcctccggtatttctttatttcaacacgagaacggccttacacaccatcgtatatggattgtgattattcataagatttctttgggttctacttcttaaaaagttttaaaaacactgaatataaagtatatattacatttatttctcctgaaatttatttctcagattgttaatcaggtcttcaatttttggactcatttaaaattctaaaattgttcttttgctcttttcacacacatatccatattcttcttctggctcgccacttctccttctgagcttgggatttatgcaagacaataacgggaacaatctgatatggcagcataataaccaaccaaaatatgtcttttctgtttttcattttgcttgatcatgacaacatcaaaatgcaagaatgggtgaactgttttgaagtctaggttttgaaaacacttgtttgctggtgtggatgtgtgtgcatttttatatttaacattaatagcagctttctctgtcatttttacactttcgtttcaaaaacagtggcctggacagatcctggcaaaatacattacgtggttatggtagcagctaaaatgtttgtggaagaataaaaatgtacattaatacaatttacacttattttattagtttatgtaatcttatatgagcaagaatcaactcttctgttgtatataactttttaatatgttatttgaacttcatcaacagcttcttgattgggtctcaagcattaatcaggcccctcacaagtactatgcgaggcttaaacatcttgcatccatcataaagaataagtaggaccataatgactaatcacattagcataatttaaaaatgcagagcgtgaatagcttttttccccaagatttgtagtaaaaacatatgcacaataagactgaaatgattcattacaccattgacttgtttatattataacatatttatgtgcccggcagaatgaaaccataaaactgccattaatgagtacaggaaagaggttctgtttttaactaaattacatgaattcataatgaatacattttaaaaaaattattttaaggaagggatcttgctatcatgttgtgtccttttgggacattacaaaacccattctcatcatagatcttttttgtcatctacactttgcacttttcacttaggctataagtaaatttagcaatttatgaacaagtttctgcccttaaagccaaacaataagttgcaggtggagtcacttcgtattgcagaagcaaacagctaaaggaaaatgtattcttaggggaaaaaacaagaacaaaaacacctttttctttgtagccacttacaaataaaaaaaatcttgccaccccaatggatatgagttcactggtcccctctcggaactttgggatgtctgctttaggattgaatttgtctgctaaatactatttattgagtgtcaggcactgagcaagatgcttcagaggcaacaatgaaaaatgacaaacatagtagtgacttaattgccattgccttaccatctggtaagaaaagcagaaagagaaacagacatttaaattatagtataaagattttatcatggaagaacaagcaaggcgtccaggtgcaaggacagtgttgatacctgaaggtaagcaggagtttgccatgtgaaagggcatgagggttaaacagaattattccaggcagagggtagtattctatgtggaatgtttagggaaccgagaatagtcattatcaaataattgttgaatacatgttgactgcatatagctaaaccataaatcccaagaaaaaatatagcaagagatgaagctagacagtattcaggggtccagatttattcacttaaccatattcaggagctagggaaatatcagtgtgcaagatagacatggtattttctctcagggagcttattgtttagttggggaaacagataaaaataatcacaataataatgtcaaattgtaatgaatgcaatgaagaaaacaaacaagttgctaagagacaataacaagaacttactttaaatgggatcaggatgatacctctgaggaggtgagatttgaagaatgagaaggagtcagatcatgaaagtctggggaaccttattaaggagctatggctttatcttgagagttacgcatgtttaaagattttaaataggggaaagatgtcatcaatttgcattttagacaaatcaccctggctgctatgcagagtctggagatgaataagtcaggaggtagggaaacaagttggatggtgtatttgtctgtttcattgctataaacgaatgcctgagactgggtaattaataaagaaacgaggtttatttggctcacagttctgcaggctatacaggcatggtgccagcatctgttcagcttcttgtgaagccacaggaagcttacaatcatggtggaaggcaagggggaagccggcatatcacatagtgagagacggagcaagagagagaaggaggaggtgctaggctcttttaaacagccaaatcccgtgtgaactcatagagtgagaactcacctgttatggtgaggacagcataaagccattcataagggatctactcccatgacccaaacacctttcactacacccaccttcaacattggagatcacatttcagcatgagatttgggggggacaaacatccaaactatatcagatagcttttccaggaatctgggtgaaagataatttcctagtgctagaatattttagtcactgtggtattaggcagggataatattaaaatacttagctattttggcataaacattgatccatcagaatggatgcaagccttagcactagagcagagtcttcaggtgtctgctagaccaggctggatggggcacgtggaccccagaggtggagccagcacaacaggagcttaggccagcagttctttaaaacaaatatggacatatttcagtattttagcaacagatgctgctataccagcctaagaattaggtatagagagccagggaaatatccaggagatgattaggaaacagaaggcttacgttttggtaatgcgaaagaatgccaaagggaggagttaatgattaggctctggtttctgcttgggaaaccaggtaaactcatgtatgtatttattcaatcatatttgctcagcactttacatttaagacatctatctgagagacttgcaatatcaagtgggcaattggatatatgagtaaggaaatgggggaatgatctgggctgaaaaagtaaatttgtgagtttccagcataaagatatcatttaaagctatagagtagatgaagtcccctagggagagaagcaatagaacccaggacagagtcctgagcaactccatcatgtagtttgtgaagaggagaaggagcctttgatgattgacaagtattcctgctgaaggaaggaaatcagtcttgaaaggtttcagaagatgagtggagagtatttccagaaggaggagtgagtggctggctgtgttgaaagctgtgtagagattgagtaagaaagagaagactggagtctctgagggatttagcaacatggagatcgtcggtgaccttgataaggacaattttagtaggtggtgagcgcagaggtcggactatctagagttgaaggtaaatgagcagtggagaaagagagctggtgagtacaaaacaactttttgcggtgatgtgggcttctttgatttttatttaggggagggacttgagcaagtttaattgcaagtgggggagccattgaggtatttcgatagattctaggggtgtacaaactagagctcctgtctatttttgtaaggaaaattagaagacagccaccctcattcaattatgtattgtttatgactgcttttgtgctacaagggcatagtttaatagttgtgatagagacctatggcccacaaaacaaaaatgtttactctctggctctttataaaaaaaagatcgccaatctctggattaagctaaaatattacgtgcccttgcccatttaatttcccccaggaaacccaaataagtacatatgtatataaatgcatgcataagcacataaaccaaataaagaatttgtttcccaaggcaaaagtgcgatggaaattctctctagtcagtttaccaatttatcaacaaaaaagagaaaaagactttgctcttctgtcgataatacacttatagctgttgttgacaatagaaattagcctattgtagtcaccactacatacccagtacctggtgctgagcctgacacatggtaggtgtccaatacatattgtttgaatcaaggaaggaaaggtaccaggtgctgtactacatgattgcttggagcaagaagcagaggatctttcctagatttgggtagatagcggagaattcccaaggtaaatgagcttatatggagctatcccagtgaggtttgtggaacctggaataaatcacattcctttagaattaatttgagaggtgaatgggggaatgggttggggagatgaagtcaaagctcatgtcaagagtaagctcaatatggaaacaaagtcacaaagaggcagtgtgtagcttggctgcaagaaagggccatccctgcagctctttatttgttgcggtgaaacagcaaatagagatgagccaaatttatgtatagtccaagccaacttatccctcaggagtgggaccaggagttggtctgttaaaaagtaggttaaagcaacaagtcaaaaaatgcgattttccacaaacattttaactgaaaaaaaaaaaatgtatatgtcatcagttttccaatcctttgacataggggcaaggccttttcttttctttctttctttttttttttttttaattgagacagggacagggtctcgctctgtcacccaggctggagtgcagtggtgtgatcatagttctctgcagcctcgacctccagggctcaagcgaccctcccacttagccccccaagtagctgggactacaggcacatgccaccacatctgactaatttttaaaattttttgtagagatgaggctcattatattgcccagactggcctcaaactcctgggattaagtgattctcttgcttcagcctcccaaagtgctggaattacaggcctgagtaaccagacctggccagcaaggccttttctttgagcacaggacatcacagaacatcactcttgaataaagcacaactcctacatattaactaagatttaaagtatggatttctttaaaggagagtgagagcttatagagaaatgggaagaaatctgagcacagcatccttctagatttttttccacaatctttttgcagctgtattactcacactttgtgatgctttcaacttgttttcatagaaacagctcttttgccttcacattttattgatttatataatatttaatgaaatcacatcattattataataaaatacaactatcataaacagatttaggaaataagaactgcttctcagggagcacataattcctatcagagagtagcctgctaattttgttctgtgttggggagcattatgatacaaagggaatagagactcactgattctggtgagtccaggaagggaaagcaggttaagactgttgtcggcaagggtggtacaagcacgttacaggcaacagctggtgctccttgagtcactgacaagctgccagaacagctaggtcccctgaatattgacctggggcagctgtaccaagtcatcccactctagggaccttggagtattgtgtgttggaaagcatgtattaagcacttgctgtagctgcttctggaatacagtatgtggaataatagctgaatcctcctaacaatgcaactttcagagaattgcaactgatgagaaaccagccttgcttatcctgtagcagatttagctttggaaagtatacttaaaattctccaactgctagatctagacagagacggtaaaatctcagtaaacttattctggcagcttgttacatggtaactaacaaagaacacccaaaatagtgggcagaaatcactgaacaatgtaaaaatcagagtagtggttaatgtattaccatgaactgagactggggaaccctctgttctccatcaaatgcctacccagctttctaacttattttgagctaaatttgggctgataaaaatgattctattctctactaccaatattttggaaaattatttccaataatgtggaaacgacagaaataagattgccctgtaaaatcaagactagcattgatgaaaaataggtattcagcatcttaagaaacagaatatttccaatttaagaacatttacaatattaaatattctatattgagatatttaatggtagaagttgaagaagactaaaaagttcagataccttctttgacagatgtggatatcaagacccagaaaggttacatgatttagtcaaggacccatagccagttatgagctaatccagttacaacccaagtctctcaggtcctagtctaatgttttctcattataacaccctccttctacatgaaatcttctgataagttggtgtccttagtgacctggctactgtagctgagtcataaattaccccataactcaatgatgtaacacaaccatttagtatgctcactgagtctgtgcattacagatttcgcacagggcactgtagcgctggcttggccctggtcttcgctccaaggctgagggctgggattatttgaaggctcattcacatgtctgctagttgacccatcttggaagtcacacagcatgacttccactctattccttttttgttgaggcaatcataaaggtccaccctagtacaaggggatagacgccacttcttgatgggaagtagcaagatcctcgaagagcatgtgagaccagaaatattgctgtgactacttttggaaattacaatttgctacaattaggaattaaaagaattctttgcaagaagaaaactagagggagaaaagaggcagaagaacaataacaaatcatacctgcaggctgagtgtacctactcccatttctctccctctggggaacttcgcaatctgtgcttactgcaaattgaataggaataaagcattttaactcaacatgattgaagcttttatttcatttaactgtctagtttggtgtgttggaaagtatgtttataagatatatccctagcataaaagccttcacaatgaggaaaaagggagaaattattttaattgaagaaattatttttttaaatagcttatatactagactataaagaaaacatcaataaatctcttaaaatatgaagtgcacagacatattctctgaccacagaataataaaactacaaataaaagtacaaatcagaacaaaacatttcaacaaaaatttcccacccacttgaaaataaaaaaatatacttctccatatctcttgggcataaagagggaaatatgattgcagttacagaatatatagaaaataagaatgaggacactacaaaagtcatgggatgtgacacaagttagatttaagtggcatgtaaaccagtgaggaatgaataaatgacaacaccagcagcagcaatggctgacacttcatgtgttggacacttggagctttacacgtataaattcagttactccacacaacaacctataggtagacactattatgttcattctcattttcctctgaggaggaaattgatgtacagaaggaatgagtgattggagcaacactgtgcaactagcccctatcatatgccaggcagtgtccaggcactaaggttgccaagatgacccaggcaggcaaagtccatgctctttgacagctccccattactgctgggcagggcgggaattcctcttcccactgggcctccacagataccctcctggcagggaggggtagaagtgcctcataactcctctacatgaggcctccactgataccagggtgaagaggtggcctcatttccactgggtcatggtgaaaaccctgaagctccaccaggcctcctctaatggcaccccagttaggggtgggagtggaagtccaaactccctatgtggtctctactggtactggggagggggatggtggaggaaagtgtgtgtcattactgcctggtgctccctactcagcattctttcacagcaccttggacagcatgttgggaggacctcaatgtagcctagcagagggttacagtctaggcttcctagtaggacttgtttagcatagatgggaatagggccacagtttttttttttttttgtcattttaggagtggttattgtctaaaagttttctgttttactaggctgaccctttcctggttctttggcttgacagatcttgcttttgttgaggcttttttttttttttttttttttggtttctgcctgttggtgtttgtggcttattgtggcttaccagcttattcagctcaaagcctgggatatatgaggcaaacaaacaaaaagcacagagaactattactatgttgttcctcaggttccaaatcccccatctggtctgccttcttctctccacctttcaatgtttcaatatttcttttatatgtaatgccaagaggttttcatttgatttagctggaggaataggggaaagtatgtctattacatcttcccagaagcagaagtctcctgttttgttttttaagaaaaaaaaaatctgacagcatgtgctcattctcagaccaaaaagacaaacagaatgacagggagttatatataatgataggtagaggggaaaagtgggatccatgcactcaagcgtttttcacttttgcatttgtcacttttttgacagttcatcaaagttacaagaaggaaagctaagaatatacagtactacagattcaaggagtttagtggatttggtggtgggtgaatgagaaagctctccactgttggattctattgtccccagtagaatagaagggaatccaccaattgagaaaggagtcgctcggggaaggctagggatttgcagagaggaaggtgtgaatcagttgctttgaaaggtggtagaatgaactgatagagaaatagagtaggattgctgagcatactgaagccacatacatttcgaaggaaatcagtcagcatagttgcttgttaccttccagaactaggtacagagtaggtgggtagatgtaggtttaatcagtagttgttgccagattaaatattagaaggggaaaggaataaggacatggaaggtgtgtgcaagggagtgattatgatgatggaacacaggatcagtaccacagcatggcacaattgcagaaggcacattgcattttgcaacacagttaccctgcatagattctaatctggataaaaatgaatttaagtttaggcgtggtggctcaggtttgtaatcccagcactttgggaggtgggagaatcacttgtgctcagaagttcgagaccagcttgggaaacatagtgagacctcatctctacaaaaaataaaaaacttagccaggtgtggtggtgcacatctatagtctcagctactcatgaggctacaggcaggaggatcacttgagcccaggaagttgaggctgcagtgagctgtaactgtgccactgcactccaacctgggtgacagagcaagaccctgtctcaaataataataataataataataattttaagatgaatttgagaaggtggacagtgaacatgaacatatgaggatgaatgggttggcagtcctaatggggttgaataactcttaacatagaactgataaattaaaggaactcaaggacaggagatgttggccatagggtagatatttgaaatttaggaggtgaaacagatcttggaaatgaaaagttctagggtatgagaatgggtagctgaagtggggtggatggaagaccattggcaaactggatactcttaccaaccctcctattgagaataattaaaaacaatgaataaaatatagaaatatgttttaaaatgcatcaatgaactggtaataaagtaaggccaaaacaactcaaagcaaggccctagcaagatgacagaggctctaatgctggcttctgtactgagcagttttgacagatccaggggatcttgagctccagttttcacagccttgtgagatgtggacaataggtcacaaagcctaggtccagcccaaagaaggtagtctaaaagacaacatcctacataaagctcgaaagggtataccagaaacaaaattgcccccacagcagacaacaagaaaatttgcttatcttaaaacttggcactgggtaaacaagaaggaaaatctccccgaaagtttataagtacaagccaacccttatgtgtgagttttgctgcctgagttttactacctgggtggtctggaaaaacttcaagctgagaatttagtttaaagtggccctccttcagtagtacccatgggcatctggcagaaacaaatgcaaatcctctttaaatgaactcccttcaatctaggcttcaaagaattcccatagaaatatgaatccacagtcaagaaacaaaagcaccgtgaatgatacccaatacaaataataagcttctgaatatcacccacaaaaaactttagtcaggtactagaaagatgatacaaaatttatatacaatttgtaaggattagataggcagaaaagttacatagtcatcattcgcagatgatgattttttttgcatagaaaatacaaaagaatctgcatacaaattagaattaagcctttttagcaaaattgctacttataatgttaataatttaaaaatgaatttatttatagccacaaataaaaacaggtaacatttacaatactataaacatattaaatacctagggataaatttaacaaaatatgtataagatctgtacacaaaaaaatcataaaattattgacagaaattaaaggacgtttaaataagtagaaagaaatactatgtttatggataggaagattcaatattgtaaagttttcacttttgttgtaattggcccatatatttaattcaattacactcaaatcccaacaaagtggggtttttggttttgttttgttttgtttttcttttcgaggtttttttttttttttttttgaaggaggacgggttgaagagtggatagtggaacttggcaggttgcttgtcaaatgtatcagagctggctgatcagagctgaaaatcagctgggaaagcataggctttaaataggtgatgctgaaacaactggttattcctataggaaaactcaatttgaacccctatctcacaccacatgccaaaaaatctattctagatggattaaagacttaactttaggtagagctttaaaacttttgaaggataatataagagaatgcccttttcaattaaaggaagggaagggtttctgaagctaaattgaaaagcgcagatagtaaaggaaattattaaagtcaaccacattaaagttaagatcttctgtacataaagagatacctaaagagagaaaaagatgagccacaaactgggagaggggatttgctatacctttgtgtcaaagaattagcatccagactacataaaaactgtaagcccataaaaaaaatacagcctaatttattttaaatgggaaaaggatttaaatgggcctgtcactgaagagaaaacacaaatggtgaacaaacatacgaaaatatgctcaacttcatttgtaatcagggaaatgcaaattaaaaccacaatggcatattatttcaatcccattagtttgacaaaagttttaaaatgtcaaataacaagaatgagaaaagatgtggaaccactgagttcttatacactgttaatgagactgtaaattttttcaaccattttggaagaaaatttgccattatctaaaaggttgaaaatgtgcatgcctttgatccagtaatttcgcttttgatatttggccaagagaaattcttatacgcaatgtactgtgatacaggtacaaggatgttcatagtagcattacttgtaatagcaaaatctattcattaacaggagaatagatttaaaatatggtatattcatataattgaatactatataacagtaaaaatggatacactgtagctatgggcaacaacatggatgcatctcaggaatacattgagtggaaaaagcaagtcaccgaacgatctatgcagtaaaatttcaatttatatagtttgaaaccatgcaaaatcacatattatatatgttcaggcatatgtgcgtatggagacaaaagtgactccatcttggatgctaatcaaccatgttgacttctgattagccccagtcccatgaatgcctcctgatttctgttttagttactgtccttagtgtaaaaacatgtactcctacttttagatcaaagcaaccttgatgttatcgcacaaattataggctgtgacgcacatagcattctcacctgttctggagggttgcctttcattgtcttgctggagcacgtataccttttccctgtggtataaagctgtggttctgaggattaacaatgcgaagatctgcttgtcttgtggccacccaagaccacgcttctgtttgtaagttctcttaataaatcagccaatactgacaagctggatttatttgcctccttctttggtttctcggctcctttggcatttgggggccacttggcatatatggccctttcatggaaaaatatgcatgtggtaaaatacaaacaaaataaagggaatgatgagcaaagaaggatgagattggagagggacgcatagaggattagatgtggtgtttcttaggatagtggctacaaaagtgatcactgtatagtttttaaaaacacttaaacattcattttataaatatttttgtatatatttaatatttaataaaaataaaattccaaagatctttggggttgaggaggtaagagaggtttatcacagcattatttcacgctggaaattgggaaacagcaaaggtcacataagagactgtttaaataaattaaggtgcgtctatacaatggaagagcatgcagcaatgacagatgatgtgttagaaatgtacgtactgataggaaggatattcctggtagagcaggtgaaagaagaagattatagaacaacattgtatctcatttgtataaggaacatgtaaaaatacacatagataagagtattaaaagtgacgcctataatcccagcatcttgggaggtcgaggtgggaggattgcttgaggctgggaggtcaaggctgcagttaactatgattgtgccactgcactgcagcctgggcaacagactgagactctgtctcaggaaaaaaaaaaagtgtttagtaggtacaacggaaagttaacaatgttgggatctgggagttgatgttaggatttatttaatttattttcttaatttctcctagttttccaccacagacattattactgttatatcaaaaccatgtcagagaaagaataacaaagaatgtctaagaaaaatcagacagaagaatgtaaatataaaatatttggaaatgaccttcacaaaatatgcttcttattctcttcttagagctaaaaaaagacttgatgataagtagatgtgtgtgtgtgtgtgtgtgtgtgtgtgtgtgtgtgtgaagtttctggctaaatataatgaagttaaactcttcccaatttaatttgtaggattaaaacaatcccaaacaaaatcccagtggatttttttaattgataaaatgtttctaaggctcatctggaagaataaatagactattaataatataattctgaaaattaagaaataagaagttagacttgctcaaaacgatattgaaatgtatgaaagtgacaaccctttccacaatgatagttaaataggaagctcttaaacatcgaatagaaagtgcttaggcatctctttgtacttttaaaaacagtatatgatgaagtaattgtaacagagaaagtgatgaattatttagtaaatgatgttggaataatggctaaagaaggataaattttcaccttaaactgtattctgaaataaattctagataagttaaagaaatataaaaaattaaaagcattataaactacaagggaacacagaaaatatgtaacagattccggatgtcatttaagtcactaaatccaatgactgcagcaccagttgatagtcttgactgcaaacgctttttttattccctttgcttcctttggctttcataacacttccctaatttttctcttaccagtttggccactacttctccagtgactttgcaggattatcctcctctggggaccattatatgtttgagtttctctgggcccatcccttctctccactgtcttccaaggattctcatcatgcctatggctgtagttaccacctcctgtcaggtgactctcaaactccagcctaaccatttccaacttttcagtattagtcaggatccatgcaggaaatgtatggcacattcaaaatgggtaattaagaagactttagttaagagatcatttacagagggtttagggaaggcaacaaaggataatggtacagtatctcagggaacattactgctttaggcctaaacaaggaagcaggtggaaatgattactgaatgagagtgagagagaggaggaggtggcaaaggagtggtacaagtaggaaaaggtggggaagaggggcaggagaaggaaggggaagagagaatgcagtatggagataatatggaataaataatcagcctccacgctctgccttcagtcttctgcttctacctcccattggctgaacctaactagaagacagagaacacgggaaccaggtgctaaggttacatgggatgttgattcatttcatacaggtcagtctctctggatacagcagaatagagaagggtggagagtggctctatgtgggaaagcagaagatatccacctagcattcacctcctacctggcttcttctccaggacatcccaagagcatttcaaactcaacgggtccacaattgagctcataaactgcccgctgcataccctctcctctcaaaaaacaaactaacaaaaatccaaactggttctttgtcagtgttttccttcttttttgttaacaagtttattttcttgcatttcttattttaaaaattttactgtatatatttaaggtgtacaacatgatgtttcgatatacatatagaaagtaaaaaggttactatagtcaagcaaattcacatccattatctcacataattacttgttttttgtgtgtggcacctgaaatctactcttttagggaaaatctcaagtacaatacaatattatttcatggagccctcctgttgcacattagatcttctaatgttatcttatgtcatcaaatgctatcaatgtcaggattgaattctcattaccatggaatggattaaactggggcaagagtaggagcaaatagatcaatgaggaggctgttccattagtgcaagcagaaatgatgatagaatggactaaagcagtgttggtaaatatgaagagaaatggacagattaaagtggatagattaaagagatatgtagaaagcaaaagtaataggatttgggggtttgatagaattggatgttgggggtaaaggtaatatggttgtcaaagatgacaccatggattttaggaaggaggcagcactctttaacacggacttattaaccctgcatagtcagcttctcccagctccatcccccaacctctcagcctttccagcttcatcttataccaagaccctctcaggatccggtggcgtttactttcttttatccctcttatttcctgtgcttgttcctgagcaggacctttgcacctatagttcctactacctgtaatgcccttacccagctacctgactccttttcatcattcatagttcaatcaccgtttccccagggaagcttcccctgatttccttagttagtcctaattttcctattagagctctcatatattgtgtaccttctctttgtaggatctgtccactggcagctcacacttatttgggtggcttttcagtttaatgtttgccttaccctcggtccccccactaggatataaactaggatataagacagggactgtatcttttttggctcgcttgtgtattatagcctggaaccctgtggttgctacgcacagacacacacacacacacacacctattagtgaatgaataacagtaaaagcaatggaatatatcacaaagaaaaatactggtatatttaattacattaagactatattcttctctgaattaaataagactacatagcaaataatgaacaagtgataaacttggagacatagtcataataaatagacaacaagattacaccctcaatagagttcttaccacatcaacaataaaaacactgataatgcctaataggaattggcaaaaaccaaataaaaaactccaaaaatcccataaagagaaagggttctgacagcttctcactgtaaaaattggaagcccaaatcaaactaacctaaacactaaggaaataatatatttttgcatgtaaccagaaagtcaggttgacttctctgaggttcacaagataacacccagcagcacgtggggacaatacgctttcctgttcacattcatcagaggagaagtggaacctctctctctctctttttttttttttttttcttggctcactgcaacctctacctcctgggttcaagcgattctcctgcctcagcctcccgagtagctggaactacaggcacccgcgaccacactcggctaatttttgtgtttttggtagaggcaggctggtctcaaactcctgacctcaaatgatccacccacctcggcctcccaaagtgctgggattacaggtgtgaaccaccacaccaggccgtagaatctcttttctagcaacaaaatacaagtgcttcttctcagccttattgactcagattaggaccaacctggattaaatctcttgtcacaggaatgctatgttttgattttgaacctttcactagccaaagagattggattactatgcttggttcaatagtaatcaggactcattccgagagctggggtcaattccagaaactacattgttgttgaggagtgaaacacgatgtccactgtaattggccataaccataggaaagaaatggtcaactttaggattgagggagatagaagaaaataaagacagctgtgaggcatcatttttcaactcaaatttaaagctggcttttaaaattacaccattcactgaaaatggattataaattgatttaacttttctggagggcaatttggcaatatatgaagcacctttaaaacatttatgacaaattttggaaagtatacatatgtgtagaaataaggaaacacaaaaatgttcatgtggctgccactaagtggtaagtttatagatgattttaattttctttttaatattttccatagtttttaaaaacaggcctaattacatttatttaaacacaaagaacgtgaagtaacctgttatttaagaacatggacaaattccagtcaagaatatcctctagaagcttgagaggtgggaaaagtagtttgggggatttatttgctctctcaaggtgatgaaaagaaaaatatctgaatcaaagagtctgagttatggaattctctgcttctggggttctagtgcagccccgttggtctggaattcaggaaaaaagatacaaggcataaaatcccacagaaagttacacagttgcaacagaacatttagcatttattgcttgttcttctaattaaacctctaattcaactcactaggcccttgcctgctagctttagtgagtaaagttgagaccatgtgactggacttagcttgatttaatgtcatgttcattgaggagaatggttggacttttttttaaaaaacatgagcataggaaatatctgaagtcacttttaacactagtctgaacatgtaggataaaggaatgtgtgttactgaattgggatttccaatagatatttaacccaatgtgatttggtgatgatgttctttcttcagatttaatttcataatttcctcacttatctcagaccactccctcagttcgctttctgccttaactatcacctctaagtaacatgggataagtcacttaacctttgctgtatcctttcaaaaataggcctctgtcacggaatttcctctctctaaacatctctaaagttctgttggtgtgaagaattagtacgtctcttctggttatatgaatttaagaaagcatttaggttaatgagggaaaattgaattttaatggtcctcccttaaaaggctttacaaaagattttttagctagatgaggtgggaatatatatgctagcaccagattccacttatcagtcatccagcagttacagcaagccagcagctctgcctgcgcctgagttggccatgtatagacaagtgaggactgcagaggcaggaaatatggggttacgttgatttccctctattagcagcagcttaaaccggcatgctgggcagcactgtctcctattggctacagctgctgagagcagcaggatgagggttgacctatatctgtcaggtgtaggtcaaaccctgaatttttgttgcaaacttcagtcttctagaacgccaagtttcacttgtgctcaaccacatacaatatttttatcaggatctgtgatatactccacctgcaaagagcttgcatctgtgggtttccctctctggattcttttgctttctttcttgctgcctctccctcctgtcaccctcttaccatttttgtcccctgcttccgtgtcatcctctggctgagaagggttgagatggtcacagctgtgctccttctagtaatcacagtaacaccagcccttctctgcctgccccagtttccatctgaccaagctgtgcccgttcctttcagttgcagttattgccccaggttggcacagcctgtgcacatatgtgctcctctgggccaccatggtttcggaatgtgtcagttgctaattacaactgcagctgtgcacagaaatacagcacacattcaaaatgtgggtcctaaagttcctacacagtaaatatttcttgatagttttaaggccattttttttcttattttttttttgtaaagatagacttttaagtatttagacatgtatttttctagatgagagaataaactacttgaattttcatttattcagccaccatctaactgtgacaaaggtcctttccctctgcctttggtctcagtcaatatatgtatgttgttttgggacttaattggtattgtgtttttatttatttacactgacatcacaatgtgaaacttaccatagtcagtcctgccttcatactaaagcatcagtacactgtgggcttccacttacaatgcagaaactgcattccatgacccgttatcatttcttcactgaggccttgtagtaatagtaaagaagcccaaatgctggaaaaattattctagaacctcaggtccccatgcgtacaaactacatcacagtaatttgagatggaaaagacctattaagtcatcccactgattctctgaggacctgcggtgttttttccctctccaacaggctgatctactttttaatggcttttccaactgtaaatggcacaagtgatggggtttccacccttcccaaggctgtacagcctataatagatctctccattagggcctgtgactcgttcagctgcctaaatcatctttgttttgactttcatttaccatcactcctcctgctgtccccttgcacactaaataatttctctctgtccccactatttacacccttcaagtacttgttgcccatgagccagtcccgttagagccacatggtcatgctgagagacttgtctctttcatcttctctctgaaggctgtcccttcagacttatgaatcatatttgttgctcttcaatgaatgcccatcagtttcttaataatttgcttcatttctttgttactgacactgctcaggaaaatcttctttgtctccgtcgctgcaaaacaagaagataatggtagtagaatctctgctaacagaaaatagagcggagcttttcagctaccaggtatcttcctacccaggacaatggaatcatctaatcagttatctttaactctcttacttggggtgcacaattgctatgttaacaggtgttaggtgtgcatgtggagacagggatagttcatctatattttatctgggaaggctttgttgtggtgtatttagttaatgcccattagctgtttaagtcatatttccccaccaacctcacttcccagttggaaaagcttccttgaactccctcaagagaatgctaacctcctcctttccattactatgcctatgtttactgatactaaattgtgtgacatcagtgacatcagcatctttgccagaggaggaattcctttgctatgagagaggcagagtgtgccctttaccttgaatgaacatgaatggtacggcaaaccgggaaattctggcagtgggttttgtaattccagggttaatagtgttcagcctgtcccgtctgtacccctctccagagcctactccctggctactgtgtgtgcttatacaccatctaaagtactgaatttaataaggtctggcctactgtgctcattgttcgtatttatgcaataataataataccaacatagtgcttcacaaactgtttttgtctaattgcatcatcccatttagtagttccaaccatcccgtgaggaaggaattaccatctttctttcaccagggagcaaactgagacttagagatgctctattgccacaaatttcacaaacatcccataaattctcctttggagtccctcttgtcctccctctgaaatcactggagaacatgctttctgagcagtatgtgaagaggcactaactgcatataagttcctaaagtcactgaaatgctggccatggcataatgtttatctgtgttctccttttggcaaaaatagagtagctagacatcatccacagttttatatgaatcctattatcagtaggataattcagttgttacacgatgacagaaagagtatatacaaattttaagaaatagcttgctatctcttcctaaacaataaggtaatattattaggcatggactaaaagtgagcttatctattcaaacaccaattcagaccctaagggtatctgtttttcctgcaaagttgatgagattatacacctaagataaaagaagaaagagctatatttcattaaatgttaataacatgatttgaagaagcaaagaaccgaaaaatactgacttttatttatgaataatataaaaagcagaaatataattttctaccaaatacatggtggtaaaggaggcacagcagcctaaaattatgttaatagctaagcaaaagaggacattttatttattctacaactgattttcaaataggcttaccaatattttaaacttggcataaatgtggttatggtaggagaaaagcctgtactaaaagggttttatcctttaacaaactgaagtgacatcaaataaataaaagactcttcagctccagcaatctgaagaaaacccaggtcaagaaaattatgcattttgttgctacctgtacaagtagtccattcctttttattgctgagtagtattttattatatggatagtacacaatttgtttatacattcacatattgatggacatttggcttctttccagttcaggggtattataaataaaactgttatgtatatttgtatgcaaaacaaagaagaaaaataaaattatgcacttaagtgaattgccctcttctgtggcctggccagagaaggcaaattgcaagtgtatgcatatattgtccacacacagaaatgtttagaagttaccatgtctatcaatagggagggaagaattatttcttatatattagcttgcgggcccccactgtctcatgtacggctaactctaaattcagctttgtggctggactggatggtgcctgtgactttctaggaaaaaaacgaagccaatgcatctttgaagatacatccttaactatgccagctgtaccttacagtacccactgtttaaccgtaaaaatgggggggaggggtaaatgctatcatacttactgctttttaaaattactgcaaatgcaatacatgcttactacggcaaaatttagaaacacagaagaggaaaaaacaaactcagatacttttcattccaaagtaacaacttttgacacacccttccaagccttatctacatacctatatatgatatgtgtgtgtatatatattcatctttttaaaacagtaagttttgggtttaaatcttccatagtactaactaattgactactctgtcctttaacttaagatctctgaagcccttattgaagaactgatgctgttttgggctgatataaatagggtgacaaaaatgctttagttaggttttaaaaaatgcatttactttagatgaatcttatgaggctataggttttttaaaagtacaagaccttttacagtcaaaccttggataaatataatgcctagaaaatgtattatatctgttattatggacattattaaggtaaatgaatcttttccaggggttgcagtgtgtcattgaattctacaataccaagggactgaaactgactagacccagctttatgaggtttgggagtgaggcaggaaagacatagctgagttagatgccagcctaagtcactatggatgtcattaaactcactgtctttacccaagaacttcctcctgacaatgcttttcctttttgctctcaagaccagacgttctaatgaatgtttctttagcattttccagtttatcctaagataattcacaaatattaaaacatctatgatgtccctattgaagacagttcatcaaatacctcatgatttgattaaatacttcatcaaatctaagacaccatcataaattgtgccattattttaagtgatgccaagaaaaaagatgctgccaattaaacaacaacaagccattcatttaaaattttatccacgtttcagggccgggcgcagtggctcacacttgtaattccagcactttgggaggctgaggcaggtggatcacctgaggtcaggagttcgagaccagcctggccaacatggtaaaaaccccatctctactaaaaatacaaaaattagccaggcgtggtggcaggggcctgtaatcccagctactggagaggctgaggcaggagaatcgcttgaatcggggaggcggaggttgcagtgagccaagatcttgccgttgcactccagcctgggcaacaagagcgaaactccatctcgaaaataaataaagtaaaataaaataaagtgttatccacatttcagagatgttaaaatgtaaaaaagtttcttataataaataaaccgtggcatttgtttaacacctacacatttcatagacaatattcagtcatataccatgaacagatttttagcgcccactgcataataggttatgaacagagaagttccaaattagaatggatatctttgacatttaattcatttatttatttttggattgaaataagaacaaaaatgttcatattttaatatgtatgtttctatagagaatattctgtttccataccttacattgcagtctctaagtgggagcagaagccttccatgtgatcttgagtgtctttatctccttgtaatttgtcctcagagataacaaaattctcagttagactgcccttttaccttaagaagcatgactgagttctttcctttcatcttcaggctgccagttagtgacttaattcagttttaataaagtcatcaggcttggaaaatgcagattcattccaatttatgtgtattatatcttttgcccattatatcttttgctgggccagtctaatcaccagattttacagatgaagaatgtgaaactcaagcaagttaactgattcatccctaatcattcagaaggggttttttccctgtcacagacagcctgtccaacacaaagtccagttctcttgaagtctcctttcatcttaacagatccaaatatgttctttcagttgcctgagaaatccattttcttctaaattttctgaaatcaaaattcatcctctttttaacattctgccccgtattagcagatcctgtctggtttccaaatttagagtcatacatttttccctagggaagagaaagagatatcccctatttatccacaagagtaatctgctacctggaatatatacatggaaccgctacttggtcaaatataaattagctctaagtgggagaaggtaaggcaacaacttttcatagactcccatcctttcccctttgaatttttaccttgaattatcttgttttcttgctttaaagtggattatctgtaaagcatgtgatagaaacagaaagaaacataaaataaatgtttaaaatgtgaaattttgattaagttaaagaatcacactgagcttacgcaagaaagtatgggaccctatcatcatcggtggaatcagtttacccagctatgtactaaatgattatggtttattgagccacctctgagctcctccccctcttccccagtgtcctgcttccttgggccaaaaataaacctgttagctggaaaacaagctagatgagtgtattagtccattcttgcattgctataaagaactgaagatcgggtaatttataaagaaaagaggtttaattggctcacagtttcacaggctgtacaggaagcatgatgctggcatctgctcagcttctggagaggcctcaggaaacttacaatcatggcagaaagcaaagggcaagcaagcacttcacatggccagagcagaaggaaaagagagatagcggggaggtgccacacacttttttttttttttttttgagatggagttttgctcttgttgcccaggctggagtgcaatgggacgatcttggctcactgcaacctctgcctcccagatttaagagattctcctgtctcagccttctgagtagctgggattacaggcactcgccactacgcccagctaatttttagtagagatggggcttcaccatgttggccaggctggtctcgatttcctgacctcaggtgatccgcccaccttggtctcccaaagtcctgggattacaggcgtgagccactgtgcccagctgccacacacttctaaacaaccaaatattatgagacttcgctatcacaatgacagcaccaaggggaatggtgttaaaccatgagaaattgcccccttatccaatcacctcccaccaggcctcacctctgacatttacagtttgacatgagatttggtggggacacagatccaaaccatatcaatgaggctgggcaaggcttgacataacccagaacaaactttttcctgaaaaagcagaaaaagcttgactagccttaaaggaggtggaatacagaaggcattaattaggaatggtcctagagggaaacatacaagggcttctgagaagatggtctaagaatgagatacaaaggagcagagttgatatgtgaggtatagtccctaacagcatttctgaaatgactacttttggcagaagacacccttattctgcagtttaggaaaacatttgccattaagtcatctgggtttttttgctccccccataaaaacagttcttttcttagagtgggagacaagtccaagtttaaatgtttaaaatcctactcatatttctgaaccactttcttatcagttataattgtagatcttacacttactaggtaactgaggtttgtatttttgatcttgaaatgtgatgccagacccaaaccatattctttgaaatcatcaggttaatgtgtcctcagcaagcaatgtgaccccctactaagatgatttcccttaaaaaacgtgggacatttagccattccaatttcaccaaacgtagatttagtatgttgaggtcaggtgctgtggctcatgcctgtaatcctaacactttggaaggccaaggcagacagatcacttgagctaaggagtttgagatcagcctgggcgacatagtaaaaccccatctctacccaaaatacaaaaaattagccaagtatggtggtgtgcatctgtggtcccagctactagggaggctgagatgggaggatcacctgagcctgggaggcggaaatggcaatgagcaaagatcatgccaacgcatttcagcctaggtgacagagtgagactctgtctcaaaaaaatagaaaataaaatatattgagacaagtctgtgtgtgtgtgtgtgtgtgtgtgtgtgtgtgtgtgtgtgcgcgcgcgcgcatgtccaaatggacaatgatatttgcaaagaacgtagatgtgctttttctttgcattatagtaaaggacatagctaaattcaaagctgcttttaatcacaaataaaaataaaaaattatcttcagagagacaaatccaataaataattacataaaaataaaaattcaaataacattgtaattacaaagttctaacattttattgatattgcaaacatttttggtaatataaacataggaaaaatgattttaaaaaattgaattatattatggcttcatttgctgttttcattactcattaaaaccttgaaaataaataaataaataaagaaaaccttgataagtatggagaatgaaatgagctatataattacaatgtgtcaaagattcctttagatgccatctacattaactacaagactattttaaaatgaagtatgtgtgccaggtggctgataggaaattcttagatcaacaaccattttttttgcagaatttttctgttctttagctaacaataagaacataactaccaagataacatttattgagtgcttactatgttccaggcactgagctaggcctagctttaaaagtattattttatttacatcttaagatttaagaaccccatgagccaggtatgattattatcttcattttatacacatagtatcatgtgcttagctgtgtgtcttctgtgtgccttctgagtagagggttttaggcaagagctaaaagaattctggtagttgtatatgatagtttagcataataagaaattatggccagatgtggtggctcacacctgtaatcccagcactttgggaggctgagtcaggaggattgcctgaggtcgggagttcaaggccagcttgggcaacatggcaaaattccagctctacaaaaaatacaaaagttagccaggtgtgtggtggtgcatgcctgttgtcccagctactcaggtggctggggtgggagggtcacctgagcctgagagagagaggttgaaatgagccatgattgtgacactgcactccagcatgggcaacagagtgagaccctatctcaaaaaaagaaagaaattataagaaaagctaattttatttctagtgttggacagagtgacagtttgctgctaacaatgggctctatgctatttaataaatttttcctcactctatacaaaattccattcctaatacaatgttattctattctcaattttaaaacctttgcagaaaattattttacatgtgtggtatgtgcaaagcattctttctagtaatatatgtagacatgttcagtttagaaaaatgtaaagaagcccagagatgaaaataagtcaccctttatcccagtaaccacagggaaccactattaatgttttggcatgtgttctcttggttgtttttatatatgcatatgtaaatatatatttatattcaattagaaacatactttacagttgagtttggtttttctggtttttcaaattcacttgataatatatcattggcattttgttatgtcattaaaatttcttccacataattctaacaataacacaaaattccattatatggatatactctattagactaatttcttaatgttggatatttaagtaggtggaggaaactttaaatataaatagctaaagtcttactcatgctataggcctcagatctttaatgattaaaaaaatgtgcccagtaaaagccttggactaaagctctattgatctcaattttaatctaaaattgcagggctgaaggtggcctcagaggaatatagtccatttttctatttttcagataggactatatcactatcctagatatatgtctctagaaactattcttgaatttaatgagagcagaagatttcataacactgcccaatgtagcattacagtgacttggtcctgtagcacagactctggaagtaaacagaccctaagaccaaataccaggtaaaggactttgacctttgactttgaccttgacttttctacctcctcattcttggtttctatcagtcttgcagggtatctgggaagattccatgagataaaatacatagagtgcatagcagtgtgaatgctgaacatatgcttttatttaccctgttcctcttaaatctttaactaatttccttacattctttctatgacgaaaaatccccaaacaccaatatctatggcactaaatatacctgaaggccatgactaaccccttcttgaacttcttctgcaaactaaataaagctaaatcatttgactttttctagcgtctacattcataattctttattaaattgtgggaccccaaattaggcaggatttattataattgctctgggtggtgatagagattgtggtgtaagttgtaagagtacaccttatttattgttatgttgatgccactatagcaagaacttgctggattcttattttaatttctttctttctctcttaacttctctttttctttctttcttttctttctttctttctttctttctttctttctttctttctttctttctttctttcttttcattttgtttttttgcagacatgggatctcactcaggctggagtgcagtggcactatcatagctcattgcagcctcaaactcctggactcaagtgatcattctgcctcaggctcccaaatagctgggactatagccatgcaccaccatgcttggcagatttttaaattatttttttagacacaggatcttaatatgttgcccaggctggtctcaaacttcttgtctcaagcgatccctcctgcctcagcctcccaagttgttgggattacaggtgtgagccacaatgcttggcttgaattcttaaaaagaacttatgatgtaagttctatgatataagtaaataactcgggttgtacttgtaggccatcatgacaaggatgactgcttttctgtgctgtacttatttcttggttctgattctttatcttacttagaagcagctccttcattgtttcaagttgctttcattaatttgagtcagttttacttctatggtgttatccatacactctttcttttttgttacttgttttgttaattttgattacatttagaggcaaatgaatttatgtgcacttccctagatcaaggtgaaaccatgacacatctatgtggtaaagtatagctatgacatagaaataaagggtacctctttttaagcagttttctcctaatgtaagtccaatagtgctgaaattgtcttcagacttacaagtttgagtagattttagtatgtcatctgtatggattatgaatttgtaggctttgggtctgaaagctgtaattatcaatgtttgaaagacatctgtgaaggtgaggatatggagacaattagccaaaagttagatatataattaccacaccctgccttcctatcaggaactctggatatttaaaacaaattaggacctttagacaggcccttctcttatcagggtgcatcatcgggttgccttgaatgtaggtaatcaatctcttagccagtaagtgtcctctcttgcatatactattagctcacaggtctttcagagaccaacgtggaaaagaaccatgcctctcaattacatccctggctcttgctacagagggaatttttatagtgaagaaaaaacactggggaaaaaagtcacccaatttttatagtgaaggaatcagaagacctggcttctacttctagtctctcatgtgctatctgtgaccccagccaaggttgtgggcctccatttccccatctgtcaaatggagacagcatacatgttctaacgtcacagaattgttgtggtgatacaaaaaagtcatagatctgaaagcgcttttaaaagttctgtgaagtttctataaaacccaggaaattgggaaaaaatcatgcagagtcacatcatttccttggaatttggaacatttgtttctcttcccatctgtgactaagtactacacatatatgttttgatatttatgaaaccattgagtacatagttacactatgaatagttacgactggaaggtattgagaaaaatgacaaaattccttgttattgataattaacaaaggaactaatcctttcaagggtaaagctacttagacctggctcacagcacttatgctctaactgattttctttaaagaaaactcctgaagagttttctaagaacaagtgaagcaagattggaccctgagtacggaaagtgggcagctaaagcttctttcctcaataacaagtttaagtgccttatttatttttgtattattaagtgacacttgtgaaaatactttgttgagtaatgatgctgtggcaaaactaaagtttatttaggacactgctccgcccaaggtgagcaattaaagcaggtatgtaaacctgctcccctgggctcctccactcaaccacttaagtaagtagtgctagaaatgaaaaagggtgtggggcaagatacatggcatggctgggggtgagaagaagttggaaggggaagaggaggccccatgaaagaatgaaaaaaagtgtgaaggttgatagggaatctataactaaaaatggattctaactgatgactgatatcactatatcaagttaatacaaattgagatggcataagattgattaaaaaacaaacaacaaaaaaattctttttcccgcatggtataataataaccaccttattttaaatgtagccaggaagggttgtgtttgttcatgtgatcaggtttcctcacttcccacacctggggaagtatcggctaatattgatttagcactaatttatacctgatggtcaggatcaactagaatggagaaaaactggtacaaattagaggggctttgtgttcccagaaagcagtttgggctgcgactattgtgtatcaatacaaatcactttttctaggaggaaatggaaataaatttttcaaggacccgtatctattctcagctgctgtactgctagtgtgctcaagattttgtttaaatatgttaggaatggataagatcaagttgcattcttatattttactatgttagtttattaatctgggagctaagcaaaccagaagcagaacaggctttaaaatatctgactcattattatattatacataataactgttagctagtcaggtccatttcccttttcctcaatgaaatttgctataataaaaaaaatctataacctagtcttatatatttaaacaccactgtagattatttggaaccatagaattagataccaatcatgtaaaatgagtagacctcttagattttttaaaaaaaattctacaggtagaattttaaaaggtgttttcttttggtaatttccatgaattgatgtcaggtatcaatgtttctatgtatttggctgaaaatggagataatattttgggcctgaaattatacttggtaaactttcatttatttcatatctactgttgcgcaaatttgcctgatcataaagatcacctgaggaacttgttaaaaattatacagtcctaaccctcccaccagcagaccagctgaattagactctccaggaaaggggactgaaatctgtgtttttagcaagggacccagatatgcctgatgatctgacacatgtggaaaatacagttttgtttccttttcgtattcctcatgatgccagagctcttcaaccctatattcacttctgactatcttgctctccactgattgcactgttttctactccaccctacctgtattaatttgttttgtgctgctgtaacagaataccatgggctgggtaatttataatgataccacagactgggtaatttataatgaacagaaacttactggctcacaattctggaggctgtgaagtccagtatcaaggtgccagcagtcggtgaggttcttcttgtagcatcatctcatggcagaaggtgtcacatgctggaagagcaaaaagaaagagagagagagagagaatgaataaggggggtgaacccccacctgcaatagtgaacccactcccatgataatgccaataatccattcataagggcagagtcctcattacctaatcaccacttaaaggtgccacctcttaatactattacaatgacaattaaatttcaacatgagggggtgggggcagaaagaaagaaaaaaaagttcaacgtgagttttggaaaggacaaacattcaaaccatagcgccatctaagaagtaaggcacacttcatcagccactgtggccttttgtagcagtgagtgtctgctatggtggtagtggaaaacaagtcttgggcagggaggtaagggatggaatgaagggttggaagtatggttcagaaaagtctttcaagagattctgatcttctccttgacaattggtttgtagatgactttgctaccttctgaagtggccacactcaacctccctttgctcgatccaaaactctgtcttacttttgacctcttatcctccttccttcctgtagtagaaggggaaacattgtgcctttttgtcaatgttgtgctcttgatcaaatcctttaatgctaatggaaactaaatctattaatcttcctccccattcaaacgcttcttgatgtttttctccttcggcttctttggcttatgggtatatcgataggaatattttctcttttcttttttctttttttttgagacagagtccaatggtgtgatcttggctaaccacaatctccgcctcccgggttcaagtgattctcctgactcagcctcccaagtagctgggattacagcatgggccaccacgcccggctacttttgtatttttagtagagatcgggtttctccatgttggtcaggctggtctcaaactcccgacctcagatgatctgcccgccttgcccccccaaagtgttgggattacaggcgtgagccaccgcacctggcctgtcttttcttttaaactagactaacatgtactttctttggctctgctcaaccccaagatcccattttatatcatgccttattttaattgttacactcttaaaaggaatattctgcattgatgcatctaccttcgtacccatcttgctaacttagttgtaatctggcttcgattgggccatattttatggacactattggcttgaagatgatcagtgatgagatccagtgctttttgcttagctcttaacctgctttcccattcagcagcatgtgacattgctgatcaccttgtccttttaaaagctgcatcaattagtggtcatttgatataacagcagaaacctactcaaattattgacatgacaaaagggatctgagtacaagactataggaaactctcccacagaaagtatagtaggactgtacaaggactggaataatgaatgatgaagccatcagcaacaagtaaagttataacaagtaattattgaacacgtggtatatcctaggaactacataggtgttaagtgatcaagtagtgaacagaagagacaaacaaggtcgctgcctctagagactttacaatctagtaggaaagacttgccattaggaggtaaacaaatgtgtattgacaacatttaatgagcaaaatagatggaaaaaactgacttaatgatagattattataggttattagtgatgggtgaggactcaggaaggacattctaagacatggcatttcaagggaattgaggagcagggaggtagaagtgatttaggctgaggagacacctgtatgcaggccatgcaggagcgtttcaggggaagtgaaaggaggcattgtggctggaactgaaaaggggaggagaagagtagagcaaaagtagtcaggccaggtcaggccttttaagctattttaaggaatttggatttcattgcaaagttattggaagacaccaaacctttttttttttttgagatgaagtctcaatctgttgccaggctggagggcagtggcatgatctcggctcactgcaacctccacctccctggttcaagcgattctcctgcctcagcctcccgagtagctggactataggcacgtgccaccatgcccaactaatttttgtatttttagtagagacggggtttcaccatgttggccaggatggtctcgatctcttgaccttgtgatccacctgccttggcctcccaaaatgctgggattacaggcgtgagccaccgcgcccacccgacactgaacatttttaagcaggaaatgtggctcaacatatttccaagtttaccctgactaataagtagaaactaaattaaagaaggcaagagtagaagctgggaggcaagttgagtagctgcagcaatagattaggtaagagatgacagtagtttgacttaatgtaatagcagaagagatagaagtggatggattagacatccatttattaaaaacaaatgagaggactagctgctgggttggagggggcgatggtggggagaaaaatgagaaatcaaaaatattgtctaggttaattgtttggaataactggatagatggtgaaaccatttgctgaaatggggaaaaaatggggacaattttctcagaggttaagagaaagcaggaatatggaaattaagattttaggcccattttagacacattcacttcaagtattcatgggtacttgacgtatcaagcaggcaactgaatatacaaatatgaatcttggaggaaatgtctgggctggagagtttcatttaggagttgccagcattttgcagtatttaaagccatgggaatgtctaagattaccaagaaggtgagtttatacagaagcaagcagagaatagaggccaatttttagagggaactagaggaggaagaacctgaagagcactgagcagtagtggttagagaagtaggaaacagaacaggtgagtacagtgtcccagactcctatagaagagatttttttaaagaactgagcctgaccagcaatgtggaaaactgctaaaagctggaaaaggaagaggtcccagaaatatccactgggtctggcaatatggaggcagttgatattgattagcagttttcagtggcatgaagccagattggaatagactaaacaggaaaatagtagattaataggattaaataggatatcagaagtaacatgtagacatctctgtcaagaactgttgctgtgacaagatcaaagaatttggaccatagatggaaagggatggcagaagaatctttgttttgccttttaaagtaaatgttggcataacagcatgttcaaacattactgggaaaaatcaataatttgatgatgaagaagatggagataataactgcagaaatgaagtccctgagagacaagagggtcagaatttaaatcagaagtggaggagatggctttcgataggaaaggagaacatgtattacctgtacagaaaggaaaaagaaattgatccaaatgttgaaaaaatcatagatttgatggtgggactgtagtggagatgtatcagcaggaatgggtctggagttggggtggttttggaggattgaataaaatgcataagaaacaaaataatcatcatgggaaagtgaacttcctctcagactctctccctctttctggtcacctggtgtgatttctccttctttctgtaagtcacttcattcttttctctcagaaggcaggtttcctctgcttctctgtgcccatgacagaaaatggccactctatgcacaattctttatagaaaaatattttatttcttaatttcagattcccaaaggagaaaatttaattggcccagctttagtcagttgttgaactcgggtgaaatcaaccatggccagaggggcaaggttatttgggacatacatagctgtcaggcccaaaccctctatgtgttgggggaggattggttctcagagaagagggatattagtttgtcagatgacccacgaagcagctaccaaacttattttctgagaccctgaactctattttaaggagtacttctgccctgccttcttttctagtattgttttctttcattttttttttgttgttgttgttttgttttgttttttacttatccctccatgactcacgtataaattttcacaattttgtttttcaccttcttttcatttctatgcttttctcctttgtgaccatggcttcagctaccatatggacatggatagcccccaaatctatatctcttgtcttctcaacttcactgtcgtttaaaagctgtctctatttggatattctctggttattttatttatagctgaactcattatcttttcaccaaacctcctccttcccttagctgccttgtttgtgttaaagccatgactatcttctcaggcatccaagcttgaatcttcagaactgtctggcgttctcttttcaaagtccacatgatcatcagctgagaaggagcatgactttcaccttatttcactctccatgtcctttgtcattcccctgactcatgccacctaaactaatgtggagtatcctctaaaccttctacatcgtcttccaaccatcaatctctaattcaatgctttaagctattcttgcattaatcttcataaagcacagctccactcatgttctctccacccattcaagaatcttcaacagctcctcactgcatatccaataaagtgcaaaccttacctggcaaccaagggccgtcatgacccgtcatcaacaggctaagacttatcttccattaaccatcagccaaaggcaaactgttcaatcatcttctgcctggttttgtgcattcctacctacatgacttcttcatactcttcttcctgaagccttttctcaagtgagctttcctttccctcacttcaataatactctatttacatcctttttatataaggcaaatctgtagatatggctttagctttgtcggcatatctttttactcctctttaccaaagtgtgagaacaggtaaaccctactgagtgtaaaacagtgtctgacacttcaaaaacattcaataagtaacctgacaaggagttgctatggcttgatgctagtattgttgctactaagcccgcatttagccttattaggggcattaatatggaccttttcaataagatgctgagtagggcactctgaaaattgtgtttcaaaaagtttaaaataataaaaagaaacttctctagtccagcactgctgatgaattgacggcaccctaacaacagtccctcaacacacttactcgtgtggcaaaaaataagatttggccacataggaagaaacctatgacatactttaatgactttcaactctcaataaaaaaaaataacattatgataatcaaacatattcccttcataggactactattgctttcaggtattatgaacactctatttgggactaaaacaaatagaatgtcacaccatagaaagagaatatttatagtcctttggcccccaagttttacctgtgaatgtgctgactttatacaatatagtcttttagttacatggtgagagtattatgcatcagcttaagatgcattggaggtgccactggcatcatagttggcaattggagctgctatggcgatgaaaatctgaaaaaccagtggttttcattactgttttctatttttgagaaataactgtacacttattctggatgaccttaccagttaaaaataaaatatctattactattgcttcttctgaacttcttttagaaacaaagttttcattatttacatataatagtctcgtctacttaattatcatttattttcagttcctttacacaggtctcttgagaatagctcttcttaatagtgagatagaactaaataccaatcagcagatgtcactccttaagtgatcctcttcagttttctctgtttatttcagttgtcctttttttttcaatgccttttctccattgccaattctattttccttcttttggagataggttcccactctgtcacccaggctgtagtgcagtggcacaatcatagctcactgtaacctcaaactactgggctcaagcggtcctctgcctcagccttgccagtagttgggaatatgcctggcccccattttccattttcatcctctgatgagcctccaggagccagtaggtctaacaaccataatgcaaggtattctatctttttgaatggcagcttcaatacaaatatctgtgtggtttacagtagccacatcagatatttttctactctgcgactaggcttttgtagcagagatacacctgttagattttttttcctgaggaaaagcacaagttttagttcataagataaacactggctaaaatttgccactcttaacaacattaaacaaatatttattgatcatctaccatatactaagcactgttgtagagattcagcagttataaaactgataaaaagtcttcacttcatggctgttctattctagacagacaaaacaaaaaataattataatatattatggtttggttgctgataagtactctgcaaaaagagtaggataaagagcaggaaaagccgaggggtgcttacaatttttaaaaaagtgttcaggaaagctctcatcataaaggtggtgacatttgagtaaagacctgatggaaatgagtgagcaagccatgtggatatctgggcaagaacctttcaggcagagggaacacctagtgcaaaggtgcacgtaggctgtcacaagcagtaaggagtttaatttaagcatctgccagggacaaaaattcagtcaaggcttttttgttgttgttgctattaggaatcaatctacaagagagtttaatcagcttaagatgaacatcagtgcagatctgtttagtgttctctcccagccatgacctcattgcaaatactgacagcctggactgcctctcagatttggatgggccttggatgctcagccaggcaaacccagatggagctagaagaggaaggttttggtagctctgtgggctctgtggcttcttcatcttatgatctctccacatagggctgcatataaatcgcatgtaaccaatgattccaagttttaatttaacctaaaatgtagtctattaccatatttgcactaagaagaaagtagaacagaattctacctcagattagctaatggcagatcctcgtcccacagatagccatggcatggggctactgatacagaagtatttctcatgccaccaaattgtgccttcaattttgtcttctttacacaggacaacatagtaagaggtcattgttaacattaagtcttatataagattttcagagattgttacacttacattcaaccagtatggaaaatcggcactaggcctaactaccccatagctagcatagtagcataacaacgctcttctagcctagcaatccacatctcattctagggggtttccaatttactaagaacattttcttaaagcttctatatatccttggagcttactttgtcctcaataagaataaaatattatcaagaactcaacaaatggacatttgaaagcaggcactgagtttaatttattttaggccacctttgatttgtttgaagcctgtattccttaaatatgaagatcagtacttacgtcgtgagaataaaggtttaagagacaaccaaggtttctatagcaaagagaaacgactgagcttctagattggtcataatgacttactagtaactgaaaatagtattttaagatcatactaattctctgtttctctgtgtgagttatttagatttgctttagatgtctaagtcagctgtggtagatttgaacaaacacagaaagtccttaaaatatgactaggtatgttgctttagatccaaattaggtattgatcattgtgattgtgacctagaataaatttagaattattgtaacctaatgtgttgaagttgttccataaatatatttaggagtagctagagatgacatttctataatgcaactatgctgtaatcaaagcaacaactcagaaatttaccagcatgtaaaagaaaaatcttaactttttttcttcttcttcttcttttttttttttttttttttttttttgagacagggtgtcattctgtcacccaagctggagtgcagtggtgtgatcaaggctcactgcagccttgatctcccggccttttgggctcaggtgatcctcccacctcagcctccctaaccgcgtccagctagtatttttacatttttagtagagatggggttttgccatgttgcccagactggtttcaaaatcctgagctcaagtgatccgtctgccttggcctcccaaggagctgggattacaggcgtgagccaccgcacctagccagctttacatatttttaatctgtcagattttttgttcttgctattctgagaaaagtcactgaaaagaaatcatttatcattctttttacacacaaaataatgcagtttttaaattaatgagataggccatttatataaaatttgaaagagtaaagtttttattcataattaaaatatatgttattctggaaaacaaaaaaaaagtagtggtctgtcttcatttgtaaaatttcctttgaactgatgggaacttatctcacagatgagatttgtgggccattgtgaatactctacagattatgtaccccacagctttgagctgccaggtactatagcagagtgcttcctcagactcttgagccagtctgtctgggtgaaatttttagctccccatatactaactatgtgatctcaggcaagacagcttatttatgccacaactgagaccacagtaaggataataatagtatctaccttgtggattatatgaggactgaatgaattaacacacataatgttcttagaatagcggctggcacatggtgaataaatgttagctcttattataatatgtggtaaactgaggaactatcactagttttacttggatgaagtactgcatgaaatttttgtatttttattgagtttcatcaatttttttactgaacctagtatgctttctcgtctgaacacacaaggaagaaaagaaggatggctcctgtacgtgaaagtgacccctgcatatagtgcctgaaatcagaggaagcttgtcagtgtgggcagacaccacgagcagaccaatttgacattgtgcttctcttttaacctcttgaaaattaatgaaagttatctgatgaagatccttacattaattgctcccgattaaggtttaaaaccttggtttactgtggggtaaatttatgtttttgatagtcatccaaaatctttgtacgctttcagtttcattacagaataaaaaacaaatttaccacaatggattattacattacatctggtatttattcctcccaagaagctatctgcttcggaaaagccaggggcgcccttcattaatatatctaactgatggtgtaatgacataaaattccttgttgacccctgctattcagtgttattgtcttggaacatagaacttgataatctcttttcactgcataactacaaatgttaggctgtaagagtattttactttgttcagtgcaggttccagacatttctcctgatcaccagaagttcttttgattaataaggctactggtcacgaaaactcagcttactaaaagagatccagtcttctggttctaactaaaacatcccaccggatgcaggtgtacttgcaaattaaagtttgcctcatgtgtcctgtgtctcaagtcatacagacggcccaggagggtggagcccctgcaacctgcctagcggggcgtttgcgtgtctgggggtgtcgggacacgcgcaggacacacacagtcccactttcctagtctcgcacttacctcaaggctgtcaacttttacgctcctccctgcgcgcacagcccccacctcacgctgccacccctcacgccccgccttcaaagtaggaggcaccattgtcattggacactgcttctctcactcctattccagaaccaatcactcgagttctagtggggagcgcctaagccaatggaaatgctcgctgcggcagctgccgggtcctgggcgctgggaggcggtgccgggggcggggtgcggctggggcgaattagttgccattcggagtgaggagtgggtagaagcggcggcggcggcggcggcgtttgcggtggcgcggactccgaggagcgccagcacctcgaggccctttctctctaccctggtccccagaagcaggggtcccggccctccttgcagctgccgggttctcccgtgcgtgcagccctgcgagggctgaggagaaggctgcgagcggccctcggggctgcgtgatccgggccgttgccctgtcagcacgatgcctggagcggtggcggcggcggctccgggctccttgcggccccggccgtgaccgccacaccgagcccagccgggcggttgcggccgttggacgtttgttttcgcagccttcccctcccccctcgccgaggcggcgggggtgtgcgttggggagggggagccccgagactcctcccccacagcgatacccccgcccctcccccttacacactcgcacgcactatcgcgccggctcccacacgctcgcgcgcctcccgccccgcgcctccgtgtcggccggcggcgtccagggcccgcagagccaccatgtccactgcctcctcctcctcctcctccagttcctctcagacccctcatcccccgtcgcagaggatgaggcgcagcgccgcggggtccccgcccgccgtcgccgccgccgggagcgggaacggtgcgggcggcggcggcggcgtgggctgcgccccggctgcgggagccggccggctgctgcagcccatccgcgccacggtgccctaccagctcttgcggggcagccagcacagtcccacgcgtccgcccgtcgccgctgccgccgcctcgctgggcagcctcccggggcccggcgcggcccgcggccccagcccgtccagcccgacgccgccggcggccgcagccccggccgagcaggcgccgcgggccaagggccgcccgagacggtccccagagagccaccggaggagcagctcacctgagagacggagccccggctcgcccgtgtgcagaggtagcgagcccaaccctcccgtcctcccgggctgcgtctccccgacggtgccctccgtggaaacttcagcctcttcgggcttctctttgctagtgcattatcgaaggtgtgaaagtggctttgggaatctcacccccctgcggtcgctgtggggcttggaggagcgaactgaaaagcgacttttatttgaccctcatgccgcccctcagagtctctcttccatcactcgcctgcttcgagaggtttttcagtttaagagctggctagctcattcgtgtgtttgccgtttgtagccggggaaggagaagctgggcgaaacacttaacacgcacacaaactcttcagcagcggataaggtggcggttgtaatctctaccgtctctttgtgcttttctgcaaagttcctaacgtgcctgtaactaccgggatagtattttattttttagagggttggtggcattagtttcgatgtaaggatatcggctggatgtaatgatatctgctagaggggacagttttgaatgtacaattgaagtgtatacggttttttccctcagtcctccctctctccctctcccccagccccccgccaccccgcctctctctctccctctctttctccccctcccctttatatattcatgcatcagagcactcctgcactggaaacagtttgtgctctaccggagattttcatggtaaatttctgaaaacttatttgtggaacgtgttcgtttttttccttccatttttaagtacacttaacagttcagttgagctgttcaaggatctcaagtttctttttttgttaggtgtcaaaggtaatggtgagctggtggatgctgtgggtttcccttagtgttttctgttttgctttggttttgtttatgtctagggacacagtgcatgatttagttgagccctgggggagaaaaggaagattagccaaaacagggacttaaagctcataagggagagtggaatagctaatattgttagataccgaactagagctacagatgctgctgctgcattgtggagggaacagatcatactgggtggaaaaatctctgcttggaagggaaacactgtcaaagtctgtacattgtttatgtggtatgtggaatttttttttttaatggagctttcttgatgaaggtgttagagttggagaaagtggttgtctgcattatgatacattgcagtcttggtgtttttgttttaatatttcagacccgtaattagcatgttgctaacgcacttgttttctgaccacttgatggtgaaccagtgtaggatgtagtgcagtgggatgagtacatgagcagcaagaaatacatcctgtaatctgtatgcattgggaggaatatgctcctgcactcctcccccaggtcaagccagctgctgcagaaactgacatcctccagcaaatcctgaatgaatgaatgaaaacaacgtgatcgccctaataatgaccacaactgaacacacatctttggctgtattttatagaaaaggccaccattttctaacagattaatgccatatgcaactcctttgcacattttctagaactgtatgaaatgagaagtaacagaacgaacagaaaacagttacataaattttttagtgatttcgcttcaacagtgcacaaattgagttttgggattttcttgtagggactaagaggcataaaataagcattgcagattgtgtacagagggtctggtgggtgtgagtaagagaagtttcggcaattgctgcaacaacataatggccatctagtacctcctccccttttgtatataaacactaacatcttacaacggataatagtacaacttgtttttctgcatccttcaaaaggcttaatggcctaggaattacatgctccatcatcaagcagttttaataaaatttgtgatctggcttaaactattctctttgttgtagtgtggcacatacgagtttaatgcgattttaatgcaatcatgatgaaaacacttttctgagtctggttgtgcagcagacagatttgcagtgtcagagagcttgtgttgggaatgcaagggctttctttgctaaagatgtttttctgctgttttaaacaccaggtggttttgtcagtttcttacattgcagtgatttttgaatgcgggcttctgtgcccccagttccgtgattatattactcctatgttacttctccatgtcccgccttttacccccactacccaaattaaaactgtcctactaaactgttctgtttccttagccatttaaaatccatgatctgaacagttgatttaatttttcgaatgattatcttctcaatttcttttgaatgctgtaaggttctgacttgagtggattttagcctccactggtcaaggttcctgccgctgccactgctgctgcagacactgacatcactatactgcatgaatgaaaaacaacaacgtgctccatttcttcctctgctctccacctcctcctttttctgcacacttcagtgtatgtgtgtgtgtgtgtgtgtgcgcgcaagagggtgttaaaactgcgtttgaaactacacttgaaagcattaagtagttgatggctcaaggggtaggtatatagtataaaggcatattgtttatgaaaagctgcaagggctatgggcatttcgactaaaggtgacataactgagcattcagtgtttcatgcatttcatctggagtgatgattataggagaaaatatggaagcttaaaaatgtttttatgattcttttaccaaaaaattatgaaaccactcaatttctaaataaattatatcattatctgcgtcttaagcattcttaatgtgaatatttgtagggctaaggctagagtaatagagaattgatattcagattgtttcacaaggctgaggaaaagctgaattctataaataggaatagtcaattttaatattattataatattaatttatacaacccaggaaaaaatgataatttcctttatttttgtagtatagttttaaataatttaaatggttaccataatagaaatacgtaaattgccaaataccttgctgtatatatagcagacatggagttttacaaattgaaactgttttgtttgtgctcatgcatcatcctctttttgcttgttttttttcttttgtatttttaaaacttcaaggtttgttatttacattcattcctgtacttctgccattagtaaaatgtcatcctccctcttgtttggttctgaagggtattgcagtggtgaatgacaggctgctgaatgaatcctcaggctccctgtgatgtgtttgtaatagacgtaaaatcataaagtattatgcaaatagttatttttttgtaatggtaatacataaagtctacctttgagataaatagagcaactcaaatgagaaaaagcaggatgttagtgttaaaattaatgatctttaagctaaaatcattagtaacaaccaaaagaaaatatagtaaagttgcttctttttgaaacctcacagaccagaacccatggatttaaacatagaacaaatacagttttactgtccaagatagtaagtaggaaatgcaaatctttgtgtgcgtgtgtgtgtgtgtgtgtgtgtgtgtgttttgtaaagatagatcattaggattaattataagttctaaaagatgtaaaaacagtcatatttagaatactctggatggagaatacagcttatttttaagtgtaccaaatctgataacaaaaacatggaagagcttgtaatttatatagctcctgttttgaaaaatagcatatgttagttcctgatttaacatatcaggtttatttaggcctaatactctaccagattgctaactctagagtgaaatttgattagactttttcatgagtatcttgagagcctcattgttttatacataaagaagttatgattctattctaaaagataatgcaaatataatgttaactccatgtaatatatgtttgcctgtgttcattcatttgctttcagtttttctcttttccttaaatttatctttttaagtcatttttatactgtgctcaatggaatacaaaaaattttaataactttttctcttttaaaagagatactcagatattctctttctataaagttttattctcaggctattcttgaaaattaagatcctccctttccattttaaaattaattaattttccttgagtgcttatagatacttgtttcaaagctttcttctacattaatgttttagctttttctaaagagacaggtttcacatactgacttttgggaaaggttttcattctcagaaaactatgctagagagcagcagtgttcattatttacagaactatttttttccatcagttatctcatggtgcctaaaatttctagatcaatcagtgaatagcaaaatagataaatgaatttatagttatttaatcaaaatctattgtcttatgttcaaagattatattcctctcaaataactgttattgtaagcgtattgaatattgaatacctagcatgtgtaaatcatcttaatcagtttttaactgtatgtaaagttctgtgtgtatatatcgaactggaaatcattttattaattacagtactttttacagaaggactgccgtgtacgtttctgtaaggacttaatgcaaattaggatttgtactttggggaaatgttgaaggataatggcgtccttgtgatttttgttttacttgtgataagtcagactacatgtgaataagaaaataagggagtaactgggctccacagcagtgagtggaatggaaataaatgacagtgttcaacaaatggctagtcggagagggttttccttagtctgaaattttaaaaaattctaaaagtctgttttattaaaatgttcacaggtagttaataatctgccaaagagtatagtctaatgacttagttcttcttaattttagtttggtcttttctccagaacttaacatttccagacaccactaagatagactttctggcagcccctgtcctagtctgtgtctggcactgctttttgtcttcagtatataatttattcttttattaagtgtctaagaagctaaatcactgacactctttttgtgctacatactgtttaattattttaacgagaggttgaaaatatctaacttctggtttctgccaaaagtaagtggaggaaagggaacacaagtactcatatattgatatagaaagcctagggaactgatggaaggcagatactacctgtatttccctctgctcttcatttggacccttgaaagtgaccataagttgactcatcatttggctattctggaagaatttttgtgcttattctgaaagacaaattataatggattagcagtaattctgaaaaatctaaggattttacttacgaacaaattgtggaaaagtatttcattgtagcatgaacaaacatggcagatacctttaagcagtgttgtttattccaagtgaatgttactaaggcacataccaagttcatgaatacctcagtgacttcccctatactatgctgtgtctctagttttaggtaggaaagaagaaaacatatatttgtgtgctaactatataccaagcaatgtatactttgattcagcaaggatttaggatgtggatcttctcattccagatccagtgttcattccataagactatgctgttgctcctaactcaaaaagactctaatgttgatgatcagctgtgatttctaagctaaaagaatgacaaaggaattggttttcttttgtttccatggcactattacgctgtgctggggtatggtctgacattttcagaatgtctaaaaatgtgagacctagtttgttgaatgtaactaaaataaaatatagatggattggccatttttctccatttctttcttgcatataaggagaaagagacagagagaatgtgtgtgtgagagagagaaatccttgtttctgagatagagagagaaattcttgtttctgaagataggaacatgattgtatctgggctttcttgtgtgtattcagaatcggtactgtcctcgaatcactttgtagtgaatataagtgcttttctccccttttctctcttcataaatgttaaaagttaattacatatggtgctaaactgatggaagcttcaggaatcactaaacagagactggtctcaagtgattgtcccagcaactggcactaggttgattcagccctcccaaaagacaacaggcttccaagaatctgcaatttgtgggttgaacagtgtacgtatataacttaatgaagtccaccatcgtataccttaatgatggctcaccaaaaagaatgatgatttaaagaagctagtgggctgggcgcagtggctcatgcctgtaatcccagcactttgggaggctgtggtgggcagattacttgagatcaggagtttgagaccagcttggccaacatggtgaaaccctgtctctactaaaaatacagaaattagccgggcatggtggtacacctctataatcccagttactcgggaggctgagacacgaaagttgcttgaacctgggaggtggaggttgcagtgagctgagatcatgccattgcactccagcttgggcaacaagagtgaaactccatctcaaaaaaaaaaaaaaaaaaaggaaaggaaaaaggaaaggagaaaggaaaaaggaaataaaagaaaggaaaggaaaactagtaacccacggttgtgtggcaaggtcagtgtccaaaattgtctaccaggttattagaattgttaagaaatcctgctgggcatggtggctcacacctgtaatcccagcactttgggaagctgaggcaggcagatggcttgagttcaggatttcaagaccaacctgagcaacatgacaagaccttgcctctgcgcaaaatataaaaattagcctgggcatggtgggacactcctgtagtccagctactcaggatcctcctgagtgatcctcaaggaggatcacttgagcccaggcggcagaggttacagtgagctgaaatcaccctactgcactccagcctgggtgctagagtggggtgttgtctcaaaaaaaaaaaaaaagttaagaaatccaccaaccatctagatgtgtttcgtaatgaaaaggtgaaaactgctacaacttcctgtctagtgttactgaagatcaaatacttattaactactgacagtaataattccttatttattctctgtagccataaagaaaacttttgtgaatagtccgtatagctaattttaacttttacattactaaaaaattagctttctgatgaaacattttctaacgtcattacacacttgattgttaagcacagtgaacaagacataaacgaactccttgtggcttgattagctttattaataacttattgataacatatacataaaattgattactatagatgatattgagaataagactgaatgagtattgactgactagacttgtgctataactgattctataaatttgcttttgggattatttcctgtttttctgatgaaggtggagcaaagcatgtttgactgaactggtccttgatagtataaccgggctgttttctctagaactaattatcaaatgaaaggccaaagcaattattttccaaatggttccatagacatgtcgtagaggcataaatgtatcctgggaaatactagatttggagtcaagaaacctgagttctcttttcagttttgacatttgtcttatgacaagccactaactctgcatcttatcttctgtgtctttaaaatgaaggggatagactttttaagattttggttgggtagggaaaagattgagctatttaaaggaaaagaaagtttattagactagatgattcttaaaatttttatttattgagcctttatgccaactaataatctttggtagaatccaatataaggtacttttattaacctcttttcacagatgaggaaatgaggtcctgggaagttaagtaatttgcccaaggtcaggcagcatgcacagggctcttgtaatgctctaagtcctgacttcaagatagctgaaagttgttgttggaacccagttagttatggggcaggaaagtatgcacaatgtattatcccactgcttatacagttaagtcatagaaaggctaaatatagctttggggcggtgagggaagaagagaaagctaaatgggactagacgctagggtgcatggaacttaaaatagctgtaagtatccccagtaattatgccatcattgggccttccctttggtccctaaaggacctatcactttgtttagacagaatttagcattttatttttaaaaacttcctttcacatgaaatttcaaaatctgggtagaataaggtctcttttttgtgtattcatatttggcaatgtaaactttaaaaaatctgcccatttgtaatgtattataaggctaccttcagccccataattatgattctctacatttatcatcctttgatattttagcaacatttaacatagtatctttttatacaacactgtcatggcaaagcaatgcacactaccttaaaaaaattatttatatgtacttggctctttcacttcttttaggtttgttgatgtaatatagaaaataaattttaatctctattttaataatttcttctggggtgttttggcattttttcaatgtcatttgtgcttactataagttctgcatagtagttaatgtggaaacgattttcttttataagtaacattagaaattgtgtttattgttaggagagcaaaagtattatatagagtctttgtgatggataaagtttctcataacatttcttctgtaattatatttacttttctagttaaatatatcagttgtacattgaattagtgaagtgtaatgctggtatcttagaagataataaaaacagtaggactcagtggctcagggttacatcaagtctagccatatggaaactttactattcctcatacaaacttgtgaagtgatctttctatgaaggtacaaaaatatcatagtaaaatatagattggtttatattagctaattataaacaaaatgtatttataatatctttcgaagttttgtaagtgtcattttatttcttctaaagtattcttggagttactctgacacattgaccttaaaagaatcaatcaacagtcctcttcctgctttatgtcagatcatttaagtgtctaggacttaactaaactggtgttggcaaacattgctaaatgcagtttcattagtattgcaaaagtgaggatttagactgtgctcagagattagatttttgaaaaaagctacagtattctgcaatatttcgatcatagagcttaaaaagtgtatttcaaaggtctattaatactttacatgccagagtgacctcttagtttgtaaaaaaaacgcattcagggaattgcatttgctcactttttatctttttaggtaacaaatagtgggtcaaattcttagcagattttaaatgagttatccttgttcagaaatatgctattgtcactgagttttagattttatatatgaattgtttatttctaagttagcttgagctttttctggtgttctgttttgaagttgccactctgtttatgtgtatttttctttcattagatgaagcttgaaatattaattggttcatcctatggtttctataacatacttacatctaacgtatcttgctgcctttacctattataatattatactatagtttagcctaggatgatgtcactggccctttctttctatgcatacatatacattagtgcagaagtctgaactgtattgttgaatgtggcttcttgtgtagtaatgtagtaatatgtagtaataatactgtgtagtaatcttgggcagtgatgccttgtgaggctgttgagataaggaggaattggctttgtctaaatatctgctattgctgagctagaatgggaagtgacaaacttttcatgtgttatgtcaccatttacctgaaactttggttgaatgcagtgacccatttttctttctcttcttttattttttctttatctttctgtctttctgtctttctttctggcagtgtctcgctgtgtcacccaggctgaagcacagtggcacaatcttggctcactgtaacctctgcctcctgcctcagcctcccaaatagctgggaccatgggagtgtgccagcacacctggctaattttttgtatttttagtagagatggggtttcgaactcctggcctcaagtgatccacctgccttggcctcccaaaatgctgggattataggtgtgagccactggacctggccctatttttctttcttataatcagactttacctattttcagtttctattgacttttagtttttgccttaaagaatattagtgacctcaccagggcttatagctgaggagaagtgggtgccatggcggttctactggagactactgtgggcaatgtggttgtcaatttgcacactgagcagcagccttgcaactgtgaactttttgagagcaggtaccacagtttaatggcatttgtgatggcagtgccaagcatctagaaggtactcgcctgctttaatttcttgagatattacaaaataaaatattacagttattgccttattcacagtatacaaaggtattttatcatacaaactgttgatcctacagggactggtcatggaggagagtctatttttggcctaggattgtatggtgatcaagcaagcttttttgagacagaaaacgtcccaagaattaagcacaagaagaagggcacaatgtccatggtgaataatgacagtgatcaacatggatctcagtttcttatcactacaggagaaaatctagattaccttgatggtaccatacagtatttggtgaggtgacagaaggcattgacataattaagaaaataaatgagacctttgttgacaaggactttgtaccatatcaggatatcaggataaattatatagtgattttagatggtccattttgatgacattcctgatttattaatccctgatcaatcaccagaacctacaagggaacaattaaagagtggtagagttgacacaaatgaagaaattgatcatttcaaacgaaggtcagccgaagaagtagaagaaataaaggcagaaaaagaagctaaaactcaggctttacttttagagatggtgggagacctacctgatgcagatattaaacctccggaaaaatctgtgtatgcaaattgaatccagtgaccacagatgaggatctggatataatactctctagatttgggccaataagaagttgtgaagttatctgggactggaagacaggagaaatcctctgttatttctttctttctttctttctctttttttctttctttctttctttctctctccctctttctctctttctttctgtctctctttctttctttctttttttgttgagatggagtctcactctgttgcttaagctggagtgcagtggcacgatctcggctcactgcagcctctgcctcctgggttcaagtgattctcctcccttagcctcccaagtagctgggactacaggcgtgtgccaccacacctggctaatttttgtatttttagtaaagacagggttttgccatattggccaggctggtctcgaattcctgacctcaggtgattcacttgccctggcctcccaaagtgctgggattacagatgtatgcttttattgaatttgaaaaggaagaagattatgagaaagccttcttcaaaatggacaatatacttatagatgacagaagaaaacatggattttagccagtctgttacaaaggttaaatggaaggaaaaagtgggaaatacaccaagagtgatttaaaggagtatacaaaggaacaggataaaccatctaatttggttctgaaagataaagtaagcccaaataggaggcaaaatataatgttgtactagatgagcaggcagaagactccaagtcaagtcactcacacacaagtaaaaatcacaagaagaaaacccatcactgctctgaagtaaaagaagatgaagactacataccaatcaaaaatattaatccagataagtatgagaaagtttggagtttggtcactacgaagaagaagaaagctgttgggagaaatgaaagagtaaaaagagagaccgaactcagaactgaagtcgtagctgatcgcaagagaggaatggccattatagtaatagtcacaaatccaaataccagacatctttatgaaagagaaaggagtaaaaagagactgaagcagaaatccaaagaaaaatccaaagataaagaaaaatctaagtacagatgaaagatgaagaggcagaattgagtggctaacatattcacccttgtctaacttagagtgccaggaaagcaggtgttcagattttgtgtcagagcttgttatttttttcatactaggattatcaccctttagattattaatactgattatatagggcactgaaagaactcaacattttctttgtatacttttttacactaatgttattgttatacataaatggtagtcttcatttttgaagtctttcacatttttactcttcttttaaaatgaagtatttatgctacaaaaatacataaacgtgtttataaaggcaaagggataataaatatgaatatctgtatactcatcagccagcttaagatctagaatattgcctatactttagaagtcccctaagaaccctctccctctcaagtaattatttggaaatttgtgtttgtcatttgctttgtacataggtatctctaaatgaaatgttaattttgtatgtttctcaattttgtataaatggcataatgtttgtttacttttgtgactttcatttttattgctgtattgtattatatgaatacttattcttctgttgatgtacatttgagttttatttagttttgtttttgctgctgaaactgctgctgtgaacattgtctgtctaggagttatagtgcttgatcatgtgctatgagtatcttcatttgtataaaataatgccaaattataaaaaatattagaattatagcctttaatattactattcagttatgttagctagtctttaggacacttgccccgttgtactttgtattaaacatgtggtcaaaaaataatgtctttatgcggatattcctgtttaatgaagtacgtgttgtagttaacttcttggtaaagcaaacaatgttaaatgaatcatattttgtggattttcttttttatgggcatatagaacactgaagaaaatcttacggcctctgactataaccatgtaagaaactgtataaaattgtatgtaggaattttaggaaatagggaggtataggaaaagtaatgaaatgaattataattaatatttgttttgttcattttaaaatattattctattattgaattaagtgcctcaaaatataaaataaatgtatagtgcagtagctgaatctttgattatttgacccactgtattattccatagttaatgtagtgattctagaggctttgatagtttagttatgatttttcatttatcttgatgtttttataactctgtattcaaggtaattttggtggatatctgtgcttcaccaaataatagcatgtcatttttagtattccagcatctactatggtttctggtgtttagaaagccagccttgcagtaaatattttttaaatccttacatagggtttatatagagatttctgtttagctatatatgttcaaatctgtgatttgaacccagctacatgaacaatgattgttagtgcatgcaagtcctgtgaatatctgacaaaggttaaaactaatagattatatttgtgttgcccattttgtaaaaatgcctaatagtttaggtaactgatggtttttatcttcatttaaggcctgttattcagtggtagtggtggaaaaacactgatttagactttcacacaaaataaaaggagctgggtgctcttgctggtagagataggtgggataaagatgggtgatgtcagcatagtccacatattaaaagatggaagatagatttccacagaatgagtttctaagttacatttaaagttctattaagtgaattttgatttagtgaggctccatggactcagcttctgaatttttgtttgttttttttgagacagggtctcactctgtcacccaggctgattgcagtggcgcaatcatggctcactgcagcctcagcttcctgggctccagcaatcctcccattttagcctctggagtatccaggaccacaggcatgtgccaccacacctggctaattttttaatttttatagagacgtggtctccctatgttacccagactggtcttgaactcctgggctcaaggaatcctctcaccttgggctcccaaactgctggtattacagagccaccagtgctgaccctgaatctgttatacttagagaaactaaaccatccatgcccaaaatttggtgggctcttcaagttaaaaattctgatgtttttatagtccctcctaaagactgtggtaatactgagctccaagtaaggagaatgtgaattatatattaatttgaacttcatcgtaatgtaaaaactttaaactgtaaagcagattttgaggtggttatttgctctacgcaatatctaacttatgtgcaggtaaaatgacccaatttacaaaatgttatttacgcaaactttttaggaagtcagttacacaaggttgaggttcatctgaggttgtaaaaacatattaactgaatagtgtaatttctcattgctgaataaaatgttctactgagatttagcaaaattaatatcctaagaaactattataaatgaacatgaatacatcttttccattccctttctgtctgagttttacaattctgaggaatgtggtattcaaataacccctaaaagggaaagaactcatatatgctaatgattttctcacatttctgtgaaaagatatgcttatattggataaatatcccaagactttttctggaatattttgtccttatttaaaaaagtattactttagttatagttccctaggaaattattcctaaccagcctcatatttctgtccttcttccaagaaaaactttcacaaaacattctactcttgtcactgtcagggggacagagcagtaagtaagcataattagactacaaatatggttagtgctgtagattatgattttgtgtatatttgtatatttctacaggctgattttaatttgttgttttcgtatatacttaaggacccagggaaatgtgtgtatgtatgtgtatgagagagggagggaaggaaggagggagagagagagggagaaagagaaagagagtaatagcatgcgcaccctaaagttcacattcctttttcagcaatcactggataatccctggctcctgacattttctccatacagagtagaggttcatgatcactttttcataatactttaggtaattttaatatactgagggatagtgacttaggatttgctcacttcgtataagataaaaccaatgatgggcacacatttacctgtgtaacaaacctgcacgtcctgcacatctatcctggaactttaagttaaaaaaaaaccagtgaacacccaactagacatattcctgaatgtcttccttgtgattcaggggaagtttactatttatagtgttatatttccttctcggaagcatttattcaatgctgaacaccttgactgaactgtttacctcagagttatttggtaaggtgtaagtttgttgtgtgtgggtttggagaaaaatcaatccgtttagatataaatcctttcttctgaatcatataatatagttttagaatggcaatcctgttatctgcagtttaattttcttaacaaatgtatcaattttctctgctggggttggctttataatttttgagtggaagattatgttggtatttaaattcaaacttgaaacaagcattgaaaagtataattactgcatttctattggctggaaatgagtatttttatagttggtacctgtgtatggcaagttaaaacagacatgatccttacacattctacaagtttacaaatctgaattttttaaagtatcattataactgtctttggatattttgctcatggtttttatcttcttcttgatcctgttactgtctgtataaaaagttttaaagtgtattcaatctctttttcacaaaatagaatatatcatactctcttagtacaggaattcgtattcaatttacatgctttgaaaaagtgacctagtgtggccaggcacagtggctcctgcctgtaatcccagcactctgggaggctgaggcaggcggatcatgaggtcaggagatgaagactatcctggctaacacggtgaaaccctgtctctactaaaaatacaaaaaattagccgggagcagggggaggggggggtggcaggcacctgtagtcccagctactcaggaggctgaggcaggagaatggcatgaacctgctaggcggcgcttgcagtgagccgagatcacaccactgcactccagcctgggcgacagagcgagactctgactcaaaaaagaaaaaaaagaaaaagtgacctagtgtatttttctgtgttactgagaataaaactaataaaattcaacaaattttactctatataattgcaagtttgagtcatgtgttttaaagattcatatgtaatatatgattagaagcatagttatgaaggtaagagtattgaatgatttaaatttacactcagagacttggtacagaaatggagttggtttcttcacttattggcatgatggttccagcctttatggttaagagatattcagacctagagtgtcattggattgagttcttacttcctactagcataatctttgactttttctcctcactcatttctcccatccttctggtcactatatcttgtcttaccttctcagaattatctactgaacatggtggggtttttttgcattctttccatgtcctaattattacttcttgcttggacttttggaattgtcacctcttaagtcttttcccatgccagttgtcttgcatctttaatgtaatcattatactgctataagtacagtctttctttaaaaacaaaacaaaaaaaccccacaaaaactgattttaatgaaagatttctgttggttccttggtgaattaggggtaaaagactcatctcactatcctccactgtgtaccttgtgttcctgccaaactgaactcactttctttgggtatatttttcctgtcaggaatacttgtgcctctaatatacatgatttttgcctgaaaaccctagccgttctttgcaaacagctttccaatatcatgcttctctgcaaaatattcctgacgtttccaggtaaagagaagtgtggctttctttgaatattcaaagcactgtatttacacctttacatcgtactgtcactatttaagacacttgtcatctcatctgaaatgtcagtttcttgagggcaggaattctggactgttcaggatctcattgcccaccaaatgtatttctctacttgaatgtttctatttcactctaacaaattgcctgacattttactacttagagatccttttgagttgacagtcatttattgattgatgattgacagagtctcgctctgttgcccagactggagtgtaatggcataatcatagttcactgtaaccccagactcctgggctcaagcgatccttccacttgagcctcccgagtagctaggactacaggtgcatgccgccatgtctggctaatttattttttattttttattttttttagaaatggggttccactgtgttgttcaggctgttctggcctcaagttatccttccgctttggcctttaaaagagctggggttgcaggagtgagccaccattttattttttaaaatgcgtatctctgaaaagatatccttgaaactcactatctttgtatgaattagttcaattagattattttcctcatgatattaaattgagaacaacagtaccaagataatgggagtcttcttggagatgagatgggagtgacggacataatgctttttggggagagtaagtagtagtctttcagtaagatgatgtttggaatatgagaatatagtctttcatctccatatggccccaaatcccaaaacctagaactaaggcagcactggagtctctgttgataagagtttacagtttacaataaggtttttgtggttaagtctatgttaaaaggatccagaaagttcaactagtgttacgtgttttaatgctgatgagcagagttttttgttttgttttgttttgttttgttttttactatcaggtgtattgttattagtagatacttagtatcatcagtgtgaaattacataccaccttgctttgacaaatcttaagaactttcgaataagttatgggagtcctgaccatcctttaaggaaaacagtgcactcctctaaaagcctattcaaagaggtcacattgaggaattatatatgttttctagtctttttgaagtacttttttttaatgtcttcggagaatttcatttagaatactcttggagtgaatctgtcttttaggggtagatacgacttttgaaaataaccaaatgtcattaagaacctaatgtggagagtaaggtaggtgattaagttagattatcttatttatggtgacagatgatgatgcttatgcaatgagagtcactttaaaatttggacagactgtctccaagagtaatttagacaaatagagttattaataatacaaaaagtcttctatagtagactcctatatgttcacctaatcctcttttctctccctcttgtgcctacttctaggctgtaatttctggccccctttgcagttctgtatttttttctttgctgacctctgctgcagttagataaggctaaatgataaagaacactttcatccttgttcaacttaaaaattcttatgtggtcctcctcattctttcttttccctcatctgccaactggatgcagagaatctagtaaaggactctgaccaaggtcctaatggaatggtagagccatgagatgaatgaagtctgaatccctaaatgatcaagtaaaaagcaatctgtcagtcagaaaatacatattgggcttttattgtgataaggcactaattttttataaaaataaagctataattttaaattgtagcggctagcattaccacccttactgtactttagagtttgaagaaggtagtccactagctgatgctattggagccaccttgaaaattaaccttgggagttcctctctttccttatctaatctgtcacattggcaagtatggttaatttgtgttggcagtgcatctgtcaatgcaagagacactccatcaacctgttctatttttgtgtttgtaaaatgtcagagcatagaaatcatggtcttttatataaatgaggaaaatagaatgacaattggacctgaattcaagttgtttttttcactgtcttgtactttattcacagtgattttagatgagcctcacataaagaatattaacgagaaatatggagctattctacttgaggctcttcccaaaagtctgctttggtaaagaggtctagaatacatgccaggcgattttaaatttttgaatatttatttcatagtaaaggctaaggagaccacttgtgatagccacaagtttaacaactgttttgtaagtagatatactaggtgtcagataaatgaaaatatgacaacattcttgccttttaggaacatacctcctggtagataagtcttgcattaatcatttaagtgcaaggtaaacatattttgattgttagtttttttcctctcctgtctcattctaaagtgaaagtaaaatagctgagatataggtgaaaagagagacagatacaagtgtgtgatctccatgagaaataagtgagctacattacttataatgctccgaacatgcgtagttcagttcttgtcacctgttaatactaaacacatagaaaggattttaaaaatgtaatcagaagtgaagggagagagaaaggagagaaaaaatccactggagctatctggcttggtgtggttttgttttcctcctactttgagatgagtccagtacatctggaggtattattcagttttgtattccaaatgccccagctattctaggtattgttaatgattcaggctgtatctaaaactatcatctgagattaattcactcatttcttgggcacttagggtgaacagtgctctttgtttgttgaggagaaaaaaattaaatacagtaaacactaaaactttgtgactgtagtctgtatcgcctggacagtgccattttgactgaagcacagttcaatcggtaatatcaattgactctttttgacaaagataataatgcccagttttgtggctattttagaaaataaagcataatgctatcctccaatatgttatgacactttgccctacacttgtttatgctgctggttgttttatttcttcagttgctctcaatccttggcaaaacttcctggcaatcttttatgcacaatatttgtagaattgttgaggtgaaaggtgttctgtgtatgcagacatagactggtgttttactgtgttgtgttttactcgtggcctctacaaaagtgtgatttctgtaagacattttccttcaggatattttctgctgcttttggcctttccgactttatgaagcactcaattttggataagctactgctttacagctacatatttgattctttggtgtcaatatatatgaaagtaaatgctagaattaacgtctgtgtttccgtatttctgaagccttcattctgttgagtctgtttattctgggtttactctagaaaagtgtagctagttgtgtttcctagtaaacaacatattcaccattgctggatttggggacacattgtgggggtggggagaatacagcttgtgagctatatttaatttactacattattttgcattgagcaaatcagtggtatccagacatatttcagtacagatttctatttatcatttgctttgcagcagtagattagcttggctggaaatcataccttactcaggttaaatagttactctttttcctaggcctttccccttcatctcttctacatttaaccatggatttaactcttcaccctattgctagacagttacgagctaatttgtagttattacataagcaaagtgtttaagtgtgtgaatcttttgtttataaattgtatgttaaaatatatttggattaggaattctacttttcagtttagatatcatgagaagggctattcacttgtctaggagactgttgtgttttctgtattatatttagctgttctttattcaaataggaaataagaatgcagataattttccaaggaaggatgttacttttcagaattagaggaattataggcatacacctatctaaatacattttacatggcataatttgattgtccttttgtagagattccataatattaatagccataatcagctttttcttggccttgaaaataattttagggatgctttgttctttactgacatgtccagtagttggtaaggtagtgtggaaggagcctggttattctctttgttctgtaagaggcccttctagatttaccccattgcaaggagaagatcttcctcaaggcttctatcttttctacatggctcttcttcaaccccctcagtccattatcccatcatttctcatggtaaatatctttctccataaaaggaactactatttcttaatgctttcctggttcttgctatagacttccataggatgcacttggaactttgtgagtgtcaggcttggagggagagaataggcaaaaacctattgatggttttagtgtgaatcctccaatttcagttactttctcctctagattgagcaggagctgatttctttactaggttacttagggagaaaacttacctctctaaggctagccaattcaatgacgttggaggaatattagaatttattttttctttctttctttctttctttctttctttctttctttctttctttctttctttctgtctgtttctctctctctctctctctctcatatatatatatatctggctctagaaggaatttaataactcacatttagttatcagacattctggaaatttatagtcttaaattcaaatgtgttgagagggaaacaatgtaattttactatccttctatggtcatttatttcatttagtggtggaagacttgcccatagagatactgaacatactgctgctctcttctccttcaaaggtgctggctcaatgactcacaccttccaccagttcttatgttaattcctttccaggcttttgattgaagagcattctctaatagattttcaggaaagactcataggaacaatattccgtaagttcttgctagttatgtagcaagaactcagatatagcttttttaatctgtagcctttatacttgaaggtcactttagctttatcagatatatttgatatgttgattattttccccagatataagtatgtcctttccgtatgtcctttcaagttatcttttattttaggagagttttaaaaattatagtttttagtattttttgttttgttcctttggtcatttcttgagggactcctgttacacacacatgttggaccttctttgcctatgttacatattactttctcttgaaatcttgtctcctcatttttttaattctgtagtttttttcttaccatttcctatttctgttaaggcattatccattgtgtttattcattcttgtgtttcttgtaacttagtcttcatccctaaaataagttttgatatcttttctaagtttttcctgagtttgatcacctctattttcatatcttccttgctgtcaaacacatcatttccgagtattttttaagtaatgaggtttttcatcactgttgtcatttaaaaaaggatttttagcttactttgaaatattaggtcacagttttcatcttatgtgagcatgtctttctggcatgctttcattattcatagggacatcttttattctttgtatgcttttattcccttacaataactttaggaagaatctgctattttctgttgttcattttttttaagtaaaatgattttttttgtacttttaaatagggtggatagttcatgataccatttctgtcttcaaggctctagtgctcccactcttcttgtttttgtaaaatgacttctaaaaaaattctcgattctgctctcttcctgactccgttgtccaactttttctcaaccttctcttttctttgcttctgtctgctcaattttgattagactctcagtaatttctctttactgttggattccatgttggaagcagttcttttttgttagatttgagcatagccatattgctctagtatctcagactttattgagttgatgtcctcttgctttcacttgcaaatcagattgtgtggaatcccctcccagtttggctactattctagattggccctttacatttacccattagtgaattgtgttctctggaccatcagaagcctgggtacattcctttgctgtctctcacacagatgctgataccactatggcccaatacttttttatgctttctcccaactcatttatatttggtgttttgtggagatattttgtgactttattatgttgtagatgccaatactccttgacttacaatgggggttacatcctgaaaaaaaaaaagaaaatattttaagtcaaatatgcatttaataccccagtaaacccattgtaaagtcaaaaaattgtgagtcaaactatcataagtccaaatgcttcttgacttaggtatgatgggtttatatcctgataaacacatcataaagtcaaaaaattctaagttgaaatatcataaatgtggaaccatctgtattgtccttgaatcttttgtttggctattgtcttaatctgtttcgtattgctataacagtgtcacagaccagcatggccaacatagtgaaaccctgtctctacaaaaaatacaaaaattagccagacatgttggttcatgcttgtaatcccagctacttgggaggctgagacatgagaatcacttgaatctgggaggcagaggttacagtgagctgagatcacaccactgcactccagcctgggtgacagagtgagactctgtctcaaataaataaataaagtagctatagaatattatagctagtttataaaattttcagactcagggttaaattatttaatgaatttaaactattaaaatctaaatttaacttacatattagagcagtctgatttaattttactttgccactttcacaaaaaagaaattcattgttcacaattctggagagtgggaagtacagtatcaaggtactagcatttggtgagggccttcatgctatgtcatcccatgacagaggtagaaaggcaagagagcaaaagagggttgacctagctctaataacaacctgctcttgtaatagcattaatgcattcatgaaggcagagccctcatggcctaattgcctcttattggtcccaactcttaataccatcagagtggcaattaaattccaagatgagttttggaggggacattcaagtgtagcacctttcttccttgctgtctgtctgtcgttaaaatctattctgccagcatcttcatattgttggaatacattgacaaaacttctatataaggaacagtcttgaatattgacttattactctatttaatggacagaaaatgctacatatattacatagatatacatagagatacacacaaacacacacacactcacacactctccatatttgtccaggtaatggtttcacttaatacactaacagtgtttgtgtttgtgtatcagtgtttgaagtgaaactgttacgtggacaaatagggagagcatgtgagtgtatgtgtttgtgttttgtgtatgtctgtgtatttctgtatgtatggacatcaatcccaagtaaaagcaagtgaaaaattttagtagtatcctctactagaagagtgaatatttttctatttgttgcctttatttcttattaaataaaaagcaaattttgagggaaaatgctttttcctatgtgtcattatattgaggaaattattccctactttaattatcaaggtgtttgaccagtaatattagttagcactttaggaggctgaggtaggcaaatcatttgagcccaggagttccagaccgtcctgggcaatatggcaaaaccccgtcctctacaaaaaatacaaaaattagctgggcgtggtagcatgtgcctgtagccccaaatactcgggaagctaaggcaggaggatcatctgagcctgggagatcaaggctgcagtgagccgagatcgtgccactgcactctagtctgggtgacagagcaacccaaatgtccatcaatgatagactggattaagaaaatgtggcacatatacaccatggaatactatgcagccataaaaaaggatgagttcatgtcctttgtaaggacatggatgaagctggaaaccatcattctcggcaaactattgcaaggacaaaaaaccaaacaccgcatgttctcactcataggtgggaattgaacagtgagaacacctggacacaggaaggggaacatcacacaccagggcctgtcgtggggtggggagagtggggagggatagcattaggagatataactaatgtaaatgacgagttaatgggtgcagcacaccaacatggcacatgtatacatatgtaacaaacctgcacgttgtgcacatataccctagaacttaaagtataataaaaaaaataaaataaattttaagttcaattaaaaaaaataaaaatgaaaaaaagagagcctattttataacctttgttgttgtgctcttgttaaaaacagtttttctttataaattgagatgtaatagtgagcctgtctcatttcataaaaaattttccaagctgtggtgctttaactggaagttaaattcacagaattttgtgaaatattgttttctgagtaggaatatttgtgttccttttgcttacaatatgactttccacctttggtcagttattttagttgtttttgtagttgctaatactttgtgattacttctttagtatatgaactcattagtcatagtggattttagatgtttggaatttcattaacagaattcatttgaaatttgtaaggctgatgaatctccttctactaattactactttgctaaagttcgttaaaggactatcattctgccacctcccaaaaaaacgaacttaaaaaaatcttttgccatatatgtaattaaaaaaaaaaagtattccaaatatcagagctccatcttaatttgttgtgtactttttcagtgcttgttaccaggcttcttgtagccatattagtgaagttttcttttcaaccttgatgcaaagatactcccttgagttttctttgaaaatagactgaaggcctccttctaaatgtcttatgtgtcatttgacataagtttattgggtgagctgtaacctagagaatcatgcccaaatagctgcctgactgcattttttggtttgtttgtttttcctgatggacctcaggttacagagttttgtcaggcctcatttggtcagaagcatgtttgtttctcttgtcagcttcttgattggtttctttccagattctgcagggcagccatatggtcatttctgcatgttttctagattgcttctgtggtagggttccaggtttggttgatgagtatttcagattctacccacactgagagagcttcagttttgctctttggttttatttcagatagcatattcacaacttgtgtccttcctgtcacttatctgaagttcatttgaatttggtgattttattttacgtggcctatgtatttggctaatgtttcatcattttatatgtcaaggaggaagactattaatggctgttgaagtgcttagattatgctaacttaggaaaactaaatctagtaataattctattggatgataaatattaatgtacattagattgggtagaaaaacataccagtcacctttccatatcttgtattctcagttattttgttacctttttttttaaatttattttgaaaatcattgtctataactgcaaggcaaggagaaaattacttaatgttagtagtgataatacattaaaaactatagctttcaaggtattctcattacagaattaatgaagtaaatttctactaataaaattgagctttaggaaatttatgcttagccttagtgaaccaatagcaggaaaattccacacctgtatttatttatggctatttttgatctcaggtagattaagaactatatcatttccagatattttgaagtttaagaaaagcaacttaatgtcttgtattcagtctgatcttgatgaatttggtattttgatttcaatgaagattgaattaatatgaataagtgaagttaaacatcatgaaaaactcactgactacctgttaaaataaaggttttataaagtagctatagaggctgggcatggtggctcacacctgtaatcccagcagtttgggaggccgaggcaggcagatcacctgaggtcaggaattcaagaccagcctggccaacatagtgaaaccctgtctctacaaaaaatacaaaaattagccagacatgttggttcatacttgtaatccagctactcgggagcctgagacatgagaattacttgaacctgggaggcagaggttacagtgagccgagatcataccactgtactccagcctgggtgacagagtgagactctgtctcaaataaataaataaataaataaataaataaataaataaataaataaataaagtagctgtagaatattatagctagtttataaaaattttcagacttagggttaaattatttaatgaaattaaattattaaaatctacatttaacatatattagagcagtctgatttaattttactctggcactttcattttgtaagagaacctactttgtttttttcagacttacatttttgaggaggtagttttttttgtttttttttttttttgttgttgttgttttttgttttgtttcgttttgttttgcttttgagacggagtctcgctcttgtcacccaggctggagtgcagtggcgtgatcttggctcactgaaacctccgcctttcgggtcaagcaattcacctgcctcagcctcctgagtagctgggattacaggcgccctccaccacgcccagctaatttttgtacttttagtagagacagggtttcgccattttggccaagctggtctcaatctcctgacctcaggtcatccacccacctcggcctcccagagtgctgggattacaggtgtgagccaccgtgcaggctcaggaggtagcttttattgtaactacttttaacttttatttgcatgcaaaatgccttgtttgcgtggttgggtctttttccaaagaagctatagtgtactttgtctttcttactttctagtgttcctaagcattctaccttagagtgttttgtatttaggttttaaggttcttattgccatggccagaacttaatttattaatagctactgaccttttgaaggagctgactacatgtttaaatttattagatctaaaagtttagctgctaattacagatttcaaagaattggttgacttttttgcagcaggatattttctagagtgtatagtcaagcttttaatgtctctaaataggttgttgaataggttgttgccccccaaaatttattttttgagatacagaaagaaaatataatttctgtatttttattttttattttctacatatacatttctatttttctgttttataatatataaaatattagcaatatcatagatatccagttcataaataagcagctacacattactgcatgcctatatatttaccaatagggacacttagtaaaaataatttgaagaccatagttctgacagagtagttatagaaagtgaacactaagtgtagagcatgtgatctttttaaagagatagataaagattcaatgattaaaaatataataaaagaaaaattaagtaaatatagagtaaataagtaaaagtatagattagaatattattatacagaccaagggactcatttatagattgtttatatatttaactcattataaaacattaaaatgggctgagtattgtgactcatgcctgtaatctcagtgctttgggagcctaaggggaaaggattgcttgaggccaggagtttgaaaccatcttgagcaacacagcgagaccccatccccataaaaaatttaaaaattagccagatgtggtggtgcacacctatagtcctaactactgtagagctgacgtgggaggatagcttgagcccaggagttccaggctgcagtgagctacgatcacgccggtacactccagcctgggcaggtgacagagcaataccctgtgtctaaaaagaacaaggctgggagtggtggcttatacctgtattcctagtattttgggaggccaaggtgggaggatcgcttgagcccaggagtttgagaccagcctggtcaacatagtgaggcctcatctctataaatttaaaaaattagctgggtgtggtgatgcacacctgtggtcccagctactcaagagactgaggcaggaggatcacttaagtctgggagtttgaggctgcagtgagctgtgatcatgccactgtcctctagccctgggtgacagaactagaccgtctgtagaaaacacaaataaaataaacaccaccccttcaaaaaaaccattaaaatggttcctattgtttatttactaaactaaaaggagttttaataattaaatggactacatacagcgtttcaaattgtttggagcaatttaagtagaggctcaagttattcacttagaatggcgtttccttatctggttatagctgacctttatataggccttttaaatttagaggtcaactgataaatgtcggctttgcctctcaacagtttgttgtcttgtgtttcttcgcagtggaaggaatttaaagtaaactttaaaattttaaacaaattactataaatcagataatgggagatgttaattttctgtttcccagtgttgctaaaattagtaggtattgcctttataaccaggaaaaatattcaaaaagttaatataaataacttctagtagtattaatagaactagaaacagtttatgtatcttcagagttacctatgatgtggggaggaggtaaagataaagggagaagaaacaaacaataaaacagaaagcaattagcaaggaacattccaaaataggaaaaaattacatgacaaattaaaccaaatttcttataacaataaatataagtgggataagctcaccttttacaaccagaaggctcgctacaatgtttttttcaaaaagtataaaaacatactttgttttatgatacacataaaaaaatcttttaggatgggcataccatgtaaattaacagaaagaaagcagaagggggtcataatattcagtatcataaaatttcaaaaataattaatgggacaaattataatatgatgcatataagctgtaatgttgatgtcaagaatctatatgtaccctttaccattatgtaatggccttctttgtctcttttgatctttgttggtttaaagtctgttttatcagagactaggattgcaatccctgcttttttttgctttccatttgcttggtatatcttcctccatccctttattttgagcctatgtgtgtctctgcatgtgagatgggtctcctgaatacagcacactaatgggtcttgaatcttaatccagtttgccagtctgtgtcttttaattggggcatttagcccatttacatttaaggttaatattgttatgtgtgaatttgatcctgacattatgatgatagctggttattttgcctgttatttgatgcagtttcttcctagcatcggtggtctttacaatttggcatatttttgcagtggctggtaccagttgttcctttccatgtttaatgcttccttcaggagctcttgtaaggcaggcctggtggtgacaacatctctcaacatttgcttatctgtaaagaattttatttctccttcacttatgaagcttagtttggctggatatgaaattctgggttgaaagttcttttctttaagaatgttgaatatcggcccccactctcttctggctgcaaatcaaaaccacaatgagatactatctcacaccagttagaatggcaatcattaaaaagtcagaaaacaacagatgctggagaggatgtggagaaacaagaatgcttttacactgttggtttgagtgtaaactagttcaactattgtggaagacagtggtgattcctcaaggatgtagaactaaaaataccatttgacccagcgatcccattactgggtgtatacccaaaggattataaatcatgctactataaagacacatgcacacgtatgtttattgcggcactattcacaatagcaaagacttggaaccaacccaaatgtccatcagtgatagactggattaagaaaatgtggcatatatacaccatggaatactatgcagccataaaaaagaatgagttcatgacctttgcaaggatgtggatgaagctggaaaccatcattctgagcaaattatcgcaaggaccaaacactgcatgtcctcactcataggtgggaattgaacaatgagaacacttggacacaggaaggggaacatcacacaccagggcctctcatagggtggggagctgggagagggatagcattaggagaaatccctaatgtaaatgacaagttaatgggtgcagcaaaccaacatggcacatgtatacctatgtaacaaatctgcacattgtgcacatgtaccctagaacttaaagtatacttttaaaaaaaggaaaaaaaaggaatctatatgtgctaaataatatagaactaaaatataaaggtcaaaaatgtgcaaaaaataaagagaatttttagaactcaatagtagtttaaagcttttagagtactcttctaagtctgtaacagataaaactgataattattcctatattctataatttaattcaattgatatataagacaaggaactatatattctgaaaacaaaatatcttctctgtaattcatgaaacgtttataaaaaatgaccatgcttttggtcacagggaaaatttcaggtaattccaatgagtagaaatgggttccattagattctctgccttcagtataatacaattagagctaaagtaatacagataaagaggaaatctggtaattttcagatcttttctatcaattcttgggtcaaaggaaaaaataaaaactgcagttctaagctattatctgcctaatatgataacatgcattttcttctgtttttctggtaaactatgtattctgatttcaggaaggtgaaggacagcattcaataataaatgtttcttcaccccctgtaaagaggaaggcattttgtttgatgtgagatatgactctgaaaagagttagccttgggaacctgtaaatctgttggattctatcacagaatgcacattagtagtaaattatttaggatagatatatggagaatcctctatagttatctgtgtagatttggtgttcagtgtgattaatttttaacagagattcttgtgatacccctatgggaaggagaagtatcatagtttgttatggcagattgattgaactgtgtataatgtctgtagattttgggttctttttacctctgtcccttgtttgcatctcttgttcagtattcctctaggactcaaattcttcgtctgtgaatgaggaagttgaattaaaatataaagttatttatacatgttatttttgtatagctctgaataaattcattaagtgagtattgaatgttggttcctatttagtctgtagggtttaaacttatgttgtgatgggagagagaaacaggcttagggtgccatgaaagcagagacaggcaagtatatcttagaaggaaggcgagaggaaagggcattagggaaactttcacagaggcagtgtgacatctgaactggtcttgaagataaatgagtttgtcaagtaaacaagaaagagagttctagctcaggaagtagaatgtacagaggcagaaagaatgtattttacctttggaaaaacacaggccattcatgtgacgcttagcatgggattatggagtagtaagatattaggcattgaggtatatggcacccaaatcgtgaaagcttattatgtcatactaaataatataggctttaaattaaagacaatgactaaccatggaaatgttttctatttgggtatgacactgtaaaatttagttgaaatggatacagggatagcagttagaaaactggcagttcaggtgagacatgaatgggagtcttaattaaaataatggcaatgagatgatatgcagatttatataaaatggataggcttcatagggtctgtgggagccctggaaatgtatgtgagatttaacatgaatgtattttccttgggacatggttcatacatttcatctgatcatacaacagggctattagtgtaaatatatatatcacaggaaaaattgacaggatgacattctacaaactatgaagttagataactttaaattttattttattcactaatgactaatcttttttttcactttctgtagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcaggtaaaatcaggaaatcaaaatcagcttattaccctgcacttcttctgttttgatcacagtaaagaaaatgtaatataatcaaatttccccaaatttgaaatacatccaaccaaggaagaaaggaaaaatccattgttttaaataaactttgcagtaattgttttttgtcatctggcttttagaagttttgaaattctttaatacttaaatagcacatcagtctatattacatggttgtagacacgttgtaattttaagaattgctttccaatacaaattaaaatgactggtaaccattttagaaaatataattttttaagaagagtttgcaccgttcttgaaaataatttataaagtagtaacaaatgcctaatgaaatctatgttggagaatttatttttttctgtttaaaaccaagactaaaagccttcagagggaaatagaaattaactgtctcattttccctgtttttggaaggatctccaagcttttgatttgaaaagcttttcctccacatcagaaaaaaaatctgaaaacatctttattcatgattatctgagttcttgaccatatcttcataacagtagtcaatcagcatttattggcataaagaagaatactaaaaatataagagatagtcattggttttaaaaaacctgcagcacagttaggtagatgagatacacatttataaaaattggtaaaagaagacagtgtataattcgacgttagatgaatggagtatgtaaatgtgagggcattcaaaggaaagagaacattttgggctttgtaggttagggaaatagaataattagagtttcatgtccgaagactgaggaaaagagagagagttttggacatgatctgtaaaactctgcttctcaggttttgtcattttctcaggcaagcttgcaactgtgaaattggcttcttctttatcatctgtctcatcagttctgtccttgtaatgttttatgctgctctactcttttgatttccattcttcatttagtgaggaagaggataagtttaatatggcaggcagtggaatttccaaatagaaataactagcaaaacttagaggtgtgggcctggacagttagagatctggacacagataattaattcagaaccatccttctagaggagttagattcacaaatatgataaaatgtaggtatagaaaataaaatttaaaaataattttaaaaagaaaaaaatttaaaaaaatgtacttatagagtatgaaagaagaaggtcaagtgatggaggacttagtttttggaagggtgcacacacacaagaaaaaaactaatatattcatctgaaagcagcaagaggaggagggagttaatatttattaactgtgtaccgtgtactgtttgttttataacctgtttcatttaattctcaaaagaccattgcaacattacacagatggaaaagcagtcactcagggaacttaaatgatttatttaggagcatagagctagaaagtgttggagccagatttctaacacaggctaatctgttaaccaatataagctccatttttattattactgaactgggattataggataatacaaacatacatatgtatgtatgtacctagtgctgtgacactgcactaaaaaatggtagctattctttttagattaccaaaccaacatatgaaatgaatgctatgtgctgacactatcgagagggaaacattatctagttttttttttgtttgtttgttttgttttttttgagacaggagtttctgtcttgttgcccaggctggagtgcaatggtgtgatctcagctcactgcaccctccgcctcccaggttcaagtgattctcctgcctcagcttcctgagtagctgggattacaggtgcctgccaccatgcccagccaagtttttgtatttagtagagatggggtttcaccatgttagtcaagctggtctcgaactcctgaccaaaggtgacccacctgtcttagcctcccaaagtgctgagattacaggcatgcgccaccactcctggcccagaaatattatcttattcgctcttcacaaaaattctgaaaaagaagagaagccagagaaagagcgaaaggctaagtgaaaaactggaatagtgaagccttagaagtcagaggagaaagctattctaagaaaggaaaaaattgttgacagtatcagatgctaaagagaggtcatggtgattaaggaccacatttagggatcagaggcacattgtcttggagagtgcagtattggagataatgccagagtaggagaccctactatttgagagttaagagagtgatgtggagatagaaggaaagaacgctggatatgtttcttacacatgtctgattttttatctgtgcagtggggttaataaaacctaacccataatattactgtgtgattaagtatgataatattgaaggtaaatttggcaaatactatatacacatttaagttagtagtagtatatgtagacatgcccgcttgtaacatttgcagggtctgcagcaaatataaagaccaatatactatatgtacgtaagttaaatgaacaaattattgagtaaaatacattttgtcctccccccactacccaatgacaaataatcttcatatggacctggaagatgaggtttaaactaagaattctcagattcttcagagttacatgccggtatatgtccacatggggcaggcccaccaggcccattaggcccacctcgtctgagcctaagtcccattctcttcctaccctacaatctattctgtactttaagctggctttacacatacacttggacccaccagttctcacattcaagtgccatcctcaaaaagcaagaaccagggaatgggtctgcagaccttagaagccaagcctactgctgtttgttcaggaaattcctggttttagattacctggagtatattctacagccaggcatgggctcataacgtccatgctctttgctcccaaggtctcttatcccatggggaggggcatggctgctagaaggccagaggaatttctcctgaattttgaggtccaggataagggcttgtctggcttgcatctatctggatgtaggtcatttatttgagaagtttgacattgaaaagaaggtaaaatatagggctcattttacagatgaggaacctgaggcttagagaagttaagtaatttgtacatcattacatagctgtacattaatatgtactacatacatattacatcgttatgtaatatgtactacgtacgtagtacatcgttatgtaatatgtacgtagtacgtattaagcgtgaggacagtgaacccagacctggctgattctaaagcgtttccttttttttcttcagctgtctattgccttttatggcaaccactaactactaacctacttcttgcctcacaagcataagaaatggtccttccctaaccatttattagtttaattgaagatacaagagatgaacatatgagatactttttatggcgacatccgtttctcctggattaactgttgaactcttagggtgggaagaacttgttttatttatgtagtggaattatgtagtggacattggtggaaggaaggtggtatactcagcttgctacagacattaaacacctgggctgtttggccttggtggagggtgtcttgagggtgttcttccttttatatttctgtttcaactaccttaattattgagagcttgacataaaaaaattaatattgtttagtatgtttacatattaaaaagaagtagcataatgttgtgaaaagattgtagactttggaaccagatcatgtattcaaatcaaggcccactgagggaactttctgggataatgaaaatgttaattaaaaaagtagttaattttaattaagtaaaaattatttatatattaatggtgtacagcatggtagacacacacacatttgaaatgattacatcaatctatttaacatatgcgttacctcatttttttatgtgtggtgagaacacttaaaatctactctcttagcaattttcaagtataccatatattttactgtagtcattatgatgtatagtagatcacttgaagttgtttcttgtaactgaaattttgtgtcctttgaccagcatctcccaaggactcctagcctctgataaccactattctactctctatttctgtaagttaaatgttgtatatcttttttttttttttttgagacagggtcttgttctgttgcccaggctggagtgcggtgatgtgatcttggctcacttcaacctctgcccctcagattcaagcaattctcatgcctcagcctcccaagtagctgggaattagctgggactacaggcccctgccatcacgtccagctaatttttgtatttttagtagaggtggagtttcaccagtagagaggctggtcttgaactccttgcctcaagtgatccactagacttgacctcccagagtgttgggattacaggcatgagccaccatgcctggccagtgttatatgtcttaatagaagtttgggttatgttggcgaattcatttatcggaacttacccaagtgtacacttgtgcattttgctgtataactttaactttaaaaatacagaatatgaacagaaaacaaatactgaactcagatgtttagagatgaagtatactgctgtctgcaactttgaaatgaataaaaaataagatgaattgatgggtggatacctagatagatagctggtggagtaaatagagcaaaatgttatttagagaagctcagtattggctttatgggccttcactgaacagttttttttttaactgttctgtttgaaatttttattagtaaaatgttaaaaaaaaattcatgacccactgacttaactgctttgtgacccagtcttaagctttcttttctgtaaattgaagttagtaatacccgatttgcacattcacacgtttattctgaggattataagatacagctttacatttttaaggcctctgaagaaatggatcactgctggttatttagagtcatctgtttagccttgtagaaagaaaaactaaaatccatttgtgaaatttaatattttattactgtagccttgcagatacaacctttttaaaacaaaaaatgtattaccaactcttaaaattgaacttgcaattaaggttactataataaaacagtaatgtttcctcagtcttcaccccatagtctgaggtgtagtctctggacaaattttaaattctgtgtttgaatgtgtttttaaatgcgaaagtaatatatattctttgtaaagtggtcaagtaataaaaataatatatacagcaataatcagaggtatttcctacaacttcccaggtatagtaatgattagagctattcataaatattggcattctctctcctgggcacatgataggattctacttctctgcccacttgaagttaagtgtggccatgagacttgatttgggaagatgctttaaagaactggtgcattctctctgacagggaagtaactgttcattcctactctgtccatctgggtcactgacagtgacaagcatagccttcttaatgacccatacatgtagtatgagcaagaaattaacttttgcagttttaagtcatttggatttggagattgtgtagttactatcctataatctagtctttactaatatgcaaagtataacccttttaaacaaatttttgtaggcctttcagagcatagtatgttatttttattaattaaaagcttttcaaaagattcagtgtggacgtaaaatcagtatcaaaatagaatgaaaaaaaaaaacctgagcactggaagtggtttttttttttcttagagttttgccatttgcttaattaacttgttttcttaatcttatttaaacatttaaaaattgtatctttaatggtttattttcctgttatacctttatttgagttttataggccttaaactttttctgatacagttagatgcgattttctttgtatgagtagtccatccaaaacagcccctggaacaggctacctcagtctcaaaatgtcacctcttttgaaatgtctattaaactagaagacatgatggtgttaatctacagagctaattttcattaacaagctttctgcaagtgaatgtattcagtcttaacaagagaaaccaccactgccttcttgcttctttcttctttttaaatgaggatttaaaatgcttttgattagatttatattctaataaaatgatggatttaatgctttttatatataacttgtaaaagaaaaaagtcacttgcctaaacatcgaatttccactttaggaatctgctccctgccaaggtcagcatcctgtcataatatcttataaaatctctgtgcttctcagttcttgcagggatgcttagtgatatatttatagacattctataattatcccagaatgtttttaattcagctaaattaaaagaagtaaatatttcaggttatgtatttttgggttttatctgattttgttttaaaaataatgctttttgatggtaaaataatccatcatatatttgatggcaaaataatccataatatagaaggacatgaatagtagccactaactccctaggcctactacttaaaaaaagtattattaacaggtttttgggggacacatattttgagaaattttctgtacctatagaaatatattgtttagacatatacacacagagatggaatcatactttatatcatattactgacttgctttttccatttgatggatcatgggcatctctccttataacatataaatccctacctcattttttttttctattttttaagttgtggtaaaatatatataacatgctagggaggcatggtagcctgtgcttgtaatctcagctactcaggaggctgaggcaagagaatcgcttgaacccgggaggtggaggttgcagtgagccgagatcatgtgactacattccagcctgggcaacagagtgagactctgtctcctcccacacaaaaaaaaataatgaaatttaccatgagtgaaaatgaattaaccattttttaaatgtacagttccatagcattaagtgcattcacattattgtacaaccattatctccatccatgtctaatacttttttactttttccagctgaaactctgtgtttattaaatactagctctccatcctccccaccacacgccagcctctggtagccatcattctattttctgtctctgtgaatatactctaggaacctcatataagaaaatcatacagtattttccttttttgtctggtttattttacttagtataatgatttcaggatttgacattgtagctgtgtgtcaaaatttccttcctttttaaagcagaataatattccattagatatacataccacattttctttatccattcgtctatgggtggacatttaggttgtttctgctttttgacagttgcaaataatgctgctagcaacattagtgtgtgggtatcttttcgagtctcggctttcagttcttttgtatatatttccagaagtagaactgctagatcatagggtaattctgtgtttaaatttttgatgaactgatgtactgtcttccactatggctgtagtattttatactcacattagcaacgcacaggggtccagttgttttttcttgttgttgttgttgttgttttttgtttttttgtttgttttttgagatggagtctcgctgtgtcgcccaggcaggaatgcagtggcactatcttggctcactgcaagctctgcctcccgggttcacgccattctcctgcctcagcctccccagcagctggcactgcaggcacacgccaccacgcccagctaattttttgtatttttagtagagacggggtttcactgtgttagccaggatggtctcaatctctcgaccttgtgatccgcttgcctcggccttccaaagtgctaggattacaggcatgagtcaccgtgcccagccaggggtccagtttttctacatctttgccaatattttcttttttccttttttaaaacataatagtcaacctggtatcttactttgattttcgatttgtatttcctaaatgattaatgatgctgagcatcacttcatctgctttttggccatctgtatttcttttttggagaaatgtctattcaagtcctttgtctatttttgaattgggttttttgttgttgagttttaggagttctttatatatactggatataaatctcttatcagatacatggtttgcaaatattttctcccattctgtgggttgcctttttattcttttttttttttttttttttttttttttttgagatggagtcttgctctgtcacccaggctggagtgcagtggtgtgatctcggctcactgcaagctccacctcctgggttcatgccattctcctgcctcagcctcccgagtagctgggactacaggcgcctgccaccatgcccggctaattttttgtattttttagtagagacggggtttcaccgtgttagccaggatggtcttgatctcctgaccttgtgatccacccgcctcagcctcccaaagtactgggattacaggcgtgagccaccacgcctggccaggttgcctttttattcttttgatagtgtactagtttttaattttgataaagtccagtttatctatttttccatttgttgactgtacttttgttggcatattcaagaaatccttgccaaatccagtgtcaggaagctttcttcttattttcttctaagaattttagcctttaagtttatgtctttgatccatttgagtccatttttgtataaggtaagagtccaacttcgttcttttggatgtgaatatccagttctcccagcaccagttgttgaaaaggctgtccttttcccattgaatggcctcgacacccttatcaaaaatcaatttaccgtatatgctagggtttatttctggctgctgtatttatcacagtggtctgtgccttgtggctttttgcattatgccataattgggaaagattttttccactccaagttaaaaaatttcatttaaactatattttcttttaatagttttatgtttctttttacatatttgtgtctttgatatttctggagtttattttgatggaaggcatgaggtgatatccagctttatttatttttcaaagtgactaacagttgataaagagtttatcttttccctgctgatttgagatattgttatatcataaatttccattcttatttggatctctttctggcttctctatgctatactatataccattaatatcttttttaatactgaatgattttaatttgtattgcttagtaattcattttaataatttgtatggctagtcttgcgtatttatttttctcagttaattttataatttgtacaattcctcaaaatgttttatattacaattaaatatgaattcaggggaattgttaccatattgaatcttatccaagaaaggggtatatctttttattcattcaagtattatgtttgcccttcagaatattttacaacttcttattggaacaacacatttcttgttaaacttatatctaaatattttgtcttttttggttgctgttgtaattaggatatttaatatctaatttacatacaggacatcttcaacttgacttttcttgtttctagtaatttttaggtaattttctttggtttttcggctgtacgatcatccaaatagtaattctacatccttttcgttatttatttcttggtatgtgtcctcttttggaattgcatttgttgccactccgagaaccatgtaaactaacagttatggtactgaaggccttgacttttttttttttttttgagacggagtcttgctctgtcgcccaggctggagtgcaatggcactgtcttggctcactgcagcctccaccttctaggttcaagtgattctcctgccttagcctcccgagtagctggaattacaggcgcccgccaccatgcccagctaattttttaattttttagtagagacggggtttcaccatgttggtcaggctggtctcaaattcctcaggtggacctcaggtgatccacccatctcggcctcccaaagtgctgagatgacagatgtgagccactgtacccggctgccttggcctctttcttgactctaatggtaatgtatctagtttactcactggacaaggtatactgacatttgctgtgaagcatgtgtgtttgttatacgtagagtacacatgcttattttactaatggtttttcttgttttaatcaggaataataatttatgtggaaaatgccatttcatcagtgaatatgtttgttaattctatatttgtttattattcagcaatgagttcttaattttttttcatgagccttagagtatttttacacttgcttcataaacaggttttgcaagatttccttcctctgtgctctagcataacacagtataaatatcatctgaattctgtcacttgggtctgaaaggattttacctaagtaacttacttactagcctagtatgtttttggattgtagcactttagaaaattttcttaatttcttccatggcacttggtctcttggttgatatcagggagagatttcaaaacttgtattctctgagaggtgagagatgggatggttagatcttaaataaaattacatatactgatacttccctttctccaggtgatggtattattatatttggtattttattgttttaaattaatttttaaaagttaaactgtgaaacatgagacatgccaaaagcacataaagcagtttctcttaatctcattagacttcagtctatggagttttatgatcctgcctctatgtcagcatctttccctagaaatctatttgtttttatttgtttttaagaaacagatccagactaagtagttagcatttggctttaggcaacattcaataaagttaactaactctgaactaaaacatatatattcttttctgttgacgtcatatttaaagtacctagccttttcctccattcctgaaaggagcttggttagggaggactttagtcaaaggaacagatgatgcacctcaaatacttactgatataaaaaataactttcagttttatcactctgatcagaaattcatttcctgaccaaaagtcacactttatacagctgtctgagtttcctgtgcccttgtcaaagggcttgcttttgaaatatatttaagaaacagcagttgctgaaacattttaggggctgggggacttcttcatgaaatggaagcaagactgaagatttgactgtttttgcctcttagattgcattctaggggtctaaattattttttatggagctggcccctgactggctgttgagatcacctttactttttctctcagccatcatctaattatgagacagaggattgtagaatcctagagttgaatagttcacaccaaattagtcatgttcctggtttagggagtaatttctttggttgctaaaggaatatactcagttatattaatgaaagattttaacccataactaaaatatttaacattttattcattagtttcaaataccatctctaaaattaccaaagtcaaaattctacttattaattttaatacgttatgtgttcatttgtttcaaaagtagaaagtatacagcgaaaggcctttcccatacccccgttaccctgatactcagttttcttccctttacgagaaacatttagctggaaacaaaattaacctgtttttcttcattgctttctcatgcctttgcccctaagcacactctaggtaaaattgtgaaataggttgtatttatttggaataacactcttactctggtcccctgacctgtgttggttttgtacattgacttatacattggttctcaacctgttatatcttgtatcaattttctatgaaaaattcctgtgataatattaaacagaatttactgagaaagacatttttacgttagagacattatgccttaacagttaagatcgcccgggcgcggtggcttacgcctgtaatcccagcactttgggagaccgaggtgggcagatcatgaggtcaggagatcaagatcatcctggctaacatggtgaaaccccgtctctactaaaaatacaaaaaattagccgggtgtggtggtgggcgcctgtagtcccaactactcgggaggctgaggcaggagaatggcgtgaacccgggaggtggagcttgcagcgagccgagatcgcaccactgcactccagcctggacgacagagcgagactccatctcaaaaacaaacaaaaaaaaccaattaagatcatagagttatagtttaaaattaggtcatagtttacggtatggtatgagaaagcagtatgcctcttaaggtatactgttttgtataaatgaatgaataaatgaatgattgatatgggagataccatattgttaggaaccagtataaactaagggaaaacttttccatgctattggaattctaacagcttttgggggacaactattattgtcaacatagcctattgcaatgaggattatatgaaacaatccatgttaagcttctagcacagtatctatgacataacagacactgatacttattagttgcctttgattagaatcaatagtattttactgttaccgggtttaaatataataatatggaattaagtggacaggaaaagtctttattactagtatcaactattgattatacaattatgaacattaggtctggactggtaggaaatggcatagaaatgacacaagtgaccccagagcatgtgagggctgtgaaattcaataaacaatttctggtaggtcaggattcattcagtcagaggtagttattgtgtgtttgctgtcttacaaataagaaatggtacttcaaatctataggttcatgtgcaggagagcgtatttacattcttaggaaagctactccctcctccattacttagttatcctattggtgatattcatgccatcatcttagcactatttttatgacttcagtgggtgttttttagaatggtgtgaaaaatatttttggccatatgtagtaatcacctgtgttgctgattttctgtcagatgtaagagattttaaaacaataacatgttcaaagctagcaagaaaaatgagtgggtatatggtcaacatgacaccttgagtgcagattccgtatcttattgatttcaattttttagtctaacactggttttcaaactttagaatccatcagaataatctgaaaaggttgcttaaaaaataagaagtatatttctgggccttatctaagagttccagatctagtagtctgaggttgagcctgagaatttgcttttctaacatgtgatgatgctgctgctcatttggggactgcactttgaaactggtctaacataatgagcacaaaacttagcatagagttggagcttgataaaaaatttgaatatgtaagtgctgctattgctgaattcctaaagcttaaaaaaaaaccttccgactttacataaaataaaaatgcagtcttaacttccacagtgttttgtttgagctgaattctgcctttttctacactctttgctaatcagagcagctatttactatatctggttaccactcttcccagaaaggcaaaggataattacactagaaccacaatcttttgtgctgctttgtaatacttcatcaggatagacttttcaaaataatatttaaagaagttttaaaagaagttaaaaattgttttattagtcaaaaacaaatttttgtaaacaaaaacaaatatttgtaaataatggtttgtcattacctattctaaacttttttataatttaagattagtctgtggtcataattaattcttaatataggtatcattgatttttcagctaattacatctcatttcttgctaggtttatcattgctataagtactataaaataattagcagtcagtactcatatttctataattgatttataaactacaataaattttaagaccagtgatgaaccacataaaatagattttttaatatttaaataagattaaagaattttgttatgtttttgttgatggattttttttaagtggctttagacttttgcacattgacaaagcatgttttttgctaggagttagtttgagctggtttgaagttgataaaactaaaaagcatattggccctttctagttagtgaataaagatatacataacaaaagcacccagtatttaagctttttggttgatctagccaaaaataatttttctaatggtattcattttgaagcctctttagtcctgtgcagtgggattattccctttgtattttacttagagaaaaagtggttctcacacaggttggagctgggaggatggccctagaggttggaaagaaatttcatagtctggactttggagacttccagggagtgagaatagaaaaggaccccttctacctataggtatcctttttacatagaggctttttttttccaactaccttttttgttaatagtcttacagataggttttagttctgcattgttcaagtgtacagaagtttcatttcttttaaatgatggtatgatattacagtttttcctaaatttatttaactgtggaaccctttttgtctactccttttaacaccaaaggcatggttatatgtagcactatttaaaaaattctagtctagattaatggacagaataacagaccagttggaaggggctgcttgctgatatgaaaggaaagaacttttgctactttgtgttattttcctgattgaaatggtaaaacatttctcaaatacacaggtttaataaattggattcaaattagtcacttctgtgacttcttaatcatcagctttaaatagatttgattttggtagccatcttttggttttgttttggctaaaataactcattaaaaatcagtgatcagtgtatagaacactgccctccaattgaactttctttagtattggaaatgttctatatttgtgttgtcctatatgacagccggtagccacatgtggttattgagcttttaaaatgtgctaagtgtgactaaggaagtttagttttattaggtcctcattaatttaaatctaaataggcacatgtggctagtagctgttgtattggacaattcaatctatagaatatatttgtagatgagaatttttttatactgtttattttaaattgatggaattaaaactactctttgggggatatttttggaaagttaatactatgatgaccttaaattatatgcattctatagttacatgattgagagaactctttcagtcgtttttcttttttttaaactacagtcactgtcacttcatgagggggatatgttttgagaaatgcatcgttaggcattcatcgctgtgcgaacatcatagagtgtacttacacaaacctagatggtgtagcctactacacactgaggctatgtggcatagcccgttgctcttaggctacaaaactgtacagcatgttaccgtaatgcagactgtaggcaactgtaacgtagtgatatttgtatatataaacatagaaaaggcacagtaaaaatataatacataaaggtagaaaatgatacacctgtatagggcatgtaccatggaatggagtttgcaggactggaacctgctccaattgggtcagtgagcggtgagtgaatgtgaaggcttagggtattaccgtaaactactgtagactttctaagcactgcacatttaggttacactaagtttataacaaatacttttctttcttcagtaatgttaaccttagcttaccataacatttttacttcataaacttaattttgtttagctttttgagcctttcataataacacttagcttaaaacacaaacatattttacaaccataacaaactattcttattctgtaagcttttatttatttatttgtttatttatttcctttttagacttttttttaaagctaagacaaacatacacattagcctaggcccacacaagatcaggatcatcaagacatcactaggtaataggaatttttcagcttcattataattttatgggaccactgttaggtataccatccatcattgaccaaaacattgttatgcagcacataactatacatatactactaacttgatttcttttgtaggtaattcttttgtgtaaataacacactctgaaataactgaataagttttcatattcatttttaagaaaaggataataggaagaaagaagataatctgtgagataagagaactcagatttagttccttttgctgttggcgtgcttgccagtgttgaagcagttgcagaatttttgtggctattaatttatctgtaagttggagatacagtatatgtaaatgtcctttgaaaaagggctgtacaaaatgaatgtaattcatattataaatgttgattttgaataattgtggaaaatgctaaaaatttgactcattttctgtgaatatactttgagttataaagattatgattcttaatcttttcattttgataagagtaatgctcagttgctagacaggtaaaaccattaagttatataaattatcaaaataaaagtgactaaacaattgaataattttggaataaattcattattaaggatacaatgatttggagggttgaattattttcagagtacgtcatcttatctaggacggaacataggaaattctaataagtaatagttttttataagcaacttatttaatatattgatacctcttatccgtggtcttgctgattgaataaagtattttactctgtcaattgacttaaaaacttctttttactagtgaactgctcaagcagtttatttttgtgtttattcagctagcattcagttgttaacggtttttttgaatatcattgcttttaagacgtggtgattattttaaaagttttccacaagcattttgaactgtaaaatagaactgatgacttcttcataagaacttacatattatgtagtcacaagtatggccttaatataaatgatacctttttcagcatgtattgaaaaataatttttaaagctgtatatagttactgtgacaatcattgccctttaagtagtggttttgaccctttctgatttacattacgcaagtcttctcatgtattaaagatgatattttaatattgtttaattattattttttttttgagacagagtttcactctcgtcgcccaggctggagtgcaatgacacaatcttggctcactgcagcctctgcctcccgggttcaagtgattctcctgtctcagcctcctgagtagctgagattacaggtgctcgccaccaggcccagctaattttttagaggcggggtttcaccatgttggtcaggctggtctcggactcctgacctcaggtgatccacccgccttggcctcccaaagtgctgggattacaggtgtgagccaccatgctcagcctattgtttaattttttaatacaactattaaatggtcttaaccactgtatggcattatttcggatttagtgatttgtgttacatttgaggatagtatctattaatggctaaataactgaaaatgatattttagataaaaatgattctgttttctgacatatggttcaggttttttagaagatgtattactttagtttatattctgtttatttagcttatattttactgtttttaatctttttcacttttataataactttatgtgttttatataaagatgcctgatatttttcaaaaaagatactaatacttactcttccccaagcacagaaaaagtagtacaatcagccctctagctaaatatttgaaatgtaggtcattcttaatactattgcttttgagatacttttgttcattttacctctattgaatttagtggaaataccatttcatatttagtttggctattctctttaaaaacaccaatacacatatctttactattccctttgaattttataattaagttatttatgttattgatgtgaagatatcaaatttttaagtaaggtgactcagagacatctttgagcatatataattcagaatatggcagaatattttaaacatttcacggggtcacaaaactcttagcgtttaaaggattttagtatagctctctaactggtaagtgctaagaattttaaatatgtttcagttgcttgagattaggaagtagagataaaatttcttattttatttatatatatattttttaaagacacctagctgttgggcagaagagggtgcagaaaagaggtcacatcagcgttctgcgtcatgggggagtgctgatcaactaaaagaggtaagttatttctgttttccgtctgtaacctgttttggtcctagtagattaccttagtatttcctgaatgtaatgacacttttaaaatttatcctaaccttacctctttcagtaaggttaggacaaattctagggtaaggttagaataaattctaggcaggtttttgtaaggttaggacagattctagtttggtaggctgcattctacattttggtgaacaagtctaaatttaccctatttgtgtattttgcgtcttttataaatatttgttatgcactcagtcagctttaacctttccagagtgaagtctaattttatgtaatactctctatcttgttcattttagttatcttttgttctctcttcagcttgcttgtttttaagttgtagcaaccagagctataggttatagctttgtacaatggtaggatagtgttttctgtttctaatagcttttttatttgagacggagtctcgctctgttgcccaggctggaatgcggtggcgcaatcttggcttactgcaagctccacctcccaggttcacgccattctcctgcctcagcctcccgagtagctgggagtacaggcacccaccaccacacctggctaattttttgtatttttagtagatacacggtttcactgtgttagccaggatggtctcaatctcctgacctcgtgatccgcccgccttggcctcccaaagtgctggaattacaggcgtgatctaatagctttttaatgatatccagcatattgttgccctttggaacccaacagtaatccatgcttctcagaaacttagtttctatgacccgtttccttatttattatgaataacctgaggtgtcatatctttatgtatattttggattatttttcctgatacttttatccatctaaattcttttctatttctttttacaaattacagaaactttagaattgaaaggtcatccagccaatctcctaaataaatactccttaaaaagatggtcatctaatctctgttattcttttttttttttttttttttttttttttgaggtggaatctcactctgtcacccaggctggaggacagtggcacagtcttggctcactgcagcttccacctcccaggttcaagcgattctcctgcctcagccacccgagtagctgggattacagatatgtgccaccatgtccagctaatttttgtatttttagtagagatggggttttgccatattggccaggctagtctcgaactcctgaccttaagcgatctgcccacctcggcctcccaaagtgctgagattacaggcatgaaccaccacaccaggccatgatcattcttagtgatggaaactcactactttacaaaaagagccagtttaattggtttaattgtttcaagtttttaaatctgttctcttatgtattgaacttagaattagataacttagttttgactttgccctctggatcaatattgagtaagtctaagtcttttaaaggctagcagtaagtcatttttttcctccagagtaaacatctacatttctctcaaattttttttcatataccagtttccaggcctctttgtataatttttatgtactataggttatcagtgtccctcatatactgtggtgtctggactgcatagatatagtttattagcatgattttacttatgattgtattacattttagcagcttctttatagtatggatgtagagacctactcagctccttctgcctaccatacatgtatgcaaaaaaaatcagttttctccagcaacaacaaaaaataaatgaagctaagtctaatatctctggcttactataactacatgtctatgtatagcatatgaataacaaaaaagtgaacttgtatttttatctcagagttgaatacagtcttagagttatcaacgagatttaggctgaaaggaagtaacgccagatattaatttgaatccgtaggaagaattgaagagtgctgggaatagtaaatatgtggataaatatgaaagagtttttaatactgttgtgttggatttataatttaactataactggatttcagtaatatatgacatacactcttaaaaaggaatgactgattcagtgagaacatttgattgttttccacagaaggcaaccattaaagctggacaaaactgtcaaaacaactgtttgagtactttaccaaacaaactgagaagctttattcatgaaaactaatgaacatagggtaagaatagcacaaattcgtgatctggtgctactccttttctccttttccttgtccctagctctgtcgcatagcatttcagtcaggatgaaaaccagcagctttgcttccacttttgcagagaaatcacttgctatggagaattgtaggttaaaatagtgatctttgtggcaagtaaacagagagggccaacagctttattagtctaagactgtagtccaatttggggccagcag

SEQ ID NO: 1078 - DNA, 1315 bp, Homo sapiens
aaagacatataaacgtgtatgcctaaaactctgaaatactatcacaatgtgacttggtgcttaaacaagtggagttctaaatcatttgcagggcaataaagaaaacattgctcctggataggacagtcatcaaagacgtcttggtcaatctcatttaagtgccatagttgggtgaagatctcagtgcagaagggagaaaaaaacagaactttaccttcccttgctgtaggtgagctttgggcatgctgatttagcattctcctctgcttctttcatacttctttctgagaacatgcctttaacttttgaatctctctcctgccttaataataacaatagttggagtggaatggctgagattgtagctgaccaactgacaaaatggagcaggtgagggtcatgctagccttccacccatggacagtatcttagatgaaaatactccactttggaattgcaaattgacctgcatggtctctgccctggttgccctttttagagtggaaatatttaacttgtttttccaatatctgcaaatggttctaactcactaaaccactaccatcctggttaatagctattgcatgcagttggttttcttaaccagaatactttttttttttccatttcagcattccagaacttaaccaaaagtattttcaatatgattacatggacttcttcccaatatgcttctcaaaagaatttgctgttaataaaaggtcactatgtatatcataggtaagcatgctgtttttggatgcagctatgctagtgttcactgctagttgaataatctgccagtggacacacgcttcactgacattgaatgttaaggattctcagtaatctaaacgtcaaacccgccaatattagtaacttgaagaatggatcaagacagcttatttgttgttatttcacatttataaaacgtcttaacattactatcttatacttaaatacagtttgtaaattgataacaaaatgagttaaaaattactgggaaagtccttttaagtaccaaaatgaaataaatattcttccatgcttaaatttttatgaggaatttttatttccagcaactgtaaggctgggcagcaatgtttgaagaagtttcaataaatgtaaattgaataatttttttttttggttttatagattgtcaggtgatcaaccaagtgagaagcttttataaatgtgttggttcttctctgagacatgagtgtttgggagaaagtcctcccttaccccctgccaagaatcctggtaaaacagaaaatgaaaaaaaaaaagtgttgttttagaatttcattta

SEQ ID NO: 1079 - DNA, 5185 bp, Homo sapiens
ccaactctcactcctaatgagaactatttctcatacctaaaagcaagttttactgcctctatggtgaaaatagtctagtttaataatgttttctcttgggacaatgatgctttgtaaatggaaataacacagattctgtactttgccccatcttgtttttctttctttctttctttctttttaggcagtgagacagactttattcagggggactacagcaatgaggttttgcggcagggaaagaggttgcagcttttgggtttgcttcatgccttggacacacagtaacttggaattcttgcacttacaattttttgaattatgaaagtaatacatgttagtggctaaacaagaaaggaaggcacggccgggcgcggtggctcacgcctgtcatcccagcactttgggaggccgaggcgggcggatcacgaggtcaggagattgagaccacggcgaaaccccgtctctactaaaaatacaaaaaaattaggtgggcgtggtggcgggcgcctgcaatcccagctactctggaggctgaggcaggagaatcgcgtgaacccaggaggcggagcttgcagtgagccgagatggccccactgcacaccagcctgggcgacagagcaagactccgtctcaaaaaaaaaaaaaaaaaaaaaaaaaaaaagaaaagaaaagaaaagaaagaaaagaaaagaaaagaaaagaaaagaaaagaaaagaaaggaaagcacgaaggaaaatagcaaagggtcccggtgttgcacacacacaaagcagcagcagccgctggaggtcttccgtgtttggtaaaggtggctacggactcccgcatggagacgcggcctggagggtgtcactgctctaggctgtctgcagggcctctccgcagacctggacggatttcagtgggagactagagcgtcacttaagatgtttgaatgtaaaagcatcctgaatgatcatcttttagcttgagattttggctacctttcaaacagacatagtttgacctttgcagtcctaggtaatgcaggaatggcaaatgctcctgaaggcggggaggcggcccggcccgcactgagcttctcaccggccagagggcgcagccacccggccttcccgaagcaggacagcggcctttccaagaccgcggagtccccgtgagggatggtgcctccggagcctggcatctcgggcggatgagaagctgagcgcggtcagatggcccgcagggtcccactgcgggccgagccctggctgggggacagtttggggggaagcagcagctgcctcagtttacagtggcagccggaggaggacctgggcagtggcgagtgtggctgtttgcatggcggggagaaagaggtggtccctcctgcctgctgctgatgcccacggcctcctgtccccaggaaaggggtctgcgcccctcccccaccggaacagcgacagaagaggcgaccctctcaaaggcccttctgctgctcaccgcggggtgagtgatggtgtggagcaggatctgggtccaaggtcttcttccacgttcagggttcccgtggtaactgaagaattatccatccagagaggcaggggagggcctgggacagggatatatcttattattgataagtacaattttaaattttaaattatcagcaggaccgtaggagatgacataaagaggaaaaataacctgtgtggcgctctcagcataaagcgcccaggttcagggatgcgtgtgcgtcctgctgtctgctcattcgaagagcaaaggaagcagggatgatttagggcctccgaggtgacacggaatcgggaggaatggcgccacgagaaagacgtctttctcattttgtgagcagagagcccatcgttcaggaagagcatctgagccacaaagctaatcacagatcaccgagccagcgccggctcctgatttgtctgtgtggctccaggtggcaggtgctccacggcactcagtaaaaggtgcatatggtgaggggtgcaggcagtggccaaacaagggcttccctggatcctggagtggctccttccagccacagccaaggctgctggagggaagaccaggccgagggcacgtcttgcgtgctctcactcacaagcacacacctgtatttaccatgttatgtacacccacagaatcatctttaagatcttgttaatattaatatataaattgaaggtcggaggcagtggctcaagtctgtaatcccagcagtctgggaggccaaggctggtggatcacttgaggtcaggagttcaagaccagcctggccaacatggtgaaaccctgtctgtactaaaaacacaaaaattagccgggtgcactggcacatgcctgtaatcccagcttctcaggaggctgaggcaggagaatcgcttgaacctgggagtggaggttgcagtgagccaagattgcaccactgcactctagcctgagtgacagagcgagactccatctcaaaaaaaaattaatatataaattaatatgagtaacatatacacatacattaataaaaatatacaaaataatacatatagtatataataatatatgctaagtataggaaatatgaataatataaataaaaagattatgaattatgcattaaatattaaataatattaatatgaatataaatatttattatatctatctatctgtatgtacctatatagacacagacagatatctatctctatagctagatatttctatctctgtacacactcatctatatccacatgcatgtatatgtaaaaagagagagagagcagagacatagagagatttatttcaaaggattatcccgtgctattgtagaggttggcaactccaaaactcacagggcaggcaggaggctggtcattcccacaggaactgctgttgcagtctacagcctgaagggagaattccttccttcttgtgggaactcagtcttttccttttaagaccttcacctgattgggtgaggcccacctgccttcctctgactggatgaggcccacccacattgtcagagggacatctgtttcactcaaagcctactgatctaaaatgactttgattaaatgaccttcacagcaacattcagactggcgtttggccaaacagcctggcactgtggcccaacctaggtgacgtgaagctcatgacctccctgtgcctgcagggcgctgtggcactccatccctcttctgtgtcaaagagctgtctgaactgctccagcaactctgacacatggggacgtcctgtcctgaagggatgggggcatgctaggactggtttgcgaatctctccataaatggccttgctgtctccagcatgagagaaggttggagcgtaaagagcagatttctgcggtgtcccttgtgcttcctgaaaggagtcccacactcaagctcacccccacggtggatgtgctggaccaggaccctggggtgctcggggcccgagggtgccaggattagaacctccacacccagaggttcctgcctggggcctgcatcacccgtggcgtctcctgcctgccccggattcctcctctttcttccctttgccgttttttctggctcctttagctgcaggtccacagctggcttttctccagctctcctgcatactggctgagaagggcacctatgtcattgttgctggctgtttgcgctgctgtaatgcaatccctgagactgggggatgtatacaggacaacactgatttctcatagtcgtggaggctgggaagtccaagatcgaggcactggtaggttcgtgtctggtgagggccccagtctgcttcatagctggtgcccttggctgtgaccttcagaggaggtgaacgctgtgtcctcaagtgggaggcagcagaagggcacatccagcagtgaggctgttgctataacaaatacctacaactgtggaagcagctttggaactgggtaatgtagaggctggaggatttggaaggtgcatgctagaagcagcctagattctcatgaccacagagaatcaccactaagggtgattctggcaggtcctcggaagagggtgctgcggaaaagcccagttctcctcacacttaaatggttgtgaacagaaagttagtagaaatatggagagtgaagactattctgatggggtcttagaagtgaggatttttttttctttgagacagggtctggctctgtcacccaggctggagtgcagtggcgagatctcagctcactgcagcctcagcctcctgggctcaaatgattctttcacctcagcctcctaaatagctgggactgcaggctgccctaccccgccctgccacctcacatggcagctgttctttattcataatccccactgtctgtctctgcttctcttctccctttctcttctctctctgtcttttggggtttcgtcatgttgcccacactggtctgaaatcctgggctcaagtgatcctcccacctcagcctcccaaagtcctgggattacaggcgtgagccaccccacccagccagaagtgaggaatatcttactggacgctagaggaaagaccgaccttgttgcaaaatggcaaagatcttggctgaattatgtccatgttcaagtgctctgtgtaaggagaagtttaggagccagaagctgggacattgctaatgctgcatggagcctttttcagaggagtcttaatcccattcgcatgagaggaggccttcctcaccgcctactcccctcccaaaggcccggcctgttacatttcattgcaggaatttcggatgggatgcattcacaccaaagcgtcaccctcctgagtacctctctgaagccaccttggagcctgggctcccccaggcatgggacagcacaccccgtccactggagccgaccctgatgaatgcaggctcactggctttgccaccgcatgcccccggaggcatcagacgctgcttgtctctgctgcctttgaaaggtgtgcgtggagtcgcaggcctgaactacatgagatcgagacggaaaccccgccaggcaccaactaacggatgcccaggctggagtgaccctcctcctcaccctggcagcagagacccacgttggccatcgagaaagaaccgacgcctagcgagaagtgacagggaacattcaggatcccccgcctgcccccgtctggacc

SEQ ID NO: 1080 - DNA, 5357 bp, Homo sapiens
cgttagagtgggagacttagttctaatgcaaactatagaagaatgaccttgggtaagtttgttgtctaattagtaaactgagtggtagagttggataatcctgtcagctttaggcccatgccttaaatatgcttcttatcctctcacagtcaaaaaggatttttaccttggtacagtctgattcctgcaacacctctctagttattgaatgtatagtagtttgctatagacagactactttgcagtggctatcaaacctttctgagactcattctaagaaatacatttacattgtgacttagtatatgcacacataaaaagaagaaagtttcacaaaatagtttccttactagcaatgagctgttttttgttttatttcgttaacaacaacaacaacaacaacaaaaactgctaaccatctttttcttggggttgcactactgtccaatgagcacatagtgagggcagtactgctaacgcctacataacatgcctgcatcatctagagctttgctttaccttggtacaatttttggaagaatgaaaaactgcttttccacagggggaaaatactgtttactgcccatctttgaaaaacattttacttagagcataaacttgaagctagatccttttaaccacttaattaaatcatacagtaagttgttgatagctatttgccacaaaatgaaaatatagtggctatatgaattttagctgctgtcactgttcattaatcataacataagctctgaacacagtgtttcttcttagaaaggtacaaatgattatgattttgtataacaactgaagttaggtgtgtgtgaagttttataattgctggtcttcattagataaattaaattataattaaatgatctgttttatttttgctttttatttggtctcttattaataggcacaatactggcattagctataacacaaaccaatggcactaaaaatcttcagaacctttttggatttgagtttttgaaagatattttgtggagactacagatttaattttaaagtataaatatgctcttattttaaataaatggggtttatactttgtgttctaatgattgagataacttttttttttgagaacttaaattaaaattcccagtcttctctagttctgtcagatttctttgttccccctcccagtggttgagttcttatgggatttgtggcttatttttaaaatccaatgattaaaatgaagttttctggcaatattaatatttgtgtgaatctggatatcctcctcacttaacttctaaggctttttcttcatctgaaaatgacaattttgtatacttggctggattattttaagtaacaagtaacaaacactgtggtagactaacatttgagtttgaagtttcatataattttaaatcattgtcatcgactgactttggaaagtaacttctgagatttttggtctgaagtgaccctgaaagtttatgacctaattatcattttattaggtctgaatgtgaatgttgcactttgagaggaaatagtatagaagtagttacattgctgggtgactgatctagcaagtccctaacagtgccattaagctgtcctgtagtacatcttatttagttctctcaataactacatagtatgttgtcagtcctattttatagatgagaaaaccaagggaacaatttgatagaataatgtttccaaaatcagagatctaatcttagaaggcttagttgaataacattggatatattactctgcggttcctaagtctatgaattaatgggaattttgaaatctaattgaaatccaaggagaaagtgatagaaataaaattgtagtgagcgatgtcggctcactgcaacctccacctcccaggtttaagcgattctcctgccttggccttccgagcagctaggattacaggcatgcaccaccacgcccagctaatttttatatttttatagagacggggttttaccatgttggccaggctgatctcgaactcctgacctgaagtgatccacctgcctcagcctcccaaagtgctgggattacagacatgagccactgcgcccaacctagtttaaattttctagtagccacatttaaaaaaaaacaggtggaattaatttcatgaatatgtttcatataacccaatatatatccaaacatagtttctttttttttttctgagacagggtcttgccctgtcacccaggctggagtgcagtgagtggtgcacgattatggctcactgcagcttcgaactcctgggcttaagcgatcctccagccttagctttccaagtagctgggactacaagcacgtgccaccacaccctgctaatgtttaaatttttttgtagagacgggggtagggtgggtctcactatgttacccacactggtctcgaactcctggcctcaagtgaacctcctgcctcagcctcccaaagtgctgagattataagtgtgagccaccatcctggcctaaatatctttcagcatataatcagtataaaaattataaagatagtatatattcttttctattacatcttcaaaatctgctgtgtgttttacacttaacatatctcggttcacaccagcaacatttcagtgaagtactcaataaccatacttggggctgggcgtggtgacacatacatgcctgaatcccagcactttgggaggctgaggtgggaggattgcttgagcccaggagtttgagaccaggctaggcaacaaaccaagatgctgtctccaccaaaaaaaaaacaaaacaaaaattatccaggcacagtggcatgtgcctgtagtcccagctacctcggaggctgaggtgggaggattgcttgagcccaggagtttgagaccaggctaggcaacaaaccaagatgctgtctccaccaaaaaaaaaaaaaaattatccaggcacagcggcatgtgcctgtagtcccagctacctgggaggctgaggtgggaggattgcttgagcccaggagtttgagaccaggctaggcaacaaaccaagatgctgtctccaccaaaaaaaaaaaaaaaattatccaggcacagcggcatgtgcctgtagtcccagctacctgggaggctgaggtgggaggattgcttgagcccaggagtttgagaccaggctaggcaacaaaccaagatgctgtctccaccaaaaaaaaaaaaaaaaaaaaaaaaaaattatccaggcacagcggcatgtgcctgtagtcccagctactggggaggctgaggtgggaggattgcttgagcccaggagtttgagaccaggctaggcaacaaaccaagatgctgtctccaccaaaaaaaaaaaaaagtatccaggcacagtggcatgtgcctgtagtcccagctacctgggaggctgaggtgggaggattgcttgagcccaggagttttgagaccacagtgagccatgattgtgcccctgtgctccaacctgggtatcagagcaagactcccatctctaaagaaattgtattttatttattttatttttacaacccagatgtgtgaatcttgaaggaatttttttttaattggctaatggctactattactggacagctcaatttctgaatgccaagtacctcttgttaaactgttcaacagcctttccctaccatctcaagaagttggtgataaaaattatcaataatgaattacagttttttaatttttgcctttgatgtgattgtcttattttataatatgttagcatttaatatgaatatttttgttgacatttattttttatttttaaaaatagcattattgaagtatagttgacataataaaatgtacatatttaaaaggtacaaatttaataagttgtccacatccatgaaaccatcaccacagtcaagatatttattactattttcctgaagtcttccctcctagctgtgcaaatctcctgtcactacattaaaacttttagatattcttcttttttggagataacctctcttaaacttctaaacttcaccatttgtactggttgcattctaggttgatgcttaggttggggatcttcattcattctcattttggagattcttcttatatctagctggtttttgatcctgcttccagaatcccatttctttctctttcttggtctcctcatttgtgaaagaataacttcataactctttgagaaaggtcatttgggagataaatgtatttttgagaacttacatgtctgaaaatattttccttcatcttcctttccctttcctctttaataggtagttcggataacaaattctagattggaaataatttatttcagaattttaaagacatttattctattttcttctagcttccagtattgctgttaaagtctgaggctagtaggattctctgttccctgtaacctattgtttttttcctctggaagttttcaggttttttgtcttgtcctcagcgttttgaaatttcagcaatgtgccttggtatgggtctcttttttccattgtggctttttgtctggaaactcactggccatcaattctgaaaatttaccttctactcatttcatttcttgccctctgttttttatgttgccccttccagaactcctgttacatatatgttggttctcctagaccaatggtctaacgtccatatcattttctcccccccccccaccccctcgaagtggagtcttgctctgtcacccagagctggagtgcaatggtgtgatcttggctcactgcagcctccacctcccaggttcaagcagttctgcctcagcctcccgagtagctgggattacaggcacccgccaccacgcccagctaattttttgtatttttagtagagacggggtttcaccgtgttcgccagggtgatctggatctcctgacctcgtgatccacccgcctcagcctcccaaagtgctgggattacaagcgtgagccaccacatgaccctgccttttccaggttcctttttttggttgttgttatttgttactgattttagttgctctttaattttatttatttatttttttgcttcccatgtagattggatgctctttaaagacttttttcaagtaatcccatgagccttggttgtcgcatttgagttgggcactgaaaactgataaataaatgcggtttgctgattgtgggccccagtataatctgactgtactgttctggcatcttatgaaatgcagatgttgggatctttagagctgttcatttatgctactcagatccctagttttatatgccaaagtataacttatgctttatgtgatttccactttagagattttattaaaactttttatttatagtctaat

SEQ ID NO: 1081 - DNA, 1598 bp, Homo sapiens
gcaaatgagaaactagaaaagatacaggcagtaagtataaggcaaagactaacattcagcagaaaaaaataatttaaaaaaatttaaaatattgtatgtaaatgggtaagacataagaaaatactcagacttattagtaatcaagtaagtgcaaattttaaaaaacaaaatcctggctgggcatggtggttcatgtctataatcttagcactttggaaggccaagaggcaggaggagtgcttgaggcctggagttcaagacgagcctgggcaccatagtgagaccctgtctatttaaaaacaaaaaagttagccaggcgtgatggtgtatgcctatagtcccagctactctggaggtgagacaggagggactacttgagcccagatggaagaggctacagtgagctgtgatagtgccactgcactccagcctgggcaacaggctgtctcaaaaaataaaataaaataattttatttactatcaaattggcaaccattaaaaaaaaaatactcagtgtgggccgagttgaggaaacaggcctatttagacttaagtgcaaaagccctaaaagtacatatactgaacagccctgcttttagaaaaacattctaaacaagcaagtattgctcacagatttaactacaatgtggtgtttaggagcaagaattacaatctaattgaccaatacaacatactagattgaaaaattatggtctatatcatggagtatcaggtagccattaaaaatagactggagaagaatatttgtttatctgaaataatgttcatgatgctttgcttagttataaaacagtacataaaatataaaaataggctaggcactgtggctcatgcctgtaatcccagcacttggggaagctgaagtggatggatcacatgaggccaggagtttgagtccagcccggccaacatggtgaaacctcatctctactaaaaatacaaaaaaaatcagccaggcgttgtggtgcacacctgtaatcccagctactcaagaggctgaggcatgagaatcccttgaaccctgaaaactaaggttgcagtgagccaagattgtgccactccaacctgggtgacagagggagactgtgtctcaaaaataaataaattaaataaaaatactatttctgaaaagaaaaatggtttacatatatttgcaaaaaaaatgatagaaaggtgtacacccaaatattaacagtggaattactgatgaattttctatattgaatgcgtatttgttggcaaccgaggaaaaatcccagataacgattaaatttataaagaaaactgcaggttgaaagataatcaaacttaaaatttagaactcatttgattagaaaaagcatctcctatttgtaatttttcaaatataattttagtagtttaagcctcaataaaatttttagattttaagttctataaatttccttcaaaatatgtagaattgcatattaaatcatcttataacaaacaattgaacaaaattcttacttgaaaaatgcaataagaagattaaccataatgatatactgtacaaagaggtagactgcttgaagaaatggagtcaaccacgtcccagg

SEQ ID NO: 1082 - DNA, 45246 bp, Homo sapiens
atatctaggaagcagtaactgaacatctgctggttgattttctttcagaatctccatgtttgacttggctagggaaacattttctttctgaagttgaaggatgcagaaggttgcccaggttgaaattagactctgggtggtaaaactgccttgagctcacctggagagttgtagggcatccacctgctcagttgtgttgggggcttgttcttattctttcaaagccaatctggaaaataaaagcctctatgagattccatgtcatgtgggctaatctgaccaaagggacttagagcagccatgaaggccaaggaattcctgaatgttctctggtcagatttccttgtaactcacaaggggtctgtaaggaaaacagattgtctaactaattgctgatcttgtctcctcggggttccttcccaattcccagtcacttcatgacaaagctgcaatatatttgcctcttctccaaacctatacagaaagcttttaagaaacaaaggaaagagcatgaaacttgggattgcacaaatatgggactttaggtccaggctgcccctgaatgaagctgattaaattccttaacttctcatagacttgcttcttaatcagtgtagtgtgtatcattataataatgtacatttactgtttgaatttatgagtagacctagctagcattaagcaaaaagttacttatctcttggaatctcaccttgaccacctgtaaaacagagatgtaaatagcctcaccttctagagtcatagtgaggagtaaaggggacataagcacttttcacagtgcttgcgtgtaagaggtacttagtaggtaattgttgaatgaatgactgactaggaggacaaggttccttttcagtaccttggcttctgttcttgttgattgaaattcactgagaagaaactcatctccattgcctccagattctaagttctcctaccaccctgtacttgcccttacagcactcatcacaactttgcctaaataattatgtatttaaatcctgactctctctcaagagtggaaatgccatgtctgaggccatatctgtgctgttcacccaccatgtagctcaatgtttattagtatactgttatcactaaaaatgtttgttggatgaataaataacaaatggctaccggttaggtagcggtacctcttttatttctacttttgagatgttttgtgactgtctttgcagatccacttggtcttcatatggtttttacacttgcttactataggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaaggtatgggcaaaactggtgttctctccttgttcatattcctacctgctgagtgtcgtgtgtcaatctggtgccgtaaacaatgttggggtaactttagatgcagaggtaagcaagacataggccttgcccttcaggagctcacagtctactggcagagactgataaacagctaatatatggtaagagctgggatcaaagtaactatagctggagctggggaaagagctaaccggagggggctcagggaagacaggacagcttgaggtgtgaccacatgtggaagaattcactgatcaccttattaacatttaccacgcctttaatgtgtgccaaaggctgtgtaaaatgtgttaacttgcactgtgtagttgcatcttcacatgaccctataaaggtaatactgtcactacccctattttattgagggagaaatgtaggcacagaaaagttaggtaacttactcaagttcacacagtaagtagcagaggcaggactagaacaaagcagtctgactccagaggtgcgctcttttttttttttttttttaattaaaaaaagttcaatgggtttttggggaacaggtggtgtttggttacgtaagttctttagtggtgatttctgagattttggtgcactcatcacccaagcagtgtacactgtacccaatgtgtagtcttttattcctcaccaccccccagcgctttcctccgagttcccaaagtccaattgtatcattcctatacctttgcctccgaggtgcactcttaaccattggactctgctgccttccaagtggacaaatgaggatgagaggaactgcattttgggcagagggaatagcatatgcaaaggcatggtggcacgaaaacatggtgtgttctgataaagcaaaggagtcagattagagtgtctcccatatatgccaggcatatgttcaccctgagtggccttggattggatgcagcctgctggcttgggaaggaaagcaatgcttcacaattcttgtttgtttttaaagtttcacttgactgtttgattttatgtcttggtgatcagtaatgacagaggtccttttgtctttttttccatggggaaaaataaagtcctggattccttcttttccctgttcctagtttagttccttaaatattcatgaggtgcttggtaatttgcagatggacaattcaccattctgtccctattgatcagtctgtttaaactttaatgaattctgggctgctgttagtgcccccggagaagaaggcagagagaggagggagtgggtaggcagtaccagagcattatacaggaataaaagagggatgcatcttctcttttgcccatttaattttcctctcctctcccctcctttcagcccccaatctggtaagaatcttctactctttgcacttgggccttctttcttcttttaacatacagccttgcttgccgttaaggaaattatcaagaagaaaatataatcccctgatgaaaagctactttaaaaaaggtctactctaagtacagctggtttaatggtagatttttaatcatctcccagtggtggccaacttatcatctgtttgagccctgttagctgcataagtaccatggacatctgtcgatagcaatgctattgcactatagcaaacctaaatgaagcccttgggtcttaggcgattctcctcagatggagtatggatatgtgggcatgtgccagaagccacaggataagcatgttacatctatatggaacatcattgctggtgtgaggcttagggagggaagcatttttatgttagagagataataacaccataggaatgagagaggtaggtgacctgttatagagcacagattctgcagccagactgcctagattgacatcccacttacaacgtttattaggttgtgatcttggacaagttacctaatgtttcttgcttcagtttccttatctgtaaaatggaaatgacattagtacctacttccataggattgttgtgaggattaaatgaattaatgcacataggatgtcataacattgcctagaaatgtgtatgggttgtttcctatggtggtgctgatggtgacagaaaatgagcagattatagaagatagtgaatttctaagacaaaatactgaaaagtcaaagtctacggcgggggaggcgcttcttgggaatattcattcactctcctggttagggttcttactgtgtaacactttgagaaacactggtctagggcaaagggtggcatcagatatgtcctggtctgtcttttcttcctcatggactccaggaagttgagagcttcagagcagttgttctaattccttttccctaagtcattcacattgcctgagatgactttcctcttagttaaagcaacagtaaggataatgtggtgtcaatgatgatgacaaagacagctaacagttcttgggcacactggtccaggtactatactgaagagcttttacccatcacttcattttatccttataataactacttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaataactactttttaaggtagttttgattgttctctctgttttgaagatagaaaaacaatgagctttgaagaggttcagtaagcagcctaaggtctcctgaataagaagaaggggacgctgtccctgccactgctactgctctcatgctctgtcccttgtctctctccagccatatctccctccacatgaccctacctggaactgataagaagtagcctgaaatttttagattttctacacatggggcatcatgaggttacccaggattacgagtgcctttacctggttgcctgctcatctgggaagtgtgtgccccctcagcaggggttatatctagtttatctgtatttctctagaattctttgcttgtagtgtgttcaattaatgtttgttgagtacataaatgaatgatatatctctgttgtttacattgtctggaatactcttctcttaacttcctcacctgcccaactcccaccttataaagtaagcttaggcggggcgtgttggctcacgcctgtaatcccagcactttgggaggccaaggcgggcggatcacgaggtcaggagattgagaccatcctggttaacatggtgaaaccctgtctctactaaaaatacaaaaaaaaaattaaccaggtgtggtggcgggcgcctgtagtcccagctacttgggaggctgaggcaggagaatggcgtgaacctgggaggcggagcttgcagtgagccgagattgcgccattgcactccagcctgggagacagagtgggactccgtgtccaacaacagcaacaacaacaacaacaacaaaaacagtaagcttaaacattcctgtctcctgagtgtcttccttggtgacttctgacagtctatgcccttttttaccaacctcagcagaaagagagggtgagaagcccctctctactgtccagagcccaccatcttcacccagatcactttctactccttatctttgcattttacttgttggcttgtttacccccttttaaactatgagctgagctcttagagagattcatctttatgtctccagtatctaacacattgcctggcacaaattaggtgctcaattaatggctgttgaatgaatgttacttagagctaaaaacaaagagacaaaatccaatctagcattccttatcttgtttcagtgtcactgtggggcaggaaggacaactattcttcctatttgaaatatgaggaaattgaggctctggaactaacaagtattggagacaagaccagaaccctggtgagatggctccaaatcttcctctctgtcttcctccctacattccctaaatttggcaggttttattgggctggtaagccgcacacctaagaggttttatggaaactcacaagtcatagaggttatatgcagtccacgattttaaaggttcctttatggagccacaaatcttaatcattccaaaaaggtgagaacatttcaaattagtgcatgattcatactaaacttctcttaggaagaaggagaagataagctggaggaatcatttagccaacaggtgtttgttgagtatcattctttcatttagtctgcaaacatttattgagcacttaactatgtgctatgctctttgctaagcattggagcatatagaggagacgtatacaagaagtctgctgcttttaaagatgaaacagcttaattgtatgagaaaaataaacaacacatatgaagccagtaaagtaccattttgttctgtcttggtgctatctatatgagtagtggttgtggggagggggacagaagaaagagtagccacatgtcgggttgagcaataatgttaaccttatattcatagaaccattatagtttacagtgcatcttcattttcatttgattgctattgcagggtgaagtagggaagaagttgttattcccatttacatttgaaaaactgagggccagagagttaagtgattttcctaaggtcacccaggtggtatgtgataaggcagaactcagatgggtcaaacctatgcattctctctatctctagcaccatatacctttatattttgcatggaatattattccaagaacctaactgatgtcttgatattcatttttcttttctctattcttgcatttgaagtgttttttttttcctctagtgctaactgatcatgtcactcttttgctacagcccttcaacatctatcactctactacaggcataatgataaattcagttccagaacaccataatgaggtgaatattgcaacaaagctcacatgaatttttgagtttctcagtgcatatgaaagttatgtttacattatattgcagtctattaaatgtgtaatagcattagtctaaaaaaagtatataacttaatttttaaaaattgccaaaaaatgtgttaatgatcatcgaagcctgcagtgagttgtagtctttttcctggtggagggttttaccttgatgttgatagctgcttactaattagggtggtggttgctgaaggttaggtggctgtggtaatttttttaagtaaggcaattttttaagtaaggtttgctgcactgattgactctttctttcacaaaagatttctctgtagcatgcaatgttgtttgatagcatcttatccatggcaggacttctttcaaaactggagttagttctttcagaccttagccttatcagttaagtttatgtactattctaaattgtttgttgtcatttcaacattgttcatatcatctttatcagaagtagattccatctcaagaaatcatttcctttgttcatccataagaagcagcccctcatcggttcatattctatcatgagattacagcaattcaatttcatcttcagggtccacttctaattctagttcgtttggtatttccactacctctgcagtaacttcctccacttaagtcttgagccactcaaagtcattcatgagggttggaattaacctcttccaaattcctgttaatgttgatattttgacctcccatgaatcatgaatgttcttaatggcatctagagtggtaaatcctttccagaatgttttcaatttactttatctagatcaattagaggaatcactatctatggcagctatatccttacaaaatgtaattcttaaataataatacttgaaagctgaaatttctctttgatccatgggctgcagaatggatgttgtgttagcaggtatgagaacaacattcatctccttgtacatcttcatcagaactctttggtgactcggtgcattgtcaatgaggagtaacactttgaaaggaatctcttttctttgagcagtaagtctcaacagcagggttaaaatattcagtaaaccatgctgtaaatagatgtgctgtcatccaggctttgttgttccatttctagagcacaggcagagtagatttagcataattcttaagggccctaggatttttggaatagtaaatgagcattggcttcaacttaagtcaccagctgcatttgcccctaacaagagagccagcttgtcctttgaagctttgaggccaggcattggctttttgtctctagctgtgaaagtcctagatggtatcttcttccaatataaggctgttttgcctaccttaaaaatatgttgtttagtgtagacaccttcattgattgtcttacccaaatcatctgtataacttgctggagtttctacatcagcacttgctgcttcaccttgtgtttttatattatggaaatggcttgtttacttaaacctcctgaaccaacttctggtagcttcaaacttttcattctgtagcttcctcacctgtctcagcctttacagaattgaagagttaggactgtgctctggattaagctttgacttaaagaatgttgtggctggtttgatcttctatctagaccactcaaattttctccatatcagcaataagactgtttcactttcttattcaggtgttcactggagtagcgcttttagttttccttacgaactttcttttgcattcacagcttgactatttggtgcaagaggcctatctttttgccagtcttggctttccctatgcctacttgactaagcttaatcatttctagctttacatttaaagtgagagactatgactccttctttcacttgaacatttggagaccattgtagggttattaattggcctaatttcaaagttgtgtctcgggggtagggatccctaaggagagggagagagatgaggaatagctagtctgtggagcagtgagaacacacaccacatttatctattaagtttgcccgtcttatatgggtgcagtttgtggtgccccaaaacaaatgcaatagtaacatcaaatattatcatagcagatataatattaatgaaagtttgaaatattattaagaattaccagaatgtgacacagacatgaggtgacatgagctattggaaaaatgacactgatagacttgctctttgcagagctgctacacaccttcaatttgtaaaaaacacaatctgcaagatgcggtaaagcaaagcacaatgataccagatatgcctgaggcatacctcaaactgcggttttagttccagaccactgccacaaagcaaatatctcaataaagcaagtcacatgaattttttgattccccagcatacataaatgttttgtttgtgctgtaccgtagtctattaagtgtgcaatagcactgtatctaaaaaaaaggtaccttaattaaaaaatactttattgctaaaaatgctaatgaagtgagcacatgctgttggaaaaatggcagcaatggacttgcttactgcagggttgccacagacgttcaatttgtaaaaaatgtaatatctgcaaagtgcaataaagtgaagcacgataaaatgaggtatgcctgtatttgggtagaactcaatccttaacatggccttcagggccctacatggcctgtctcgacttgcattcctggctcatctcatgatgcttctcctggctctctgcattccagccacaccttccttctgtcatgtcctcaaacatgcaatgctccctttagcgtaagaattgttacccagattctttcttctggctgcatatccttcctaccttccaccagcatatctaactcctgttcatccttagacctaagctatccaatccaatagttgctgaacccacaatgccatttaaatttatagtaattacaattaaatataattaaacattcacttcctcttttgctccagccaaatttcaagtgctcaatagccacatggtggctattatactgaacagcacagatatagcacattttcattattgtagaaagttccattggatagtgctgccccaaaccttaattcaaaagttagttcttcaaggaaggagcattttctctaccaataccacctccaactaagtcttatttcacttattaaatgttttcacagtgccttgtacgtctctttcatagaactccatgtggttcgtgaatcattcattttttgttatcaaataataaaatcattctataaatcaagaataaaataccataaaatgaaacaaaataataagatatttcactttttggattaatgtatgtcttccctactagattttatgtttcaggagggcaggagctatgttttgcttacccagagcctgggttatattagacccaggaagtgtaaaaaaaatgaagggtcaaaagaaattgagagcactttgggaggcccaggtgggcagatcatgaggtcaggagtttgagacccgcctggtcaacatggcaaaaccttgtttttactaaaaatacaaaaattagctgggcgtggtggtgtgcgcctgtaatcccaactactgaggaggctgaggcaggagaatcacttgaacccgggaggcggaggttgcaataagccgagatcgcagcactgccctccagcctgggcgacaaagcaagactccatctcaaaaaaaaaaaaaagaaaagaaaagaaatggagacctccctacttctacccactggagaaaacttgagaaaggatgtagggcaaaaagtgactcttgaactcttaagagaagacaattggaactggaggaatagaatggtcagaagcgctgagatgggaacatcaaggatcgaatcctagctgtaataggtggtttctaataggaagaaggaaagggaggctagaattgacgatacaggggtaggtgagacagctggctcagaccaatggggagctcctctagaatcatcctgagtttgagattgaccagtcttgcaacagattcagaatggctggcagagaagaaactaaatttaaggatgtcaggaggcagacatcctgatgagtttcagaggctgagatttttttttttttaaactataaactttgggaagactgggaccacgtctctcttgaccaggatatgttctctgtgtctggcacatataggtgcttaatatttttaataataaatggctagattagactattggcagaggaataaataggagggctgagactgagaggctttaggaaggcaggcgtaactggacttggcaacaatggagaggaaggaggtagaggctatttgagtttcagttcttggcagaatgttggggtcactgatataaatgagagtatttggcctttatttcatcatcttatcatcaaatggcaataccatacctaagctgggatgctacgtaggtaaaggattaggactgggtttatttacttcactggtcactagagtagcttttacaaaattgactgccttcaagggccttccaggtaatgcacgccccaacacaagctgtatttgtcttcttgctgttccccctcccaggacctctgcgctcgctgttcccctgcctggaacactcttcccccagatttccatgaggtccactcctcatgtctttcaggtgtatcctcaaatttcacttgcatcttgcataggaaccacctcctccttgcattcctaatccccctgagtaatcacttgctagtatactatatctacactatgtaatttatttgatttattgggtattgtctatccctactaaaatgtaatctccaaaagagcaaggattaaaaaaaaaagtttttctctccattgtttttccaatacctagaagagaaaattctgcacagcctgaccctagaaggggcttgattattttcgctaaggacttatggctaagtgagtgattgaactgtgtaaccaacaggtagtgatggagcctgagggaactggtgattgcataactcctcgcacgcccccaaagctgacaaaggcattcaaatcaagatttaaaagaatacagtacctgccactcagaactctactgcaagctggattatgtctatgaagccccaggctttgacccttgctctaaatagagctaaggataaaaccaggtatgcatctgaccctccagttctcagtttggagggtttctaagaaacaccatctccccacccaatatggcagatcttgctgatttaaaacacatgcagaattgaaccatttcccacaataagaagaaagtgatacacaatcccttccccaaatatttgtttgctgccccatagctacgagttgacagttgttagacatggaacaggttaccaaatgaggttgcagaaatctctttctctggaaattctttagaagagcaatgtgctttctctctagctagggaaattctcttgattccaagctgttacaatgagattactgggctgctttcttcttccattaataagaatataaaaaagaattcttaggtcaccaggtcaagccccagaggccttctgggtagtgtgactctgacagtcatctttctgggatggtttagatggtgtggggtgaggggttgggaatggcgatgttcctcagctgtggatgagcatgatcataaggcatttccttgtaaggctggggaaatagtagtggctacctagctagatcaggtttaaatgcatgccacagttactcttccagtttcttgtgagaggtctctgtttgaaagatagagacgctgagtctttgtgactgaaggccatgattgtaatattgagcactctgtaggtctgttgaggggattcataacatacattgaagaaaatattttccttgctcctactaggttactcccgccatgattcttagaaagatttgagtctatccaattttttctattcctactctttttgcttgtcatttttatatgtgcttacgtgacacagagagcaagcatgctgtgctttgtacataaaaacattccatgaacacaataaggcattgagtgcatttcctatcctattttctataaaggtttactggtttcaaagtaatttcagactccactgatcccattcaaagcctttgattcttacttgggaggtatctctcactcaggaaactgaggctcagaaagttgatggagttagtgcaggattacctgacctagaagtggtggagttggcaccagaaggaagttctttggacaccacatcctgtgtttgtttctactcccaaactgccttgtggtatggagtttgagtcatctatattttctcacccaagtcctcttttgactaactgcagacctgtgtgagatgggcttacccaagtcagacatgcactttctgggcacagaagccaattgggccacatagcaagtagaagttagggctgggtgattgattgattggtatcccacatggaaagatttgaagcaactaatttgctctaatataaactgctacttactgtgcactgatgccagatgttgagctcatcacaccttattttgctgaattctcatatcattgggagatgcaggtttaggtaatagttttgtactgccaaggaagctgcttatctgacttcacaaagttatataactcggaaatagtagaaccagatttcagactcaggtcttctgcccccaaagtcgctgatttaactactatccagtgatttccaagccaagttgtaaggacattccaggcagaaatagccatacctgtaaatgctatagaaacatgaaccagcaaagcaagagaggagttgcaatggctagaattgtgtaacttgccttcagccacgtagccatggtggcagagctaggatttgaattcaagtctttgtgactcattgtcatgaggccatactgcctgtcaggaaatgggtttggtcctcacactgtaagtctagatagatcagtgtggtgaaggcatctgggtattcacttggtactgtgggtcaaggtactaccagcagtcacagatgggtcagcagcaagtgttctctagatcacatgtcctttccacaggatgagtctcttgggcaacaggaaattatctgatgacagaggtgagcagtatggtataatggaaagaaaatagacactgagtttgaattctggctctgcaatctactggctgtgtgacaagtgcaagttccttaacctctctgtgcctgctgttcaccctttccctcgccaatcatccacttcttttattttgttttattttttttgagatggagtctcattctgtcgcccaggctggagtacagttgcatggtcttgggtcactgcaacctttgcctcctgggttgaagcagttctcctgcctcagcctccctagtatttgggactacaggcacatggcaccacacctggctagtttttgtattttttagtagagatggggtttcatcgtgttggccaggctggtctcaaactcctgacctcaagtgatcttcccgtcttggcctcccaaagtgttgggattacaggcgtgagccattgcacccggcccccacttgtttttcatgaaaaactaatattaaatgtttcttttggagggctttgtaaggattaaataatatgtatgtcaaacatatggcacatagtagatgttcaatatatggcaatgctttattaatatgacttgaaaaaaattactgcttttcttttttggacatttctcataattatgtgaagctcttgtttgaggaacatgttaaatagtaagaaatggaattctaaattataaatctggtatttccaaacaggaaaaaaataattatatattttaaggtgaatttcactaaatgaggatggacatttttgagttgacttttatgggatttaaaaggttgtagtcatgttttaagttaatagaaactggtcgctcatgctttttctataaaggaaaccatagaaacaaaaataaaaaatagaattaatcgataaatctattattctacaactttaaaaattatacaaacaagtgtaaaatctatatcctcctcctgcagttccaccctcaggagcaaccactattaacaatttgttgcatattcttttttttaaaaccttactaatatatcatggatgtctttccattttatctttcatagctcaactcgttttaaaagtatttaacagcttgatgtatgatttatatatcataaaatccagccattgtaaatgtataatgctgttattttgtaaatttatacagtggtgcaatcatcacctactccagttttagaacacttattactccaaaagtttccttacacctgtttgcagtcaaccccaagccccagtcagaggcgctttctgtctttataggtgttctttttagaaattttatataaatagaatcacatagcgtgctttcttttatatctggctcttttcacttagcataatgtttttaaggatcatccatgttgttacatatatcagtagttcctttttcttgctgagtagtattctgttatatggatatacaatactttatttaacagttggttaaactatgatggatatttggttggttttcagcttgggaatatcaataatgctgctatgaatattcacatacaattctttgtgttgatgtatgtttttattttattttatttggtttgttaatattttgtattgaagttgccgggttgtgtggtaagatgtggctgtattttacatttccatcagcaatgtataagggcatcactttctccacaattctctaacacttggtattgtcagtctttgtgataatattctagtaagtgtgcagtagtatcttattgtgattttaatttgcatttccttagtgactaatgatttgagcactttttcatgtgtacattggccatttgtatattttctttgcagaagtgtccacatcttttgccaatgttatcattgggttgtttttcctcttattatttgagttttaaaatatattttatatgcaagtatattatcagatgtgttgtttgcaaatattttcttccagtctgtagcttgtcttttcgttttctaattgtttcttttgaagaaaaagatttttaaattttgatgaagtcaaaattttttcttttgtgggtcttgcttgctttttataaaatcttcatctaatgcaaggttgcaacaatgttctcctgttttcttctacacattttatatttttagtcttacatttagggatgtgatatgttttgagttaagttttgtgtatggtgtgaggtaagagtctaagttcttttttgcatatagtcatatagttctagcatcactgtcaaatagtctgtcctttcccccattaaattatataggcacatttaccaaagccaattgccataaatgggtttacttcttatatctctgttctattgatttataaatttatccttataccaataccacataaacttaggaatgctagttttatagtaagttttgaagtcagatagcatatattttccaagttctttctattcaattttgtcagtttctacaaataagtagataaataaataaataaaacctgctagttttttttttttttcactttaagttttgggatacatgtgcagaaagtgcaggtttgttacataggtatacatgtgccatggtggtttgttgcacccatcaacccatcatctaggttttaagccccacatgcattaggtatttgtccaatgctctccctccccttgccccgcaccccctgacaggccccagtgtgtgatgttgccctccctgtgtccatgtgttctcattgttcaactcccacttatgagtgagaacatgcggtgttagaaaacctgctaggattttaatggagttgtggagaatctgtaggttaatttgaagagattaccatctgaacaatgttgaattttccattttacgagtgtgacatatttctccaatttttagctcttcatagcaatgtttggtagttgtcagagtataggtcttgaacttcttgtgatatgttaattcctgaatgtatttgtcaggtttctccagagggacaaggccagtaggaaatatatatgtatatgtacatgtatgtatatgtatatattcatatatatatatttatatgtatatagtcatatatatatatatatatatgaaagaaagtttgttagggagaattggatcacatgattaaaaatgtgaagttccacaataggtcatccgtaagctagggaatgccagtagtgtggctcagttcaagtccaaaagccttgaaaccagggaagccgacaatgcagtcctgaataagtctgagggtgaaggcctgagagccccaggcaggctgctagtgcaagacctagagtccaaaggaagatgaacctggagtctgatgtctaagggcaggaggagaaaaggtgcctcactgcaaaagggagagagggaggaaggtaagcaatctgagtatcccccttgttccacctgctttgttctaatcacacccattactgattagatggtgcccactcacatcaagggtggctcttcctctcccagtccactgactccacatgtcaatctcctctggaaacaccctcacagacacacccagaaacagtgcttcactaaccagctaggcatccctcaatccagtccagttgatatctaatattgagcatcacactgagtatttcactttttgatgctattgtgaatgggattattttcttaattttattttttatcttttagttgctattaagtagaaatccagttgatatttatatgttagtcttgcatcctctcatcttactaaaattgcttattagttctagtaatttttttagcttgtagattctttaggattttctgcatatgagatcatgtcatctgcaaagaaagacactttaacttcttttctaatctgtatgcttttaatttacttttctcactttattgcaatggctagaagctcaagtataaggttgaatagaagtggtaaaagtgaacatccttgcttcatttctgatgggggaaagcattcatgttaccattaagtatgatgttagctgtaggtttttgtagatgctccttatcaggttgtagaagttctcttctatgtctggtttattgaatgttatatttggagggtaggggttcttttttctgcatctgttgagatgatcatttggtgtttgtactttgttctgttaatgtgcgtattccattaattaatttatggatattaaaccactcttgcattcctgggatgactccacatagtcatggtatataaaggaaagttttacatgctggaagatttcgtttgttaatattttgttaaggatttttactatgttcatgataaatattagtctgtagtgtccttttcttatgtatttgcttgactttggtatcagggtaatactggctatgtaatatttgttggaaagtgttcccttcttcactgtattttagacaagtttgtgtagcattggtaccatctcttccttaaatgtttgataaaatttcccagtgaagcatttggacctgtagtttttttattttttgtgggaatgttttaagcacaaatttgatttttcaaaaaaaaagtgcttctcaatttttcacatggctttggccaatttccataaccccaaaatggtggtttttgatagttttgtccagtttattagttttattttgctaagaggattttttgacttcacaccgccacacccagcagttgcctctctacctctttttaaaaaaaatctgtatagtatttcattttacaaacatgccataatttatttaataaaaatagttttttcacttttaaaatatagtctgagcagtgctgaagctaaccttcttctatatataactttacttacttttgctaataagatacgtgcatttttaattttaataaatgtcaaattattctccaaagtttgttgtcattaattatattgttagaataatctccaagaaggtccacttctgcatatattgccactaccatatacaggttaagcaaccctactctgaaactaaaatgcaccataattcaaaactttttgagtggcattgtgacgccacacatggatgtctaagatagtaacatttttgttttctgatgattcagtgtacataaactttgtttcatgcacaaaatcattaaaaatattgtataaaattaccttcaggctatgtgtgtaaggtatatatgaaacatatatgaattttgtgtttagacttgggtttcatcctcaagatatctcattatgttatatacaaatattccaaaatctgaaaaattctgaaatctgaaatgcttttgatcacaagcatttcaggtaagtaataacagcctgtagtattaatcttttatatttttgccaatatgaaaagcaaacagtttgatatctttttgtttgtacttatctaattggaggtgggaatcttctcatatgctctttgaccatttctttttattttatgaggtgactttttattcctttgcttaatttccaattatttttaattattattattatttttttttgagatggagtttcgctcttgttgcccaggctggagtacaatggcgtgatctcggctcactgtaacctccgtctcccaggttcaagcaattctcctgcctcagcctcctgagtagctgggattacaggcacacaccaccatgcctggctaattttcgtatttttagtagagacagggtttcactgtgttggccaggctggtcttgaactcctgaccttgtgatctacccacttcggcctcccaaagtgctgggattacaggtgtgagctgccatgcctggccttaatttccagttagtttggttctttttttcttatttataggatcttttgggattatagtgatactaaatttttatctgttttatgttgtaaagatttttttctattctgtcattccttccttctagttgtaactgttttcaatctttaaagaccctggtgttgtaatttatgtttttatttgtttttaaaacagaaagttgtacaagggattgatttaaaccaaattcgaggacttgggtttgatgccacgtgttctctggttgttttggataagcagtttcacccattaccagtcaaccaggaaggtaagaccatgtctcttccttttcccagtggtgggatacttggctgattaatccaatgggcccaggtggaacaggagggcaggcgtctcttgctgctgatagtaaaatttagaggtagagtgaagtgacacagatcatgttgcagaagtcaagagcttggagagcagttggtatgagtggggtggtgttgacgctggattagggggactaggctttctaaaactcaggagccacagtgcagagcttggtaaaggaaggatatgagattgttagctaggagtgattaaccttgaaacacacaggtggttttgatgttttctgagaagagagtgtcagtgcttgcagtttctttgtatacgatattcctattccgtgcttatctgagtggatgagccaagtcctttgaaaggaaatggaacatggtagacagggccatgtgacagatagaaggtagaagcagatggcctctctattttcagtagccagaccaaaagacattcacattaaatggtgttgtcctaatagacacttgtgagtacagaaatgagctgtttgaaatgtaaagtgctacttgggtccaccatcagagatttttcacagcagataaggttgtcccttttggggaattttagccaataacgtttgtactggggttacaaacccgaaagtctattaatatattaatgtaataattaatacattagtcagatgggtaatgtaaatgagtaataggccaggtttgagaaaaaccactgcacctgtgtgaagataaatttcaactgatatttaaccttgtaatgagcagatgacattagggagcagtggaggctgcattgcactggaaattgcatgctccatctgaagggaagggccagctctaggcattgtcagtcagctgttgccaagatagccattgcaaacatatttggggctagattctgttagagaacccttgattctgcacactgttgcagcagcatctttcttaactgttggctatgaggtagtagggtacattgatacacagtggaattagagttaggcggggactctgattgtagctctgctgttgctgagctgtgacaccttgggcaagccacttaactctgtgtttctcagttttcttctctgaaagaatttgaatgaatcagtagctttgctgtgagaatttagtgagagactgatacttaaaatgctcagaaaagtttcttccatcagatgatgaattttttaagttaagagaatattccggtcactactgtggacctaatgtatgaaatagtgattattataattataaggactataaatgatcatctatttgcatcccttttcactataagtgatcactataaataatcataatcactatgtgctgaaaatggatgcaaatagatgaatgattagagcacagtggtaatgatgaccattttctgcacagacacacacacttttttccctcttcttgcgacatttattaacacctcctgtgttccaagccctgtcttagcaaatgctggggcttcaaagataaatcaggacggttctttttcttggtggctgttcattggctcagttggcactgttctggcccaggacagggcagccttgttctgagccatttcagaaagcagagaccaaacctgggtagagcaaacctcagctctgcagcagcaagcattcactaattacaagatgtggccagccacagacctggccgttttgggaggctgtcagtatatcttttatgggctttatttaagtaaaggtcaggtgattgtttgggatgccatagatcagatgtctcttactgttgatagtgagatttagaggcagagtgtggaggctagaaatcaccgtcccagaagttaaaagcctggagagcaattggcacgagtggggtggtgttgggggcagagttagagggaacttggttccataaagcacaagagccatgttagagagcctgattttgggtggaactttagatactaagagtcctgtttcaaggattttgtatcatctgatctgctaaaatacatgtttacttatttatttttattctggctgtgcattagtatcaactggagatctttttaaaaattgccaattcatgagccctaccctcaggatttgtattcacttgacttgaggtggagctagggtgtcaactttttaaaaaagttttctcagtaagtctagtatgtagagaatcactggggacagattaacggagaattaaaatattaggaacagaacacttgaagtggaagaagacagttccttgttaaatttgcttaaatatgtaccctctttggatgctatttttctttcattgtaggtagaatggcttcctgttaacaaatcctctattaaaaaggtaactaggttatcactctaattataagtgttgaaataactttattccacctaaaaggttaaagtgtacccattcatcaaatgcatccagctgcaggtgccctcatcagtttcttgcctttcaacagattgtattaaggttagatcttttatctgaaatgaattatcctgtgcaagaaaatgaaattagaattataaaggtggtttgaaggttctttagagactcctacctgcatggcagcgaccaactcttgattggctaatgggagtaattgtgaggagcagagagtggggtcaggaagattccagataaccctaatcatgcagataacctaaaaccaaacccataagaccagcaaaagtattgccgtctttagatgttaaccaaaaaattataaacgaataaattaagtacaatagtttaagaaaattcagcattagtctatgataaaatagtctcatttgcctttccttgtttgactcttcttccttaaagatcagaacaacccctgggctggacagcagcacagttgctgaatgcttcctacccctgccactgaccaaactcagagccttaccctgattgtgtcatctcagccataggagctcttgggagggagaggaacaaagggtgataattggggctgggagagggagttatgacctagtctcctctgtgcaacagatacctaatgtttagatttttttgctgattcataatattttttcccctcaagtatgcctgcaacacattctgtgaacataaacatgtattttagcaaggtattaattaagtgaatatatggatgaataatctacccttaggtaaagtgaggtagctcaaatgtaactttacctccaattctcttaaacgacaacatttttgtgggtctgtgttctgtttcccatgctgccttattgtatagaacctctttctcactctttcctcacctgcctagccattggctagtcatttgaagaattaaataaacactttcctgccttttgaaagctttctgtgcagctccaggctcagctaactagagcctgctctttgctcctcctccacattcccatgtctggtactcttgttctggcagtcaacacacagtatagactctttctcctgcagacatatgttgcttaagggcagaactgtggcacattcttcttgatatcctagcatccaacactgtgcttggcatgtagtagatgctcaataaaagattaaatgaactttcagttttccataagagctgaaaaaaattaacttctcagtttttatctaaaacgaaaattattaattctaatacagtaatgattctgtacaattttcattgtattgttctgactgcattttgagagcatctttatgtagaggcagtagtagctgattggtctgtctttactataggcagaagtttagcaacaggtatttttaccttaaagtagctgtagatttgttctgtacagtacttaagaaacaatactgatattgtccccttcaacactcacccacccacacatacacccacatcctgattcattgatggttgtggaataggagctggacatcagtatttttaaaagttatcaaggcgacgctaatgtgcaactaggtttgagaactagagctttgagcacttctgttagatagaggaacaattctgtttacaaaaaattctttgacattcctgtggaaggtcccatgtactctgtattattttcaaagtattagtataatggtttgtggagcttttgtgggaggtgatatctttccagttaggcaactgagcccctgccttgttatgcccatgaccttatttaggtatcttcttacattggctttttttgttgtttttttttttggttttaattttaaacattcttttcaaagatgtggaagggtaaagaaagcaacatcttcctattcgcctaccactgaggataaacatgaaattttgccatatttgcctcagctccttttattttaaaaaaagatatttgtaacttcagcttttcacctcctgcaggtaaccattctgctgtagttgctgttcttaaacacattgtttttgtgcttttactacatatgtgtatacccacaacaacaaacagtatacaatccttcctctgtatctgaggggtacttgttccaggacctccttaagaccataacccacagatactcaagtccctgatgtaaaatggcatcgtatttgcgtataacctatgtacgtcttcccatgtacttcagataatctctaggttacttataatacctaatgttaggtaaatacttgttatactatattgtttagggaataatggcaagtaaaaaagtctgtacacattcagtacagatgcaaccatccatttaaaaaaatatattttcaatccacggttggttgaatccacagatgcagaactcacagacatggagggctgactctgtgttttaaagtatctcagctggtgtccttgttcatgttactatgtctaactctagtttattcatttaagaattgatttatctgttctctatgcagatctagttccaaaatacactttgtgcatttcccagctgtgagacattgggtacgtcttcactttcaagagtctgtcattgaaaaacaggggttaaaaacctgtatcagagggttgttttgaggattaaatgtgatgatatgtgtaaaatgtttagcacagggcttgggagacaaacacacattacaaacatttactattagcaagatatgtagtgctgcggttactttgccattaaataaaataatgtgtgaaaatataatacctggtttggtaactgctgggtttcttttctctttgccctaataatctctcgggtatattaattgctgttctgcaacttttgccatcagaggcatcagagggctgttaaaggatttctggcttgcccattggtacaggatgaattaacagaggctggggagagagataaggagttactgtgtggactacagggtggtaaggcaggatatgaggggcagtgctccttttccagctggttttaaattctcctccttatgattttctcctcctgagggcctactttctgagaagtacttgccatatcctttatgtgcattatcttttgtttaaaaacttcctgaattatacatcttcatctgtaactgtatcttcatctgtaactagcattccctgttagatctgcctaattccaaaacccatgagcttcccacgccagcaaacaagccaaccaaatgaggaaaaaaaaaaacacctacataaactaattttaattaaagtgaccagaaaaagtgggaatataagcagttaaatgccattgtttagctattagatgtattataccgtcaaagtatttatccatatttaaaggagacagatcttagaaagtattgtcttagtcttatttcatagacacctttcctgaatgtatgcccagaaaagtttttctagaacagaagggataagaaaggaagggaagaatttgagagagaatacttgataatataattaattggtagatgttttctgcttttaatgtagacatttattctaaggtcatggtcagagaacacatgactggacgggaaattccaggcctggggacagtgctttcctcagccttgctggtgtcctttcattttgcacactcttgatacataaaattatagaaagtacatagcattttgatcttgggaatccataattgttcccttgaattagaaggaagagaatgtgtgtccatctgcatctccctctcgtttctgctaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagaggtgagtgcatagggtctaagagaagataccaacaatagtagaggattcctgttactgtggacctgtaggtaccaggcaccctgctaaaatcggttatgtttgatttttcccagcaactaggaggaaggttgatcccattttattgattacagtgtagttaaatcacacctgtttttatgtgcctaactcatactaggcactgtgacaagtattgtacacattatctctttgaaggccaacgaccctatgaagtgtttgtgtgtggtgtttattttagggtgtctgttttgtagacaagaaaacgaatgttcatagagataaaacaactcactcaaagtgacaaagtaaatatgtgacagaaccagaatttgaacctaagactggctgactccaaaatcatttttttttaattttaaaatgtttcttttgtagagacttggtctcactattttggccaggctgatttcgaactcctggccttatgtgatcctgcaaaagtgatatgattataggtgtgaaccactgtgcccggccatccaaaatcaattctttttttttttttttttttttaagtatcaatttctcttttaatcttagacgtcgtggtggaaggaaaaatcagttagcaaagaagcaatctcagaaaaagtgtatctttttgatgcctttatgccttttttttcctctttttttttcggttattctttattattatactttaagttttagggtacatgtgcacaacgtgcaggttagttacatatgtatacgtgtgccatgttggtgtgctgcacccattaactcgtcatttaacattaggtatatcttctaatgctatccctcccccctccccccaccccacaacaggccccggtgtgtgatgttccccttcctgtgtccatgtgttctcattgttctattcccacctatgagtgagaacatgtggtgtttggttttttgtccttgtgatagtttgctgagaatgatggtttccagcttcatgcatgtccctacaaaggacgtgtgaactcatcattttttatggctgcatattattccatggtgtatatgtgccacattttcttaatccagtctatcattgttggacatttgggttggttccaagtctttgctgttgtgaatagtgccacaataaacatacatgtgcatgtgtctttatagtagcatggtactggtaccaaaacagatatatagaccagtggaacagaacagagccctcagaaataatgccacatatctacaactatctgatctttgacaaacctgagaaaaacaagaaatggggaaaggattccctatttaataaatggtgctgggaaaactggctagccatatggagaaaactgaaactggatcccttccttacaccttatacaaaaattaattcaagatggattaaagacttaaatgttagacctaaaaccataaaaaccctagaagaaaacctaggcagtaccattcaggacataggtatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaacaactgggcaaaggatgtgaacaaaatcaattcttttaatacccagtattctattggagttcagagaggttaattaccgttccaatgagaaagcagccgaggtgggatttaagtccatatcttctgaccagagctttgctgttctgtacacttttagccccaacttattaatatttggccttgttgacatcttaggctttccctttctcatcccacctgcactcgagtttctcatccttaaatgatatggcaatctctggtcaaagcacttgcaggtggctcccatttccagatgttaggacttctttctgaagtgtggagaatggtgatgtcagcttaatggttcccattagagatggatgtgtgagaaagttcaagtcctttgggaatctcaaggacttgaaaacctctaggtggtctggagaagtagagaatccatctaatgagcatgacctgctgtgattcatttactggctctgagatttcaggtgggctgagtcttctattactcagattgtaaatggagatggggagagcttaggttgctgagagggtgcctaaggattgccatcacggggcaggagagtggtaggaaagaagggcttcagcaatcaaagcaggcttggctttttagctattttatatattgagctgttttgtaagttttaatctacataaaggcttctgtggttgctaagagtttgaaaacagagtttcttaggagtcaggagttttcaagaatctaattctgactctactgtcaacaattgtatgctttggtcaaagcacttcttatttcaggcctcactttcttcatgtataaagtgggagagttgtattaaccagtttgaaaacctgactcgggtatatactgaaacacaaaattggaatatagaactgttctgcgctgcccggtaccctgctttgagttgtataagcattagttgattttaatcctaatggtctgtgcctggtagatagcacaggaaactgatcctaaggaggttttcccaaacaggtgatagagccagaatttaaatccatgtctgctgggctccaaatctcagcttattccatcatgtcatgcagtagtaaaatccctctgtgaagcatggctcttggcgtaggaccaggaatgatggcagtggtcttcttcaatttggcctaaacttgttgctatatcaacaagtttggattggatatatcaccttttttggcaacacagaaagaaaagttatactgagttaagcaaagaggattgggcggagggtcattggttcagtgtcagggccttctagagcacttgccatgtggccagctccagcctatatcccaggagatctaaatgcatatctggcacgaacctctcaggattcttaccatctcgcacttgagataaaactgcactaaataaatcccataggaaatagttaaagtctagattacatggcagtgtttgtgaccctctgagaacatcttatattaatttattttaaaaaatcaattttctttcagaattttctgagtaagcctctagtgtggggtgtgttttggtaagcatgtacaggaattcttgctgagaattcctttggctttaacatgattgcaaaatcaaaattaaagagatttctaaagtcagttttagcatcttcttaaagcctgaccaggagggctatagtgcttctcagacttcaatgtgtaaatgaatcacctggagatcttaggttctgattcagtagctttgggatagggactgaaaatttgagattttgtatttctaactcaagttcacgggtgatgctaatattagtggcctgggaacttgtgaaaccacttttaattccaaaagctctgctcccctaccctgaaaagcatccacttttggggaatcagggaatggtacctttgtttttaatgctatgatgggagacacaggaaagtttgatagcttcagtagagctgctcaagtgcccgttcagtataaaagcatgagattctgtgttctaagttcatcaagctgtcatgtgtttactccttcttcattctttaattcttggaagtctgtactgagctcaactatgaaccagcaactgtgataggcactggggaactggggacaataaggactcaaccttaccattgagcagcacacagtccactagggatagtggtaggggagcataaggaatggggtggatgcaggagtgacatgaaaacagagccatcaaatgtactatgcactgtgatatagcaatatacaaagtgctttgggaaaaaggatttgcttcccagaggcaatagtttgacaggagcctcaagatatgagtagaggttttgcctagcagagaagataggaaagacattctgaagagagactgtggttcatctgtgttatggtaggtgagtcccagggcatgagctggggtgcttcagcaagcatagcaggagatgaggccaggtaaatagtctgagttcggcttattaagggcttatttggtgatagggattggttgatggttgttaagcaagggaggggctggcttaggtaactggcagacatgtggagattggattagggtgagaaaatgtgtgtgggggagtaagaactagagttttctcattcccctgatgatagcactctgatggctttgcattgctctgttagataaattccagaaactgaaacatggactagaaaatggtgcatgatgtcatttttacctcttcctctctcgtcactgtttgtcttttacatcctagctcactatatcccatctacaggaatccacttagagttttttgttacatgagtcttggctagaggttggcagactatggcacccaggccaaatctggcctactgcctgttattggatggcttgagaaaatgtaaatggttttacattttcaagtggttaagaaagaatcaaaaggatgatattttgtgacttatgaaaataatatgaaattaaaattttagtggccgtaagtaaagtttgattggaacacagccacactcatccatttatgtgttgtttatgtctgttttcacactacagtgacagctgagtagttgagacagagactatgtcgcctacagggcagaatatatatgtaccatctggaccaacagatgaaaagtttgccgacccctggtcttgacaatgctgagtctttcacctacagtgttcttccctctactcactgctggttcttcctcatcatttaggtttcagttttatttttgctctcttgaaaagcctttcctgatcctcaaatacatcagagtctcttgttattacactcttaattttacttcattatatctttcgtaaattgtaatgctacgtcaatttttgtggtgatttatataatgcttgctccaaccattgtaatctgcaggaggatagagatcatatccacctcgttctttgctatgtcttggtccttaaccaaatggctggtgcacagtaggtgctcagtacatattttctgaataatttgaatgactcaataactcaataaggggctgttacagtactccatgggagaactaatgagacctgaatgaggcactgtgagatggcaggagatgggtcctagaaatttttagaggataatatcaatagaacattgacactgattggctgtgaggagtgagtcagatggaggagccagagctgaccactcacttcgttattgctgtcatttatcttctccttgtccttagcctagagtcagatgtcagaggaagttgggcagaatttggggttttatctgtcttgagatgttctaggaccaccatagctcttgaacaaagtcacctggatcctagtcctgcaaatatggaatttaatcatgtccttttcatttaaagtttatgtgtttcaggttgacatttgtctccttaataagaattgtcagatgaaaggaaaaatgccatttgaatttttcataacccccagcagtctggcttttccatttggtctcaatgattctgactctcatcttaatgaaggccaaatgtaaattaagttctgtcaggcttgagcagctggggtctcctatctttataaacatgaaacattgtagggttaacaaggtgcagactgaggaaggtcaagagagttgctgagctgatgtggatcctgacagctcaatgttaatgggaggtaattaacgtggcttgtaggggctacatggagatcttccaagctgtcttttaactcatttcctcttttgccattgtcagcagagcagaaagctaatcattttatagtttgagatttttcttgcttattccaaagttctggaaccaactgtctggaatgtcacaggattttgttgatggattcaggaaatatacctgctgcttctctctcccctgtctgtgcccctgtgcttctgtcctcctgataacatactgggaaaatgaggaaatgattctccaattggtagattctttggggggaacctgggggtttggatggctagagaggtggtttgataacttcctgctagctgtggaagctgtcacttgagtgctttgcagtaggaactgctgaaaagaaaaccctgctgcaggtcagggaagcttggttcttctagttctttctgtaacttgagaggctggacgaagctaatttttaaaaccttatttggccttattttgtcactcttgttgatgacataataacaccttttctctatcttaaaccttagtctaatcttgaaacttcatgaaagatagacaatataagtttctttccttgaaatgccatcatttaaatagatggcagtatggtggaaactagtctttcttagttagttactgtctaattactattcaactgtgttcatcaggtcttaatagtagcactaatacaagatattgaggaactttgggagatataacacaaatctatacagaaaagtacaggatttggagccaaacttgcatttaaatttttctgtaccacttaccaattgtgggatcttggacaagctaaaatcaacttctctgagtctcagtgtgctgagctataaaatgaggacaatagtatcagtcttgtagagttatgagttagtgaggtatttgtaaagtggcttatatagtagatactcaaatggtactttattttcattatcattgtgtttaaaagtgcttgtttctactgatgggcatttcagtaacatcctatcactaactgagataattttaaagactaaaatatcctatttcatggggctggccataatgagtgatatgttttttcctgttttattaaggaaaattctagaaaccatcatcaaagtttctagagacaatcatagaaaatagagaatagaagagcacagaacatattttcagtcattcatttatttgaatcacccacatcctatgtgtaataccaattccaaaggcagccaacttcgagctgtaaagctgattaacttacttgagtaccttctacttgtttcccttgacatttaccagtgccgccagtctcagaatgtttttacttcacaagagttattttatttaatctttacagcagtctgtgggacagatattatctctttttatattaccagatgaggaaactgaagctcaaaaaagttaaataacttactcgtggtctcatactatgtaagcaaacccatgtcaagagccacaccattagctctgttccctcatctgctaccttatgggaacctgtgcactttcagtgtgggaatccagaagtggtctctgccaccaagaaattacagtctagttaaagaataaagatacagagcaaccaagcagtaagagcagaacaagaaaatagatgaaaataagagctaaagcgtatgtagtgcttgttaatacatctggtacttttctaagcattttacccatgataattcatttatttctcacagctaccctataattattgtatttttcttttcttttcttttttttgagagggtcttgctctgtcacccaggttggagtacagtagcacagtcttggctcattggaacctttgcctcccaggcttgagcggctctcccaccccagcctcctgagtaactgggactacaggcacacaccaccatgcccagataatttgtgtatttttttgtagagatgaggttttaccatgttgcccaggctggtctcaaactcctgagttcaagtgatccacccacctcggcctcccagagtgctgggattacaggtgtgagccactgtgcccagcctaattattgtcttttacagatgaggaaacaggcacagagactttaagcaacttgcccaaggtcactcagctaataagtggcaaggctgggatttgaactttggcatttcacatccagagtacgggcttatcaccattttgctctactgcctctttcagcgtttgctttgcaggctttgcataaactagtttagggaagaaatttgtgggtgatggcttcgggaggatctgaggctgtgaacaatggtcagtagcttcattgtttcatttaagaaatactgagtgtctcctgtgtgagaggcactttgctgggcgctggagatgccaaggtgaatgagtgggataagggccctggggtaggcttctgggaacttagagtctagtgtagagaggcagaaaatagacacacacaaagtaattttgttttctggaaaatgctacgaaggaaaaacacagatgaacagatttggcatagcgagtgtgggcctctcttgggagtttttgtttgacctgaatgatgagataggaaggaggagcaacagattcactgtgggggaggaaagcacctcatgagatcagcaaaggaggtcagctgggccaggagggtatgagcaaggcacagaggcgtaggagggggtttggcgaagtgggcaaaggctgctgcatgcagccttgaggccaggggcaggagtttgagttttattccaagatcagtgggaaatggttgatgggctttaaacatgggtgtgacacagtatgttttatgaccttaaaaaaatcattctggcatatgtgctaggtagatagtaaatatttgtatagcaacaacaaacttcatactgttttttttttattattatactttaagttttagggtacatgtgcacaacgtgcaggtttgttacatactgtaatgttaaagggaagaaaagttagaagactaatgaacagtcttataaatacatttgtttaaagaaactatcagtatggaaaaaaagactggccatatacacacaagaaaacattaatactggtacactgttcatggttggaagagtttgctactgttttagcacaatgctcatgcttttattacttagtaattttccattcaaagcttgtagtcatagctaacctttctggttgacaacacttcattattgagcaagggattttttttttttctttttgggcttattttcctaaaaagcaacatgctagggacttcacaggcagaattttatctctgccctttagtgacacagtgtaacagcatgctgttttactgtatctgtgtggcagtatgaggaaaccaagactcagaggacttaagtagcatccccaaagctacacaatagtaggttgtagagcccagattctcacctagtccagtctgcctccagctcctgggatctaactattgcctctcactgcctgcttttaaagggcactcatttcttcccacttgccagggctacaggctggcagaccactggctgaatctggtccccaatcaggtttagtttgacctaccatgtgcttggaaaaaaaaaataaacaattttaaattagtttccaatatttaaaaattgagaaattttatctgaaaattcagattatttattttcctgaataaataatgaaagaacttggcaatacagggtccacacttccatgcagaagggaacggctggagctgaataggggctgccttctttagaaggggtcggcattcttcattttgcagcagtcctcacccagcctgctacactcatttcctttttcagccctacccctctgagcacttgaatttgagacttaggctgtgggaatttgttcaaggaatctgtcattacttttcctctagcaagcgcttagagaaatggaaaggcattccagatggcgaatttcttggtccagggctctcatgattccatgcctgtattctctcacacctctgggtctttgctcaggtttttccttctgcctggcaaacttatagtaatttcttccttcaccaggaaaacttataataatagttcaaaacccagccttcactgcctccaggaagccttccttgacttagggtcctacactctgtcccctgtggcattctatgcttatctctaccctagaatttattgcattacattgtgctgtatttatctcagtgtccctagcctccagagcaatgtttaaattctaacattaataacttattatatattttgatgggtggatgaatgagcggatgaacttattaaatcatctcatgccatttttgatggctaggtgcatttgtccaatcatttcattccaaactaaaggttcactgtatgcccaacataagttaattttctcttcctcattgtggaaaatgagatttgagcattactgttcctttccatcctagagccaccccttggctgcagtcctgttaccggagtcacagcttattttgtatgcaaagtgaaggctctagactgagacagtaactcctctgggcctctccactgtgtctttggactcctgtgatggataccactttaagttgctcccttcaccccccaggagaatccaagactcatcttctcaatcagaaagactttctttagaatgtttataccagggccctgtatattggaccagattcctcccagcctttgaggaatgaagacagtattgtcagctgctgttagggcatgtgttgtggattttctctccagggtgggtactggacttgtaactaaatacacagaatgttgaggctgatggcttgccttcatctacctggacagtgaatcctttccttattatcctgtatttgcatatttgatttataccaaatatgtgttgcattcttttagttttatagtccagcaaagtaatttttaaaaggcagacaaaagaaaaaaagttgttggccagataccttgtaacatttaataaatgtcagctattattataatactttaaaaaattttactttatggctatggcagactttcataaatatttcctttatatgatctatgacatgaccttgtgggataaatattactacttctcacattttacagatgaatacaagcctcaaagaaatgaaatgacttctctacaggtatcaaatcttggtgaaggtcctttgggcttaaactggagccaaatgaagtcccttggatcttaatgaaggtccttttggctttaaattctggtatatgtgtgtgtgtgtgttattctgctgtaccatgtttcttcctcatttgggttggtggattttcagctccataaaagcagggaccaaatctatcttttcataccttactgttttatatccccagagccaaacacagtgtttggcattgaaaaaatactcaataaacatttactaaatgaattcatgtcccctggccagccaggagctagccatgtgactgtagtgctgaagaccacatgcctggcttacctgttgccagtcttcctgacggctgtgcagggatgttggccacctctaggagtcattagtgtaaccagagaggtacgaggaaggattgtgaagttaggcttgctttatgtacacatggtatgattctgtgtcgatcaaaaattgaacaaaattcttttctcatagtggctaaaatggaagtcacacttactggaggaaaatacgatctttatagaaacaacactgaaaaggacaatgcatttaatgtgtgttgtgatacagtaactcatagcgtgtaaactgtcaacttggaaatctagaggctcagggtcaatggatgtccactgatgcaaggaaggtggcaggctagaagtccaaaaaggtgcaaaatggtattcttttggaggagtaagtaaatctcatttctctgaacacctgggctgttttactttcttttttcctattatccaaagtgaccataattgttctgttattgtagggatatattcatttaatcagtgaaagaaacttttgtctggtaactactaggtacaaagtactgtgcttggtgatggggaggaaaggaggaagccaagctcaccctttatctcaaggaattcccatatctagtaccaagagcgagaggctgtgaaagccattacccgccctgccacccccccgccatgttttattatcaaaatttcaaacatataaaaaagttgaaaaacttttacagtgaatactcagagccatcacctagagcctgccatggacatttactgtccttgctttatgacttatgttgtttccatctgtctgttcctctactcagcttacatttttggaataagttgggagattgttacacttgggaaggcagtttgaaatattaaaagttgtttacatttctgaaatattaaataagttttagttaagatattgactttgttttattgctatctacatacatggccaacacctgtactagactttattaaatatccactgtgtgctttcaaatcttctatcccatttattcttatgaaaatcctgtgaggtagatgttatcacttgctttgcagatgaagaaattgaggatggagggagttaagtagattgccacttatcaactttattacctctggcaacgttggaatgcaaacccaggtttctgactctaagaaatgaatttgaaaaattattgtaaaggttagctggtcaaacaccagcctttatcacacaggtacccctgtctacagataagacatcattggagcttacctaagtaaagcaaagcaagcaattagaaaatgagagctctcttattttgctgattaattattcattattttcttaataatgactttatttttctatcatttttagtattattacttcactttgattagagaaagcaacttctgatggtttaagttaaaaatcccagataacacatttgtttggcataaatttttaaggtaaatatgaactctagaataaaacgttatcaaagttattaaaagtttagctgttcaaagttagactcaaaatgaaagaatcatacttgagactgggtgagatctgtttcccaccactatgcaaactctgacccagggcctcttttgtttgtattccagcacattatagttacctctccaagagctgactttgtcctcttctttgcattcccctgaggtatttgtagtgagaaagaatgactaaatgatggaatgagttcattacctcttctgaacccaggggtcttggaagtgctgacacagctaagacctccctggaggcttgtctgttcatccagaatggccactctggattcctataaaggctcctgtctctctgaatcctccctgtatggagaggctatggattagataaacttcagagtgtttagtaataaaaacaagcttgatctcaactctgtggccctgtcaatacccatacctgcaccctcttgaaaagctacatcagtgtagcttctaggcttgtaatctgaatgatcagtgtcttttggctcaaaaatgcaaagtgaaggaatattcagaggaaattagagagctgcctaagtggctctatcctacctggcctccgtttctcattatggctttgctaaagggtctgaaccgtggcatggacgtacattttttctcagtaacgccacatgtgtagagtattgatgcttacccaagcaaagcaaaacaagcaattaggaaatacagtctctctctcattttaccgattaattattcataattttattgataataagaactttatttttctatcattgttattattattattattattattattatttcaccactgattagtgaaaattattggtcctggactatcaccagtccctgttctggcatttgggaacaactggtgcgtgtaagccctgaaactctccttcgtgctggcattctgtgaacctgagagagatgagaagagaaccagggactagagtgaagcctactgcagttgtcttggcatgaggctgtgtggcttggctttggctgggagtcacagacaagcccacggacctgagaaagagagtgaatcactgtacaagtatttatcgagcacctcccatgtcctgggaagcagtagctggagagtggtgaaggagtactgagttttggggttcaagtggccagggctttcccccaggctttttacctattatctgcattatctgggcaattcagttcacttatgggccttagttttctgtctaaaaaattgtgttgatatactattatgtatcagaaggtatttgataaattgcagaatgctggtggtattgatagattttcagatgatagtgacagaaaaagttgattgttggaaagaaaattagtgaggtctatttttcatatacttacctttagaggcaggtaagaaatctaagagtgaagggaaatggaattcacattgtttgaagggtaggaaattttaaaaatagtgctttttaatcgtccggaagacttggggagagggtattattcctgtttgagtgggtgggaacagtctgagagacacttacctcatgcagctactgagtgggtagagctggggcccagctcagatctaactccagcctgtgctgtttctacagcagctcagaaaccaaagttcaggggagcagaggagctggagacagtgaatccatcctgaggcccccctgagtaaatgcttccagggcaattccacttgcactattattaataccttacagggtgtccttcacaaatttctcagaatgatggctgtaaaaatgggtgtgtgttttagaaataaaaatattgtggtgctaacaagttcctgccggagttgttcaaggacgttcattcattcagcaaatatttattgaaaatttgttttgttccagacactttgttaaatattgggaatatagcagtaaggaaaacagagtcactattcccaggatgctcatattctagaaaggagataagagataaagtcacagtacagcattagtgcagtgggaacttgggttactctagaaatacagcccagttaggatcgaggggctcggggaggtaatatgtaggttgtgggccagtggatgaattggaattgggtaataagcagttgaggtgaggcagtttgtaaaagctagtctggtggcagtctgaggaaatgagacctccgtggggctgcaaatgcagtatagtgagagcttagactgcaagaagctctgtgaatccgtcaaaagttcctttaagtcccttttatatattccatgctattaattacaggattctttgcaggggtgaagggggacctcatgggatggagccagttcaccctagccacaatcagagaaaggtcagaagctatttgtgacatttttcccgactcttctatctcaaagacctggacctgagaactccggagaagatgagctttgagcactcacgtcctcactgggcagacagagcagctctcctcatttcagttgtctcaagactagacagtgtgcctgagaataaagcagtgaattaaccccacttgtccaagagggtgggactgaatactagacagggccctttccgcctctcttgggtggtggggggtggcgtgtgactcagaggcagtgacatcagccatgacttcattcatccacaggaaagacagtgtgcagaccgcgaacacggctgatttctgccctcccttctcgatgctttgtcttgctggggacattgtcatggtcctgctgttatttcccacacattttattcacgtctcatgtttaagctgttctttttcttcaccccattctttttggtctctttgttcatcttttgcttttgtctttattttcttctttctcctatttaatttttcttgtttcattttctttcctgtacttcttctcttttgtctccattttccattctttccatttgctctgtcctttctcttccctctgtgtcagaaatgtatacaggaacacatcctcctgcctcctatttcttctctcctctgggcttcccactaggttattgctgtcctaacattcctaaaactgtgttcacaaaacactctccacacaaggactgatggtggctcccattcttttctgactcaagtatctaatacaagtccagatttacctcttactgcatctcaacacaggtctctcagactgagcttctcatagttccttctccatggccatggatgctgctgatgcttctgcctgcacttttactcaggccattgcctcagtgtggactgacctccatcccatcttcctcagtctttgccttccctctagacacatatctgacattgcctcctaagtaacccccttacttacctccttcccacagcactgtctccttcatgatcatacagaatccatagtttataaattatgtattttagaacttgaattattctgtactatttatacattcttcctgcatgtttcatatgcatagattctttgttccacctagccagtaactaacctgaggataggaagtatattcctgcctttcatcttctatgagcatacctagcacatagttggccacaaaccaggactgacagaccatttttttgcaaagtcaagaaatattttacttgaaaaatagttatttgatgctaattctggggagatagatgaatgaattatagttctttcctaaaaaaagagctaagggtctagtagaagagacagacccacacgtaatttgagaagaacaaggattgtggaggaaactaatgtttactaggagtgtacaagaatgggcacatgaacatgtataatctcactgaattgaattcggctaacaatcctatgagttaaatgttgctaccaatgaacaaagtgagactcatagacattaggtgactactagtcagaaataacaccactaataagtaggagaaccaacatttggactaaggtttgtccgactctaaagcccctactctttcctgaagagggaaggatgtagtgaaagtgacattctaagtaataataagaacaatcgtaggtaaaaagtgcttactatgtgccaggtgctgtaaacagattacctatatttgttcatttgatcccccatcaaccctatggcataggcactattattgtcctcagtaatttttataggatgaggaaattgagatgaagagtagttgagtagattgctcaaggccacatagctacagagtactagagccaggatattcactcttgcattctggctctggagaagaggcagcagaatgtagtgaggccctctacatagagtagcatattgcatgatcagaactgctgttggaccagtctgtttggagaatcagggactgtggagatgctgacaggtgaaggtgttgagaggtgaggctaaagaggcagccaggaatcatcacaaaggaccagtgccctcctcaaggacccgtgacaaaacatgcaattttcctagaaatattttctgtgaggttggaccgttagggatccatcataaggaagagtttaagttgtggtcttattctactacttgagttgtgaaggaacttttgagttgtggcctttgtccatgcccagcgggaaatcacagtggaactctgcaacagtggtgtaaatgaacaagtaaggatgcacatacccaaatagactccaaagaaatgccagttgaaacagtaaagtacgcctgtcctttacgggttggagatgattaagtttgggttgaaggacatttgggaagaaagaagaagggacatctgtgtgagccagcttggaacagatgccaggttatcctcaggtgtcccagagcgctcaacatttgatggagcactctccccactgcagcccccctctccattggtacttggcagcaattcagtggtgctgcactgacctgggagtccaagccaggaagtgaatgaatccattttccaattaaaatgaaacttctccaaaggacctgctaaccctgagagaagaaatttatcttcctggcagtctggcttgcctagaatatgtctctgctcctgaaacagactgagaaaagccattagcttgaatgaaaaaagagaaactgggacagttcttattcacaacctcattcatttatccattcattccttttatttctgcagactttaatttggcttccacatgtctgctcattcattcatttattcattcattagctaacatgactcatcatctatagatcagacaaactgctgtgtcctaggagtagagatatttaataaaaaacatagctcttgcctttgaggagctttcagtctagtgagagagacagacaaatgaacagatgatgggaaatgcagtgatagggatattcatagagtactataggggcatagcataagagcatctgactcagcatagggatgtcatgggtgatttcatggagtaggaaacaccagagttgagtcctaaatgtgtacacacatagacatatacatgctattgcttctgtttctctgaagaactctaatacagggtgatgaggtgggcacctcttcatgaattaattgggagttgaaattagaatggtggttgaatgtaaggaatgagagaagaggtagaagatgactcctttggtagaggtagaagatgactcctttggtaactggatcaactggcactggaaatcaaggaggaggaacacacttgggggaagatagcagattctgtcttggacgtgttgagttggaggtacagtgggacatccaggagacatgtctcagaggagagtttgaattggagtttcagatttggcacgttattcagcgtgtagttggttggaatcacaggagtgattgatatttctcagagagcatgggaacagtgaaaagaacatttggatgaggtaagatccctggggagcagctaaagaaaagagcagctaaagaaaaggagcccatgaaggagacagaaaagcactgatgagaagggcgtgagaaggtcccggagagtgagaggttgaggaagacttcctcatttctcccctggtcccagtctttgactttctttcatgtctgctccaagacctgttcaccctttccaaagccttctcttcctattaggactgtctccctctctcccatagatggtaccacccacaaggcatggcttgatccaggtcactgtggcatctctctcatc

SEQ ID NO: 1083 - DNA, 54699 bp, Homo sapiens
agccacagaaaagtccatatgctggtggtatttgacatgaactctaacatatctgtgattaatatggtcaacaaattataggagaagatggagaattcagcagagatctgggaagtagaaaaagaagtggggattctagaattgaaactaataactgagattaagaattgactaaatggagtaaagtcaacagcatacaatataattgaaaagagaattagagaactgaaacatagatctgaaaaatctatttatactacagccagtatacaaaaggatggaaaatacatgaaatacacaaacaagtatgagatatatggagcatggtaaagaggtctaacagaggtgtagttggagtccaagaatgagagaagagagataataaatcatacatagaagctatatttgaagagatattggccaaaagtttttcaaaacttataaaagaactcaagtgagttattttaacttttgaataatcaattaatgcaattccatattaaaaggatgcaagagaaaaattaacagttgtttacaaatgcttttgatacaacttagcacatattcatgatttttttaaaaatcatggcaaactacgagtagaaaggaacttattttgattaaggatatcaacaaagaaaaaaacataatgcaaatatcatacttaatggtgaaatattacaatgttccaattcttaccacgtttattccacagggcctatctagtgcaacaagtcaagaaaaataaatggaaaatataagaattagaaagaaagaaagctaacatcatagatgatacaattatacacatatagaatgtcaaaagaatctatagataaaatattaaaattaataagtaatttagcaaggttgctattgcagaaagtcaatacaaaactctattttatttctctaatccagaggcaaccatttagaaaataaaaattttagggaggagccaagatggccgaataggaacagctcccgtctacagctcccagcttgagcgacacagcagacggtgatttctgcatttccgtctgaggtacggggttcatctcactagggagtgccagtcagtgggcgcaggacagtgggtgccgcgcaccatgcacgagctgaagcagggcaaggcattgcctcactcgggaagtgcaaggggtcagggagttccctttcctagtcaaagaaaggggtgacagcacctggaaaatcgggtgactcccacccgaatattgcgcttttccgacgggcttaaaaaacagcacaccagattatatcccgcacctggctcggagggtcctacgcccacggagtctcactgattgctagcacagcagtctgagatcaaactgcaaggctgcagcgaggctgggggaggggcgcccgccattgcccaggcttgcttaggtaagcaaagcagccgggaagctcgaactgggtggagcccaccacagctcaaggaggcctgcctgcctctgtaggctccacctctgggggcagggaacagacaaaaagacagcagtaacctctgcagacttaaatgtccctgtctgacagctttgaagagagcagtggttctcccagcacgcagctggagacctgagaacgggcagactgcctccttaagtgggtccctgacccctgaaccccgagcagcctaactgagaggcaccccccagcaggggcagactgacacctcacacagacctgcagctgagggtcctgtctgttagaaggaaaactaacaaacagaaaggacatccacaccaaaatcccatctgtacatcaccatcatcaaagaccaaaagtagataaaaccacaaagatggggaaaaaacagagcagaaaaactggaaactctgaaacgcagagcgcctctcctcctccaaaggaacggagttcctcaccagcaacggaacaaagctggacggagaatgactttgaagagctgagagaagaaggcttcagacgatcaaattactccgagctacgggaggacattcaaaccaaaggcaaagaagttgaaaactttgaaaaacatttagaagaatgtataattagaataaccaatacagagaagtgcttaaaggagctgatggagctgaaaaccaaggctcgagaactacgtgaagaatgcagaagcctcaggagccgatgcgatcacctagaagaaagggtatcagcgatggaagatgagatgaatgaaatgaagtgagaagggaagattagagaaaaaagaataaaaagaaacgaacaaagcctccaagaaatatgggactatgtgaaaagaccaaatctacgtctgattggtgtacctgaaagtgacggggagaatggaaccaagttgaaaaacactctgcaggatattatccaggagaactcccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtagggttatcctcaaagggaagcccatcagactaacagcggatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcttgaaggaagtgctaaacatggaaaggaaaaaccagtaccagccactgcaaaatcatgccaaaatgtaaagaccatcgagactaggaagaaactgcatcaactaacgagcaaaatcaccagctaacatcataatgacaggaacaaattcacacataacaatattaactttaaatgtaaatggactaaatgctccaattaaaagacacagactggcaaattggataaagagtcaagacccatcagtgtgctgtattcaggaaacccatctcacctgcagagacacacatagactcaaaataaaaggatggaggaagatctacctagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatgtgcacccaatacaggagcacccagattcataaagcaagtcctgagtgacctacaaagagacttagactcccacacattaataatgggagactttaacacctcactgtcaacattagacagatcaacgagagagaaagtcaacaaggatacccaggaattgaactcagctctgcaccaaggagacctaatagacatctacagaactctccaccccaaatcaacagaatatacatttttttcagcaccacaccacacctattccaaaattgaccacatagttggaagcaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatcttctttgaaaccaacgagaacaaagacacaacataccagaatctctgggatgcattcaaagcagtgtgtagagggaaatttatagcactaaatgcccacaagagaaagcaggaaagatccaaaattgacaccgtaacatcacaattaaaagaactagaaaagcaagagcaaacacattcaaaagctagcagaaggcaagaaataactaaaatcacagcagaactgaaggaaatcaagacacaaaaaacccttcaaaaaattaatgaatccaggagctggttttttgaaaggatcaacaaaattgatagacctctagcaagagtaataaggaaaaaaataagaatcaaatagatgcaataaaaaatgataaaggggatatcaccaccgatcccacagaaatacaaactaccatcagagaatactacaaacacctctctgcaaataaactagaaaatctagaagaaatggataaattcctcgacacatacactttcccaagactaaaccaggaagaagttgaatctctgaatagaccaataacaggctctgaaattgtgtcaataatcaatagcttaccaaccaaaaaaagtccaggaccagatggattcacagccgaattctaccagaggtacaaggagtaagtggtaccattccttctgaaactattccaatcaatagaaaaagaaggtatcctccctaactcattttatgaggccagcatcatcctgataccaaagccaggcagagacacaaccaaaaaagagaattttagaccaatatccttgatgaacactgatgcaaaaatcctcggtaaaatactggcaaaccgaatccagcagcacatcaaaaagcttatccagcagcacatcaaaaagcttatccaccatgatcaagtgggcttcatccctgggatgcaaggctggttcaatataggtaaatcaaaaaatataatccagcatatacagaaccaaagacaaaaaccacatgattatctcaatagatgcaggcctttgacaaaattcaacaacccttcatgctaaaaactctcaataaattagatattgatgggacatatttcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggtaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagatccaaatcatgagtgaactcccattcacaattgcttcaaagagaataaaatagctaggaatccaacttacaagggatgtgaaggacctcttcaaggagaactacaaaccactgctcaaggaaataaaagaggacacaaacaaatggaagaacattccatgctcgtggataggaagaatcaatatcatgaaaatggccatactgcccaaggtaatttacagattcaatgccatccccatcaagctaccaatgactttcttcacagaattggaaaaaactactttaaacttcatatggaaccaaaaagagcccgcatcaccaagtcaatcctaaaccaaaagaacaaagctggaggcatcacgctacctgacttcaagctatactacaagggtacagtaaccaaaacagcatggtactggtaccaaaacagaaatatagatcaatggaacagaacagagccctcagaaataacgccgcatatctacaactatctgatctttgacaaacctgagaaaaacaagcaatggggaaaggattccctatttaataaatggtgctgggaaaactggctagccatatggagaaagctgaaactagattccttccttacaccttatacaaaaatcaattcaagatggattaaagacttaaacgttagacctaaaaccataaaaatcctagaggaaaacctaggcattaccattcagaacataggcatgggcaaggacttcatgtctaaaacaccaaaagcaatggcaacaaaagccaaaattgacaaatgggatctcattaaactaaagagcttctgcacagcaaaagaaactaccatcagactgaacaggcaacctacaaaatgggagaaaattttcacaacctgctcatctgacaaagggctaatatccagaatctacaatgaactcaaacaaatttacgagaaaaaaacaaccccatgaaaaagtgggcgagggacataaacagacacttctcaaaagaagacatttatgcagccaaaacacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttgaaccattgtggaagtcagcgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgttagggacatggatgaaattggaaatcatcattctcagtaaactatagcaagaacaaaaaaccaaataccgcatattctcactcataggtgggaattgaacaatgagaacacatggacacaggaaggggaacatcacactttggggactgttgtggggtggggggaggggggagggatagcattgggagatatacctaatgctagatgaggagttagtacgtgcagcgcaccaacatggcacgtatatgcatatgtaactaacctgcacattgtgcacatgtaccctaaaacttaaagtataataataataaaataaataaaaatgtttaaatagcatgatttacaataaaataaaaatattaagtacctaggaaggaagatgtgtaagacatctatgcagaaaggtataaaacattgagagtaactaaagaagtcataaataaatcgagggatatatgatgttcattgattggaaaacagtattataaatgtgacagtttcttcccggttgttctatagattcagtgtacttcagttcagcattctagcagatttgtgtgtaagaggatggaaattggtagacatcctaaaacttagatggaaaggatcaataataagacagtcttgaaaaagaacaaagttgggaaaactccataatgccagatagcagaacatattacgaagtaattaagaatggtattgagggaaggacagacaacccagaggaaaacagattaaggagcccagaaacaaactcacacatgtatggacagttaatttgtggcaaagatgccgttgccagagctgtaaggaagcaatgtatttttcagtgaaatagtaccctgccgattggttatcactatggcagaaattgaattttggcccttctccttatactatgcatacaaatacattccaaacagattaaaaacttaagtatgaaatttaaaaaaataaagttcctaaaagacaaggtcttcatgactttgagatagacaattttcctaaataggacattaatgtaagtacaaccataaagaaaaggattggtaaataagactatgttaaaataagaaacttcttttcatcaaaagcttccattaaaagagtgaaaatgcaagccacaaagtggaaggaaatagttgcaatgcatataacaaaagatgtgtatccagagtatgtaaagaatgtctacacattaatgagaaaagaacaattattttgacagaacaatggttaaatgtgtataaatgtgtgcatatatacatttgagcagctttgcagaaaagaggatatacaaatggacaataagatacgaaaaattgtccagccttgttagtcattaggaaagtccaaattaaaaccatactatgatatcactacacaccctgcaggttggctaaaatcaaacggtttgataatgccaagtattgatggggatatcaaacacctgaaatgctcaagcattgatgtggaaatatgaccacactttgggaaagagtttggcagtatcatgataggctatgattcagcagtcctattcttagacatatatccaacagaaatgtgtaccagaaaaaatacgtatatagtaatacatgtaaaaccattatttgcaataggcaaaaactgcaaacccccagttcccatcaataatagaattcatcaatgtttggtatattcgtggagtaaaggattttatggcaacaaaaatgtacaaaatattgctacatgcagcagtgtggttgaatctcacaaacatgggtgactgaagctggcacaaagaaaatacaccgaatggtttaaaaattaagcaaatcctgtggtgtagacatctggacagtggttatctctggcaaggcatggtatttggaaaaggacatgaggtttatttcttgatctggataggtgtgtttactttgtaagactccactaaattctatacttaaaatctgtagctttttaatgtaggttatacttcattgataaggtttattaaaaatatcaaaggctctgggccgccctgtgctaggcactgggaatgcagacatgagtatgaaataacctggctctgaagaacggagaggaggaggtgagtggtaattaataaacaattagagaaggagtttgttagaagtgaagtcagggtgtgtcactttatatgtcagcacacaaaggagcaactcccaactcaacacacttcctgcctgtattaggtgcttcataaatgttaaattctactcccaccttgctatactcataatcatgagtaatcaagtaagggaaaaattatgttatgaatcctcttttttagtgcacaatccatgttagtgatagtggtggcaagtaggcttttttatttgtctgtttgtttgtttgttttttgatgtctttaacagtgagccttcctcaaacaatgtattagatagaattgcaacttcctcagctgaaattatttcatcagtgattactttctccatggaatgttaatacattgagtttctcttgtatatataaccagggattctgagcctctttcatctctgccttgggccacacagccccatagaaagatgatggaagggagaagaagggaagaacacctgccagcctgccagaatttcggctatagattggcaagcagacagctgaatggagggaggatatggacaatgaaaaggaccatctaacttgagggcacagtgcccaccgacagcacagcaggtgctgccaggcctgtacagagctggaaatcctggcaagatggtagctgctccatcttgtctggcctagttactgcctctggcccatgctgaagggagtctggggagttaccattccaaagaactcacaagaaaacagaactgacttggatatattccaggtttgcctagtggtacttcaaaatggtagattgaatgttattttaaaagtcattttaaaattatttcctttgaaatacagaatttaataggagaaaaatcagaaggagaatgaaaaataatatggatatgcagaatatatccgaaagaaatgtgtacttcaatgtaccaaaaatatgtacagggatacagataacaccatttcaacagcttaatggttagaaagaagtatgatttctggagccagactacctaagtttatattccatgctgtcacctactgtctttgtgatcatgtgtcagttactgaacgtgctgagtctaaatatttcatctccaaaatgggcatcatcatagcagttgtaagaattaaataagttaatttacctaaaacactcaaaacagcacctgtcctgcgtaaatactacacaactactagctgctgctgatgataacagctaagccatttttgtggctgagagtcagcagccacagccagggtggaggagatccttgtaatcataaggtcagaggaaagagggcctcagtaaagaaggcttcttaggcccatacagcgggaattacttcttgccaaaaggcttgtttgtcctctcttgaagccatgattagtctgcctctgccatgtcgttggctcctcaggagattacaagctctctgaggacagagattacattttttttcaagtattatttccccagcagtgctgagcacagtacctgatgtaaagttgtgctctgtaaatgtttactgaattgaatccttctaaacagaggagggagatactattaatcagggctgaacgtgtgacagcactgttctttcaagccaagactatatgtatgttctttactttttttttttttttttttttttttttttttgagatggagtttcactcttgttgcccaggctggagtgcgatggcacgatcttggctcactgcaacctccgcctcccgggttcaagcatttctgtctcagcgtcccgagtacctgggattacaggcatgcaccaccacgcccggctaattttgtatttttagtagagatggggtttctccatgttggtcaggctggtctcgagctcccaatctcaggtgatctgcctgccttggcctcccaaagtgccgggattacaggcatgagccaacacacctggctttttttacttttaaatcatcatttcccttttagagatgggatgtcagaggcccaaaaaactcagttcatttgcgtgaggtcatgtaaatggtgatatctggaagtgtctccctcaaagtcagtgccctccctcacaggcactcattccctaaggcacctaggatgggcacagagaaaggagaaccaagcttggctggggctgctgtccagagaaggtgggcaggtgtcaagagcaggtgcagaggtggagaggagagctaaatcttgtcctcagtagaagcagagatgtcatttcaactgcaggttttgaaaaatgtcagtgcatacttcatgagattttctgaattcatttttactctcatcttctacactatttatctaagctgttgttctctttgaaactatgtcagccacatgtcattcattgtgccacaaccctgggctttttatcctgcttagggttttgttttgttttgcttgttttttctccccagctgctctgcctatcacttaattctctgagccctctggcctgagtcttatccggtggtgtgggtcaccttacaatcccgtttctagtctcctgggagtagtggtggcaggcgagggatagaatcaacatccaggttcagaatctatttgtcttttttggtcttattgtccgaagcttgagtcaaggataaattaatcagtctagaggtgggagagccctctaaccctccccagggaaaatcctagcctttatagaaacttggcctggttttggctctcagatttaattccaagctgtgaagaatctgtcaatgttcaactaaccctgacaaaacctttggaagtttctgttgcaaccgaaactcttatcacaggaggtggtactgagcttggcatcagaggttggagagagaagagagctagcctgctaattaatattttttttccttaaatttcaggcttttttttttagtttaaatgttctaaagaacctgtcctgtcacttcccatctgtttcctggtgttttcctcaagcatctcactggtttgttttatgtttttgaggggattatctggggtgctgattactttccctaccttcaaggagcctttgaataattttataaatgagaccatttgtctaggggcaagagaaggttgctgaaggcaacctagtcctgctttctcccaagagaaattgtacactaacatttgtttagtagtgcctatatcccaagtacaaggctcttgccttatacctaggatgagcaactattccagtttgccccaagataagctggggggtttccttgggtcctggaccttaaatagagtgtagacgaggagagttatcttttcttctgtctatcctaggttcatagctggggcccttttaacaaaagatagattaacaagagagaagcatacacatttatgtaatatgttttatgtgatatgggaggtatcatacagaaatgtagacccagaggaacagttaaacatgagtatttttatgttaggcttgatgaagagtagacagacatggaaaaatatgatagggcaagaagggcatgatttaatggtaataaactggggaacttagcaaagcctgttagtgcagtttcatccgtgtgatccttcatctccagatacaaggatggtgctttcctttgagtacagggagggcacctctcacatgagggtcttatgacctgcttcaggggacagtcagaaaatcctaggtttaatgacctgctttaggggagaatggtgggggaaaggtaagagtgacctctatgcctctatgattttctcagataccttcagcttaaactattcaaaatactaacatgccatattttgggatagcatgtcctgaaccccatcaagtgcagataccaggaaaaatgaccctgtaaaggaaatgccattatttccaccttacaagtgagaaaagtgagtttcgaagaggtgtgttcacttacagaagtttgcacaggaaactggtggtgagaaagaatcaaatatacatctgtcagacttcagacccagaactttacactaaccaacttcttcagaatgcagagttccatctccttcagactgtgtagctcaacagttttgtaccatctggctatttttctctactgtgtatttgactttgtctcttttgtctcagggtgtacttgaaagcctttacctccccatcttccttccctgatggctgatatacttctgcctcacctgctttaggagcccctgcctccaaccatccaaactaggtcaggggctggggctccttccttctgttagactattcagatctgagtcactggtcattcgcatagtgtcttataaatgtctgcctgtgtatttttccaccactgctagactgggatcttgtagaatacaaggaaacaactttcatctttagatttctagcacccagcatagttcctggcttataattggggatcagtaaatagctgttgaattaatcaatttataaattttcaggaagcatttgtgtgccttcgagtcacagtatttgatctatttaaggacttattccataagatgcatttgtgatgcttaggccagttctcttaatttttttttctatttttaatttttacaaagtaatttttgtgagttaacttggctgtttggattagatttcaacctgatactttaccatgcctaatgtctgagaatgagaaattgtcttttctgaagtcatagatgataatgtccaagtaatctagaggctgtgttgaagttaggaagaaaggaatttctgacatcaagtttttgctttgtcttcactgtggatttttctagttttctctaagtctcaaatttccaagctatacatattagcctacctttgagatttgatctttctgggtaggaaggagaaacaggagtgagacccagttatcagaaggtctgttctttgttctctccactcctcgcaatacaaccagcctcttgaattggtttctgattgctctaagtcatggaggagtgtggcatgaagacagaaatgatgaatgccatcccaagttaaactgcagtatgcatggtgctacatgtaattgtggcttttcatgaaataagcagattttggtttattcttaatgtttaaaatgctagcctgggttatacctactacctggtacctcattttccttattcctttgggcccgcaattattttgtcatcagttgtatagtcaaggacagaaaacagatgttccaatcaatctaagtaaacccaaataactctggcaaagcacacaccgtgctgaaatcaaatgaactgttatgccaagccttgctattaacaccaaagattggaagttgttggtagtaacatcaaaaatggtgaaaatatattgagtaaactgtcccagacattgttcccctcagttaatctccatgatagccctataagccacattctatcatcattccaattttatagatcaggagactgagacataggaaacttaagtgatttgacctacttgccagacttgaaaccaagcagtcgagttccagtgcccttgctttgaaccattacgccctaactagttcatatatctagtaaatgtctgtttacatctcatgtagaaaaagaccttccctattatcttgctctgcagagggtgggagggttggggtggggagggggcagtggcagtgtcaaggtgtgtaaaatttctctgttgacttaaagcataggatgatgatgatgatgatgatgatgatgatgatgatgatgatgattattattattattatttgagacggagtctggctctgtttcccagtgcaatggcgcgatctcggctcactgcaatctccggctcagtgcaagctctgcttcccaggttcacgccattctcctgcctcagcctcccaagtagctgggactataggtgccgccaccacgcccggctaattttttgtatttttagtagagacagggtttcactgtgttagccaggatggtctcgatctcctgacctcgtgatccaccctccttggcctcccaaagtgctgggattacaggcgtgagctaccacacccagtgcagtaaaagtaaacctactttaggatttagttggggtaagttctagaccacatttctttcaaggtcaaagcaatacttcatgaaacattgggattacctttttgacttttttttttttttttttttgagatggagtctcgctctgtggcccaggcttgaatgcagtggcgcgatctcgattcactgcatcctccacctcctgcattcaagcaattctcctgcctcagccccctgagcagcttggactacaggcgcgtgccaccatgcctagctaatttttatatttgtagtaaagacggggtttcaccatattagccaggctggtcttgaactcctgacctcatgatccacctgcctcggcctcccaaagtgctgagattacgggcataagccaccatgcccggccacctttttgactgttttactccccttcatttgctaggcttgaggttaaccctttgggtttgctttagtggcattttgacagtaagtcctgaaagagatctgagttcagctatcctattgtctaggaatagttggagttcttgtaagtagttgaaaagaaaggaactagcttctgtgaactccacgagataatgtaggataaggtagaattagagtcaggtagatctgggtgtgatatagtcccaccccgaggtcccccacaatttagtagtgtgggaccttgtagaagttgcttggaaaactttactctccttttctctatttgtaaatcaaagtgataataactaccttgcagtatcactgtgggaatcaaatatgataatatttgcaaagtgtcaagcacaaagcaatctcccaataatcaaggatcttagaacctttagtctttaccagtgatttttgacaaggtatgttgtgaggctccagtaattacattattacccatgagttgtcactcaaaaccaatcaatatttttcacctttattcatatttaagacacggagcctttgtccgtgattaaatgtgctattgttacctagaaaatgtcttgtgctttactagtatgtgacttctgccacacacattcatttattcattcattcattcatcaacaataacaacaaaaaatagtgagctactgcagtgtgaagacttgccctggcctccgtttgcttatagtgtagtagagggatttgtttgtgttgtctgtgcagacacataaactaaagttacagtgacagaatctgtagagagtcagaagatgggctacaaaggaaggaggcttggtcggttctgctggtctggggtgttttggggatgtggggagatgtgatcaggaaaggcttctgatgctgcaactgagtcttcaaaatggagttggtgttccccaggattgttatgggatgaggtgtattggtggaaaggatatcctaggcagagggagcaaagtaaacaaatgcttagtggcaaggaccaccaaatcacattcaggaataaggagaaaaggtcccaaccatatggaaccctgctcatgccaggcaattctgcaggtcgtggatggcgtatctcccatttattgagtactggtgtgttccacctaaatctcatttaattctcacagcaactttgtgggtgagtattgctatccaaattcttcagatatggaaattgaagttctaaggggtcaaggcatctttgcccaaggggatgaaagagggattcaagtctaactctgaagaagtagataaacaacaaaaacagcaataacaataataaaagtaataaaaacagcaaaggttcatatagtactaggcatgttttaacctgtaccgttcaatataatatccactagctatatgttgctacttaaatgtgaattaattaggatagaataaaaaattcagtcctcagttgtactagccacattttcagggctcaattgccacatgtgtctggtatctattgtatcagacagtgcaaatatagaacatttccatcatcacagaatgctcttattagcactgttatgggtactttacacctatattaacatatataatttttataatctgtgaggaggatactattcatattgtagagatgtggaaattgaggcataaggaagataagaaacataaagaagataagaaatcacatgatgaatgagtccttatttttaagcactgtgccataatactaactcaatatattgtgttctgtttaacataaatgaatgttagtcaaaataatggacttcagtgtctgcgtgtatgtagtctggtgttaagtcttctgcagagaacacgtctttgatatgattcttatccttccagaagcatacagttgtcaatttgcatgtataaagctggtggtcactagagagtcttctctggagcccttcctctccaggaactccagaaacctcccagccagctttggcaagaaactcactggatgggattcatcagtcagttcattcatccaaatgactgaatcaagagtctcaaacagatgtagtcttaaataatgttcaaaacccttcttatcctttttgatacttcagagaaggtgcctgaggttattaaaagagaatctttttcaagatgccaacacatcagactcaaagactgaaaatcctagttgagtccaacttctacctctaagttactaaataaactcgactaaattacttcacctttctgaaattcaatttcttcaactgtgaactggaaataaaatacacatatcacaggattttctaaggactaattgaaggttacagtgtttgaggatactttgcaagctataaagtactttatatggctataaagtgggagataattataacacaaatgcgagaactcaggatgtttttcttctatataaccttgtaagctttcaaaactgccacagcgtgataaattataggaaaatgtactcttaatcataacatttgcaaagtctcttttttattttacataaatatagtagggactcaatgcttgggtggaagtattgttggttggatgaatgggagagatgaagggagacagcatattaaataagagagctgttcatgaagttttaaatgttccttttttaacattctttttaaacattgcttgatatgaactatgtgtgttacatggagggttgggagacatttaattcattgagttagcctgtttttctgctatttgttttttagttcaacaaacatttattgagcaactgccatcagttgggcattgtgcaagtttcagggaaaacacagttgatgatgtcactgtttttttatgcctgtttcttcatctgctaatttttctccttaaacattttgaggattgcagaataaactgacactggtatggtcatatgaagggccccagcggtaccgagggctgcacttgtgtcaaattgtttcctgatgtacacatgcagcctgtgagttctctgtggatggcaaaatatgtttctccggaaagaagaaagctcctcccaccttttcttgcttttccctgcttatctctgaacctcttttctcggggatagcccatcaaagcactgtgtggccaaaggaaaaataagatgtcagctctccgactcatgtggtcttgcagtgaacatcagctatgcatggctgctgaattggggtggacattaggcagagtgtagagaacctcttgaggggaaatgaggccagtcctgcccaatatatataattttaggtaaggagatacctcagcttgtattttaggagaagcactgtgtatatactgagaatggctgaggaaggacctccatttgtaattcatttctctcattgtggggatgagagaaccagttcaaacttttaggccatttgtggcagaattggggctgaaactcttgtttttctaactcttagcccatggctctcactgagtttcatggtgaactagcacttccaagtatgttttcattatgtaagacaattataacatcataaagtgaggagtatagaaagaacataagctttggagtcagacagaacaaggtcaaatcctggcactgcttcttaaatccatgtggccttgggcaagttacctgaacactctgctctgttcttctacttctgcatctattaagaggaagaaagaatgtttaccttttatggatgttgcaaagattaaatgagagaacattcaaggagctcagcacagtacccagcctatctttgatgttgatatgtttactagaaaggaagaatccagttgtctcttgagagggggttcagatgatgatgatggtgatgatggtggtggtggagagagtgatggtagtgatgatggtgacagagctaccattaaacatctctttttaagcatttctgcaatatcacaacaaccatgtgatgttgtgattttcctcattttatagcagatccttctgtctccaaattccatccttttctcataatagcacactagttctcaggttctaagtctagatatagcagcagtgaatctgccaacccaagaagaaacaaataaatatttcctacacatttctttttccttcattttaattcccttttcgtattgactgaccctgtaacattaactttgcctgtactttatgtttatgcaaccagtaaatgtgggtgattctcaggaattccttgaacctatttatgatactgtggagcagcgtggccaactccttttctgtcaaggatctcagaatcaatatatttaagatcccaagattttgagatgtacagataagtgaacattggttgcctggctattggatttttatcttagagaaaaacctgtgagtcttggtggggaagaaccagcactttggaatcagattacctgaatgtgaatcacagcccagttccttgtgagctgcatgaccctggtgaagttactactcatttctaagcttcgattttcttatccataaaatgaggataatactaataccaatgacattagtttgttgtaagaataaaatgagacatgtatagaaagagcatgtaaaaagagctcagttaaaatgagctcatatcttgggttattcctgtacaaaagcctttgtgccctgaatggagaatcgtgtcactcaggattcactcagcaaaacacaaaccactctaattgtttaaaaaaccagtaacttaatacccaaaaatggcgatcctgatgatggaggagctgagaagggctacattccctgtgaagcaaatcagagatcagtgaaatggaagcagctaccatccccaggctggagggactaaggagggaggagggaggtggtgttctcatagtctgagggcaggggacaccagccgatgctggagccatggcagccctgtcaacagagcccgagtggtggaggggaagcagctgctgcctggcacagaagagaagtagataggctcttgcttccccttgcctgcaggggtagccccacaatactgagcagagcagcggacttgatctgaaaacacataggccaaggattcttgcaggctaaagtctcagacttctattgcctggttgtggatatgtaactactgtgataactaacacagaaagtttggaagagtcttacttccccctgttgctagacctctgaacaatagcagagattcacaggttgctgtgccccagaaggtagaatttggaaaaagcagtggaaaaccctcgaaagctgtaagaggcctgtctctggcctttttctcacattactttctagcaagtatctgagcagccagtgccttcagtatctggggatttgtggtctgatgagacattcccaccctgccgtttacctggctaacttctgcagaattgagtatagactgaacttccttgggcccctataggtgggttagctgcctttgtggcccctcctgtgatacactgatttccctgcactgaaatactccatttaggcttccatctccttcccaccagactgtgagcagggacttgtcttcttcatccttgcatccccaagcatttgtactcttacttcctgtattgagctagctactgtggtaggtcctgggctatgcatgtaagtaagagtgccagctactagcaacttttattatagaagggaggcagatgggatatatgatgttttaaaattacccatgtcttttgtgctagggaagtccattgcatgagactatttaacagggagaatcgtctgtcctagagggtcagggaagccctataattaggagtcggcctgacagcgaggttgggggaatggcattccaggcagagggaagagcaaatgtgaaggtcttgaggtgggaaacagcattaaggattagagattgagagcaaacgtggcattgcctgggagctgatgaggtcagcaggacctgttctctcctgtgtccaagtctctgcgtcctgcctgagcactttccacccccagctttgtgttgtagtcctgcaagtctgcgtgtttgtggcttccacatcacacctagtatatatcgttttgtgcatagaaggggcttattggatatttgaacaaatgaatacaattccaggccctaaagagtctttctagctttcttgtcatatttataactttagttgccctgcaagtatcaaggaatacgagctctatggggaagaagcctgaatttataccatttatgggaaaccctctgctatttggcattctgttactaggaactcgctctcagtcattctctccttcacaattggagttctgcgataagtagtagtaagaatggtgacctagggatgccagaaagattcagtcatcagaccatcctttgcttttgcttctttgggactgagatgtgatgtgttaaaccagattccatttggctccgctccttcttagcagtgaccttgggcaagtcagttaacctctgcagaccttagtttctcctctgatgtctaacattaataatatctatgatagtgttaaaatgagaccatgtatgcaaatatgtagcatagtgcctggtatttagtgagcagaaaataactgatagctgctgcttttattatgacaatcacaattactgccattattataacgttgggtgccatacattgaccagaacaaagcaaaatctgagcaggcttccgaggtttcctatgcaggcaagtatgccctttgggtttctccttgagactgccctacacacaggacccttcctccatgttgtttgactattaaaaagaagatttgttaatgcttgtttttagctttctctccctctttttttatgtgttaaagaggatttgtttttgttttcctttctcacaggagtgattggggcagatgtgagagggcacggcctcatctgtgaggggcagccagtgacgtcacggctggctgtcatctgtggaacgtcttcttgtcacatgggggtgagtccactgagcacaaaggcaaggccaccacacagcaggaggtagcctggaaggagaccctgagtgctggcttcttcaccctttcacttctttcctcttttccctgcctgccccttgtgctttgtctagccagaagcccagctccccactctacctcccttgcttaacatttgctggatctttttccaggggccaaattcttagtaagcatgaaaaggattgagtgctccctttgacgtcaccctggccagagagcccaggcatgaatggtgacatctgatcctaaggtgacaaagtctagctcccccagactgatctgtccctaatgggtagcggggtcttctcggcaaagagtgtctgttttccttggccagggaactctctctcaatcaatataaatccatctccctgggagcgtcctgatgatctatagaattagcctgcgtatcatgacttcaaaagaacactgataagcaattttcactttgttaatttttctccatgaattagtgaaaaggctttctccaagattgcagttaaaatttagtgcctgccctaaaatttatatcttctttaaatgcatgagtctgaaagcattccattccgataagtacccatttctaccatatttttatttaaaagtcattactctgttaaacttaaatcgacgactctttggaattttcccagataagtataatagagggcagagtgggggaggagcagggagatgagcagagattagagcgggacacagcccagggcagaaccaaagcagctatggaggaaattaagtgggatgtgagactgttttgcaactgtagggacccctgagcctttttaccatcagatattctagttcagttgatataaatacatgtacttacttatcaatccctgctcttgtgctaaactgtggatataagaatgacatcggctcagtgggatgagatgaagttataacaggtattagaatataatgtgaggccccccaatgtagatacaaattgaactcatgatactaagcatctgttatgtgccaagcaatatgcgaggtattcttgcacatggcatcccattttctatggctgagggagccagcccgagtggtttccagtcccacttcctcagtttactaagtgtgggcctttgggcaaggtacttaaactctctgggtcccagattcctcatctacaatatgtagagagtgacagcacctgtcagagtgctgcaagaattaaatgaggtgatactaagtgctccacatgcagtaagcacatcacaagggctcactcttaatcactaggactgttgttgttactgagcagaaagcaaacagtggctgactctgcctgggagggtgcagggtgatagaatcttcttgaggtgacatttgtgctggactttaaggaaatagatttccttctgtttgggctctgggcagtcttgaatggaatttttctaagtttaaaaattgcagcatatttggccagacacagtggctcacgcctgtaatcccagcactttgggaggccgaggtgggtggatcacctgaggtcaagagttcaagaccagcctggccaacatggtgaaaccccgtctctactacaaatacaaaaaattagccgggcgtggtggcaggcacctgtaattccagctgcttgggaggctgaggcaggagaattgcttgaacccagaaggcagaggttgcagcaagccgagatagtgccattgcactccagcctgggcaacaagagcgacactccatctcaaaaataataataataatttcagcatatttcttctgctcagcagcccttttgtaaggctcagctgtccctgaagggagagatctgcagaggcctgaggcctctttaagccagaaggcaccagcccaggagccagcccttctttcccttgatatgagtctacacttgttagattgtcttcactgaatactgatttaatcctgtttaaattatctcttattttcacagggatacatctaatcaggcttctcctgggagatctgaatctcaggcatttttaccccactcaattcagatttctgaacagaagcaaatctaaatggatgcaagtgtctctgtgatggcctgcttcttagtcttactgtctcttaatggagatgaggctggctttccctacccatttaatgtacacatttgggacctaaagcgtagaaaagtccagtaattttcccaaagtcacaaagctttgaagttcttgagctaagaactgaaatctaactctgattccaaagctcatactcctccttgcctccctgaattgtgcatgaagatgatgtacccatagaggaatggtgagaacatgggcttttacattgtccagaggcaagcttgaacatctgctcatgcatgttttggccctctgacctgagtgagctacttaacttctctaagcttcagattcttcatccatcaaattggggataatgatgccagtctcacagggttgttgagtaacatgcattatgtaggtttgtacctagcacacagcagacactcaaaaatggtggagattgttattaaactttcctagtgatgtaaacggctcacatgaagcaactgtttgggctttaacgagtttgatgggcagctgcagttggttgcgatgaatgagggccataaaaggccagtttatgatggctgtgttgtgctggaaataaagtccccacccccatcctgctttgtacttgggagtgggaagggaccctctgggccaaggggattaatcatcagctttaatgttatgtcatgagggtgagactgtggtcatgctggcatgggaaagtgcctttgatctcctcaggtgctgggaacccagcaacaataacacctttgtgaggtctaggagaggtgcaggtctgaggaaacactcccagggagactcaaggaccccctttgttgtggttctggcaaataaaaccgccactgtgaggaaaaattaaccaaacagaacacagggaccaaagggtgatgcgggcttttcaaaaagtggttttcagcatgatctgaaggatcctctttcttcctgtctgcttacttctgatgtttccaatttagtagattgagacaaaattcccaggaacgttttgtgcttgatccaggttgcctctttctagatcacccaaaaagaataaatgaatgaacgaatgaccacataagtgagtattggtaaatacttagaagcttcgtacctccaggttcctgttgcttccaggaatctggagaaaaagcctgaggttgaacataagacatgttaataaggcctttgatattttagaagatacaagcatgggctgcacatttatcttccttgtgggtgatttaattaacaggggaaaaatgccattctttttttaactccatgaaagcagagctgcttgttcagagttaattactaccaagtcaccaaaaccccagataatacacagcaggggttagccagaggttgaaaagtcatggggtaagatggagctgatccttgccattgtactgacatccttttcttgagctgtcaggttgggttgtaacttggcaacttgtcttccagttagcatgtcagatggggacaggaccctgggggggtcggggtagggagaaacactgaggaggtaagatttgagcagaacaatacctgaagagagctgggaactacatctgcatcttaaatcgctcagaactgaagttttttcagtcttaatattgagatagtggttctctatcattgaagggatgtggagactcaaagacataggctcatacgctgcccccaccacttactgtgtgaatttaggcaggatgcttcatctttcagtgcctcagtttctgcatctgttaaatgtgagtgatagtatttacccataaagttttgttcaggttcaaattaggccatctttgtaaatgacttggcactgtacctggcacaaaataccaaatatgatattgttattaaaaatgagttgttaatcacatgaacaatccatgtggttatggactagaattagagacatcagtatgaactcatattgggggaacccacccccaatatttcaacgtaggttctttctattttccgtaagtgtcagccggctgagaaataaagagaaagagtacaacgagaggaattttacagctgggctgctgggggtgacatcacatatcagtaggaccatgatgcccacctgagccttaaatccagcaagttttattaaggatttcaaaaggggagggggtgcaagaacagggagtaggtcacaagatcacatgcttcaaaggcaaaaaggagaacagagatcacatacttctgaggaaacagtacaagggcaaattcagaactactgataagtgtctatgttcagctgtgcatgtattgtcttgataaacatcttaaacaacagaaaacagggttcaagagcagagaaccgatctgacctcaaatttaccagggtgggttttttccccaccctaataagcctagggtactgcaggagaccagggcatatttcagtccttatctcaacctcataagacagacactcccagagtggcttttatagacctccccccaggaatgcattccttccccagggtattaattattaatattctttgctgggaaaataatttagcgatatcttccctacctgcacatctgttttaggctgtctgcaagaagaaaaatatggctctttttgcccgaccccacaggcagtcagaccttatggttgtcttcctatgttccctaaaatcactgttattctgttctttttccaggtgcactgatttcatattgttcaaacacacatcttttacaatcaatttgtacagttaacacaatagtggtcctgaggtgaagtacattctcagcttatgaagataacagggttaagagattaaagtaaagacaggcataagaaattattaaagtattaattttgggaactgataaatgtccatattaaaatgaaatcttcacaatttatgttcagagattgaagtaaagattggcgtaagaaattataaaagtattatttgggaactgatatatgtccatattaaaatgaaatcttcacaatttatgttcctctgctgcagctccagccagtcccactgtttgaggtccctgacttcctgaaacaaactcatatttagtttaacatagatgcagatggatgcatatagaaatagttatggatatatatacatatacaggttagtaaacacatatttatttcctggctctgttagctgagatggtctagaaataaggatacctcaagagctagtttttacaagcacatagtgtccagatcatggtatctaataccattatccaatacaaagaaccaggactccttggagaaatagttgattttaggattggaataggaaatatacaagatgagcttggagcatttgcagtgccagaaagttaggaagttctcaacaaaaaagatgagaatatgtcacagggagccaactgtgggagctcccactagccaaaactggaacaatttaagcagtaaaatgaagtattatgaattataactcaaagtataacataaatatccataagaccatactgacataaattattttgaataaataaatcaatgaaaagaagagagacatctcccatgcagaaagattccaaataatttatataaatgttccaccatcaaggaggtggagcataactttccactccttaagtgtgggctgcacatagcgatttccttccacaaaatatggtatggaaaacgggggaagagtaattttacattggagaaatatgagaaacagcatccacgtgacaaggtcaacatcaacaatgataagtcatgttgatagtacgtacccttgatatgatgtaatgaaaatgacactttgtctctgttgtgttcatcccccaatcctataagcccagtctaattaccaggaaaacaccaaacagatcttagttaagggacatcctataaaatacttgaccagtatttctcaaagctgtcatccaggtcatcaaaaaacagggaaagtcagagaaactatcacagccaagaggaacctaaagagccatgataactaaatgtaatatggtatcctggatgggatcctggagcagagaaagaacattaggtaaaatctaaggaaatctgaataaagtatggtcttcagttcatgataatatatcagtgtcattcactgtgacatatatacttgacaagatagtaatgataggggaaatgtaactggatgtgaggtatatatgatctttacaaccatcttatattgtaaaactattctaaaatttaaaatttatttttaaaatattcattaactattcactcataaagaaaacttttttttttaatttacctggctaagtgctaaaagtcttcataagataaaatgtcatgcctgccttcaaagagctcaggcacattgagaaagacagacagaaaaaggagatactacaatacaaaatggtaactactatagttaatgcatggctggagtgtggtggaagtaggaagaaggggctgtcccaagtcttgggtagatgaggaggttttcctataggaagagatatttgcaggatcatggcttccccgcccccactgagacactgttcctgccagcccaatttctgtagtaggccctttcctcagtcttctccactttgtttttctttgctgtgtccacaaagcctcacagctgacttcccctgaggcctgagcaggatgtgggtgtgtatgagccctttgggagggcaccacagggagacagcacagtcatgtattatgaactgatggtcttctgttactagctgagaagagtgggcaagtgggaccagtttctctgtcatggtctctttaacaagtgacattggcagaagttaccagaggggtggagtgggatgggattccacacggtacagtagaccactgttacacctaacaatgaaagtgctgaggtgctgctcagaaggtgcctcgcttcctctttgtttaccaggacctgttgtcgtcagccctctaggaaccagcattctcaggacactctctgtgtcaagactagctctcagactgcatgttttgaaaacaaagtatatgctaggcattgattcggcgaggagagggttgatgtggttcagtggacaatgagagacagactgtgcactcaagaagctcaaggtagcttgtttttcaagacatttgagaaacatagaaacattatgctggactgagtatgtttaatatctctgaacccaggcagtagcaccctttcctcaatcctcatgaggagataagcagtaatactacttgctaccatctgttgaccacggaccatgtactaagcaccttactaaaactttgtatcatgtaaatagctcaacaatcctaccaagtaggcaccatactgtccctcattttacaagttaggagactgaggcaaagagtggttaagtgggtcacacaatgtgtaggaatgcaacactttgagccctctggaagactgaccagagagtccttcctcctccctttcagctgtatagcttccctcaaaggcctagaggaaagggagaacagactcaattaaaagggccaaacatgagcaaatgtttgaacagacatttcaccaaaggagaaatttgaatgaaaagcactggtcattagggaaatgcaaattaaaaccacagtaagattctctactactcctactcatcttagaatggctgaagatgtgaggaactgtagctctcacacaccactggtgggaatgtaaaatgatgcaaccattttggaaaatggtttagcagttacaaagttaacatattcctactacgtgatctagccattccactcttacaaaagcatgtattcatacaaaaatttgtacagtaatgttcataccaacaaataaagctttgtaatagtccagcactggaaacaaccgagatatctttcaagagtgaatagatcaactcttggtgtatcaagagaacaaaatactactaagcagtaaaagggaatgaaccataatataaggtacaacatggattaatcacacaaaataattatgctgagtgacagaagccattaattcttccaggcaacttgcagtcttttgtggaaaagtgggctcaggccagctgataggtagattccccctaaaggcttttgttcctggccttctgagatgctttgtttcacctgactttgccatgttcctggtggactttcagaaacatgaggccagatatccctgcccagcttttatagaaatggaatgtctggatcacagggtagatgtaagttttaagaaactgccaaactgttttccaaagtcactgtaccagaaacgaatgcaaactttcttgaataaaaaatagttccattatttaaattcttgcaaaagcaaactaatatatagtgacaaaaagcagatcagtagttgcctggaatcatgaaatgggcacaacaagggccaggaaagtaggatcaaaaaggggcacaaggaaagatttgggtatgtttatcttgattgtggtaataacttcactgatctatgctatgtcaaaactttccaaatcagacatcttaaatatgtacagtttattgaaagctattagctcaataatgctttttaaaaacagaaaaaagatcgattttgtatctggagactttactgaagttgcttatacacctaaggaattttaaggctgagatgatggggttttctaaatatacaattatgtcatctgcaaaccgagataatttgacttcctctcttcttatttgaataccctttatttctttctcttgcctgattgccctggccagaacttccaatagtatgttgaataggagtggtgagagagggcatccttgtcttgtgccggttttcaaagggaatgcttccagcttttgcccactcactatgatattggctgcgggtttgtcataaatagctcttcttgttttgagatatgttcattcaatacctagtttatggattgtttttagcatgaaggggtgttgaattttattggaggccttttctgcatctattgagataatcatgtggtttttgtcattggttctgtttatgtgacgggttacaccaataatagagagtcaaatcatgagtgaactcccattcacaattgctacaaagagaataaaatacctaggtatacaacttacaggggatatgaaggacctcttcaaggagaactacaaaccactgctcaaggaaataagagaggacacaaacaaatggaaaaacattccatgctcatggataggaagaatcaatatcgtgaaaatggccatactgctcaaaataatttatagattcaatgctattcccatcaaactaccattgactttcttcacacaattagaaaaaactactttaaatttcatatggaaccaaaaaagagcctgtatagccaagacaatcctaagccaaaagaacaaagctagaggcatcatgctccctgacttcaaactctactacaaggctacagtaaccaaaacagtatggtactggtaccaaaacagatatgtagacccatggaacagaagagaggcctcagaaataacaccacacatctacaaccatctgatcattgacaaacctgacaaaaacaaggaatggggaaagattccctatttaataaatggtgttgggaaaactggctagccatatgcagaaaactgaaactggaccccttccttacaccttatacaaaaattaactcaagatggattaaagatttaaacataagacctgaaaccgtaaaaaacctagaagaaaacctaggcagtaccattcaggatgtaggcatggacaaagacttcatgactaaaacaccaaaagcaatggcaacaaaagccaaaatagacaaatgggatctaattaaactaaagagcatctgcacagtcaaaaaagctgtcatcagagtgaacgggcaacctacaaattgggagaaaaattttgcagtatctccatctaacaactgttcagaaatcagttagagagcctctggccttagtgtctttgggctctaaccacagaaaagccacccttcagaccatgctacgtttttagagctgtgttctctgggtgatgtctataacagcactttacagcttcctcagaacaccaaagaaaacgttccccagaggcaaagggtgtggcctgggcctggggggcccatgtttcatccaggaccatgaggcactgcacagtgtttgtttgttagaggagcagaggatgctcaaaatcattagtcgttagggaaatgcaagtgaaagacacagtgagatccactccacacttactagaatggctgaagttgtggtgataatgtggggaactggaactcacatgccactggcaggaatgtcaaatgatgcaacgactttggaaaacattttagcagtttcataaaacctactctaccctgtgatccagacattccatttctataaaagccaggcagggatatctggccccatgtttctggaaacccactaggaacacggcaaagtcaggtgaaacaaggcatctcagaaggtcaggaacaaaagcctttagggggaatctatctatcagatggcctgagcccagttttccacaaaagactgcaagttgcctggaagaatggtgtaagttcttcctctagaagtagaggacgaaaatggtgcagctgtgttttagctccctcctgattggcagcatgggttcttctcccaagggtacaagggaatggggtgggatgggggtggtatatgggagtggaaagttctggaggactgccttgattagcagcaatgacaataacagctaatatttattatatgtttatcatggtctatttggatttttttaaccctcataataaccttatacagttgtcagaattatcttaccaatttatggggactgaaactgaggctcagagagacaagtgacttatccaaggctgtctagctagtaagtcctttctttttttttaagacagagtcttgtcgcactcttgctcaggctggggtgcaggtgcgccatctcggctcactgcaagctctgcctcccgggttcacgccagtctcctgcctcagcctcctgagtagctgggactataggcacccgccaccatgcccggctaattttttgtatttttagtagagacggggtttcaccgcgttagccaggatggtctcgatctcctgacattgtgatccacccgcctaagcctcccaaagtgctgggattacaggcgtgagccaccgcgcctggccgtaagtcttacagataggtttgccactcaggcagttggattccagagctcagactctcaacaataagcagaatgatgagacacaggctgtgggatgggttgaccataaacacacgtgttttgtgggaatgaggtagagtgattacacagcagatctttcccagagcctgatgagaactgcacagttaaggctggatcacagctagaccgcagtgctttcattttccctttttcccagtcttccaaatcacttcctttcaagaagccaccagcctaatgataacaataaaaataaacaacatcacttgtcaccatcatcccctgggaagagagtatttatgagactccctatttaatcttcccctgttccctgctgcgctgtggtcaagtaccaaatttggcaatgtgaagacatgcggctgacttcccaactcatgaagatgtttttctatttgtttggagagcatgatgaaaaccacattgattttttttttccttttcctatttaccacacatctgttgtgtgggtgattctgatattgtggctgctgagggttacctggcagtaaccctcagtaagaggagagggtttgtccttttccagaagtttggtgtggatgaaatagatgatgaggcagtcatggtggagccctaaccaagcattgggtcccgtgccaagtgcctgcatgcatgagctcatttagttctacatacatttagttcagaggctttagtatttatgccttgtttttctcttagtttttcatcctcttctcctattctgtttgtgtgttccaaatgtctgttttttcatacattacatttttatatcttttgaaagtactcttaagagctgtcagaagtttgaggtagtttctactctttcacttaaccaatggttagagccccaggagaaataacagtgagatcaaagaactcagaagaaccaatgggaagctttttgagcaatcagcactgaaggaatgaaattgaaagtccctacgtaattaaccatcagtggctccctactgccaatagaaaaaaaaaagttcagatgagacaatgagtggaccttctggctgtgttcttatgggtttgggatatattgcattagaataaaaccgaagtcttaaatcctaaatgaaagttactgtcagttatactgacagtgatactgtcatgtatgttgtaaatctttttgttgaaagataatttacataccatgaaatttatccccttgtatttttaaaacatctagagaactgagtatagtgatgtttgagaaagaggagacttactgcccattttttaggttacattatgggatgatactagtgtgtggtctttattacttagggagataacagaaggatatcatacaatagtacattgccatttacttgtatgtacctgacacataataggtgtccgttaaataatagatatatacatgagcataaggacagacagaaaaataccagttagcaactgtaaaggtttgttggagaagaaatcgtgccatacctatttgatttctgttctctgatggagtgaaaggctgggcagagaaagggagatacagcatataaaccaccaagttattggtcaggccttaggttctttccttgattaactgacccttcccacatgccacagcagcattggttaagtcagtcacacaattttatctgtgcacaaccgagttgtccactgaattatacctcaaagcaggccaaaaatatatatatatatgtaaaactgattgaaaagcattaagaacaactaattgccaatttgtatttgggctgtttagttgatcgttgtagccttgtgtggcaccaggcaaagactaagccacaattctgttggttgaggaaatatttaactggaagatgcttttgaatgaatgatcagctacccaggtactatttgacatacagcagtcttggggcttccatgacttattctcctatcatctgtttgcatgataaaattacaggtttccatgtaatctttagcagatgtatttgctatgatcttggaagacagggcatagcttctctggaattaagggaatggcccaggaaaaagaagaggtgcccacagataaaatggtcagttatttttatatatgtgtgcattcttctgtggtgtgcagaacaccaaattgcttggacctgtttattcccacagactcacagtcaaactggtcctgaatattaaatctgatggtttcattctcctgataaaaatcctttgtcgataaaaaatcctttgtcaagtctcctgaatgctagctaggcatacgagatccagcattattgcccctgtctacctctgataccattccgtgctatccctcaccattcatcctgtgttctagcaggtgcatctgcacacgcttgtttgaattctatggaaccagagatgtttgagcatagagaatgaccagattttaggcagttaatactgtatatatacaatataatgcataacactgccagtgaagtttggagcagcacctgtaatcgtgcatactaatatctctacagtaaaacatatgaatattcacaccaaacaggttaagtcagctttaaatggcttgatccattcagatcagattttaccatcaaatgaattgtgaaaagacttttggtatttgaaatgctttgggttgaagaagtgtggtagacctgtacttgcttttcttgaaaagagcctgtgctctcttattcatctggcctttgggcatgttgttttccctgcctggaatggccacatctccctctgcctgttgagtagcatcattactagaatcatcattgcatatactgaggatttactatgttgttactcccagcaaattctatggtcgggggggcgggggggggtgttcttattgtattacatccccccagtgtttagatgaggaaactgaagcttggagaggtcacagagctaggaagaggtagagctgaggttgaaccaaaaagtatggagacaacaaaccttgggttcttagttactacactgtccgtgtgtgcgtcttccccaaaggtccagttcaggtgtcaccttcctaaggccctcttcccttcctccaccacgtttaatagattatgactcctctgggccttcacagctgtttatgcatagctgtggtgcactgcttctcattctctgtctttcccatgagcctaaactccttgagtagttggggaaaaatgtctacttcagtgttctatctctagggcatacagtaggtagtcaacacatagtttataattaagttagtttaaagtgatacggtaacagataacaatttgtatcatcattaaaataaatagtaaacaccaaatcacaagttcaaggatataaaatttggatttacaaaagaaaaaaatactcagaaaaaaaaaggctgctcatttttatgcatggtatgtaaagaagaggaatttggggacaacagttcaagaatgggcaaggaacacatttatacttaaaaattatgacagctaggatttattaaatacttcacatgtgacagtttctctgctaggcattctgtgtataaactttctaatcctcacaacaaatatgtaaggctaattgtcgaatccctgaatggacaaaaattatagctatataagaaagagaaagatatggtaaccatgtcttagatcagaataaaaagaacaaaaggtaatgatcctaatatattcagatttaacataaattaagcatcattagaggacagtcacataaaattgcacaatagaatatatttccacatctgagagatgatggaattgaggtcaaagagattacaggctagtatgtggtattttatacccattccttgaattatgttaacatggtaccagaagtatatcttgctgtcctcctcagaactgggtgcagttttgagctctgcttttgtaaaaagctgttagaacctgaaagaaccacataacacagctgtaatattcaagagaaagtgggtcccacgaacaaagattgagattgttcagagaaatggggtggttctgattgcttaatagaaacctcacaggttggctctattattttcttgtttatggaagtttttgtgaccgtaagagctaacttttccttggtgctttagagtttattaaacgtcttatggaatttgatgctcagaataactaagtgaatcagtcagagcagatgttttctttttttcaaatgagactcaaagaaattaagtgatttgttcagtgtcccacagctaataaatgatagggccaagactcagatatgtatctgagcagacccctgagccatgtccactgcaatcttgcaatccttggttcatcttcatttactcaaattgaaggatcctgcggctggtgaatgtctggttcattgcagaagagttcctggttccttgtctctaatttccattgtgactgtgaattctccattgagctgcaagccagtgactgtcaattaatgtgcacaaaatatacctgggtaactgttttaaaaatgcaattcctcaggcccctctcccacagggtctgattctctaagtcttgctggaagggatatatgagaatctgtaattttaacatgtgcccaggtgattctaatggaaaactttcaaaaaaactgctttaagctctttcagagtagcaattatatctttacttcattgtttccgtagtgcctagcagagcaccttgtacatagacagtactctaaatttacacttgatgaatataagagtgaagtaaataaatgtaaaattaatgtaaaatgaaggaaaacaagtttgagaatcagtcagttcctgccagatttggagcacactgaggaatccctttatctccatcctttcaaataaaatatctcttggtaggtctgggtaagacatactgagaagtcatgacttggacaaagtacctggtagaatctgccaacaattagagattgtggaattcttattttctcatggaaagcaggatggagtgaaacagtgagagatcctgtttgtagttctgtgcagacaaacccagaaaccagaacgcagacacaccaggacgcaacaggaaaccacaaaggcctgagatctttcaatgtaaataggaagtcagagtttacttccgaacccacagtgccaagctgaagtgcagtgtttaatccagctctctacccagcccttccttgagcctgggcacagatgaaagatgatgatgccacctgggtaaaagcattcaaaaatgtttgttctgatcaggtcttggagtgagcttcttttgtttgtgctagtgaataatttgggacacaggtgcactttgcatttgaaagcgttaattggtctccttggttttccctgccatgatatttgaagccacatcttcctccacaaagtaattttaatccatatacattcaaaaagcacttgtcatggacagccgtctttcatataccccatctgtggacccctgggtccaggtgcagagtagtggaacattggtgatgcttaatatgtactctgtgttcattgcattgacatctgtaatctcatttgattactactattacactgggaaataattaataggatacgatcatcaccattttgaaataaggaaaatgtagtctggtagaaaacacatggatgttaaagttaggcagatctgtgttcatgtccaaaagacttaagctttcttaccagactgctttattttatgtagccagttgtttagagcattcactctgtgccaggtactggagagaaaatggtgagcagtagacctagactgtacagtgtagtggaggagatgaatactcagcaaacaattacaaaaatgtataattacagaccttgataagtgctttgctttcataccctgctgggggaagtataaattgggcagtcactttggaaaacagtgaggcattgtctgatcaatttgactgtgcacatgccctgtactctaccaattccattcctaggtaggaagctggagaaacaattgtacttgtgtaccagtaagtgcccagagacaagtaagtacaagagtattcatagcattattttttataatagctacaaatttgaatcaactcaaatttcatcaataatagcatgaataactaagttgtattatattcatacagtggtagacatacttaaaatgtaggaactacagctacatatgacaacatagatggatcaaacaattttaagtggaagaaacaagacatgaaagagatacatacagaattatttcattcatagaaaattcaaaaagaagcaaaaaagacaatgtcttttaaaaaatgcctacaaaagcactaagcttagaaaagacaagcaagggaataattaccacaaatatcaggacactggtgaattagatggcttggaattgcaggttgttgaggttaaaagatgctttcaggaagagcttgagggaactagcatttgcttctgaaggatacatgagtacttaacagtttttttaatgttcacataagttttatacactcctctgtatgtatgatatgtaagtgctagaaagcagagaagctatcagaacatagagccaagtgccatataatttgggtggtctagaaggcaaggcagtgatgtttgagctgggagattttgattaggtaactaagcagagagcctgacggggagggagtagggttgtgcatggcagtggtcaagagaaaaaatttgttcagaaagagagtacagaagaataagcagaaggaaattggcagctttggtgtggggcaagagagaagaatgctacaagtaaaggctggagaagcaaaaaggggtagcatatgctgggcttgtaagccttctgagggattttagtcttttatgtaagagaaactgaaaggttttaagcacagtggataagataattgaattacaaaggatggaaataattccagtttggagaacaaattggcaagagacctgagtggtactaggatactaggaaaccagaagaagactgggagtctgtgtgagagatgatatcatactaacttgtctcagattatggtgggggagatgagatgtcgatatattggaaagatgtttagaagataaaatcagcagcacttccttggtgtgaaaactgttgaggctgcagggcaaacacaatagaggcttattaggtatctcacccaaactcctaagatgagctgctccccagtgagtagagatatctggagagagagcagtagtcgttcaggcattccttggacagactggattcactagagagaaacatttttggtttgcactgtcagctttgtttttaggttgttttaaatattttacccttgtctcttatgaaaggtcttctcaagaagtagccatgtggacacgatattgctttggtagtaattctgccaaaaatgcctgacttgaatctgatcatgaggaaatatcagaaacccaaattgagggagattctataaaataacttgcctctagtcttcaaaaatgccaaggtcataaaagaaaaactacaggaagatcaaaggagacgaaagagacatgatatctgaaggacatgtgtgatgctgaattgaattggagaaacttttttaaaagttttattgtaaaggacatttagtggataatagatgacattctaataagatcagtagattagataatagaattgtatctatgtatacttcctgataattgtattatggatatataagagaatatccttgttattataaaatacacactgaattattgaatattttggagtaaaaggacattatgtctgccactttcaaatggttcagaaaaactacatacatatacacatatgtgtgtgtgtatatatatgttcatatatatacacacatgtatgttcatatatatatgtttatgaacaatatgtgaacaatatgtttatgtaaaacattgggaaaatctaggtgaatattatacaataattctttgttctatttttacaactatttcataagtgttaaatcatttgtaataaaacattttaaaagtgttttttaatagaaggaagtagtcatgtgaaggccatgcttatatttggcataaccatgagttaatataccactcattgtgccccatataaaatcccacttgagaatttattttagaatttaccatttggaaaagtgttgttcaatctcaaatggtgtattttcatctttccagtaataaaagctatataatggattacatttttcttctggccctggaagccaaggaaactcagagttaaaaatttaacactcaagctaaactgttgagccttctactacatagcatatttccattcttctttttgctgtaattgtcttgcattactgtttctagtcactctgtactatattatctgtgtatgtatgtttgtgggagtggtagataaaatatctcaaactctttgtattagtttcctatggctgctattgtagcaagttgccatacacttggtggcttaaaacaacacacatatattttcttatggttctcgagactagaagttcaaaaccagtttcactcagccaagatcaagtgtcaacagggccgtactccctctggaggttccaggggaaaacctgttccttgcttcttccagcatctggtggctgctggcattccttggcttgtggccacatcattccagccttgccttctgtggtttcattgcctcctcctcatctgtggtcacatctgcctctccctgtctcttacaagaacagttatgattgcatttaggccaactcaaataatccaagattgtctcctcatgtcaggatccttaatcacatttgtgggtcctttttttttctttcttttttatttttttgccatatgagtaacattcataggttccagggatttgaacatggtgatcttttcaggagccattattcagcctaccataccctttatggaaagaagtgacatttaaatgtgttttttaaggtacataaaaataaagtattaatttatttggaaaatataaagtacttctgcactctgtgtatagtgaaggaacaaagataaaagaaatcaaatttctgtttagtgatttttcattgcttttatgaattacattgaattttctattatatttcctatttggttatttctggaatagagaaatatatttgactttttttagaaagtaaattatttgttaatatgaatgaataatacctgtgagatttccaatgaaaagaagcaaagttttatacatcaaatttgcttccaaatgctaatatactaaaatcagtgctagttatgtttaatataggttgctgagaaaaatagttatcttttatggtttttaaaaagtgtatgttaatttatttttatcgtttatttcttactgacaaatgcaaattgtatatatttatggggttcaatgtgaattttgatatactatatattgtaaaatgattaaatcaagcttattgacatattcattacctcacatacttttttgtggtgagaacatttaaaatctactctcttagtaattttcaaatatacaatacatttttattaactatagtcaccatgctgtgcaacagatcttcaaaacttattcctcctgtctaacccaagcttagtacaatttggccaacatctctgctttaccccttggcaaccccaccctaataaccaacattctactctctacttctatgagttcaactttattaagctttacatataagtgaaatcgtgcagtatttatccctctgtgtgtggtttattttacttagcataatgttctccaggatcgtctgtgtcactgcaaatgacagaatttccttcttttttaagactgaatagtattttgttttgaatctatggcacattttcttgatctgttgatggacatttaggttgatttcatatcttggcaattgtgaataatggtgcagtgaacatgagagtgcagacatctcttcaacatattgtttgcatttcgtttagatacacccagaagtagaattgcctgatcacatggtaatttgtcatttttttgaggaaactccatactgttttacaaaatgcctgtactagtttacattcccacagatttttaaaaagttaatcttctacccactaaccttgctaaactttcttatttttttaaaatgtgcatgtattatatatgctctgcatgcattataaatgttacagtaatttttaggtacaacactaaatattctcatatggtttggatggtcagtgaaggcttctgtaaggaagtgatatctgtgatattttggttaggaaaaaagtggtccaaacatagaggacagtatgagctatatatacaagatcatatcatctgcaaattttgcttctctcttcccttctttatatcttcttttgctgttaatttttgtctaattgtgtttgctagggcctctggtattatgctgaacagttgtggtgataaaaagcattctcacatgcacacatatgtttattgcagcactgtttacaatagcaaagatttggaaccaacccaaatgcccctcaatgatagactggataaggaaaatgtggcacatatttaccatggaatactatgcagccataaaaaagaatgagttcatgtcctttgcagggacatggatgaatctgggagccatcattctcagcaaactaacacaggaacagaaaaacaaacactgcatgttctcactcataagcaggagttgaacagtgagaacacatggacacagggaggggaacatcacacactgaggccagtcggggggtagggggaaaggggaagggagagcattaggacaaatgcctaatgcatgcagggcttaaagcctagatgacgggttgataggtgcagcaaaccaccatggcacatgtatacttatgtaacaaacctgcacgttctgcacacgtatcccagaacttaaagtaaaataataaataagcattctcatcttatttctaatcttagagggaatgtatataaaatttttccagtgagagtgatatttgctagagattacagacagacagacagacagacagacacacacacacacacacacacacacacacacacacatttccttatgaaattgagtaaatgatcttccaaagcattcagggcaaatagcagcccatgttttaataaccctaagaattattttatatgatagtcccattccatggccatggagctctgtcactatactgtgaacttctctatggcaggaactattcattcaccattgtatccttactctgaacttctctagggcaggaaactgttcacttgccattggatactcagtatctagcacaatgcctgtaagttaggcattcactatccattcaatgaatgaatggatggatgaacgatagttaatatctgtttcattctcaaagctagcaaattctttttaagcatgagccaaaaatatcactactttccattttctttattcaatgagttgagctcattttgccgccatccttacctcctcccagcacctggtacagtcagtagtcatttgacatatgaaggaataaatgaatgagtcaatcacagagcattctgctgccagttgatagactttgcccctaaagattctgaactttatttgaactgaagccaggtggttaaagatgatttaatcaggacaaaaataaaattctactctctttaatggaataattgcttattgcattttcttcttaaagttggccattcatctccttaaagttggccactgtctttcaatttatatatgttgtccatgaattattgaaagtgattattctgaattaagccaaaattattcacaaagaattgtcttggtgtgtgactagagggttcagaattccagtattacttggagagaggggttgggtatagtggtaaacttaaagtttacctgcaaaaaaacagtgttgaatgcctgagtatggcaaatccaaaaagtaagtatttggatttattggtgaataagggagagaggttggttatcaaaaaaagagcagttaagtaggaatatgttagtagttttaaatactttatgatggctctaatcatatatgtacttcctatttcaaaaggtatttcatttcataagttagagtaacacccaatattagaatttcagtgtccagaaattgattaccttctcctgacttggaactctctgctcaaaagcctttgatgactcttcgttgcctggagagtaaaaatttatttagccctagccagcgctgtccacctgcactcctaccatacacactctctgtttcagccacatgtaacagaatgttaccatagggctcttcctatcttggaggtttcgaacaggccccagagcccagaccacctatgcagagcttgctaaaagattgtgaaacttgtgctaaacgtcaccctgaggatataaaagaggtggaagaagtcagaggtcaagactaaggaaagaggctgaggttgatgattgtatctgagagagtagagcaaaaagtgaagacaaggaaaaggtgtgtgggtccagcacaagggagccagctggggatatcttaaaaggaatcccatccataaggttcaactagaggagcagaatgatcccagagcaggacttgatcacctgaaggccaggactgaaagggagttgtgggcagaccactggacggagagatagccagctttggacaggcaccacaccctgaggacataatgaagccagataacaacgtatatgcatcaagtgagaccttccccaggcaccttgacccctgtatggaggaaccccaaaacacccagctgtccagcaggaaaaagtagaaggaggagagagagaagccagcaagtccccttcttgaagtgtgtatacgctaagcctgaaatatactgtagctgcagaagggagaattttcaattagccaaaatgggagttttaattattataatagagtgtacatatttactgctagaagctggcctgaggacttttataattgaagagtgtaggaatacagtggatccccctgaaatttcatcccaggaatgaggaagaacagttcgtggaacaaatttaccaaggagaagagaatagagctgttttttcctgcacacccataatggtactacagatccttcaataaaccagaacacacacaaggctggggttgtcctctcgtccctctcctacatcagcaaatctgtctctacgtaatcatgtaagactacagcttgctttaatagctcccatcttaagaatgggagggggagagcgaggtagaagaaaaaccttgaccttatatttcgccctcctgttcccccatttattgtctttgccacacagcttctcaagtgctgtataatcccattcctcccctcccactctctcttgagcccaatcagacatttgtacaaacttctccatgaaaataacccttgaccatttgtttcgggctcctgtgaccagggtctgtgttcctaaatccagtagtcctcattcagatcgttctgttggcagcattgggcacagctgcgccctcccttctcaaaacccctcacttgcatgtagttgactctttggtcccattgtctaattgctctccatcaccagtttctaaattttggaaggcgttaagcctctgcccaagacctcttccctgcccatttccccttgcttcttcagtgacctcattaagactcaaagctttaagacaccatctgtagagtatgacctccaaacatatatctccagcctgaccctgatatcctaatatatttaatcacctactcagcatttcttcttggctttctaatagatacctaaaatttagcatgtcaaaagcctaattcctctcagcccccaggaaatctcctctcactgtctttcctagaacatgaaagaacaattctattcatacacttgcctatgtcaaaacaccttgaaaacatccttcatccctctctttttctcatattgtgctccagtaaatgctgtcagttctactgatggaatccaccaatgtggaccacctagttcaagcagttgtgctccctctcttggtttattgacacagtctcctgactgtctccctgtttttaccactgggccctggattctgttctcacagcagccagggtggcctcttgaaaacttgcctcagattatgtcattcctctgctcaaaacctttcaataattttgcatttcactgagaattaaagccaatgtccttaaaaataaaagatctgttcctcttacttttcagctctcatcttctgtcccctttctcactgttcacaccactgcagctgccctgattctttgctgttcatgtaagatagcaagcacacctctgccacagggcctttgtacttgctcttatctctccacctgcatcactcttaactgcatgcttcactcactcactcccttccagtctctgctgtaatgtaacctcatcattaaggtctatccagaccaccctatattaaaataacaacacttgccttcactcactgcttaacctctctatccttctttatttttctacacacagttatcgtcctacgctccactggactgtaagttccatgaagacagaactttgttttttcaccactgaatccccagccccttcaaagtgccttgcatgtaatagactctcacaaatagttctcaaatggagggtgcttcctaacttgctttagcctttccacatgctgttctttctggcaagagttgcttccctttaccccccgccttgttacaccccagccccaagtgagcctgttagaatcctgtgcatcctctcagactccagtttcatacaacctcctctgtgacaccgcgtgagtcagatttaattcctctttccccagaactcaaagttttcagttttattttgctttaatcaagtttgtacccttaaccactacattgtgtgtctttcagactcttgttctttcttgattttaaggctttagagatgacaaattcagcaaccgcaggtccttctcatgttgtagaattgtaaagtagctgttttttaactgcatgcaactgtatgaatcctaaacctagaattttcaatccctctattctaccgcatgtattttcatttctccttctttttctactacttcctcttcatcacaaaaaaagtcccaagcacatattatatgttattcattttcttcaaacatctttcacttaatagtttagagaaaagcccatctattccattgagtgacctttcctatgactatagaaagtggtcagtttttctgtcccttggcctgtttagcagttgaaatgcacctgacagtttgtattacaaagctaaatggtggtggccagtaaggagtttgataaacttttcatgtaatttatacataggggaaatgacactggctgttgagcacatgaagtcattttctttcttccctgaaatgctttgggggagaagaccaatcagtcatcttagtgctgcacctccatagtgagatctgcattaggtttttgaccaagaagacagtaatattttatgacaaaacttggaaaagttaaaaattcacagatgaacaaatgctttttctcattatttatctttttattctttcctatttttattccctgagaccatttgcatgaggggaaatttaatcaggatccctagttgagaacatttctattggagaaaatggaacctggatatcaaattatctcacaacttcttctgagtgacatacactgaattttatcttaaatagcttgtttagaagctattggtcaccagcttaaatagcaccttttcattataacattgcttctgttgttgcattcataacattttatttgctaaaaatgtattaactgtgtctctcccatcagttcttgagctttggagggctgtggctgtggcttattcatctctccatacccaaagactagcatataatagacatacagtaaaaatggaaagactatattgagctgcagtctaccctgtccaattaaaagtcagtggacatttgttgaataactgctatgtgccaggtattttgaaatatttggtgttatttaatctttatagtgaccctaaaatgcattgttatcccttagttatagatgagagaaagtacataagtggtttacccagctagtaagtagcagacctgtctttgaatgtaacccatgtaaagcaaaattttctgtcctttctcctttattagagcttaagtgatctttcagggaccgatatgtttagctatcaactctgtaataacatgaaaaatatttatttagctgtgatcatctatttgataaattgtcagagtgataaacccaaaaggagctttaaagatcattcagcctgtaatcccaaggtggaaagatcacttgaggccaggagtttgagaccagcctgggcaacatagtgagacccttctctcttaaaaagaaaaaaaagctggatgtggtggtggtgggtacctgtagtcccagctacttgggaggctaaggcaggaggatcacttgaacccaggaatttgaggctgcagtgagccatgatcatgcccactgcattccagcctgagaacagagcaagaacttgtctcaaaaaaacccccagaaatcatccaattcagtattctaatttcagatgcaaaaattgagtcccagaagggaaaaggtcttggccattatttcttctgtcagttggaatcatgttattcttctccttttgcactgtccttacagtaattacttttaaatccttagcaagtctgattatcccctgcatggtatggcctgtgatgacctctccagcctcacgttgcactactacccctcacagtttctgtccttcatctgtggcatagaacacactctattctctgcttcctgtccctctgcctatagcacccttccctctactccttctcctaagtcctacttacccttcacatttagctcaggcatctaatatcctctcgctggaagctttcagactagattaggtggtgtatctatgtgcatccatggtacatacctgtcatggtgcgtatccttctgtgtttgttgttagttaactggcttatgtcttccttgctgtgaattccttgaggacagatattgcggagcattcatttctatatcaccacggcctcataaagctcctcacacaaagtcagctttcaggaaattttgaaagaaataatcactcacttggattcaggtctgaagtgaggcaaacattagagatgtgatggtgttgaatactcatcgtttttgatattttgaaggctctcccatgcttgaggatccaaaggagtttaccattttgtaatgccacagatgtgtactggtgtctgtaatgctcaggtcccatccttgagcttcaccaggaacatcagtaggaagatctggcacaggctatgtggagagcctcctcaccccatgctgatgatctcatagtatctggtcactgccactaaggaaaaataaatgcctgcaggtccttttataccatgatgtaactaactataggaagtgtccctatgcaacatctttcatcttacctgaatcaaagcttcaatgaatgaagttctcttcggcccatcatcctgcaagaaactggtaggatgatggcattgggaagctataagggtgattctgacttctctgaaatgacatacattccttgtcaatattatgtcagcggaaaacttgctagccttagaaataaaaataaaggtcttatttttacattgacactttcaatctaggtaaacttgaataattcatttgatatttcagaggcttcatttcttcatctaagaacatgaggatcttttctatttatggaggtatcttgaggattggttgaagtagtgagcatgaaaggtctctagaaaaccttggttgtttagacatgttttagggacattgaaatggactgcgcatggaggaagcttcatggggggcacacctgaggggcatttcctcaatgggagagcacctttgcccttcacaacattcacacacccctcctgggtattggtgccaggctagtgccctgatctgagtccacctctgaacagtcaccctcaccaagataccccgagccaggagagccagtggagcacatctaagccaaagatgtcaaagagagtgaggagtgagaggtccaaattcaactggagaccctcaagatgagacctgttttgaatgagagagagatgaccgtgcagggtggaagcaggtctgatgcagctgacagctaaccactgctgctcggaagtgtcgacggctcaccacttatgtgttggcttttgttcctggactactcaggtggtttaaaagaccaggtgaaattgaggcaataatgaatagcttaccaaccaaaaaaagtccaggaccggatggattcacagccgaattctaccagaggtacaaggaggaattggtaccattccttctgaaactattccagccaatagaaaaagagggaatcctccctaactcattttatgaggccagcaacatcctgataccaaagcctggcagagacacaacaacaaaaaaaaagagaattttagaccaatatccctgatgaacatcgatgcaaaaatcctcaataaaatactggcaaaccgaattcagcagcacatcaaaaagcttatccaccatgatcaagtgggcttcatccctgggatgcaaggcttgttcagcatacacaaatcaataaacataatccagcatataaacagaacaaacaacaaaaaccatatgattatctcaatagatgcagaaaaggcctttgacaaaattcaacaacgcttcatgctaaaaactctcaataaattaggtattgatgggacgtatctcaaaataataagacctatctatgacaaacccacagccaatatcatactgaatgggcaaaaactggaagcattccctttgaaaactggcacaagacaaggatgccctctctcaccactgctattcaacgtagtgttggaagttctggccagggcaatcaggcaggagaaggaaataaagggtattcaattaggaaaagaggaagtcaaattgtccctgtttgcagatgacatgaatgtatatctagaaaaccccatcatctcagcccaaaatctccttaagctgataggcaacttcagcaaagtttcaggatacaaaatcaatgtgcaaaaatcacaagcattcttatacaccagtacagacaaagagagagccaaatcttgagtgaactcccattcacaattgcttcaaagagaataaaatagctaggaatccaacttacaagggacgtgaaggacctcatcaaggagaactacaaaccactgctcaatgaaataaaagaggataccaataaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagctcatatggaatcaaaaaagagcccacattgccaagtcaatcctaagccaaaagaacaaagctagaggcatcacgctacctgacttcaaactatactaccaggctacaggaaccaaaatagcatggtactggtaccaaaacagagatgcagaccaatggaacagaacagagccctcagaaataataccacacatctacaaccatctgatctttgacaaacctgacagaaacaagaaatggggaaaggattccctgtttaataaatggtgctgggaaaactggctagccatatggagaaagctgaaactggatcccttccttacaccctatacaaaaattaattcaaaatggattaaagacttaaatgttagacctgaaactataaaaatcctagaagaaaacctaggcatcaccattcaggacataggcatgggcaaggacttcatgtctaaaacaccaaaagcaatggcaacaaaagccaaaattgacaaatgggatctcattaaactaaagagcttctgcacagcaaaagaaactaccatcagggtgaacaggcaacctacagaatgggagaaaatattcacaacctactcatctgacaaagggctaatatccagaatctacaaagaactcaaacaaatttgcaagaaaaaaaccccatcaacaattgggtgaaggatatgaacagacacttctcaaaagaagacatttatgcagccaaaaggcacatgaaaaaatgctcatcatcactggccatcagaaaaatgcaaatcaaaaccacaatgagataccatctcacaccagttagaatgccaatcattaaacaggaaacaacagatgctggagaggatgtggagaaataggaacacttttacactgttgttgggactgtaaactagttgaaccattgtggaagtcagtgtggcgattcctcagggatctagaactagaaataccatttgacccagccatcccatcactgggtatatacgcaaaggattataaatcatgctactataaagacacatgcacacatatgtttattgtggcactattcacaatagcaaagacttggaaccaagccagatatccaacaatgatagactggattaagaaaatgtggcaaatatacaccatggaatactatgcagccataaaaaatgagttcatgtcctttgtagggacatggatgaagctggaaaccatcattcttagtaagctatcgcaaggacaaaaaaccaaacaccacatgttctcactcataggtgggaattgaacaatgagaacacatggacacaggaaggggaacatcacacaccggggcctgtggtggggtcgggggagtggggagggatagcattaggagatatacctaatgttaaatgacgagttaatggatgcagcacaccaacatggcacatgtatacatatgtaacaaacctgcacattgtgcacatgtaccctaaaacttaaagtataataataaaaaataaaagaccacgtgaaatgagcaggcttgggcaattcaaagcctggaaaaaaagtggtagagagggggatttggggaa

SEQ ID NO: 1084 - DNA, 199992 bp, Homo sapiens
aaacaagagacactgtaagtaagtttggtttactggttaaatgttagaatttctgagacatttctgtggcatatgcgaaaacggttgaatttctataattttaggtttattatttcttatatttctttatattaaatttacatattctacttactcattttacttttcctctcccctccattataatgtataattctgtatgggttattagtaaatattctaccttttcctttaaagagatgaattcatggcttttagaaactgaagtctctttaaaataattattacgtttctgatgtgtgtggttctctgtgttttgggtttataagggatattattgtattgttattcatcttgtgggtttttaccagtctgtcaggagatgattatgttgggttattgatctgtagtcattttctaaatacaattcataggatctcaaatacaaaaccattatttagactcttattctactgatttttcttttgttaaaaaattggaaatatgctttgtacaacttatttttttacttaatatgttgtatttttcatattaatgtataaaaatatttttgacatctgtatagtatcctatcctatgtcagtatcaattttgtcaagggtttgggcttgaaatgggatcttattttaatttgcatttttgattattgaatgcaattaatttttcttatatttatcaaccacttatttatgtatgtcattgtcaattactaattatgacaattagtgttatatatttcaatgatgtttatgtcaattgctaatatttgtattgggagttcagtgttttcttcaattttggtgagaatttaaaaaaaaatttttttgcagtataatttccagaaaaatttaaacctacagaaaacttgagagaatggcatattgaacacccttataccttttacctacgttaatcagttgctaacattttattacttttgtgctctttagtgcacaccttacctacctctgacacacagacctgtaattattttgctgaaccatttgtaaataaattgcagacctcacagtattctccacctgatcagccaatactaacaacattttcctttataaccacaacatcattatcacacttaaggcaattaaaattaatcctcatactcccttacaggtatccctgctgttaaggattcagagggccactcactctttcttgctattggagttctgactgatagagactacattaaaacatattagctaaatgaggagtgaaaagttgtcttattatctcagaaaatactctttagcctctagtgtatagaacttctaatatactagatggataatacagctcagaagtgcagttaaaccccgtctgcatgttcaggtatgtgtacatacataggagttggggcaggaaggaagacccgatttgccaaccctatctcaagtctagcagcttagcaatatgaatccagacctgcttgggtatgattaccacatggcagtgggaagccatgctggtcacacttgggcataggaggtgaaagtgtgagctcattattatcaccttttctttaacacagtgacccttaaaatgtggcttaatctattccagtctcttaatgattacatgaatttcccttaccgtcttggagaaaattgagtaagaggatggggtgcaaagtcaactctgtgtctctggtgcttctctgagtggagagaggaggtcgggtggaagtctcattctccccagagagcagaggcagcagcaggagaagaagggagaaacttgcaccttaatacgtgcctgcctgtggtgactacagtccacatcccttccttggtacttggcctcttcatctcctgtctcattagtatatctgagataagagttgatttttttagaaaacatctttagatgtatatagtatacataattacatataattcacatactatatgattcactaatttaaagtatactattcaatgatttttgcagattacattacttatttttattaattttaataatacatatagcataaaatttgccattttaattatttttaggtatataattcagtgtcatgaattacattcctcatggtgtgcagtcattaccactatctatttctaaaacttatttatcaccccaaacggaagctgctactattaaataataactccccatttccctctttacctatcccctcttttttttagacagggtcttgctctgtcgcccaggccggagtgcagtgtcgtaattttggctcactgcaacctctgcctccagggttcaagcgattctcctgccttagcctactgagtagctgggactacaggtgtgtgccaccacacctgactaatttttgtatttttagtagagacagggtttcaccatattggttaggcaggtcttgaactcctgaccttgtgatccgcccacggctgagtgaacagataaaaactttactatttttatccctccctctcccctcttaaactctaatctactttatgtctgctatgaatttgcctattccagataccccatttaagtagacttatatagtatttatccttttgcgtctggcatatttcacttaacataatgttttcaaggtgtgtctatgctggagcatgtgtcagcctttcttttttatgactgaataatcacatcctattgtgtgcatatactacattttgcttgtccattcatcttgtccaaatggacctgttggtggacatttgcatcgtttctaccttttggctattgtcaatgatgctgtggcgaacattggtatataagtatctttgggtctctgcttttagttctttttggtgtatatctaaggagtgaaattactggttccatagggtcattctaagtttagcttggtgaggaaccaccagatgtttccactatggctgctccattttacattcccaccagaaatatatgaaagttctaattcctccacatcctccccagctcttatttccctctcctttaaaaaaattatacccattgtagtagatataaagtagtctcttattgtggtttaagaattgattttttaaaatactagaaatctgtgggatgaaagtaaaattgattgaatttatatcatcctagaagtaactttttttggcaaggataccccagggagtgtcataaaattaaaaattaaaggtgtctgagagtaaggggagaagcacagttacttctgatgtgcttgatgctaaagctccttgatttgcattgttttatggttgtgttgaaggatgatttctcagaacagtggtatttaaagcagctcttctaagttctaggaaggattcagtcatcctctctcaccagcttattttttagtatatttaatagtgctgagaaataaccagtaaatattagatattctttacccttatttttgagaaagaagagtgttttcactctctacagaagaaatatccttatctcttcactaatgatagtagaaataataggcatttcaaaataacagttacttaaacacataagggctcattctttcctgtgaataaatatagatatatggagtcttgggctactgtgatttccccataaagtcatcaaggacactagcttttttgatgttttttagtcctgagttctattttcaagatcacctcatggtccaagatggcggttgaagtttccattatcaagtccacagtccatgtagcaggaagaaggaagtgggtgtggtgcatacaaaggatgtgcctcacattggagtgagccttctttaaacaatcttcttagaagatctacgtcatacttgtgcttgtatattattgaccagcagctaggtttataatcaaactgaggtgaaggggaatcggggcagtgtaggcttttatctgggtgtcttcctatccaaatattggggttttcttactaaataaaaagggagaattgatatggggtgggtaaaaagacactcaaaatcataatttctcagcaatttacattgaccagtatcacagacaccaatttatagtccaatgatagtcacaaggtaaagggagaaggtggtgatcatgagggagatagtatataatctgagcaatgtaactcacaagtttcattattcattaatacattcattcattcacttattccttacatatatattagtaaagcatctgtgaggcattctctccctaatccagtaattgataggtacacatgtatttgactattcaaacccgtataagagccaaataatccttagttcaaagttttgctctgccacttttaagataaatccgaactcagttaaatagcttgtggatggggtgaggaagagggaccatttagaaacctagtaaacctgtggttcgatgacctttttctccacctcctccctggcttgggatttgattttggctacctgtggagagagtcatccactgaggggtctcagagacattgtgggggtgaagaaatgggtaggtgcccaggagatttcaggccagcccaacctgagttcagaggcttaaagtccagggagggcgagagaggatgaagcatgctgggtcagtcgggctggaggcagtgggggagtcggagggagtaggaggaagtaggaggtgctaacatcatgagaagcatgagttaaggcacaggttctcagggactgtgccttgcacttgtactcacttgttacatcactgactgtccctctctgctacattgaggcaaagtctgaggaaggttgaggttgcttctttctcttttcattagtaaagcaaatctggatagaaaagggtgagaagccccatctttgtcctttggaggaaagggtaaaactgtgtgacctcgacgattatgatgtgcactcttcactgagaaccactagtctgaatctgttccatttctataaagctttttccccagttctctgctgtgtacgtctagatgtggattttatgtggctgaaagatgatctctagcatgactgtcattttccaactgagcagcagtatagcttttcctttactgaacaattttctctgagaccttgaatcacttttggaatttaatttcatttgctttttcaatatgataaagtagaactctctctgaatttgattcctcacttacaaatagatatgatactatattctctgttgaaaatgttttggaactgtgaagatgctagagagttagatctcgtgtttcagggaacagaactgaaactcagaagggtttcattctgagggtgaagccagtgtgtggaataagagttaaattttaaggggtacattcctggatcatgccttgttcaggagtctttttcctgacccaagaaggcctccctcaggatacagtgggcatctcagtctttgtgaactcttaaattcatttcttacccagggtggctaactctgtcagtggactattttgtgaacttcatactttcggaatatgttatacttatgtgattcttggtagtctcaagaaccttggtagaggttcaaatcagtcaatctggttaaaggtatcagtattcagtcttggaatcaagtggcactagagctcttaaggcttggcggttttcaggacctacatcacaagatacagaagtggtgtggcttggagctcgtaagactcgtgtctggtccaaccaggtaacttggggcccctggcacccatatcagacttttctcatctgcaaaatgtgctgcttggagtgggtgatttatttagtacttcccaggcccaaagttctgagtctgtaagatgtagtggggttgaccagcatctccttttggattctcctttaaaactcattcctttgaaaggagattgctaaagtcaaaccttagaatccaaccctttgggctatgatttaatgttaaaatgctgtaccctttcctttcctcctttttctcctttactacttctattttgtttctttttcgaaaaaatataccttcttttaaaatttttcttcatttttccttcttctctgtaaattatcaagggcctttgaagagaattcttacatgttattaagaaattgcagtcagggagccctctgttcccagatcatttagaagattgcttttccttttgttaaatacaaaaaattgtcaacctgtattgttaaaatgtgccaaaaactgcattcaccaataaaaaatgtcagctctcattattgcccagatattattcttttcaaaagcggagcactcttgccaggctttctaaacaatcttcagctcattcatcttcctggttttgttacattttgaacctctctgggtctatataaggtggcagcctgtcttttaaaaattaatggattccaaatgccattcaaacctatttccgcccttaacctcctcctcttctccccaaccctgcctgttaggagtcttatgttctgtataaatattgagctggagatagtttctaaagaggtgtttggacctttaattaacattgacagcctgtctgcttaggattttgctctgctgtctccatggaaaagtcaggtaggtcagtatgtgggggagggacctctgcagtggatgtgttcctggcggctggccctagagacactgcactctgagccaaccgtgaagtcattttgaatttaaggagtcttgctaatccaaggcaatgtgtcttaatttgacaaagtaaaggctgcccgataagcaagcctcactacaagttctgtgaaacagggggtgtttgtaagtttagattgtgctagagaaatgtggtgatgtggaagaacgggctcattttctcctgtttactccctttcccaccccatccccctcctctctcccttctctcttacttactttggcccaaatcagccctgcagtctggcctctgcagtggcttgatgtgaaatttgagaaacatatgtagttttctatttcaggaaaatgatctcagggattgaatgtgtttttttgttggctgttaagctctgatcttgcccagtgtggttttttgatgatgggaaagaggcttcgaagtgctttttatcagaatttcatgtaataaaacttaaggtttggtttctttattttggcccccaaccccctcccaggctcaggacacaatgtcgtctattctgtcagaagtgggaagaagtacacattgttcatattacaatcacttctttgctgcttgcacacacatatataagaatggccactgtgtctatccttcacaaaagctattttaaatgtagttcagtggaggaccaaaggtctgcgtagtgtctcttacaaaggaaaagggatctgttgggggaaaagtctgcctttgttttgccttggaagggccagtatttttctttgttctagaggtgagtgccaataatgggcctagtgccctatcaagcaaacttcattaatccagccctgcaaagggtacactgatcagataaaagggacctacatcctcaaagctcaaggtatttgtttttaaacttttttcttactgtaaataaatatcactattgtacttaatctcatattcataattgtattccttttcttaaagagcctttacataaaagcttcaggccctacaaaatccgagagcatccttcatggaggaaggatagtagactcgagggtgagtggttgaactttggctctggtgtaaaatgcccaccctgggacttattgtgtgaccttgagcacgttacataccatttctgcacttcattgtcttatttatatttcatgggcttgttgcgggattgaacaggttcaagtgtataaagctcatagtacaacctgctaaggactcaacattagctattcctgctgctgtttttattatttgttgctggcgtataagacctaggcaaatggagctaaatactattgtctaccattaaaatattcaccttctggagggaatagtgcaagggtaacttcagatttgcattgaaaaacccatggactatcactttacatatttatttccttaccatcttcaacccttatccagacagctccaaatgcacattattcagaaaattggtgatattttcacagcactgagactaagctcatctcctgctggtccttatcactcaccagcctttcagccacatcagacatctcctcaatctctgggcaaaccaggccttttcatgtcttcttgactttgcacgtactgtttcctccccgcagagtatcatttgcccttttttctgcttgtcaactgctattcacccttcgagacccaacttaaatattatttgtgaattttgggcagttacacagactcttttgggcagttacacactactgtttcatttttcctatagttcttcaagaacttctctcattgtagtgtaattatttcttgacatacatttttcttctaacagcctaggaggtctttggatgaagatactacagtctattcacttttataaccccggtacagagtgcatgacacgtgttaggtgttgagaaatctgagaaatcgactgggaagagttttttttcataccattatattttaaaagctgcaatagtttgttccagaaaagttatatttttcccttggtgtatattctaatttaaaaggtgtttttaatgcctgattgatctccaatctgtaatgactttgtagcattttctttgtttccctgcattcagccttctgatttaagcagataatgcttggaaacacctgtttaagttgtatcttctttgctagttgtaacttcatgagtacagggaccatatatgttctgttcacagctctatccccaagtcctaatacagtggttggcagttctagaggtagaagaaattataataataatagtgcttgtattttatgcttaacagagcacttaacatgctggccactattgtgagtattttagatacattaaccccttcagtcctcccaatattcttatgttatatgtattataattatcatctgttttctacagataaagaaacagactcaaaagaggctaaggaacttgccggtggtcacacaatgattggcagagttgggattttaacctgggcagtctggctccagaattcaggctgtttgccataatggttccttgcctctgattagtactaattagcttagtacttgtttgttaactaattattaaaggaatccaacagagacctatttctctaatgtaaagagttcattcattaggcaaataatcaccctaagccagttgttctggaagtatggccttcagaccagcagcatgagcagcgtcacttggaaatacattggaaatgcaaattctgtggcctcactcccaccctactcaatcagaaactcttgggagtgggaccaaataatttgtgttttaaaaaaatcctccagaagaatctgatggatgctaaagtttgagaaccactggccaagactcagccattttctctggaattttacccctgatttttgcttttcttaagaagtcataattttgggtgtctcacttttgcatactcctgatttttgtgacattaatgtggggactaagctctaacctcagtgaatgtttttgctaaagtttctgagaaattttgaaggtttcaggtgtgtctgtagcttgacagtgtttgtttcttttgatttttttttcctgtgatagcttttaggatcaggaaatttaaaaaatatagtacctcctccattcagccctgctgtctcagactcccctaactggtgagtgaagaaggagcccagaggtgcagggataacagagaaaggggaagtagcagaatcagtgagtggggaatcaaagtttgatgttatcgcacttcctagaagtggcctcaggtcctttggactgttggtttacaaatggtagaaaaaagggacactggacttcaaactggacttggaatcccagttcagtctctctatctatgtgattctaggaaagtaatttttctgagcaacagttccctcatctttaaaatggggataatattactaatgttttaatgatgtgagaatttatggagatgcatgatgagcactcaattcatgcttgttgtatctatactgaaggaagctgtaagagatagagttagtcactagcatatttaccagtgagtgttctaagaaatggattatagattttgcagagcaacaaggaatccacagcattccacaatggctggtattccaaggatcgaaattctgggaggttcagttgcagagaaaactaggcaccagtttgaatgcattatgtcttgagtctgctttttttttttttttaaaagaaaggtatctaaaagtgatttaacaatgtcaggatttagacttaagtttttttctgttaaagaggccattgctgaaagtcaagacccaaggactgtacaaatattgatgcaactgtcagagatacatggtatttgaccttctattaataaagacaaattattgcatttctgtgatatttgagtctgcaggaacttcccttaattccactggtattccattccacggctaccagggctgctgggacaagggacgtggcgttgtgtttctgatttacgaggtggaatattagtctgatttactaaactgaaagagcaggttcagataacaaacaacatagtgaaacttcctgaataacagccacagaaacaactcatgtatttggtggtatcacaacaagtttggctagatttatccacagactagaatacaaaccatggaggaaagaaagcaggtaagcacaagtaaatagagggcaaggcagatactagtggactatactggatgtaggaagactttgaggaaggcttttttttgcagacatctgcagggtgtaggcagtgaagtgtttgttgtgactatttgccagcaccatcccacttcacaggtgggtgggtggttccttttcaccaagattttaatggcaggttgtgccccataaaagggcggggcagtataccctgtattagtttaaaaaaggtctcagcttacacgggacagcatttttactttttacccttgcctttgctcattcacagggagtacttcggaatcagcccatctaagcctcagacttcaaagggagctcattcctatttgacaacagtcatatccattttgccaactctttgacctttgaaatagcatctactcagtcaggtctgacctgtcaactgtctgtaaaaacccatccagatcaagaacttgatattttcaagaacacatctaaaggatgggggcccttctaattttgtttctccaggacttgttttgggagaagccagctgcttcttctggtcttaatgggatgggattatagatgggttgagtctgtgaggcctcaacttacatgatgatcctgtgtccttttattataggttgcacatgttttagccactcatggcagcatttttctccagctacagtcaattttgtctaattattgttgatcatgattttactgtaaaaaaaaatttttttttttgagacatggtttcactcagtcagtctggattgtgcagtggcacagtctcagtgcactgcaacctctgcttcccaggctcaatcgattttcctgcctcagtctcctgagtagctgggactacaggtgcacgccaccacgcctggctaatttttgtatttttagtagagatggtgtttcaccatattggccaggctggtcttgaactcctaacctcaaatgatccacctgcctcagccttccaaagttctggtattacaggcatgagccaccatgcccaggttgtaaaagtatttttaaaaagtgttttcagaggccatttgccatgggaaaatgggatatgttgaccttcctgtttacctccatttgtgggcttttggttgtgagcatcagttcatatccagttttggggaccactcttgggtatactttaaataattcagatgttgaaatttttcagaatgagaaaatctagagagaagtccagtttgattatactagaacctcatttgctgattaaattgtaaaattcctaattgcaacttggtcatgtctttgcaaaatagtaataataatattaacttctatttatatagtgactgtcttctcaaagaactcaaaacagtgtccttttctgtatccctgctattcccaaaacatgtttgtggcaatgtatgtggcttcaaaatgtggatgtatcattatgaaatataaatgcatgtggtgatggtatttattagaatcatatgttattggaagtacctaacattgggtgtaaaggaagcctggtcaagtttccaatagagatttacaattgggcctctttgtatctcagtttcttcatctgtatagtgggcataatagttcctattttatagagttattgtgatgattgtgttaatacatttaaagcattgacacagtaatgctgggatagtcctcaaatgctattgtttgcatcggttttagaatcagtctaataaatatgagtttaaatacccctttgtcccttgcttgttgtgtcgtcttgggcaataacagtaacagtcaacacagatgctatttattgaataatacttatatgtcaggcattatattaggcccaggatataagtgattatttatcacttattcctttaactttcttaaataggtatgattatactcattttatagatgagttaggtaaggtttagagaagttaagaaactttcccatagtaacagagttagattactggcaaagcggactctctgaattcttgtttttggttacctacttaggttcccctgaaccacagtttcatcatttgtaatagggatgacaatagctctttgtaaggattaaatattgtacataaagtatctagcacttactgtgcattcttgacatgatatacaatgatattatcctctccaattagagctttccatataatataatttttttctttgtgttccttatgccatgcatatatctttagagattaaaagacacttcttaagaatggattcttgcatttctgagaacttcagaatcacacttgtgatctgacacagtatatatacactcaggtattgatgtgtgtatgtgtactttccattctgttcagtctagaagtgtatagatgctcaatctgggtgctttgtaaggaacatcacaaatgttcaaaatcgtggatggacttgaacatgaaaatgccttggcctcaaagttttgcttttctgttctcaaagttgttgaggaaactggcttagttaaagctaagtgtttagaaaccaagtgtgttttggatggtaaggtggagtcagcattatatatattaatacatttttggtaccagaaacagcaacaatcccttagtctggtgtgtgcagatgtaatatgtttcatgatatttcagcctgtattttctgtcttaataagtgaaagcactgcagaattgggctgcaggccactgccccatttctctccttttgtagtcagatctcccttgtgaatgataaacacccactcctttcatttattcacccattcactcaacctcctacaatctaagctgcatgcttaccacctaccttaaagaacaccagtgattgcttattgtgacttacgtcataaatatgtattctagacatgacttctcacctgaatatcagtgtcacatccttcatagcctcaaaactttgaggaaatatcctcttatggcatactttaaaatttgtaattttaaagtaagcacaaagtacgttttgagaccttcatttttttctctaacaattctgttttgttttttttttttgtattctgtattttttgttaagtttatatcaggatgatttgtcattagtgttcttgtaacatattttggagttttccttgtgcaatgtggaaatagtaaggttgacattctgcttttaactcttctttataaactatgaggaattcccaaatagaatgttaccttgaaagactcttgacataagtagaactaaaccaaatattttatataattatttttattttttatttttgagatagggtcttgctctgtcacccaggctcaagtgcagtggcgtgatcatggctcactgcagccttgacctcccaggctcgagcaatctgccctcctcagcctctcagagtgcttgggattaaaggcatgagccaccatgcttggcctctgtaattcttaattattattttatatatgttatgagtatgagaactaagcagttccataaagatgagaattataatatctcattttagtagtattttgctttgtattatttgacattttataaaaattcatagtctcaaaaaatatacaatgttcttcgtcaagtagctaatactctctttcttagtgttcggtttaactattaatcttatcctgttaaattatttaaaatttcctaataattggcacataataacagtttttaatgtcagcattgataacatttttctgtcataatattcaactaagggatgcatcttcaatgtataaagcccataagtaggttttttcaccctagattagatctaaattgcttacctgtttttggaagtgaatattatgttattaacaataaattccaaactgctttgtattactgacattgtaacaatgtcttgatatgatggagacccttgctatcacattgtcattgatcatgcacattgatcatgcccgtgttgaaataggcaatgccagagacagaccaaagacgaaactggtagtgattttggtgaacattgttgccatgttaaacttgagtatatttcttgttgaacaaccccattttagagatacggaaaatgttgtgaggcagagatattaagtaaccctgcccagagtcgaatggttaataagtccttgccaggatttaagtgataaaacaaaactcatgcttttaactactatagtcttgtaagccactcaacaagtattggccagttaaactaatgaattccctcaaggaattgattctagtaatagagataaataatcaagtcataagtcatgactcaatgtgaaaagtcttgtgactaaggaatgaacagtacaataaaggaaacatgaggaacagtgaatcgtggtaggattatggagaggaggaggaaggaatgggggagagtggggcctcagagaggtgcaccaagactggggcccaggccttgcttccaaggtaccatggcgttctgtgtttttccttgtcttgggcatactattcagtgtttcgatttatttacttgtccttacctcccactaggctataagctttctgactgcagaggtaaattgtgtgtcttcatcacttagtgcaggaagtggtagctaatgagttggatatgtaggggcgagtacagtggacaggtgaagtcaggacatgatggacaaaagcatgaacatgaaagaagatgtgaacattcgttgcctctttaggaaatggtcgacagtgtggagtggacagagcacggacatgtagcttggggtattgtgaagggatgggtcagccgtgtatacttatctaccatggtaaaaagtgatattattagatttctgagtgcttgcctttccctaatgcatcttcatgtctttaaggacaaagatgtaggaccaagagtgggctacatcacaggagatgaaaagatctgtttgcatatttgacctctgctaattatcagcagtgtgatagtaggcgtgtcatctgacatcatcttgcctgttgcatagtagacatttggtaaagatttgttgaatggattaattaatataattatatgtttttgcggactctgaagaatttgagatacagctatataaaagagttactatttattggtacatattgcttagtatttggaataagcttggtaattattcactaagcaggaaacagggtttagggatttccaggcattagggacactgagccttgagacagggtagcagctctgtggttcagagtgactggtccaccaggaacagaaacaagctagtattgggaggtgagggagtaacattccttgggaggattatttggcaaaacgaagtaagaatcataggggcatagggtcatggaaaaggcttcattcttagtagagctctggagtacccatcaagtctgggtgaagatgcttacctccctgagagggcaagcatcaggaaagcctgggtatgggggtcccgggctcctgaggcccaggactcattgctaggatacagattgcactgtcaagtccagactgtcacgtgtgagtctaagcctattgttttggggcttgccatggtctggatggggcccctcttaaaggttatagagttgtggaagaaagggactgacacattttgatagtcaaagagtaaaagaagctatgagttaccagtgtgctggatgcttctgaaagcgtttgacaagtgctttttgagtttttaaattaaattacttttttatttttgtcttcctctctataaatcataccagagaaggtaacatttttctctatactgactttgacaagcctagactatgctttgtctatgtccagtgtacaaatgtagagaacccattcatttctttactcctcacatatttagtaaagtccggctgtgtgccctgcctttaggggacactgagcagaaagcagactcctccagacgattgcattgcagtataattagcaccataacaagagtctggcagattctagtctgtagtagcaaaatgaagagcaatcaggtctatccagggaatgaggaaatacctcacaagataggaagtgactgaactcggacttgaaggatgatcaagaatctgccaggtgggtatgggggccacctggcaaaaggacagcatatgggaaagcagaggcatgaaagaccttggtgcatccacaaagcgttgggcacgtgagtctagccagatcacaggttgtgtgttggggagcatttagagaagagaacacaaagtcctcacgtgctttactcaggctttgggcttaaggagtgtttctgatgtgggctctggagccagactgcatggctgtaagccccggcctctctgcttcacacctctgtgatcttggacaagtaccttaactttctgtttctcagtttcctcatctcagatgataataggacatgcctcacagggtggttgtgagaacctgaataacatcgtaaagcacttcaaacagtgtctggcacatcagttgttattaataataattatataagataaaattatataattcataatgatgatgtttaatttgtaacctgtagtcaaaaagtagaaccaaatacaacttgcaagggaactggatgcttctggaagagtttgataagtgttgtttgagtttataaagtaaattaccttttttactttccaggtaaaaaaatatacctttgggaggggaacaacacacactggagcctgtcggggggcggggccacaggagggagagcatcaggataaatagctaatgcatgtggtgcttaatacctcagtgatgggttgatggatgcagcaatccaccacgcacacatttccctgtgtaacaaacctgcacggcatgcacatgtatcccggaacttaagaaaaaaaaatacattttttctttccaggacagcgtcagtccttaagaggctagctcaaagactagaggaaaaatagactactaaataaatcaaaattatttagtagggtatagagttatccataaagtgctgggggtcactaattattaaagcagatagagcacaggtagttgttgagcgtagaacagcccaatcagaatgatgcctcagaaaggcagtagttggcctcccagagtggagcatggattgcagcagggggctgaggctggagggggagaagtgttgaactaattcaagggatgttggagggctaaaccagtgtctcttctgctaaatctgagcagaagagacagatctggaagcttctggtaaggtaggcttgattgagtttggtgagaagttagatgaggagggtgagaacctagcatctgggtgtctgctagatagatgctgctgcaccacaccaatgtccgtgtgtctgggtaccgaggtggtgttcaggacaggtcttctccacgtactgccgctgagctcacatccacgctgtgcatgctgggctgagttctcttcaggctgttttcagctgacttaaatgcaacacgtgatgatgagcatatttacataatgtatgcctggtgaaatcacgaaagattggaatttcccattttaattccattttaaagatgcttgttaagcaaaaggatataattcatttttcaaactgctgaaatgttatttggcctcttgaatcaaaggcattccgcaagtgttttctttattacatgccttaaactttaattagaatttaattataagatcctgaaggcatgagcaagaggagcagatgggatagtaaaagcagcttagtgagggaggattaaagattaaaagttgcttgttaatggcataagaaatgaacagagagctaaattactatgcttttgtgctatcctgatgctttttcgattctgtaacttattcctggttgcaggtttttcaattctgcaacttattcctggttggaagttgaagaatctcacaaattagatttttaattttttgagttgctagagtagatttgtacatagaaaacaggtaaaacctgacaaaaaggtgttttatggctagtagcaccttgtacaataatttctgcattgtaggggcttagtggtatttactgaattgaactaaaacttacatcatctcactagtaaacatcgaatgagcataaaataagatttttttttagagatggatggggaaggtgtgagtctataagtccaggctaacctgtcccatggaatgttagatacctactcaggaaggtaacttgtatgaacctcccacctttagcctaccccccagtcgaccttagtcatttgccccacttggttggttggctagaggagtggtagaaatttggtgtgggaaacactttgagactgctcctcatgtcacacagtgaggatgacctgctctgctctctggtgctatgttacgatgatctcccgttaggctaaattattctacttcttagtgctttttcccctagcttttttttttttctttttgaaatctgatatttagagtcctcttccccacttaattgcaagctcaatgaagaaaaactagagaacaataagatagaaaagaagacaaaaatgtagtgaaacaaaaagcattctatctcctattttccaggaacaaatgttttttaaaaagcttttttaagcctgttaatagacagttgattcttcattatttgcagattctttgtttgcaaatttgcctacttactaaatcttatttgtaaccctcaaatcaatacttgtggcactttcacagtcattcgcagaaatgctcagagaggaggataatttctgagtctctcgtcatgcgtgttcctagccgatggcaaataacacaacaccctgccttcttgtttcagctctcatagtgtaaacaagtgtccttttcgaagtctactcgtgccatgtttttctcatttttgtgctttttgttggcgatttcaccatttaaaatgcaccccaagcattgtgcaaaagtactgtgtagtgttcaagtacagtgcaagaaagctgcgatgtgccttacagagacaataacgtgtgtttgataagcttcattcaggcaggagttaagtgctgttggctgtaagttcagtgttattgactcaacaatatatattaaatgagttgtttttaagcaagaatacacatgaaacagggttgcgtattgatgagttggcaaaaatataactggaggctcagaggaacctagccctgtatttcccttaggaacaatggtccagtgttccctaatttaatgtttttggagactaccaaaaataataaggtcagccatgtatctttctccttttctccttgctcttgcttgatctttccatctcttgttacctcaatctgtgtgtatatgatatgcatatatttacttaaattatatatgcatatatttagcaattatgatatcacatgatacacgattctgcaacctgtcttttaacttatcaattgtgttggcctttgggctgtttgcactgagatccatttgtcacccttgccctgctctgcaagggtgctgtgttacagggggttgacccctgccccctgacaatttgtcatcagtgggagatggcaaggcaagagaaagagaagctggagtatttgtccctccctctgtctgccttgggcagcatctctggcagtggcccctctacagctatcccacctgcaggttgggtcctccatggctctgtcatcggctggttggtcctgggtctcgagctttagccctgccttcttcctttgtccttttagctgatgggtggaagaagcttcctgctgatgctgatctctgagtttcttccctgtcccctgggtagagcatcagatttaaaagccaaggcaagacaaaaaatgagagaatggtagcaaagatccaacactttacaagaccgcctgagaaaagggaggagggggtggttcgacaccagggcctgcacactgagtgtgtgatgttgcagctctgcaggcacagattaagcagctaagatgccatcaatgcttggaaagcagccggtgcctcttgtcctgagcttatttgtctggaatatgattcccttgaacctgactagctcatccacggggagagagaaaaaaaaatattctgatagttatcctgaccaggctctaacagggcctccttccctaggatataattttttctggcctctttccattcacttcttcacattaggacccttttcccccagagtgtgagattccctgagggctctaaaaactggaatgctatacagcattttaagccccctgtgttggcacagtccttattaaaaatgtattttcctcaagccatggctgcaccccctgaagtgtggattaacagaaaggccttcagagctggaagacatttttgaagaaccgctgtaccaagtggcattaaatatttattgcctactacatgtaaattgttcatcatcttgttttaactcttggaccaaaaggtttctcatctgctttctgctaaagtggaaatcacaggaaaggtactctttactttgctgtggtattttgttttcccaggaatacggaatatttctttgttctcataagtaatactagaaaagattgccttgactctcagcatttcattgggaggccatgtggtgtcatgatggagaaaaactcgaattctggggcaagtgcattgggctttgccacctgcaagctgtgttggcttgagaacctgataccatttatgtttgttgtgctggaaaaatgggacattgcataaatagcagatagcacaattcctggcacccagtaagttctctctttctcctaggtcttctatttgggactttgcaaatacatttctaagcaacctagaataaaatatgctattaatatgctgttaataataaccaaaagcactcagcttaatctttacttattaaataaaactgaaatgttgctcagacaccttttgctgtttttggaatgcctttgtagacacttttgatcttgcttaaaaaacataacagcatttcaaaggcttatcttagctattcttattcatacctgaaaacctacagagtttggataattttggcacacatatgtgtgcacgcatgtatatgtataaatattctgtctctctaaatatatatgtatatgcaggcacatgtataactctttaagaaatgtttttctaatgtttaattttcttaaagtctgtacttcacatcatttttttccccagaactgtttatcctcactccagacatgacccttggaaaggtggcagaaaaaacaaacggctggtgtgttttggggcagtctgcattccttttaactctctgagaccaggcttatgcatgggctttcaagctatttgtccagaggcccaaccactttgatttctgcttgaaaattagcctgttgttcaagctcaggagagcttccacagagctttcttgggttcgcgaactagagatctatgaagtgtttgcttttatttgtaactttaaccacggcagccttaactggacttttgttttcttatttaacttttatccatgtaaccttaacctaagttctttttcaaatctccatcctcccccatctcacaatttctaatccctcttttgtccttagatttttccttcaaagtcaggatatgacatttatatctatgctttaggaagtatctgaaagctaacatacacatagaattatgatttttttcttgggttgcttaggaggattaaacaaaggttttagaaggcagaattcagaaaaaaattgatagaagttgtgctgcagcttggaggggagtgtggattttagaaagcataaggacactttcatttgtccctttcatatggacttttatttcctctgcgagaggcccaggggcctggcctgtggatggtttagacaggaaaagactgaagggataactgcttccagaccttcagccttgaatgttcagccattattcaagccgttgagaaagggagcaagaggcataaggaggcttcgggagtttccatgcagcttctctgagttccagcttgtgtgcattgttctccaaatgtgtccccagcactactgaaaggactttcatacctcaactaacccttattgcaagcctgtgaaggaagagttttttatatatatatatatatatatatataaacagacaaggcaactaaagctctgggaggttacagaaacttaaggcctaagtagggttacattgagaccagattaatcagttagtagattgtctttctatttcatcatgtgcttcatttcctccttggtttacatgacccttctttggaaatttccttctggtaatatcttagttaaatgaaataactaagttttatggagtatccattatgtgttaggcattgttttatgcaatatgcatctatgtagtgcacattctgataggaaccatgtgaagaaggtgtattacctccattttagacaggaaatccctgcaatacagagggttaggtaatttgctcaagatcacacaggacacagtaggtgacaccaggatttgagcccaggtctgattccagaacttatgccatgcccactacaccagccgtccttattaagaggaaggccattggtatgaggccacttgaaatagacatggtagatatgtggcaatcaatgcaaaggtattgtctttcatgctctgttgcaatctcatttcatttctagcattataggtatttaaagcagaggtaggcttgctttcttagtttcagttttctgagaaacaaagatagtaacaacaatgatgatggatcttgttaccatatgtgaatatctgtgtgtactaggcacggtacttggtctttacacatgttcttctaggttaaccttatgacaactctgtgaagttttctcaaatttatatctgagaaagcactcagaaaggttgagtcacttgcttgcccacatcacactactagtaagtggaggagtgaggatttgaacctaagacctcttacaataaaattatgttctttccactcagtatatgggacatgtatccctgggggcacatgtgagaactataattggtctgtaagattattgatgatggtatagggatagggtgttaaagaacattgatgcccatagtgaaaaagtaattccctttcacttgtcctaccaaccatctggttacatgaaagaggaagtctcagttaggtgccagtatgccttttacaattctaacagagaacagggctcagactctgaggctcgggcaggtaattgaatctagaagaccatggtgacgttctttttgtttttattgtattttaatatcttctcattaaaaaatattataatgtgttcatatatacaaaataaatgtaatgtatatataaggttaaaagaataatataatgagtatccatgtacctatcacctattgaagcattagattaattttagttactatgggaaccttctgtgtcactcttcccatcccaacttctttctttctctcctaccaacatcttacataatcactgtataactatcaaaatcagccagttaacattcacataatactattactcagtctacagactttttgctagttttgccagttgtcatactgtttcatttcctggaccagaatctaggatcacacaatacatttactagtcatatctcctttgtctttggaatagttcctcactctttttgtctttcatgaccatgacgtttttggagtctggttaggcattttgtagaatgtccctcactttgggttggtctgatgtttccacaatattaaattcaaattatgtgtttttggcagggaagctacagaaatgatgttgtgcctttcacagtgcatcacagcaggaggcacatgatgccgatttatcgtatcacaggtgatgtgaactttggccaatttgttaaggttgtgtcttccagtttatccactgtaaagttactatttttccatttgtaattaatgattaccttgtagggagatactttgagattatgtataatatcatgcttcttatacctttgtccactaattttagcaactattgtaaattcttgcctgaaacaattattcctgtggtttttccatatggtgtttttctatgattataattctttctatatttattaactggaatgctttgtaggtggctttatcctcgccacacacttatttattcattcagttgtttatttgtatcagtatgtacttacaaattcttattttattgtctggattataatccattagtatcattattttgttttgcaaatagtccttttaaccaatggggatcccttcaaattagcttttctatctttctgacatgtctccatcttttttaaggcatttttgctttctggtgccagaagataccactttgtgctttacttgctccaaccctgagagaagcctcctcttgctgttctgcatccattcctctcagtcactccttcatgcactataatatgatttccactctccccagtgcactgacacttccgtcacttaggtcattgctaaagcagtagatattttaattcttctattactgcatatcagacatctcttggccccatatcagatcttctcaggaggacagtaaagggaaattgtaccatctcttgttccagctgccgtgaccaagtttgcatagactctgaaaaacttcctacagtataagctgacagtacctcacctcatgctgcatgcttttccatagggcaccccacgaggttccatggggtttccttgtggttgctacctctggatctcactctgttcccacacatgtacaacctggatagagaattaatgcctcctttctctctatcgtggatggttctgagatacagttcatgtggcttggggtgtggagaggttgaggatgatcctatgggatagagaacgagtcacttctagtggggccatcttgataccacaacttcatcttgcctccccctccttattatttgttttattccctttgtctatcagtcctctccttctccctaagattgcactacctgatgcagtagaaccctcttccttgggtctgctgtctcggggacccaggaaaagatgtgcagtgtttaaactccttctctataatctcttaactttcacactatcacattttcattcatttattccaattcattcattcatttacaccttatttattgagactttccctgtgtgagacattgtgtacaggtagacaaaaatcttgatcttatagaagttattgtatttgggggagcagaaataactaaataaaaccaattcagctgaattataagtgcttttaagaaaatgcaacagggagagggcagagagtgggccacgtggggcctggcattgggatggttaccacatacactctgaggaaatgacatttgaactgataaggggtcagcaagaagaaatgggctgagagaagactgatctattcacaggaaagaggaagtgcaagagccctcattttctgttttgcactagaactgctttcctatgattcttcagattgtgccacctttcttccaactcccatgcatttgcacagattgtttctttgacctggaatgccctctctgacttaccaagctggcagatttctatccttagctcagatctcatctaaagcagctctccacccccagggacattttaagtcctttttctgttgttggtgtgctgtgctttgagcacagtattcatttataatagtgatgtcagtgtacgccttagaattgttcacctgcatctctccttcttggactaggagcactctgagggcaggactatgtttgtttactttgtattcccaacaaagtgcttatagggatttaaatctatttattgatgagttggatggatgaatggatgagtacatgggagaaagaggaaaaatgatatatgaattgaaataaataaatgaaagagccagtgaataaatgacagtgacctgaccttaaggcgttgtcttgtttgtgggtgagacaggagtataaccattcagagtactgtgatgaatgcttagagattctcagtgcatgaataacagtggcagtcagcaagttctgctcatagatgcatattgtttcagctatttcatgcttatttatttagtttttaagaaattcatttaggtaccaaacataaaaaaaaacccagacttgcagctttccagatttggggccagacacatgactgtaatcccagcactttgaggggccgaggtgtgcggattgcttgaggctaggagtttgagagcagcctgggcaacatggcaaaaccccgtctctacaaaaaatacaataattagctgggcgtggtggcacatgcctgtagtcccatctccttgggaggctgaggcatgagaattgcttgaacctgggatgtggaagttgtagcaagccgagattgcaccactgtgctccagcctgggcaatagagtgagatttcatctcaaaaaaacccaaaaaacagatttggcagtgctggacccttctacatggagctggggacaaaaatctgctggaaagtaggaaattattagaataactaactgtattaaaatatgttgaattcttcttgtcatgactgttttgacatttgtttgtactagttaagggaaaatgaaacttcaggttgacagcctttaccttccttgtgccataattaatttgctctattctgtttgttcaggaaattcagcttttgaaggcccagaaagaggactaagggtgcaggtggcaaggaaaggttgatttgtggtgacctggcatactgtattccatctttaagtcctcaccacaagtaggcctttatccaggttcttgttacctggaaatgtgtgttcatttggggtatctagatgaggcaggacttcaaggaaggggatggataatgcacttaatcttcatcttcacataaggatagctgctctttatcttctccctctggaagctgccattgtgaggcagcattaaggtgggagaggaccctctggagttcatccagaaccctctgggggcacctgtgtcccttctgtttgtcagtgtatcagccatggatcctgcgtgaaacaggtggcacatttaaatggggtaatccgagaagagtggacaagtgtagggaaaccacatggatagtgcaagatgcttggctatctaaagtggggctggtactctctctgggcctaaggaacaaggagaggggctacgagcaggccctggggagattgttttgtggaggtacttacctttgtgacctttggtggagagctgcagccatcctacactttctcctagtccactgatatccctctgtgtcctccattagctgaacctggctggaggccagaggcagaagagccctctggtgtgctccacacccatcagcatcctggcttacaaggcagggtggagaaagttagagattgaatttgaagagcacatggaagatgtctgggacatctgggcattctttctgtgtggttggttcttgtggtcagatatttgtggaggagtgaggtggtggtggtagtggctgtgctttagagtcagtgagtctgggacaggatcacatctgccccactcgctaacggagttaccctcagctcaaggtcagcaggcaccgatttctttgccgtctggtggggccaagggcaaatgcctatctcaaaaagctttgggaagatcaaaaatgaaaatacttaagtgtttttttgcagatttggaaaaggctgaaagaagttttattaaaatgtgagcaatatacctcaataaagttgttttcctatataagacaaataaaactgtgttgtgatttcacaacaagtgttgatttttttcttcattatatttttctgtattccagattttctgtcatcagaaaaccagacatccataagtgctatttagaaatatgttagtactgccttcaaattattactgttggctaatattgccttctctgggttactgaggtatgtgaattcacagctgcagcatagctgacttgactatggacagactagagtgaacgtgtatgtcatttcttacgatgtgcccatggattcaggtctagtgccccatccccaggaagcctttggcccttcagatgcttctcctctgagctcctgcagctcctgggctgcccctagcagttatcacactgttttgcggttttctccaccactagactgtggtctcctctaggtccaggactgaattttattcatctccaggtcagtgtctagcattgtcttgtaaatgctgtctttattcatgttgcccagcttctaccacacggctactggaagttctcaagctcataacaccgtagcttctacaacagagagcaactgactgtgctttctcctttctgttttcaaagccctgggaaagaattctgattagtttcatttgggtcaagtgtacctacatcccttattgaaccaactatacccatggagaggtatattacagtgatctcagctttggtcaagtgctcattcccagaggaatctgttgtgtggccaatagggtaggatctgtacaactatgacaggtcttatttaaatcaattagttacagtggagaagagaatgaatcagttaggaatgctttcagctgcagtgacaatgcaaaaaagcttttatttaaatcagttagttgcagtggggaagaagcatgtatcaggaatgcatttgcaagggagcaaaaattggttcttgggggatgaaaaagatcttagatattacaatcatttgtggccttctaaagcccatccttatgtaacagcataagtagatacacaatctgtctgtggtattgaaatttcacagtggcagggaaaaggaaaagactgtctggaaagggtctttagtgggggcgatagtgaaaaaaaagtttgagagtgatttatgatgacaataatcatacctaacttatttagtagttatgcaccaggaactgttatgaatgccttacatatactatattaaatcatttcaccatatatccatttgacagtgaccaaaacacaaatagtcttgatttcccactctcacacccctaaattacaagtacaaagatgatttgaccatgtcaccttcagcatatctttaattctttggacttttccctcatgctagctgcctcatggttgtaggatagttgctgcatctctggacgttacattctcctttgatgctggaagaattggtgagaagagcatgatgagattttttgttttgttttttaaatgagaggagcaaaacctttcccaggaatcttctcttcctactatacttctgcttaggtcttattggctggaattaagtcccatggccactcttagcagcaagaagcagggaaagtggaaaacaagattatcatggttggcttaaacctgcacattccaatatgatagttactagctatatggctatttaaatttttttagagagatataattcatataccctaaaattcaccattttatgtatacagtatagtatttctagtatattcacaggattatgcaaccataccccagtatccgattccaaaacattttcttcgccctcaaaagaaatctcatatccgtagcagtaagtcctcatatccctctacacctagccattggcaaccactagcctactttctttctctatggattttcctggacattttgtttggcttctttcacttggcataattttttcagggttcatctatgttgtagtatgtgccagtaatttttttatcagttcctgttttaattgataatactctgttgcatggatgtatcctattttgtttatccattcatctgttgatggacatttagattgtttcactttttagttactgtgactaatgctgctgtgaacactgattgatgtacaagtttttatatcaacatagttttgatttttctttgaattctcttgagcctattagaaggagtggaattgttgggttttatggtaacaccatgtttaaccctttgaggaaatgtcaaactgttttccaaagtggctacacattttgtacatcctggtaggaacatgtaaggattccaatttctccacatccttgtgagcacttgttattttttgtttgtttttattataaccatcttagtgggtgtgaagtggtatctcattgtggttttggtttgcctttatgtaatgactactaatgttgagaatatttaatgtgcctattttccatttgtatatattctttgcagaaatgtctgttcagatcatatgcccattataaaattggattgtctttttattgttgaattataataggtacttaaatttaaattaattaactttaagtaaaatagaaaacttagttcctcagtcatactggccacatttcaagtgctcagttgctgtgtgtggatagtggctatgttattggacagttgcagataaagataatttacatgattgcagaaacttctgttggacagcactggcttagaaccaccatgattgatcacttatagctgggcatatgacttctctaaataaaattgaggttttgttaagctaaggaaggattggtactccagaaagagtgaggtgtcctggtcccagaaaaggaggttatgcagactcagtgtataactcctaaagatgcatcagagtttaccaagggaagaactggggcaggggttgagtgggagggcaaaattctagaccagggcttggcagatgtcttttgcaaagggtcagatagtaaatattttggctttgctgactatatgatatctgtttcaactattgaactgtaaccaaaaagtgtctgagacagatttcaatcgatttagagaggtttattttgccaaggttgaggaagcacccgagaaaataaacacaagttacgttaggatctgtgactggtgttttgtccaaagaggattgtgaggacttcaggatttaaaagggaaagagtgagcaggaagggaaggaggaaagaaaaaaaaaagtttgaggggcataggcgatgaggcaagtggttacattcttgtgaggctttgattagtgctcaccaaatccacagtttacatgtgaaaagaggagtgggggaaagtcatttatgctcagtaaatctacattttacgtaagataaaggaagcatgtgaagttacagcaacccatttgagaacaaaaggatggcagttttttgattttttctttttttgtgtgtgtgtgtgtgactcagttcccaagcttaacttttctctttaacatagtgagtttggggtccaaagattttattttcctttcacacaactttgtccttatagtgaaaaagcagcctaagacaggccataaatgaatggacatggctgtgttctaatggaactttatttacaaaaactggcagcaggcacatttgggctacaggccagggtttcctagggacaatacatagaaaagtatggaagccagaaggggcctggcatactgaaataaagagaatggtaagacgtttggtatggctgaaaactggctgtaggagctatggctgtagagaaggctaggaatagagactggaaccagattataaagggtccgcaatgcatatcaatgttgttttgttctggttggtggtggtggttgtggtgctagtggcagtggtggttttctaaaatcctctaagtggcaagaagccgtcaaatatttttaagtaggacattatatgattatggctttttagacaaccctctggcagcattgtgaaaagaatattggaggaaatgaggctagaggtaaaaaaataccagttaagctttgtattttgtattaaaataaagatctggtaattatcttgctaattgcatcagtagagacatagaccaccaagctgataattcttatcctgactaacctactcactatgagctgagtaaaaagcagtattgatttaaatgagttatgaagagtggggcttggatatgctctttttatatcccaggggaatcaccctggaaacctagagaactggttccaagtattcatctgagaacatctgtgactctcagaaagttatgagattggagttgtacggggaaactcgctgtggccttggaagagttgacttctaaatggggtagtgaacttattctccgtggctcagttctaaaaggccctaagaggagaaaaggattcttgatgaactactaattgatgattttaggtccagagttaagcataatatggaggtttgcctgagagtgtctgccgtcagtgaagatgaattatccatgtgggcttagaaaatcacacatgcaaattatgtgtcaatggatttttttttcaacatgctaatcctagcctttgagtacacagcatattttcaaagccaattttgcaaacaactctatggtaaatgctgctaagctgttgataagttggctttccatttgtaagcctattagttcagaatcttctgaagtttaattcaaaatgagataatgtgtagtgatttgacagttttcattctgtgacgatgctcttcaagaaagcatcttggcttgttcactagttgaatcctcaccagttcctgaaattatgaaatgtaaatttgttataagcagccgctttgggcccttcacaaggcagaattgtaccttatccctgagtggaaataaatgaacatctcatgtgtgtagcttctctctctctgtacatcctgactccaaatgctgtgaggcaccagaaaatgtctcctgaatctgattttgggtggctggatcaatgtccagagggaattaggaatttttccaatggtggtacagatagaggtgataacattagaaaagactgacccttgacaagacccacattagtgaagtcgttattcccaaggagttgggtatgtacttcccacgtgttgtgaaaacagggctctattaccttgccagcaataccccaaaggcagaggctgtatttgtccttggatctcagtctttgacattgttttgggaaggtatgatgagaggcatgaggaaacctcatccattttgtgagtccagtgtacttaaacggtagagactgactccagggcatttggagttcacagaatttgtcaaattatttttcaagcttgtagggttcaagacttccccaaatgtatttttccaagtgcttgtaccctggtgtccattaagggaaatgtactccatatgtttctaattcttctaccctgaaatgatcaaaatattatattgctgagatctctgaagactagaaagatccttttcaattttttttttctctttgatgacactaacagaaatgggtgatcccagtaatcacaaagaggctcaaattcactcccaaatgcccggccaccaagaagctttggacataagtattttttgggggtatttgtgccaactgctgttttaggacatgtttctgataatgctttacacttaccagaaaagctgtttttgaaaaatccagtgttgtcttacaatcattaatttaaaaaaaaaaagtttcccaagtattttcttagagcaaggagatctctttctgatgaagaatacactctagcctaaaaagccacttaggtggaccagtttctttgattaacaaaagttacaaaggggaaaagaagagtgttagagaggatacctgtaacaaaaagagacaggagacatatggaacactcgtggtgtgtcacccttatttgaaccctcattcaaacaacaactgttaagaaaagtaaaacataggaggcatatatcaatacagaatggctatatgatgatattaaggaattattctttttaattatgatattgataattagctattttttgaaagatacctccttttatagatacatgctgaaatatttacagaaaaattttttaaaagcctggaatttgtttaaaaagaatcagggtgtggtatagttaaaactcctccctccctccatctctccctctccccctctctccctctccccctctctccctctctccttttctccttccctcactcccttttcttcttttttccctcccctcctccttcccctcctttctcccccactgccccagcttctcttcccttctgttctctttttctggccttcatttgggctgacaagaagaggatgcatgttttatatcaggttggcaggtatacttgagatatattgtcttggcaatacaaaggcctgacacttcctagggacccagatgggtattgtagatgtttagggcatgccttgacctctgagtagccttcttgggcttgaggtctcatttgactagactaccactccacagtcagccactgtggtctgttttttaaaaacgttgccatgatgagaatgtgaaggatttgggttgaagttaaggacacttcctttttattattagtctggagttttaaaggagatacctgggatcccacccttactttgttactttgatttggagtcagcccttggctttgagagtgtgctgtgatattggtctgatttaatcattgcctatgtagaaaaagagattagatcactggatcccaaactagcctcagaaagtaagtcattgatggcaagaatcacctggagagattttcagtttaattcttaaaaaatttagtgacgatacttggataaccctctgggaattctgattcagtagtcctgggtagaaatagaatctaaatatctgtaattttatcaggtttctacacgattctcatgttccaatagtttggtgatttaccaggttcaatgccttttaatagattcagttgctcaggagcagattgaggttgtatttccatatagtcctaccttgtaaaaaatggatgtgtcaagttttttgttggtgttattgtttttaattgttattttgacttgctgggctgggcgtggtgattcacgccagtagtcccagcaactttgggaggctgaattgggtggattgcttgagcccaggagtttgagaccagcctgggcaacatggaaaaaccgatctgtactaaaaaactggaaaattagccaggtgaggtagtgcgtgcctttagtcccagctactcaggaggctgaggtaggaggactgcttgagcccaggaggttgaggctgcagtgagctgtgatcatgcgctgcactccgatttgggtgacagcgagaccctgtctcaaaggaaaaaaaaaaaaaaggttacttgcttatgaataagaccttccatatagcagttattatataagcactaggtaaatattaataaatggcaaatactaaaaggaaagacaggaaaaggaaaggcaactgatatttattgaaggcctactattatagtaaacttgactcataatttatattttcttctttaattttaaccttggcatgcaatgattattacccaattttgtattcagtaaaattaaagcccagagaagtttagtatttttcctagagtcacatagtaaacacgtggcagcaggggtgtttggatactattgtgccaggcagcctttccgaacactccagcctatttctcaattctttcttggctccagaggattgtgtagcaggaggggaaatctgttcagagatcaggaaactggaccaattgggcaagctgccagagcttcctttactggattgtaccagcaagtttgtttttctctgtccaatactgggtaaaggtcccaccgaaagcctttgtctctgctcagaatgcctggtatgatctctgggaaactatttggcaaaggagtgtggcagctgaagcacagaagcctctcctaggtggttcacccatatctgatttttttttctttggcaccttgtaacagacctgagaatgttgaaattttgtgccaacgtggacaccattcagcatgtcagatttctctgataccgtgaagatcaatatgttggatgcaaaggaaaagtcccagcaatagattccagccctcactgccacttacctggtatattacaacagcctccatactggtcttcctatctgcagcctgtcctctgctttccggcccacttttctcagggggatcctctttcaaataaaggtctgattatgttcctccaatattaaaccccttcagtgactccccagttcttgaggaaaaaatgctgagtctctgagcatagcactgaatacccttcctggtctggccctgtttctccgcatgcttctcccactccacccagcttctggcaggtcatactaccgtggctcaccaaagatgccttggaaaccaggtactttcatgtctctgtttctccagctggagtttcgttccttctttgacctgcctggcaaactcctatgcattctttgattcctactccttcatgaagcctttcagcagtttctttcttagcacaactctaccaccttgtctcacctgttcacagacatctgcctgcctccctctctaggctatggtgccctccaaggggaggcaaggtgttgttttcaaatcattcacagtacttactacataggccacttacagtcagtgtgtaataactgaaggaggacttgagtgaataggcaaataaagatggttaccatgataggccgagatctgaaaagaagctaataatcaatgcatgaagatgtgtgaggaacttgtgtgtcttcagtaccattctaaataccatacaaatacaggtgccgccagagtgcttgcacatggcagcttcacagcccatttgagaagtagaattaatacatgtgaagaatgaggccgggcactgtggctcacgcctgtaatcccagcactctgggaggccgaggcaggcgaatcatgaggtcaagagattgaaactgtcctgctcaacatggtgaaaccccgtctctattaaaaatacaaaaattagctggacgtggtggcacacgcctgtaattccagctactcgggaagctgaggcaggagaatcgcttgaacccgagaggcagaggttgcagtgagccaaaatcgcgccactgcactccagcctggcgacagagtgagactctgtctcttaaaaaataaataaataaaataaaagaatgagtaagaaaaccaagaaaatatgcaatttagttcagcttgtttggtgctggtaatactttatttttcatgtgtcgatttttgatctccaccttgcactgtgagctccctgaggacagggactttgtcttggcaattatgtcttcacacttggcatacagtcagttttcaagatatgtttgttcaatgaataaatggatggtaggcaccattcagtgctgtttagggtcaaaggaaggcatgatttgtgtgggttgaagtggtcaaggagggcttcacacataagccagttatgaaggatataggcattgaagaagcactaaaactggttgtgagctttactcttcagagagtcacagttttagaaaagctcttgctctattggaaagaatatgggttttagaccaaatacatctagaatcaaatttggactctttcccttatctgctatgtgatcttgagatctctgagtttcagtttccttgcccataaaatgaaatcaatattacttcccttagaatatgcttgtgagccgtaaaagcgatatcatatataaagcatgtagcataatgcctagcgtacattaggctctcaataaatggtaagtaaaagctgatatataggtatagtgtgtctgaaatacctgggaaacatggattatttggatgacgtagtaacatttgattaaatttgcatgattattatattggcacataacaattagaattataatagattccagtatttttatggccttttaagtgtgttttggggatttctatcacatttctttacttttttaacattggaaaattggaaatggatatttgcccccaaattgtctgatatatagatctcgcccttcccattacacttgtgaagggaaggcttttctggcaggaggagcataatgcgtagaggagggaaagggaaatgagctttccattttgggagaaaaattagagctactcttccagtgacaaaccgcattgcctggctttccttctgcaggctctgcctcatgcctgtgttcctatagacattggagttaaagctctcattcatggtcatgattctcgcctctgtctaattcttttactttgtcgtgtaccatctctccttttcccactgttttttccagccacctctgtttcttttggtttccttgagcatgtcaagttcttttctggcctatgttctttgaatttactgttccctttgacagacattcttttcctctggctcttttcatttttcagaaaatcagctgactccttaccctgtggtggtattggagccaaataatggaattgatttttcagtgtttattccacataattccaaggaatatgattttaagagtgttcacaattcatatttttttttaatttttgaaattgaataagtttcaaatacgaaaatttaggaacatgatacaaaacttttctctgtgcaccactggagtactgcttttgaaatcaattctctctgtcctggattacccttagagctcctgtctcctgcatggaggagggtggagggcatttaacatgtccatctctcaccccattctacctgagcttccagcaccaccacctctgggcagttccgcttttagtcagcagctcccagttcccataattttgacttctgtccttgctagtccagaagaaatggctcttctgggattgaattcctccctttccccagcagaaatggattggggcagaggaattgcggagctccatggcatagagggtcctggaaggcttgtcattagggtatccagggtgggaaggggagtgaagggaggggaaggaggaaggaattgagttgggaagagtcaaggaggatgaatgaagttgctgactgatgtctggaataacattatttcaccctcaaaaataccagtaattcaggactgaaaaataaatttcacaatatgttttaatttcaaaaagtgatagtgtatttgacattcttatccagcctggtctcacctcaggagttcccccattggagaggccatccctgaatttctaactcacaggcctcccctacgttaatatatttatgtcctcctggcccttgtttactttttacttgtttacttttgcttttgtttacttgtttacttttgctccatgaagtcagggacctgcctgcttgctccgcaatccctagaactgtgtctagaaccttagttggttgcagtaaatatttgttgaatggatggatgagatggttgtagcaatctaagttgctttggatgagattaacactgaaaaaaaaaaaaaaactggttgcctgcaattctgtcagccagtccaggcaatgctaatacagctttgattattatgatcatgattattattttgttttgaaacctttttcagaggccaagcatgctggggacttgagggacataaaaatctttcaactgattatgccacctgcaaacaggataagcctgactttctacctcacccacctcttgctatcacagatatgaatcaacgaacacacaaaaaaggttttcaattctccctttggaaagagggcacatttaatattctgagtcaggcaaggaaagactctagccacaaagacagctgggaactcaggtccatagcaggcacccaggacggaggtgaagagaaggcgcctccctgtctggtgacagcagctggggcccttgctgcctccctccccacaaaaatccagttgggaccagtgcatgctgggaatctgcctgcctgacagaaacagatggcctcaggtggtgactgatctcttggtgacactaactgcatagctgctgctttactcatgaccgaatgagacacgagatggcggaggtaagagttggttaccttgccgtctcctcctcagctgaaatgactcacattgctgtagcttaaatttcagtccaggctctctggactcggggaatttctttttgctcatgctcctgagaaccagagttctccaggaacatctgtagtctctgtcttcaatcaaagcatttgagagatgctttatttttcccctttcctctgtacctgtcacagaagggggcctgtctgaataagatggcacataatctgctgagtgcagcaacccctctgtgcagccttgaggaagaagacaaggcagtcaaagtaccttccatcatttcctggaaaatgtgtcggtagcttggagaggcagagtgggagatggaagtaacactgcatgaggagttaggtggtctatgttcaggggccagggttgtcacttactagataggggacctttagccagtcacttaactccaatggccttctgcttcatatcatctcttatgtagggtggtgggactggattaaggacagcagatagattagctgtcagtcttactgattggaagttgctgtccagagtacagtatgggggatggctgggaagcccatctcagctaagtgagaaagagcagtcaactattggtatttgccaagtgtgtgacagtggcacatctgcctgctattatgagacttgatggtcatttctgcctctgtggttttatgattccaagtgtcctgcaagtgattctagagggatcatgaaacattttctggtcttaataattactcagggatctattaacaatggtgaggaacatactcacaaccagactttcattgagagtttaccatatgtatattatatcacttaaccctcatccttacggatagggaggctcaggctcatagtgattaaatgacttgccaaggtcactcagctaataggtgatggagctggaattcaaactctggtctgtctgcctccagaaccgaagcgctgaactgccaccctatactacttcccagttggagaatacctcagtacagtaattagatgccagtgtgtatggctttgcctatcagtacacagaaatcagaaaggtgattgagagattcattaatgcctccttgcccagttcttttgagcatatcttatttgagaaaggtgcacgtgaccttgggtcagtttgtctaactctgtcagtctcagttatcttatttgagaaatggggctatagcttttaagttaataatccagataaaacatcctatagtgccccagatgtcagtagcactcagtacatgttcatattatgttgccccaaggtcacgtggctgggaattgagctgaggactgcccacctccgaagtctatgatggcaccttttggttttggtacaagtgagtcctgagtggaccacatggcagcattagaggtgcttttgaatacgaaaggtggcgtgaggatccctctcacttatgtctgttctgttgtccagaacttagtgaaaatcctggtccttacccgctagagtgaaaaaggaaggaaaccttaccattctttctgtgtacctttctctggctggggctttctctggtctaggtgtgctcagcaaatatgacaagtagcaggccactcattttgaccacgcccatgtggcagacagctttcttcactttcacgcaaatgaagtacaagacaatcacatgtatggctgcactgaatgtaaaagattaaagagaagtgatatgccaaatagatgactgggagttgacgtttagcaaagtaaatctcttggtggccctggtaaagttaatttcaataattctggttttttttttcatcttagaaacttagaggttaaaaaataataaatatacatgaggagatttagagtgtatgtggaaacagagatcttcggaggacaagtgggatatttctttatagaaagagttttccctcttgatttttttgcttggtaagtttctttcaaatcaactcaattcatttggtgctattgcttttcttttgtgaaaacgattctggggatttgatcaaaaccgacatgaaaatacaaccctcaaatggtaaatatcagggaatctggaatttgcattttctaggctaaagtaatttactggccaagtttgctgtctcctcactcccccaacacatgtacaactcttaaatctcattcccctttaggctccttctctctcagtttatttccagcacacatgcatatgcatccatgcatacacaggtgtgcacatatgcatgtatacacacacacagacacacgacacacacgtgacgcacatattttactctgtgctaataaataggccagtattggctaggctgggcctcaggactgtctggtttaaatctaagctgcctgggagatctggagtaataagtgagtgacaacaggtgcagattttgttacacccttctgaactcagcccatagttctttctttgattcttttcacccaacacccttgcttcaattgtgtccaataaattttatagctgcatgatcctgtttcagagctgaagggagatttttccctccacttggctaaatggtgcctaagtcaaaacaccacttcctgccccctcctcacactttaagaagtaataaggaataaaccccaggccataagctgttgctgggtcctgtatcttcagttttgcatgtgaagagctaattttctggtcccattttagaaaagccaagaattaacttgcagagaattagccataattggggagaaaataattacttggctttttctgccctgtgataactggagccactggcaaatctttcacagcagtgtcaacgcctacttctgtttaaaacaaagtattgcaccaggggccttgaaagtcacatctgaatgttctctgtggtacattttggtccaaaccaccctgaatattggagttggattcatttcatgtcttttttggtgtaaaatcccggtgcagggagacatttcatattacactggaagacatgaatgtcttttgcaggtgtcaggtatgctcatgggccctgcatgcatacttaaggttgggtccaattggatttttttaggagcagtctgtggtctaagctgagaattttttctcataagggcccattttcctctagcatttttctgttttgagactttgcccagctgcctctattccctagtatgtagacttaataaaaaatctcttggttcataataaacatggaaaggagatggtacacgttttccatttgctagtagaggtttacctgaatacagttggtcatatatctcagtgtcgtcagagtacaacaaaatgtcatgccttcccatgatttcagacaccactcttcagtaatgacttatctgaatatcagccctgtacctctcctgagctccagccttaagggcacacttttcattgggtagccctacctgctgacccatagacaccctaggctcaactcattttccctaaataaatttgcttttctttctgtgttttctatcatggtaaaggtgctgtgatccaataactcaaacaagaaaccttgatggcatgccttccatatccattactgttagctaagtgggggacaatctatatattgcctcagatatcactgggatccattgccctcctaactaggctccctgggtccagtcatctttgcctttcctccaacttctcccccatgtcacctacctcctcttttctctacccccaccaaaacagtacttcatacatccctagtattgtctttaaatgtaaatctgatattatttaactatttgaattctttagtaacatcccactgctggcaggaaacaagtcctaacttcctagtataaggaatataaggtccaatgtgatccagctgctccctgactctccagtcttacctcctgtcacactaccatggatcaagccccatggttccctttattctctttcaactctgtattttcgcatatgtgactttcttctgctagtaatgccctttcttaattggcctgtacctttgactcctacacttctgtattattaggctatagcactagatgtggcttaaataagttagattatttgtttatctgatagtccggacgtagatgctttccatgagatcatccaggaacccaggtagcttctgcattggactgtgcttaacatgatgcccctttctgcatgatccaaagtggctttcaaccacagcttccttcaaggcagcaagatggagaatagatgaagaaggaacacaccttctcccttttggtgctgtgactaataagaaatatatttttagtttctgttccaggtttgtgacacagagctcctaaaagccttgtaatttccagagtgatcaacattctaggagtatcttttgttgtactatttagactttgactctggttcctaacagagcttctaaatcccttggggtttcctaagcgatagagcatcttttgctttaatgaggcgactcttgggctcctggataacttcagaatgggagttggtcagaatgggacttggtcactagaaagaccatgtgatggatagcagctcagaattttcagccctactccccacatccacccaatccaccaggaggggagagaggctggagattgagttaataagcaatcatgcctgtgtgatgaatcatccctaaaaatccctgaaagatggggtttggagagctcccgggttggtgaacaagtggaggtgcctggagagggcatgaaagctccccaccccttcccacataccttgccctatgtacctctttgtctggctgttcatttgtatttgtattctttataataagccagtaaatttaagtagagtgtttccctgagttttgtgagccattatagcaaattatcaaacctgaaaaaagggggttatgggaacctccagtatgtagctgatcagtcagaagtatggaaggcctagacttttgattggcatctgaaatgggagcagtcttggattgaagccttaacctgtgtgatctgcccttactccaggtagttagtttagaattgaattgtgggacacctggttggtttctgaagagttagagtattggttagtgtgggaaaatccctcacacacgtgatgtaaaaattgtcatgagtatgcagaaaaaagtttttcccctttagtggcagtttccagagtttgtaaatatctctgcttcccaatcttttgtgcctcctgtctgtctggtactccacctctgtagtaatggcagcagcagcaattctagtagtagtcacagtggtgtttctctagtagaagctgtaatagtagtaggaagaagaggtgtaggagtagtatcagtatcataatttcccattcctagtttcagaagagattgaaaggctaagtgacatgcctgaggtcacatagttaataagtaaacggcaaagctatcgttctgactgggagctctcttacttcagagctcaccactagactgtgggtagttttcaatccagtcacactaaatgccagttatttccttacatgattacctctcccacaagattcagaacttcttgaggaaaaggacatatccaactgacctttgtatctgtagagcctagctccaaggctgggcgtatccatcagttttagacattgaaatcagggtttcttaaccttggcaccattgacattttgggccagataattctttgttgtggggctgtcccattgtgcatgacaggatgtgtggcaccatccctgacttctacccactagttgccagtagcacatatccccacccgcagccagataaaccaaaaatatctccatgcattgccagctatctgctgggagacaaaatgtccctgattaagaaccactgatttaaattaaatgaaggccaaggagccttgagtagtgttcatatccgaaaagggcattttcagaattgttcaggctgctggatctctcaaagatgatgatgtattttccaggcctcatgtgtctggagcacaggttgcctgtggtggtggctgcaatgatctcagtgtgccaggccttcacggggaataccagagagggtccctctggagcagctcttactgggtcatggagaccatctgtctggcatggtaccacctggcaaaatctctttgccttaaccaaaaatatgcttttgtaaatttcctggcaaagcaggggctgcattctgtttcctgatttctctcttttatttccagatgtgtcactggtgacacatagagcccaatgagaactctgttggaaactcaagtttctcattcttcgccagctccgttgtcatgattttcccaccgtctaagccagtgtaggttacgttacccacgtgctggttagtgcttggatgtcagttttcctttttaaattctagatctgtagcatgctttagggaggaaactttatggcttattacacaaatggagttaacccttccctgctttgcagtgtttttgttagtgacagagacatgaattcaagatctgccatttattatttgtttcattttggacaacatgcttagcttctttgatccttgatttgtttaccttcaaaacagagtaacctacctgtcctgtctacctccatgggattattattaaaacacaataagataatctgctcaaaaggcttaaactccctagtatgatttactatcagtataccttttgcacccaagaaaactctacagtatcattgttcatgggcaccaaattgtaagttcagttaaggcagactttgtgtctttttctgccagtttctaggacctagaaggtattcagtaaatatatggtgaatgacagtatgaaaaaaattgggaagtcagattctgtggttcattgtaccagtgggggctggagggaggtaagtgaatggtttgtgtggctttgtgtcatttgtatttgtgacagacattccaagcaatagcattttcaagggttcacaagtgagtgcctgcagaggcaggacacacttaacactctggcagatatgcgacaagacagggtagggaggggcccaagggaactagagagggcatacccagctgtcttagtcattttgggctgctattaaaaaatgccatagactgggtggcttataaacaacggaaattatttctcactgttctggaggctaggaagtccaagatccaggccccagtttattccatgtctggtgaggactcacttcctggttcataggtagccatctcctctgtgtcctcaaaagacgggaggagtaaatgagctttctgggatccattttacaagggccctacttcttcatgacctaatcacctcccaaagccccccccacctccaaataccatcaccttgaggattaggtttcaacacaggaattttgagggggggatacacacactgtctatattgccaacctaaagacattcacagttacacattttgaagtctctgcatcagctaaacaaaatatgtctttgggccaatttaagtcttcagacaaaaatttacaactccttattgacagagtacctaatataaatactgggacagatgcggggcagataaagatgaggtgctcaggatccggcagcagtgatagacaggaaattagtgagacaatgagaatatccaagatacatggagagcttagcccagcactgtccaatgtcctttacaaatgacaacttgtatttaatcctcacaacagcccaatgtgagttagtggatattatgtcccctgttttataatgaggaccctaaggcacaaagaggttgatattttgccagaggctttgaagccagtatctggggaataataaaatgcaacgtgtatgtccaatgacaaaggaaacacagaagccccctcttagatctcactacttctactcctgcccctccagcccctccatttgaagatccctgagggatctgaaaatgcaactttgatcgtggcacagaccagtcctgaggttggtgcagtgacatccccatgccacagaggccctgtgccttctggacgctgcctctcttgccagccttgcccgcccctcatgctctatgctccacttcacttgcccagacagacaagcactttgcccctttgcagccactctcccctttgcctgtgtctccttgttatgcagggcctttcttattcctcaggcctcagatcaatgtcacctcctcagagtgggcctttgctgcccacgctgcccaaagatggcctactgggtcactttcttctttgccacttgcttatttccttcctcacgtgtgtgcctgcgtgtgtgtgtgtgtgtgtgtgtgtgtgtgtgtgtgtgtgtgtattttctgatgcctccacttgactgtaagctccaggagtgcaaagatttttgtcacgttcactgctgcatcccattgcctgagacagtggccagcatgaaggagatacacgagaaagcaatgtgtgtgcactgagtgagcgagcacatgggaggagctgacttcatggggcagattcagtcagagagactgtggctggcctggtgtcacattggtgagaagtggcacagtcgggatttgaactgatcatgacagcatctcgcttgaatcccatcattgcctccctaccgcgctcaggttggactccctggtgtttaccatggacaatgaatcttgatgtctggcccctgtagcacttctagcctcttcaccctcaattgtctgcacatcctcccttgcccctttctatctgcactgacttcaccgtccctcagtcaccccaccttctttctttccctgctcttccttatgttctcttcccacggcaggcaccctctgcccttctgtttcatggggctgtctcttcattgtccctgaaatttgaacttcagtcctcctccccccgcaaacttcttccaagcccatggactagactagaaccccctcaagtgcccctcattgcatttatcatggttgtaactctatagttatttttgtaatttattgtcttttctggcttttctgcccatggcccctacaacaacagcatgttcatctcattcttcttctgccctggctcgttaggtaggaggtgcttacataaacgtttgtcaaggaaatgaataaatgaataaataaatgaataaattgctggatgaatgaatgagagtaagtgaatgaagagttcctgaatttgcttttatgccacctcccttctctgggaaatttcacacaggataggatttctctggcatagagcaacacttctctttgtagatctcagcctgtgcctggagactgggtaaagttgaatgacggggtgcaggaagccttgtgttgtcttgtcacaacacaggaagggaaagtactttggcttttactgttgtaaataggactaaaagtagctcttcgggggtgatctttgtttaccactgcctaaggccactgtccttggagaaaggtcaggaggtgggtgtttacaagttctgtccaaactctcccatgacactatgccacaggccctcatttccctgacccattgttaattagagcagaggaggaacttcagatgctgagtttgtctttgaagaaggatccagaccctaggatgtcatcctggagactttgctcttccttatccttcatacctggtcctccaccttcctgacagtttctcttcttcctcatggttattgggagatagaatgggtggcagatttttattgtttcctgaggagccctgtgctttaatttccattatgtgtgaagatgtctgccatgaccaccaggttgggtgttctgctagattggtgtttgggagccagttgtagacagagtcaaccagaatataaaaagtgtgagtgcagagataaacccactcctgccctataacgacagtaacaaaactggcccagtggtagagctctcatcacaggccaggcactgcgctaagcacgcagtctgcacccctttagactggcccattctctggaaagtttcaaacatacacatcagcaaagagtataatgaaatcctgtgtacccattacgtgtaggggctgaaaatgtatttgccttgatcctgctttcaaagcaatgggtctagtgactgctttgggggaggagttagggaagtgcttaactcatattaacactgatattataaatttacagaatgcagctcgctctggagattatatctggttatatatgtgcacatatcagtgattgctatagtcccctggtaaggggatatatatttaacttaaaatgttctgtttggagtttttacataaatgtcactaaatacatgaatatttcagacccccttcccagtctagagtagtattgggttaagggaactaactgttttgagggaatctgagccaatttagtctggcaggaaaatcatgtagtgaagtagtgaggcccacatggcctctgaccagtcagggagagatactgaagttttacaagagaccatttaatgagagattatccataaaacttgatgcacagatttcaggagaagtctttttagtacttatgtgtgtgtgtgtatgtgagtgtttaaatgtggcaggctaaagtgaagaaatacgactgctactgatagtagctattgtttattgagggccagtatatgggtcagttgctgtgccaggaggtcctttgactacagtctattcctcaccaaggcttttagttcattgttattaccaccattgtagatgtgagaacatggagagtttcagagagttgcccaagactattcacataacaagtggcagggctggaatttcaatccaagttagcctgtttgcaaagcctttgccctttccattagactacatagcatcttaaaatattctggctgcttacttgagaggtaagtatcagttgggaacttactcacttccttctttgtttcaatatacaacccagaatgctttacaaattctgcagaattagccagtgctcatgtttaggcatatcatagattttttaaaatggctaatgttgctgttcctctccttgtgctttggaaaaaattttcagagtccgatacctattgtgacaacttttctaaacactcaaagtgccaagttcatcttgttagctgttcttccaccaggcaatcaaaactcatgttagttccctgtggattcattatagtccccgggaaaccaaaagttttgcctgtgtttggcacataccagttaattgcctaaattgtaacttctgagtattaggaattatcttaaaaactaataccaaaatttggtatgatgtatttcaattgagggggaaaatatttggaaatgaatttattttgactctggggtaatatcttttgcttcacatttagaaatttacatactgggttacttccatgacctaaaacaacttccaagttttcttatttcctcagtacccctagctttgttctggatgaggccagtctctgttccaacgcatgatttaaatatacacggttctgcatctttgtctataatgtttataatatttactatctcatgaattttttatatctacttcataatctactctctccctctatttttccttgcacttgacagcccaactggatgttgtctcttaattctttgtcacttcatggcagtttataattctttaatgttacttattatatttcagctacactgcagtaatggatgggcccattttctctcctccagcgtactgaatgggactgtgtcttgtctccgtgtgcctgacaccttgcatggaatttgcacctcatagccgctcaatagattttaattaattgaaatttaaaagggaacttgtgtggttttgtttaaacaagaccataaattagaaacaactattttcatgaatttgaaattcccagaaacattattctttaatactgtacttttgtcgagactgaagagtttggctttatagtaaatgaaatgaatcacagaatcattgaaccagagtaacaacaatactaataaaaacaccagaaatcatctgtgtaatccattcctctctcttaatgccagacagttccccagccaccttaaaatgatagaactctcctttccttaaagatccttttaaagaagactgtcatcttttcccattccacatcatcatgtcttctagccctacaagttaggcagcttctcctcagatgatcgaaaccctcccttactgaaatttatgcttattgctttcataaagatgaaaagcagctgcttttaactgaaaatagttctcttcctaaagatggttattccattattccatatccttctcttccctaggcataattttcctttccatctgacattcctttttgttctatatttccaaaccattgaatactactctctcaacttacggttttttgcctaagaaaacttggactgggtgtgattagtaagtgatcgttgattttagatgtactgagaaatatgtctcacaccattaaaactagtcgatccagccaggctggtgggtaactggaatactgtgacctcaaatgatatgtggtggtatcttttaaagcctgccatcaaccattcccatctcagtttctccagttgcttaatttataagacataatttatttgttataaactgctttgcaaggttcaaaaaaaaaaaaaaaaaacggaaatgatacacaagagaattagattgaatttaggccattttttccccctcatatctggtttttaaataagccctaagagtgctctcaattagaaaaacacatggtaattctaaaggagataaaaaaggaacatgtacactccaagtgcacttttatcttttcatatttaagaaaccccacaaagctccttcttgcaaattaaagaggatagcaagcaggcagctttctttcctcatttagtttagcaagcatattgatttacatttgagtaggggcctctgatctcttttgtttgtgggtggctttgtttgtttttaatatgaactcatttaaaaactaagcttatggactgagttgcaaaggtagagcttcagtccaacactcaaagtagtcttcctatgcaaaaataaaatagatatttatgtatgtggtagtaggtcaaagaagacatcagtgataactattgattcagtaaatattaaacatctactatgtgtcctccttactaggaagactaaaatgtagaatgtaccatccttgcatctagtgtgcagtgtagtatgggagagagaaataatttagcaggtgatcataatgcaataaatgctatgataggaagcaattaaggcacagtggaggggcgaataacacacctttggatgaattcccagaggaattgacaccagaaggtgattaggatttaccaaggttaagaaaggtgaaggtgtttcaggagtgcgttaccaagtacagaagtgaatggaagtgtgacccattcaagatactcttgagtttgtttcagccagagaacggacaaacaagggaaaacttaagtactctatcctgggttcctcaggatgcacactttaaggacgttttgcgtttttctctggtatttatttattgaagttctcagaacctccacagagctaatttctgtagccttttgtgctcccataaagctttatatatgtacccacatttaaaactttcttacaatactttttgcatttcctccatatgtctattttcccatctactctctgagctaatcaagggagaagacctagtactcacgtctatctatctgcagtgccatgctgagtgcttgcagaaatgtgtttgggaatcagtgcatctctctatgaatggctagagcattctaagtggttttgcttctaactgtgcaggagggcacagtttgggcccaatattggtttgcaaattcaagataagaaccaagaatttgattcttaactcaattttatgttgacttgagcaggctgaactgggttgcttatgccattatttcatttagttcggataatggctatcaaattagctgacaacccatctcagttccctgtagtattcttagcagtgtcttaaagtgggttttcatttgaacatttctttattatattttctttctcagaagtagccaagagatgatgatgatgttgatgctggggaaaacaatggtaacaagagcagctgctttttattgggtatgtgctatgtgaattaaccctgcacttaaccttttaatgaatttatgagataattactactgttaccttcttaacagatgaagaaaatgaagagcaaggaggatatcttactcactagtgaatgatggcttcaccatgtctgatccaaactgtactttgtaatgccttcttcatagcagcactaaaatctaaaagtctggaagagtctttaggagatcagttattccatttcacatctgggggcaggattatgcttgaactgaatgccttggtccactgcctgaaatgtatcctctacaacctttgtccacctggtgaactcctactcatatttcaggactcacaattcaagctgctactcccaagtgaagcttccttaatattcccaggtagagttgccctcttcctctgttgttcctcttaaatatcttgtatttcactcatgaaattcaccaatcatgcagagggtatgtttctagaggcagtttgtatagttgtgaaaggtatggactctgcagctaattgtttgggttccaactctagctctacccgtattagctaaataatatggtgctctcttcccctgacagactgttaatcccttgaggccagataatatttacaagaatttcttaaatggctaagtcacaaaattgtcatgttttttaccttaatagcaagtctgaatgtatcctccttctgaagagctgatgtattgtttctgctggtttctgcatcttgatccctgaaagatattgaaaacctaattttaaggccattttcctgtttgtttgtttttgtttttgtttttgtttttgtttttgttttccatttctgtttcctttccctcttttcctgtccttccttagagacaggacatcttgaaaggtacgaaatcttcaggtctgtacttctacttcaccaacttccttttaatgtttttacctctttgtcttgtgtggaaaatcttaatctgactctttctgctttgtgtcaaagggatactgttcatgttaaaattctcagctctgagaggtatgtgagtaggccgttccttgggtgatgggacagttgacatcatatctgagaagagcatcaccatggtgccctttacttatggccgttgtcatgatgacagtcatagccacctggagcacagtggcctgacaaagacaggaataggaagagggaaataattcgtccaacacttttgtattttgcacaatgggaaaagagtggcatcatttctagatcctaaaccaaaattgatagaaaaagaagactagaatgataagatctgctaaatattctcagggggttgaagtatcaaatatctgcagatggtatcactgagcaaaatcaaggagagcagtttaggatttttagtatgagggaaatgataatgcttttcagtacttcttagagttgtcagtgtctcataaaagataaagaatatttgttgagtgaccacaacttgctgggtactgggctacactacagtatagtatagttattactgagaatttgtagagataatcctagcttatcaaggaaatatttgttttataatttgttcaggtgcttatttatattgaagaatattctcaagttaagatgatttttttagatactccagaggccagaattaatcataaagggccctaatagccaaaaagaattgaaatgcactaggccaattggcagacactatttcagtctgctctctttcatcctttgccaggaattgtacattatctctttaaggcagagcagccttggatgaccatatattaatatgataacttgcttttccttgctccccaccccccaactagtggctttagaatagctttgctatttttcacttatttcttggcagtagcactagatcccaggcttaccgattatgcacactttagataactttgggtcagctcagtactgaacaaatggcaagtcaggaatgccattaagactgaagaatgttggaagataaggattatatagacaccactgtccttatacacactgtgttgtcctgtaattggataggccaaaatgagttgacactggaagaggtattttaatattggagcttataaaatgtttagaaatgttttcctatctgagtcagactgagataggtatgtatgttttctgtctcttctgagtgacactgggaaatagttatgattgggaataggccttggtaccaataacctcatatatacactagggtagaccttgcagaggaagctggcaccagggcatgggaccgtgaagcaaaggggttcagaagaactagagagtggtccaataatgagtcttcagatggccagaggcaaaggctgagatcaagcctcaggtccaagaagccagaatcataagcctgaaataattgagtgagaaacccaacattactagaatggagaagaggctaggggaaaggcaggagcaaacccaagggctgggggtctgaagatgttaccatcacaaggcagccccattttaatggcctctagccacagggtttgccattaaaaactgtaggagtagacagatgcttgatggaaacccttgaccccgggtctttgctcccttaatgaaggaatctaaggcaaagtagagattctttttttaacatttaaactttatttttaattgacagataataattgtacatattcatggggtacatagcaaagtttccatacatataatgcatagtgatcagattaattagcatatccatctcaagcctttttcatttcttcgtgttgggaatgtttaatatcctctttctagtgatgagaaactgtataatacattattgttaactgtagtcatcttacagtggtatagaacagggctccccaaccccatggggttctataccactgtaggatgactagggttaacaataatgtattatacaggtactggtctgtagcctgttaggaatctggctgcacagcatgaggtgggcggtgggctagtgagcattaccacctgagcatcacctcctgtcagatcagcagtggcattagctcctcaaaggaacaggaaccctattgtgaactgcgcatgcaagggatctaagttgcacgctccttatgagaatctaatgcctgatgatctgaggtggcacagtttcatcccggaaccttcctcctcgcaacccccacccatggaaaaattgtcatccacaaaactgggtcctggtgcccaaaaggctggggaccgctggtataaaacagagtttatttctccttatctagttgtaattgtgtatcctttaacagatctctccctatctttttacatgtcctttgataccataagctctatggacaccctataatatttcttcattatacttacccttcatagtaattactagagtgagctcttcatggatttttctcttttactagactctaagctccacgaaggaagagataatatctgtgcctggtacatagtaagagcctaataaatatttttggaaggagggagagaaagagggaggagggaaataaatggctcttttgctccttttcttcatgccagggcaacactcagcttctgaggtatgcacagcaaggatcttgctgagatgggtgtggccacttgcttgcctcacttccagccctgggcacatgcagttctttctacctggtgcagtcctcttcctccctgctctggcacttgcctctgcttccacttctgctgctgcttctttttctagtctcctgcagcctaatcatcctcttgacacattctttctttaaccatctgaatgccttcagtatggttcctgtgagctctgaatgttctggaagccattgttttgttttgataattttgaatattttactcttgctcattatggattaactttacagctgaactctcaaaaccagacttcattttcccaacttgagagaacatctcattgttgtccctgtgtccttgcctatggcacacatctcccgaacacccttttttaccagaacatcctcacagcaaacctaaggcagctaactgctttctacagctctgtgtttcttgacctcttccatctgttttattttcatatttttcctttgttaaaaaaaggagataacagacaagaaaaacacgagaaattaaatacctcaaaattactgtacattttcacttggagtaaccagtctttgtaatgttttgtaaatatctttccctgagtgggcctgaataagcatgtagttaacaagcatggacttttaattgatcagggcaggttttgaacttctgtcctgctctttcctaatgatacaacctccaatgacttaacttctgagcctcagtattctcttctgtgaaatggaaatactaataatagtatcctcacaagtttgttgtgatattcagtaacccacataaaatttctatgcataatgcctggcgtataataggcactaagtaagctgtcacttgttttctttactttcctgctttctctcatattgcctctaattagtaccgtccttattttttaggggacagatccaaatccgtgaatccaggggcttcatcacgatcttggaatattttggtggcaactttaagatcttttgttttctgactcttagatctctttcttttggtggcatgggaaaattccctcaactcgattatttattcagttctttcatgctccccatattgtcatggccacgtttgaatcatgttatcggcaagtctgaccgaaaaagcaatttaatattgccctgtgttgcatcattgcatatattatttcagcctgtcacgggcctgtcagcaagtcttgatgaagtacagagccaatagtaacaggcctgaaatctgacagctctttaacagaagctgctccgattggtgcagtggtatttcttcagaaattaaggccttcttggtctctttgttgatacaattagcaatccaatctgagtcattttatctcccaatgagctgtatcttcagggctggtaattcagtctgttgcatggcttggaaaaacagagccatcagaggcctgtgatgtaccaaaggctgcagccaggaatatcttggtaatttatccccactctcagctctaattattctgttcttcactggctggttcgattgagactctccaggttcagccttccctaagcagagaacaaaaggtttcccttgaaagttggggcctggcaatgtcagtacagtgagctgcgtataaataatgcagcagtgccggcttcatttttataaaatcttggtggagaaatgcatgagaatgatcaggcccctggaactcagcaggcatgtgcttttgatgtgcgccttgctctgagtaaaagcaggagaataaaaagttcttgtttgtgctgaggctacttcatggtctctggctcggattttggtgaccctttcgctttgtttctgatagagtctggaggctcctacctaactaggaaaactctgatatgtatatagagggaaataccttcagtaactattttctgattgaaactaaagatgatgaaaataaagatggtgattatagtagctttacttatattagctttacttacattccctcattttaatcttcctaaggttagagttatctggctaggctattttctctataccttctgctctcccaattagccttatatcttttcttttttctggtcagattccccaaaaataaatattcagggtgtgaacctagcagccaaagctctgggagctgagtcggggaaaggagcttgagggctggcctgcaaaaaagcagatactgaatcagtctctttttgtcaagatactctacccttacctggaccttttatcgcaccctatctaagggtggatgctatggtttggctgtgtccccacccaagtctcaccttgaattgtagctctggtaattcccatgtgttatgggagggacccagtgggagataattgaatcatggggctgtttctcctcctgctgttcttatggtagtgaataagtctcacaagatcagatggttttataagggggaaacccctttcacttggttctcctcctctcttgtctgctgccatataagacgtgccttttaccttccaccatgatggtgtggcctccccagccacgtggaaccatgagtttattaaacctctttttctttataaattacccagtctcaggtatgtctttatcagcagtgtgaaaatggactaatacattggaccttagtacttttcttccgtagtgtgggagaagtagtaccctggttgctaatagtgaggtcacatgggatctaattacttcctaaacatactttttgtaccatctgctgtttttagcctcatttttatcctcactttcaggggtggtgagcaccaccacctcctgaactttttgggtctctgtagggtaatcattttgcttctgggtttttcctgctgctatttaggttttacctttctcaagtctaccaagagagttactactaccatggtttttggcttttagattttcgatgctgtcatcttctatcctgttctcattgtgggtttttgcctctttgaaacattcttgtacaaccattttgttggaatttttaaagggcacagagttcaacacgtgtagtcaatctggcatctttaatcagaagcctctttttgtttttgtactttttgaaataggaaagaaggtctgctagagatctggcatgcatttgtgtcttgggcagtaggtggtgggaggaatgtgaggtaggcaaaaccaggagagcattgttggaaggctctcctggttccattgaggttaatggtctatgcaaggaacccagtgttctgcttcatgcactccaggagtctaacttttgtctcttctccagcctgcatacagagcagtatctaaagatctaggctttataatagaagccattaaaaaatgattaggaacctgaaagcttccttctataactgagatctgaaggtttttattcattcacttaattaacatgcattgtgctctcaaaatttgccagagtagcattgtgcttattcatccatataactggatgaaaaaggcagatatggaccctgctgtgggaggttgtggcctgaccttatatactgaaatttccagaaggccagatagagcatcaagaaataaaataaaataataacattcttttatgataatgagatagatccttcagtgcctcctggtcttccccactcatacacactcatgcctaaaatagtccacggttctggactcctttagtgggccagatcctttcatcaccatgggctgctgagaccactggaatttcaggcaaacctataaaacaggggcagctttaggtgaccacattctgtcatgaatccttgatttcatatacagtttttgcattacatgtttgctagtcctaggccaaaacaaaaggagaaaagatctaattttagctgagttcgagttgcctttctaaaaattatgatttcttctttatgagtctttttggtgaattgacccttttctcaatatgtaatgtacctgtttattcctggtaacatttcttgttctgaagtctactttgatattaatatagccacctcagcttattatttgtatctgcatgccttatctatttatttattttttgagactgagtcttgctctgtcccccaggctggagtgcaatggcacaatctcggctcactgcaacctccaccttccaggttcaagcaattctcctgcctcagcctcctgagtagctgattacaggcgcacaccaccacgcccaactaattttttttgtatttttagtagagatggggtttcaccatgttggtcaggctggtctcgaactcctgaccttgtgatccacctgcctcagcctcccaaggtgctgggattataggcgtgagccaccacacccagcctgcatgccatatttttgcatctttttactctttatcttgcatttttatattgaaaataagtattttttgtttgttttgttttgttttgtttttatccaggcactgcgactcacctcacacctgtaatcccagctactcacaaaactaaggcaggatgattgcttgaggccagcagatggagaccagcctcagcaacatagtgagacccccatctctaaaaaataaaaaaaagaaaaagtaatctgggcatggtggtgtgtgcttatagtctcagctacttaggaggctcaggtggcaggattccttaagctcaggagttaaaggctgcagtcagtcctcatcatgccactgcactccagcctgtgtaacagagtgagctcttctctaaaaagtagaataagtttcttttaaactccatatagttgggttttatttttattcagctttattatctctgccttcgcactggagattttaggtcatttacatttattggttgggttttaatctattttctttttctgtcttccatatattctatataattattcccttttcctgtattctccagattacttaaatatttgttagtattccattttatctctaaaaagttttacctcttgccagtttctaatatgcgtctttcacttatcacagtcgaccttaaaataattttgatgcctcattatatataatacactttcatatcttcctgtgatttgtgctattattctcatatgatttgttcatgcattggattgtataaagatttaaattcaatttttttaaagaaatttatgtctgttgtatttactcacatatttagcagttctgatactcttcattcctttgtgtgtgttcacatttccatttggtatctttaacccatgtagtttctgcatgaattataaagtattctccttctccctcctcctatatgagtatacagaattgagtttgttgattgtattaacaccctttaattccccagtagtaataataatagctattattactcttatagtttacatgtctcttcacattctgaaagtacaatcacatatttaaatagaattgtcttttttcaaatgctttttaaattttagaagctcttgtttcatatatttcatactacattgtttggttcataaaatattatgaatggtagttttcttggattgagcattttgtcattatgaaatattcttcttttccttgttaaatatttttgatcttgattctactttgatacttatattgtcatttaaaaatttttttgtttgtatttgttgtagaacatttttgaaagaaaactgaatcacattttaaaaaatctgaattataaacaaggtatatagcttaattttaaccacagtatgattaatcttatcttttaactggttgtggaattcagcccattcacatttgatgaaatactgagataattgaccttatttgttccatcttattttgttttctatttatattacatcactccccattccctttcctttttgttttgtgtggtttattggtttcactggcttgttaattttttctttattcccttttattccttgttactttgagagtcctactaagtgttttgtttctactagtggttacattctcattccttataaccaacaataaacttatgttctgcctaaacatgtatatgtatttcaaggaacgttttctgtgtaccccttctctagactcttacttaatatttgcttacttaatgtttattttcagttccagactgttactaagttttttttgttgttgtttgttttttttttgtagaacagcaagcctattgtattttaagaaaactcaatattacagattcctgcttacattattattatccacttagatttcaatacgtatatgcatatatttttatgcatatatgtatatgtttaagcatattatgcacatacatgcatatatatacatatatgcaggaaagagacacacagagtgagaaagggtctcagtgtctactggttcctctagtctttgatttccaccatattgagaaagctgctctgaatcaattgttatttggttatactctttctcaagtattgtcctcagacagtgcttatgagtttactttttgaatccttgtgtgttgaaaatgttttttttgcctcttacagctaaataatattttgtctgggtataggattctttaatcagtttctcgtaatagtttgtacattattctagtgtcttctacattccagagttgtagatgagaattcccttagctaggattaatcctttgtaagtaacctattctttctgtctggaagcttgtataattttctgtttactcttgaaattcaagtgtttcctggatttacttcctggacttaatgagacttttaatctgtgggcttaaatcttacttcagttcagtataataaaatacctagccctgtattcatttaattacagtatctccctcatttgttcttttctttttttttttttattccttttctctctcctaaaaaacacaaaatctgttctggaatttctgttattctcatgttaggcttctggaatctgtcctccaagcctcttatctcttccatcattatgtcaatctctttgtatctttgctacttgtagtagcaaagtgggagagatggtgaaatgaatgagcaaagacagttactatggtaaattaagataaagataaagataaaattcagatgtcatatgtcatatttcatttacttggtcttccagagcattaatttgattttcattagtgtcagtgattttttagttcttctgtggaaattttaaacgtaaaatcagtatttatacttccagaaagaattttttgcattcttctgatttctcattgttttcatcattaaaagattctaccatatttttcatcatttctacttctgtgggacttgcctcttgtagatgttctatgtggtctctcaggtgaactactcccattaagttagttaatgtttttgttttgcctactcattgataaatgctattttgactttcatataggtttttagtatctattctgcattaacaagtctgaaagcagtgaaaggtacatcagttcctgccctggcacttgggctggcagtcacccaaccggccaacagcaagtggccccttctttcttcttagagcacccttggtggaagcagcactcctctctagctgccaatcttagaagcaactcagactgccagtgtagccctgactctgtagggcccctatctctaattctaattttacaaacctttgggtgggggtgactagtaggtacagcttgcctaaaggtgaatagttatccaaagagggcaagttgctaaaacacttcaggaaatgtcaaaactggtcttaatagaagactcccggaggggtaagccctttgttctgctgctagtaccttgcctttacccactaataatatgaacaaagtcctatgttttctttccctcctggagagttttggagtacctgtggcttcaattgtactcactaaactttaccagttctgctgcttaatagcacgtccatattacccatcagtttgatttaaagaaactcaatgaattggaccctaatattgtttgaataatcccaatgaaggagggagttgccagaggcatctgtagccataaaacttctgtagtcatcttcactccaggcatactctcttattttaacttcttgtaaagaccaagacatccctaactttccctttattggggaaaaaatctgcttggaaaaacttagttatgctgtgaagtgttgagtttttaaactattgctgtattatgaaccacaaccaatgcttgttagtttaatacagtaatcatttatttgactcatggacagctcatttaggctgtgctgtcctaggtgatccttctggtctcagttggactcactcactggagtcttggctgactgatccacgttgatccaagacaacctgggggtatctgatccagattgagctcagctggctattgccctgctccatgtttctcttatcctcctcatgggaccagtggactagcctagaatgatctcatggcagtgccagaggtgcaagagaacaagcagaaacacatagaatctcttgaggctcagactcggaactggcatgcagttacttctgcttccttattttggctaaattcagtcatgtgacagaatcagaagtcagaggtaaggaatcagaatcagaggtaggaaaggaagccctgcctacaatgtgggggacaggaggaggagggtgcagtactacaaagttacatggcaaagagtgtgggtatgtggagacatgaagacttagggccatgaactcaacctttatcagctgttgagaaatacagtgcaatattttaaacttacaatggtacctcaagagagagagccacgagtttagcttggaggtagtagagaaactttcacagaggagctgacattggaactggaccataaggacaacctggagtttaccaagcagacaaagataggtgaaaggagtaataatccattaagatggaaggagaagtcaaagtagaggcccagcactctacagacaagaatgggacatctggggatttaggagttaccctgtgtgattggatcattggaaacaatccttctatactgccttttgctccctaatattactcttgccagggagctatcgtacctccccaaaagttggaatttcagatgtcatatgccaggaggagttagcatattgtatactcttcagaacatgttacataggtgggctgccttctccacttattagagatgtatgttgcttaaaaaaccgtgaataatttagcatgtttctagaagtgcttgcattccttcagtatatttatgccacttagcatagctcaatgtgttctgtgatctgtgccacatgtaaaaaaatcattaatgataagtgacatttgttggctttcaaaagacatttaagcctcactcagtgctacctcctctatgaacccctccttgatatttcctccctgtctcccaccagattatgtcaggttcttctgctaaaggctttcatttctccctctacttccttcagagtattcatggctgtttgttagtatatgattttagttgtgattatttgatcaatttctgtctccccaattaaactttcagcttctgtgactgcaaaagactagatattttgcataccactggtttcctggatcctagtatagtgccaggatcatagtaactgaatattaaacatttattaagtgagtgagtgaatgcatgaatctatgtgagtgactgaatgagatacatctagactattgtccttgtgagataggttttgggttatctttaaaattgcatgagctcccaggtttaccatttacctaccatgtaatggacaaacgattcattctttaatgtttccattcagtcagtgttcattgtggcttgtcataatcctgaatgtgaatgaggtatttgtgatacagagaagagtaaggctgattctgggctgacggagttgctggtttagtgggagagatggtgaaatgaatgggcaaagacagttactgtggtaaattaagataaaggtatgtccagattggaacttggagaagaagcttttcactcagtctgcccttcattggggcttcctgaaaaaggacaatctgagctgagtcatgaaggctaactaagagttagatgcataatggggatgactgttccaggaagaatgaagcaaaagggttcagtacacagggaagtgggaaatcaaggctcactatagcaaactccaaataattcagtattgcagaatgagaaggcaagggtggggatggccagaacggagtgactgtggagatggacacagtcatatcacaaagggttctttaagccctgctgtgcattggactttgtcctgaagttagagcgtagcaattgaaggatcttaatcagagattgacataaaatattttattttataaagtttgccctgggtacaatatggagaacagattataaggcaataagactgtaggggagcaatatgaagaagcagttacttacccagcatgataagggctatggtagaagacatactccatgctctgggaaatcagaagaggagtgcctaacccagaactggaatctcagcctaggctaaagtaagagtttgaattatcatggtgaagaagctgggatgagttttcccaacagatgggggtagggcaaaggcactgaagtatgtcagaacatgactttcttcagagaactgtaagtaactttttattgttagactacagaatattaagggtaaattgagaaatgtagctggaaagcatctagcgttcaagtcttcctcctattaaatattgccttagactgggatgaccatactctttattatctccaccagacactttaaaaacttttttttatcatagaaacttttgaacatgtagcgagagtagtataattaacacccatgaacccatcactctgtcccaacaaccacccatgaccaatcttgcccttagccacatgccatttacttctccttctcatgttgcttaaagcgcattccagataccatgtatcttatacaaacattttcagtatgtatctctaaatgataaggagccttttgttaacataaccacaactaccaatatcatatctaaaatttcataatttttttatcaaatagcaaggttataatttctaattatctcacaaatgtcatgtaaacgtagatgtaaatacgaatattcatatacagattgtttaatcaggatccaaataaaggactgaaacttttttttttttttttttttgagacagagtctcaccctgttgcccaggctggagtgcagtggcacgatcttggctcactgcaagctctgcctcctgggttcaagcaattcttctgcctcagcctcccgagtagctgggactagaggcatccaccaccaagcctggctaattttgtatttttagtagagacggggtttgaccatgttggccaggctggtctccaactcctgaccttaagtgatctgcctgccttggcctcccaaagtgctgggattacaggtgtgtgccactgtgcccagccagggctgagacttttgaaagtgaaggaaggtactatccataattaacaggtatccatggagactttttacctaagcagggatgtgtcattatctacactggcttattccacttctttaatacctctgcagatacctggacgggtattttgcaaaatataaaggaagcctcactcatatggtcagttctatctatatctcttctattttcttaggtctctctgctccctggtgtgtaagtggacatattcagcagagaaaggctgggacgacagtttctggaaaatgattggtttggaagactttgttgcagataattacagcaaaataggtaaaagaataaaacatctgtagagtgattatgtgcattggaggatcttgatgggtttgttgttattgtggtttgtatgtttcttgtttttgtatgcatgaaaatacaggaatgaagttcactttttccaagacaaatgagttaattatgatgggtaggccatgactagtaggctcttgccttaagatttatatgaactgagtagagatacatgctatgaaaatctgcattgaaatatagaatcagaaattgcgctgggcatggtggctcacacctgtaatcccagcactttgggaactgaggcaggcagattgcttgagcccaggagttcgggaccagtctgggcaacatggtaaaaccccatttctacaagaaaaatacaaatgttagcctggcctcgtgcatatgtctgtagtgtcagctactccggaggctgaggtggggggattgcttgagcctgggaggcagaggaggttgcagtgagctgagatcgtgccactgcatgcagcttgggcaacagacagagcagaactctgttttgagggggaaaaaaaaatgggctagactgaggaagatatttgcaaggagcagcttgggaatagcatactcaaggggctgtgtatggactgcttccagtcagtactacgaaaataattttacaaattaggttcacaggacaaggcaaggctgtgaacaggtaaaaaataaagctaaaagatcaatattagaaaatctagaaaaaagcagaaactagaacgagtcagtggctcctaactaaggccttagggtctcagactaaggccttttatgtgggtggtaaagtacatcttctatgtcccaagcacatttctctgtgcttgtatgtaccttgttttatatatttctcacaactactgacaaaagcactgttgcatgtttacagatgagaatcagagagattagtaaccttgcctaacctggcatggaatcaataaatggtaagtcaggatcgaaattctcccaatgggaggacctagaaggaactaatattttactggaacacaaatttcagcttcagttacctaatggtttaagtgatttgtaaaatgtatatgccctccaaaaaattagttgttttttgctgaatattcccatggtatgttgttaaacatagctttattagtgtatatattgattacctgtatatgtgtcttgattcctcactagactgtgagctgtttgacataaggattttcacttatttacctttgtatttcctgtcctagcacaaggcatggcatattttcatatctcagtgactttttgattaaaatattgagatgcttggtactaggaggttggcactctttcctttaaaaatctgtaatgatatttactgattttaacattatctttggcaattgggtataacttcaactctgattttctgattatttttatatttttctgctcctctttcctgcctcacacatgacacatgtttaattagtatattagctctgctaacgtagcagtatctacaagaaatattcattagaagtccataatgttaatctagcagaaaatttccagagtaactttattagattttttccctgttaagttaatggatttttaatggatttcctaaggagacatatcattaagcagaatattgctgtacgtgaattagaacttacccatttatcaaaattaattgtgtgatgtttcctttgattttcgcttctggacacttgagcttgtagtttcagtctgaacccaaagtagaagatatttaagaggctgtttattctcagttgtgactttcagaaactcctctggaagctacctctagacattctttagcaattcttggaactatgaaagatgaatctcagaagcctccctatgaagtgttaaacatttccagtggcctcattgcccgtcaagatgtgggcaatatagtgtgaaaccttttagcagatttgagcattgagcgtcctggatttgagcattaatacaattaccataatttgctccatgtggagcttttagccaagcctttaccaggcttcctgggcccatgcagtaaataaatgctttccctgaaaactgaacacctcagcaactgatggtcttatggaggaatatttttaaaatgaattatttatgaagtgtaagttaaggatcaaatgcaatatttatatggtgcatttcaaggacaggagaaaaaatttacagggttttaagtaataacatgcaagtttctaaagctaaaatgttactacctaatgccttctttcaaggaggtatttggatggcttggtttgggaacattcacaaagtaaggaaaaatagttttgtgcatcaaaagaatatagtagaaatttctttacaattgaatagaaatttctttacagttgaaactgtacaagttgacttaatgttcagaattgatggagaaaaatgaaacagattttgggtaggagattatatagccctactgacaaaatgatctgtgttcaatgaaatgatccaacaaactgatctgtgtcaataaattttgacctttaattccacatgaataattccccagttacctatctaatcctaaacatctatcaaaagcaaacaggaaggaagagatcagcagggagaaaggaccttaggaagataagcaacatcccacctgttctaattgattatccaggtgccatttcagcatgccgcggttgcctttttaattcctgggaaaatctctttgttctactattggggtagcccactttatgaaaagtcgtgtgtgcaacatggctgaattatagagtgattatctgcattactaacagggtttgtcatataaagggattcagtgtattagcttatagatcattcctttatttgggaccagggaagccaggcaaagaaaaatgtaaattccaagtccaggaagttagtaagtgttaagtgagaggcagaaatgaagataaagggcaggagacagtttcttgagtggagggaggctgctttttaaatgggtttcctcgacccgggaagcacaaggggtgggggagatttccctttcctagacaagggaagccatgacagactgtatctggaaaatcgggacactgccgcccaaatactgggcttttccaacagtcttagcaaacggcacaccaggagattatatcctgcgcctggctcggcgggtcccatgcccagggagccttgctctcactgctagcacagcagtccgagatcgaactgcaaggtggcagtgaggccaggggagaggcttccaccattgctgaggcttgagtaggtaaacagagcagctcggaagctcgaactgggtgcagcccaccacagctcatctaggcctccctgcctctgtagaccccaccactgggggcacggcgtagctgaacaaaaggcagcagaaacctctgcagtcttaaacgttcctgtctgacagctctgaagagagcagtggttctcccagcacagtgtttgagctctgagaactggacagactgcctcctcaagtgggtccctcacccccgtgtagcctaaataggagacacctcccagtaggggccgactgacatctcatacagctgggtgcccctctgggatgaagcttccagaggaaggatcaggcagcaatatttgctgttctgcagtatttgttgttctgcagcctccgctggtaatacccaggcaaactgtctggagtggacctccagcaaattccactttatgaaaattcctgcagctgaggaacctggctgttagaaggaactctaacaaacagaaaggaatagcatcaacatcaacaaaaaggacatccacaacaaaaccatcatcaaagaccaaaggtagataaaactataaagatggagagaaaccagagcagaaaagctgaaaattctaaaaaccagagcacctcttctcctccaaaggatcacaattccctgccagctacggaacaaagctggacggagaatgactttcacgagttgacagaagtaggcttcagaaggtcggtaataacaaacttctccgagctaaaggaggatattcaaccccatcgcaaggaagctaaaaaccttgaaaaaagattagatgaatagctaactagaataaacagtgtagagaagaccttaaatgacctgatggagctgaaaaccatggcacaagaactacgtgacacatgcgcaagcttcaatagccaattcaatcaagtggaagaaagggtatcagtgattgaagatcaaatgaatgaaataaagcaagaagagaagtttagagaaaaaagagtaacaagaaacgaatgaagcctccaagaaatgtgggactatgtgagaagaccatatctacatttgattggtgtacctgaaagtgacgggaagaatggaaacaagctggaaaacacatttcaggatattatccaggagaacttccctaacctaggaaggccaacattcaaattcaggaaatacagataacaccacaaagatactcctcaagaagagcaaccccaagacacataattgtcagattcaccaaggttgaaatgaaggaaaaaatgttaaggggagccacagagaaaggtcacattacccacaaaggaaagcccatcagactcaccacggatctctcagcagaaactctaccagccagaagagagtggaggccaatattcaacattcttttgttttgttttgttttgttttgttttttattttattgtattttatttttttcttctattattattattatactttaagttttagggtacatgtgcacaatgtgcaggttagttacatatgtatacatgtgccatgctggtgtgctgcacccattaactcctcatttagcattaggtatatctcctaatgctatccctccctcctccccccaccccacaacagtccccagagtgtgatgttccccttcctgtgtccatgtgttctcattgttcaattcccatctatgagtgagaacatgcagtgtttggttttttgtccttgcgatagtttacagagatatagatcaatggaacagaacagagccctcagaaataacgccgcatatctacaactatctgatctttgacaaacctgagaaaaacaagaaatggggaaaggattccctatttaataaatggtgctgggaaaactggctagccatatgtagaaagctgaaactggatcccttccttacaccttatacaaaagttaattcaaggtggattaaagacttaaccgttagacctaaaaccataaaaaccctagaagaaaacctaggcattaccattcaggacataggcatgggcaaggacttcatgtctaaaacaccaaaagcaatggcaacaaaagccaaaattgacaaatgggatctcattaaactaaagagcttctggacagcaaaagaaactaccatcagagtgaacaggcaacccacaaaatggcagaaaattttcgcaacctacttatctgacaagggctaatatccagaatctacagtgaactcaagcaaatttacaaggaaaaaacaaacaaccccatcagcaagtgggcaaaggatatgaacagacacttctcaaaagaagacatttatgcagccaaaacacacatgaaaaaatgctcatcatcacttgccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggctctgttcacaatagcaaagacttggaaccaacccaaatgtccatcaatgacagactggattaagaaaatgtggcacatatacaccatggaatactatgcagcctatacaccatggaatactatgcagccataaaaaatgatgagttcatgtcctttgtagggacatggatgaaattggaaatcaacattcttaaagaaaagaattttcaacacagaatttcatatccagccaaactaagcttcataagtgaaggagaaataaaatcctttacacacaagcaaatgctgagagattttgtcaccaccaggcctgccttacaagagctcctgaaggaagcactacacacggaaaggaacaaccagtaccagccactgcaaaaacatgccaaattgtaaagaccatcgatgctaggaagcaactgcatcaactaacgggcaaaataaccagcttacatcataatgacaggatcaaattcacacataacaatattaaccttaaatttaaatgggctaaaggccccaattaaaagacacagactggcaaatatgataaagagtcaagacccatcagtgtgctgtattcaggaaacccgtctcacgtgcagagacacacataggctcaaaataaagggatggaggaagatctaccaagcaaatggaaaaaaaaaaaaaaaggcaggggttgcaatccttgtctctgataaaacagactttaaaccaacaaagatcaaaagagacaaagaaggccattacataatggtaaagggatcaattcaacaagaagagctaactatcctaaatacatatgtgcccaatataggagcacccagattcataaagcaagtgcttagagacctacaaagagatttagactcccacacaataataatgtgagactttaacaccccactgtcaatattccacagatcaacaagacagaagcttaacaaggatacccaggacttgaattcagctctgcaccaggcagacctaatagacatctacagaactctccacccctaatcaacagaatatatgttcttctgagcaccacattgcacttattccaaaattgaccacatagttggaagtaaagcaatcctccgcaaatatgaaagaacagaaatcacaacaaactgtctttcagaccacagtgcaatcaaattggaactcaggattaagaaactcactcaaaactgcacaactacgtggaaagtgaacaacctgctcctgaatgactactgggtaaataatgaaatgaatgtggaaataacgatgttctttgaaaccaatgagaacaaagacacaacgtaccagaatctctgggacacgtttaaagcagtgtgtagagggaaacttatagcactaaatgcccacaagagaaagcaggaaagatccaaaattgacaccctaacatcacaattaaaagaactagagaagcaagggcaaacacattcaaaagatagcagaaggcaagaaataactaaaattagcagaacggaaggagatagagacacacacacaaaaaaacccttcaaaaaatcaatgaatctaggagctggttttttgaaaagatcaacaaaattgatagactgctagcaagactaataaagaagaagacagagaagaatcaaatagatgcaataaaaaataatataggagatatcaccaccaatcccacagaaatacaaactaccatcagagaacactataaacacctctatgcaaataaactagaaaatctggaagaaatggataaattcctggacacatacaccttcccaagactaaaccaggaaaaagttgaattcctgaatacaccaataacaggctctgaaattgaaacaatatttaatagcctaccaaccaaaaaaaagttcaggaccagacagattcacagccgacttctacaaagaggagctgctaccattccttctgaaactattccaatcaatagaaaaagagggtatcctccctaattcattttatgaggccagcatcatcctgataccaatgcctggcagaagcacaacaaaaaagagaattttagatcaatatccctgatgaacatcgatgcagaaatcctcaataacgtactggcaaaccgaatccagcagcacatcaaaaagtttgtccaccatgatcaagttggtttcacccctgggatgtaaggcggttccacatatgcaaattaattaacataatccatcacataaacagaaccaaagacaaaaaccacatgattatctcaatagatgcagaaaagactgacaaaatttaacagtacataatgctaaaaacttaataaactaggtattgatggaacatatctcaaaataataagagctgtttatgacagacccacagccaatatcatactgaatgggcaaaaactggaagcattcccttggaaaactggcacaagacagggatgccctctctcaccactcctattcaacatagtgttggaagttctggccagggcagtcaggcaagagaaagaaataaagggtattcaattaggaaaagaggaagtcaaattgtccctgtttgcagatgacatgattgtatatttagaaaactccattgtctcagaccaaaatctcctcagctaataagcaacttcagcaaagtctcaggatacaaagtcaatgtgcaaaaatcacaagcatttcctatacaccaacaacagacagacagagccaaatcatgtatgaattcccattcacaattgctacaaagagaataaaatacctagaaatccaacttacaaaggatgtgaagtacctcttcaaggagaactacaaaccactgctcaatgaaataaaagaggacacaaacaaatggaagaacattgcatgctcatggataggaagaatcaatatcatgaaaattgccatactgcccaaggtaatttatagattccatgccattcccatcaagctaccaatgactttcttcacagaactgaaaaaaactactttaaagttcatatggaaccaaaaaagagctcacattgccaagacaatcctaagcaaaaagaaaaagctggaggcatcatgctacctgacttcaaactatactacaaggctacagtaaccaaaagagcatagtactgctaccaaaacagagatatagaccaatggaacagaacagagccctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttataccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaccaaaagccaaaattgacaaatgggatctcattaaactaaagagcttctgcacagcaaaagaaactaccatcagagtgaacaggcaacctacagaatgggagaaaattttcacaacctgctcatctgacaaagggctagtatccagaatgtacaaagaactcaaacaactttacaagaaaaaataaaacaaccccatcaaaaagtgggcaacggatatgaacagacacttctcaaaagaagacatttatgcagccaacagacacatgaaaacatgctcatcatcactggtcattagataaatgcaaatcaaaaccacaatgagataccatctcacaccagttagaatggtgatcattaaacaggaaacaacaggtgctggagaggatgtggacaaataggaacacttttacattgttggtggtagtgtaaactagttcaaccattgtggaagatagtgtggcaattcttcaaggatccagaactagaaataccatttgacccagcgattccattactgggtatatacccacggattatacatcatgctactataaagacacgcgtacacgtatttttattggggcactattcacaatagcaaagacttggaaccaagtcgaatttccaccaatgatagactgaattaagaaaatgtaacagatagacaccatggaatactatgcagcaataaaacaggatgagtacatgtcttttgtagggacatggatgaagctggaaaccatcattctgagcaaactatcacaaggacagaaaaccaaacacggcatgttctcactcataggtgggaattgaacgatgagaacacttggacacagggtggggaatatacaccagggcctgtcgtggggtgggggaatgggggagggatagcattagaataaatatctaatgtaaatgacaagttaatgggtgcagcaaaccaacatggcatatgtatacatatgtaacaaacctgcatgttgtgcacatgtaccttagaacttaaagtataataaaaaaaaaacatacaaacctattatacttttcccttcttaaatttatccctttctttgatcttacatttccctgtaggctacatcttgttactgtaattccttttattatagagttactacaataattgtcttttactgcctctacttcctatgatgacattacagttacactttcttccccaccactgtactgaaattaaaaaaataataataaaatggatttcctccatccctatgagactgtactttgggtgtcagatgacaaaaacacagtcacttggcacattttagatactgatgaaatattcattgaatgagttaatatatgtttgaattaaggatttgattttttttaagtcccttgttggcttcaattgtttctttcttgttttttttgttttgttttgttttgtttttttttgagatgtagtttctctcttgttgcccaggctggaatgcaagggcatagtctcggctcactgcaacctctgcctcccggtttcaagtggttcttctgcctcagccttccgagtagctgggattacaggcatgcgccaccatacctggctaattttgtatttttagtagagacggggttgctctatgttggtcaggctggtctcgaactctcgacctcaagtgatccgcccccctcagcctcccaaagtgctgggattataggcataagtcaccgcgcccgactggcttcaattgtttctaaaccacaatggactttcgtaaattttttgaattaaataatactactagctaacaggcaatgaatgtatttccttaattcagtgttcactgtcatctttcatgaacaccttctacataagacgggtccctgcagaagatacaccctatgttgagtgatagtgcaattctatttcattcctgtagcaaatctctcagagacttttctatcttaggaaatatcacagactccttcacagaaggaaaacaagaattaatcttagaaaggttgggcatttcactttttcatagagtaaaataaactgaacattaaatgaagctacactttagatatttttgtcatgtaggctaaaaatttgtaagtaaagaatcttggctgggcgtggtggctcacacctgtaatcccagcactttgggaggccgaggcaggtggatcatggggtcaggagatcgagaccatactggctaacatggtgaaaccctgtctttattaaaaatacaaaaaatcagccaggtgtggtcgcgggcgcctgtagtcccagctacttgggaggctgaggcaggagaatggcgtgaacatgggaggcggagcttgcagtgagccaagattgcaccactgcactccagtctgctccactgagcaagactctgtctttaaaaaaaaaaaaaaaaaaaaaggatcttgactaatgaactaatgataggtatatgctggggacataaatgtgccagtgaacagagccacctcaggcaagggtgcagtattggctttggtcacactgaatcaaagttcagggatcttctgcctcttgttggaatctggctagactttggaacctgcacaatactgacttatccacccactggctggccaagaagctgagacaaagagaaaagaagccacctatacttgcctgaagcaagctgcacttgatcagattgattcatgaactcagagcccacaggcctgagtacaggtggctcaagaagaaagtattagttcttttctgctgctataacagaatacttgaggttgggtgatttataatcagcagagattaattcagctcatggttctggaggctgcagtgcccaagggtgccgataacttctgggcatctgataagggccttcttgctgcatcatcccatggcaaagggtgcaagagtgtgggactgcacacacaagaatgagagagggcaagagggggcttggctttatcagaagtgcctcctaagacaatggcattaatccattcatgagggcagagccctcatggcttaatcacatcttaaaagtctcaccttttaatactgtcataatggcaatgaaattttaacatgactttttgttttaatatgctgagcttttattcatatttttttttaacttttaagttcaagggtagaagtgcagttttgttacataggtaaacttgtgtcatgggggtttgttttacatattattttgtcacccaggtattaagcctagtacccgttatttttcctgatcctcttcctcctcccaccctttgtcctccaccctcccaaaggacccagtgtgtgttatccccctcattgtgtccgtgtgttctcattctttagttcccacttaaaagtgagaacatgtgatatttggttttctgttcctgtgttagttgctaagaatgatggcctctagctccatccatgtccctgcaaaggacatgatcttgttctttttttatggctgcataatagtccatggtgtacatgtaccacattttctttatccagtctaccattgatgggcatttaggttgattccatgtctttgctattgtgaacagtgctgcagtgaacatacatgtacatgtgtctttataatagaatgatctatattctttggggtatatacccagtaatgagatttctgggtcagatggtatttccatctttaggtctttgaggaatcgccacattgtcttccacaatggctgaactatttcacactcccaccaacagtgtatcaacagcgtttaagtattcccttttcttcacaacctcaccagcatctgttattttttgactttttaatagccattctgactggtgtgagatggtatctcattgtggttttgatttgcatttctctaatgatcagtgatgttgacctttttttcatatcaatatgacttctgaaggggacattcaaaccatcacagagatacatgccaagccttcatgaactccacttcaggactgtggccccacttcccatttaacacggcctcatggatactattatacaatcttttcagtctcagggatccagctaagtgattccttctcccatggatggaataagggagattataaaagcaggaaatgggagcattcacaccaatactacctcattttaggggaaagaagaggaaattcccttttgtaaacaaaccatagaggtttccaccaacaacatgcattatgtccagtgctggaagcctgaatccagtgatgccatccatagttgtgggtgttgtaaaatccttttagagcaattaatattcaatgttctgaatttttccagtaaaagtggacatgtttacaaggattcatgtcttcattctttatagtgtgtggcttgtttttcattttgatttgaatgagccatataattcagttatttctgtcctcagagctttgctgaagtgctgcttcatctttgtatcatgtgatataagtgccaattttactaatttatattgagagctctggagaaatctttaactacaggtaatcccagccttttctaggttaaatggggcccatcacaccattacctcccctctcctgagggaggcttatatggtttgcctctgcatccccacccaaatctcatctcaaattgtaatccacacatatatcaagggggagacttggtgggaggtgattagatcctgggggctgtttccccaatgctgttctcttgatagtgaaggagttctcagagatctggttgtttgataaatgtttggcattttccctgcttgttcttgctctctcctgccttccttccccctctccttccaccatgattctaagtttcctgaggcctcccaagccaggtggaatggtgagtcaattaaacctcttttcttcataaattacacagtctcaggtatttctttatagcaatgtgaagatggagtaatatagaggccatccctgtgggtactctggactgagatttgcttttgcctgtcaccctgagcttttgatcttaccttatcctcttattatccttctcttccctgtctaagtgacagaaccaggtcttcacagtacttgaaggcaagtacctatcctctgagtattgatgccttattttactctttagtatcgaatttctgcctgataaagaatgacttggaggtctccatgccagttagccatccatccagtcatgcatccagccaaccacactccccaagtgtctcctgtgtgccaggtgctgggctaagtcctagggatacaaaagtgaattcatcatggtctatccctttggggatctcatgtctactaggggtaggggcaggtaaatgaatcagtaatctcaaggtttttcagtaactctacagatgtccaagatgccatggagaagcagagcaggcagtcactggcactggtggtggtatcaaggaaattttctcatgaggtggcattttatgtgtctggaaaattggagtggtagtgagaagtgacagcgtgctggcagtcctcacagccctcgctcgctctccgcgcctcctctgcctgggctcccactttggcggcacttgagcccttcagcccgccgctgcactgtgggagcccctttctgggctggccaaggccggagccggccccctcagcttgcggggaggtgtggaaggagaggcgcgggcgggaaccggggctgcgcgcagtgcttgcgggccagcgtgagttccgggtgggtgtgggctcggcggaccccgcacttggagcggtcggccggctccaccggcccagggcagtgaggggcttagcacctgggccagcagctgctgtgctcaatttctcgaggggccttagctgccttcccgcggggcagggctcggaacctgcagcccgccatgcctgagcctccccctgttccgtgggctcctgtggggcccgagcctccctgacgagcgccgccccctgctccacggagcctagtcccatcgaccacccaagggctgaggaatgcgggcgcacggcgcgggactggcaggcagctccacctgcagccccggtgcgggatccactgggtgaagccagctgggctcctgagtctggtggggacatggagaacctttatgtctagatcagggattgtaaatacaccaattggcactctgtatctaggtcaaggtttgtaaacacaccaatcggcaccctgtgtctagctcagggtttgcgaatgcaccagtccacactctgtatctagctactctggtggggacttggagaacctttgtgtggacactctgtatctagctaatctggtggggaggtggagaacttttgtgtctagctcagggattgtaaatacaccaatcggctctctgtatctagctgaaggtttgtaaacacaccaatcagcacccagtgtctagctcagggtttgtgaatgcaccaatcaacactctgtatctagctactctggtggggacttggagaacctttgtgtctagctcagggattgtaaacgcaccaatcagcactctgtcaaaacagaccactcggctctaccaatcagcaggttgtgggtggggccagataagagaataaaagtaggctgcccgagccagcagtggcaacccactcgggtccccttccacactgtggaagctttgttctttctctctttgcaataaatcttgctgctgctcactctttgggtccactttgcctttatgagctgtaacactcactgcaaaggtctgcagcttcactcctgaagccagcgagaccacgaacccaccgggaggaacgaacaactccagacgcgccggcttaagagctgtaacactcaccgcgaaggtccgcagcttcactcctgagccagcgagaccacgaacccaccagaaggaagaaactccgaacacatctgaacatcagaaggaacaaactccggacacgccacctttaagaactgtaacactcaccgtgagggtccgcggcttcattcttgaagtcagtgagaccaagaacccagcaattctggacacagtagtttaccagaaaagaggggaaatggcttccaaggcagaagaaacagtgcaggcacagacatggaggcatggaagagtgcagagtgtgtgtgaactgttgggtgtggccagagcatagtggacctgaagcaaggtggagaggagtagttgtgggcaagatagagtttatggggggctagtttctgatggaacttctaactttcctcaaagatggggccaccgattagagactcaacatggcaggagtcactctattcctttcaagagatggttctaattactactcctgccaatgcagtaaataacacttgagggcagtaggagccattttagaatatttgtggctcctatgaagctgtttgtgtgtcggggcaggtggcaagcccatttcttttcttttctaaagtcacataccttgccccttagctatcctcccttccataaaggtttgttgtgaagctggaatgtgatatcagatgtcacagggcagtgtggtttacgaagcctgtagaaatgttcttaccaactgtaagtacaccttggcacctggaggacaagaatattcactcctgcatcactctgttccaactgtgttcacactccttagattcgcagaaggactgttttcagctgctggcccttccaggaatagccctaaagagccagaagggcaaaggagtaacattgaccacatcatggtgatacaaggtaataactttcagaggttttgctgtggaaatgttcctcctttcaatacggcatctgaaagataattggaagtcccccaaaagtgaggtcacccccaacttctcttcctactgctggagaatcagcgattgtcagagctgaaagggatcatagagattttactgtaatgcactcattttatagacaaaaaactgagactcagggatgtgaggtgaatttccttggtcctgcagcattttaatgacagaaatgagaccagaaaccaggtcttctgactcttagtcctgtggtggttctactccttcctgccacttctcctgtttgagttttttggcaatgtgaggacatttagccaatctggatactgacatttgaatgaagctaaccactagaagaatgtcaaggagggaacgatttacataggtaaatttacccaatccattgtccaatcttcagtcatgcaaatgtaggaactggactttgcccaagtcagagacctttggatctaggaacacactgatcaagcccttaagtgactgatgtagataaacgagaataaataagtaataagttcacagttgcctatggtaatagttaagagattggtcaccagggtcagatggacttgacttcaattctgactgtcatctgtaatgaaatttctgccatatgtaactttgggtgagttacttgatctttctcagcctcaattagtatattatgaagattagtaagtatatcatgaggatgaaaggtaataatgcaggtaaagttcctagcatacaataggtcttcagaaaatgaaagttcttactactataatgattgtccattcctctgaattcagatttctctctaggtgatagattatctgccaaagaccataaccccttgaataatcccaggtaattattgccaacttctagatttggaatttttccttttttctgagcttcttccttggattcacacaacctttttccaaccaagatacaataagattaattagatttctgcttctaaattataatcacatttcataatcacaaaccttccttgagaggcatcttaattggaattaagggttttcctgaattcgtcaggtccacatgactggcaatctttagctttttttccatgaatagaggggtgcatatccacaggcaaataaaaaaaatacaggatatgttggttaacaattaactagttaattaataatggctaatgttcctacagtgctttacaacttagaagagtttttcttttcatgcactattgtgcttttttcttccaccaaacttgtaaaataggtttgatttcagttttacacttggggaagccaggattgatgagctttggtcttttccatctcagtagaaggtgtcacaattctccctgtcattcaggacccaaacctagaagtcattcttaatgcttctcttcttcctcttacaccttacatttaatccatcaacaagtactttctgctttgctccaaagtggacccggaatgaggcattcctgcccctcttcactattagtatcgtagttcaaagtagttttatttcttgctggatttgtgtgctagcctcttaaatggtctccctgtttctgtccttccctctgataatccattctccacacagcagccagagtgatattttaaaaatgtaaatcagatcatgttactctcctgcttaaattcctccagtggctccccattgcagctgggaaaaaaataactccttgccatgttcaacaaagtcttgcgtgatctctgtctgacttttattgcttaccatgcccccacgtagtcaccatccaaccacaatgaccttctttttgtccctcagacatttccagtgtatatagcttttgcgttaactctgccttctgtctggcatggcccttctcaaaatattcacatggtctacctctttctctttgttcagatctcagcttcaatgtcatcagagaagagctttcccttaccacccaaacactctcttctactccagcagtattctgtttccctgttgtattttattcttaacactcatgactatccaaaattaatcagtcttgtctggatgctttataggtattaactcgtttaatgcctttaaccagtctagacaggtactactatattcattttactgatgaggaaattaaggaaaggagaggttaagtaagttgctcaaggtcacacagtaagtaatggaatcagagacaggtctgctccagatcctgcacatctgtccatgtagctgcagtctcctggcctgggctgcgctgatacagctgcagttctcagactaagttcaacaagagtcccagtcctagtccagtgatgcctgaagtcacatgtttcattctgggcctcacattcatgaagaccactgacaaaaaggccccagggccccagatgaaaaacataatttaaagccagtgaatttgagaagcagttgagcagttttgggttttctcatcaaattacctgcccaatgtcaaaatattagtaaattatagatctagattttaattgagtgttgtctgacattcccttcctcagtgctgacttgagattactcaagatgacagaagaaaagtgctgcctcagaggttctttcctccctctctgtctttgaaaaagcacagggagaagagggctgaagatgtgactgtccagtaattggaaccatctcggctcctctgaaattctaggagaagaataagtgaacagtatgatatcttgcaaagcttcatgtgccttaatcacattaaaattcacaattcagttttggatttatttttccttgttttttgaaagttattgacttgggacttgcttctggatctcagttggacatctgacctcatgccattattgtcatccatttagaggtcatttatttcagtgttcttgaaaggcagccattcccagtggttggccttctctattgcatgtgacacatcgcagctcttctgcttagcttttcttggtcacacagctatcaggtggtgactttggcctccaatgtggcccttacctctgactttgtagctcctctgcagtactcttcactctggttctgtggagttttgactccgagatacccatgaccttttaagtttcccagcaccagctaacctttctgagaatctgcatcagagggctgcagtggtcagggtggcaggtcaccagttgactaatggcctcctccaaggtttgctggcagacactgcgttgccatgaaccctattgatcccagaagtttgcctgctgcttagacagtctttgcgggcgtgaggaggtagtgagtcatggagccaccacccctgctacccatctgttcttgtggtgaggagaacaaagatgatctctttgtggtatcataaaacctagaaagacattaaaaattccgttaaattttcatacgcttttagctgttgaaatgtacaatctattatgaggggggaaaaacccactgtaattttccccccactgcccttacttcagaggctacttaagggaccaggtaatgattttacgatgtttattaatacttcatgttctgcttccctcccccattcatttatctttaaattgaaagcacagaaactgccagggatctttaaaatccagagtttttgcaatgtcataggttgttctgttatggatattgtatgtagagatctattgttgactcagagctggggatggggttgggggtggtatttatttttaaaatgcactttggagtaatggaaataacatgagttttggagccagatatacatgagtttgaatcctggccctgccatttactacctttgtgaccagtatcaaacaagttacctaacctccgaaggccactcagttcaaccacttgccagattgggaaagtaatacctctctctgagaatttggatgacctcaaacagagacctctcaatgcaggcctcgtgggaacaatcttatcttatccggatatccagataatttttagtttttcttagttgttctgagtaattacttttattttctctgtctctcgtgggtatcatgtggagtaactgtcaagatatccctcacccctttggttgcttgagaattgacagcatattgaagcctcatctatagtagatttataaactatggtataaagctataacctcacctcaatttattttgttcccatgtttggtttatttaatctttgatcccacttacctcattttatatttgcctactagttataagctgtctgaaacattttataacatagcatgtagaaatatgtctggaacatagtaggtactcaatagatatttggtaaatgaatgaataagtaagcattagagatacagatacaatatgtttcagaggataattaaataaaagagggcaagataatgagtttgtgcctttgagatatccaaataaaaacatagagtagacatttggatctatgctaggaaaaaaggctagaaatagagatttggaagtcataagtgtagatgatatttgaagccatagatatgtgtgagagactctagagggagaagagaaatttcagtactttagaggccaggtagaggaagatgtgcctgcaaaggaggctaaggatgtacctgccaagggcagggagataatgaggagattttacaaggggagggaacaatctccaaggatgctgaaaaaggaagggagataaggactggacactgttcatttgatatagtgactcggggaccttagtgaaagtcacttgcttataatagtgaggcagaagataaaagtcgtacagcagccacagctaacactgagcacagatgctgtgccaagtgcttaatgtggactgttacattacaacaacatgagatgtgtagtcatctcaccccattcccattttttacagaggataaaaatgaggcataaagaagttaatcacccaaggtcatatagctgggttcaagccaagacaggtgtcaggactcagagtcacagttgagaaaatgaagccagaaagtttagataactcaagaaatttggtcagagtgtggggggagagagagagagatggggtggtcactaggggaggaagacggttggaaataggtagagtgttccactgtttggttgattgattgttggaagatggagatttgcttgagcatgtctgattgctgataagaagattctagtagtgagtgatgggttgctgatacccagagagaagggagaatcagtactgtgggtccagagaagacaggcaggattagccttggaatacagactttctattttaataggtaggaagaagacaaaaatggtacagctcatgggagcagcatgtgctcggaagtgggaagttaagggatttcccttcatgaggcttctgttttctttgtgaagtaaaaagtgagatgatcttctgacagagtggtagccaagtgagagagtcagaatctgtaaaaaatggaaaaggtttaaaatagaagtacagaggatcggggaaaagatgattagagaaatcttggaggattatcaaacggtacacagaaccctgcttaggggtcgccatgaatttattataaatctgccctgtggtgtgattttctccagcagcactcagcatctggttgtaagcacacaggaaagggttgttcttttgttttattaatcttaatgaatagcagtagtctgttctgcaagtccttgacaccaccctcttttctatatgctgtatctaatctgttaccaagtgctgtcagtcttaggctccaaatacgtctataattcatgaactctttccacctcaaaatgctacctagcctgtgttcccataatctcgcaactggattattcaacaggcttataacacttgtcattgaatggaaacttgcctttttcagtccatcctgaacactgcagccagcatgaactttttataatgaaaatctaatctaatcctgtgacctcccagcataaaccttctcaagtcttcccaatgcttttagggcaaaaaccaaaaacccgaattatggtctcccctccttctggcaccactgttttcattgatctctgacctcagttgccctcttttggttttctgcacacgacacccttctcaccgcaagatctgctctcatggtcttgttttgcttccagtatcgagtccatgttccaggaagaaggacaaggacaaagggcaaaagtatggactttgcttctgttccagtgttaactctgaaacctcactcggtctcttctgcctacatgtcaatggccagaaccgtattacatactactacctgcaagggaagctggggaaaggtccattttttgccagtcacatttcagccttcaataaaatgagagttgtgttatttaaaaagaagaggaggaggggcactaggtaagcaacctggagtcccaccttcaatgaggaagtgttttctaggtgaagagttgagtgaaggagatgctgacagaagtgacagcatgaatacagtttagtgctgagcaatatgatgtgggaagaaggtgctggaacactgagtttgaggcagggaaaagggagggaggaaacagagaagtaggcagggatcaaaaaatcataatgcccttctattccagctgaggaacttaaacttcatcccgtgtgttagcctctaaatgaggtcttatatgccaggtgatgtcaagcaagatggtctactgggtatagacaaaaatgttggtatttttatttatctccatttttatttcattttgtttaaattctatttttaggtatgcatcttgacatacacacatataatttataagttcaatagtacattatatacaatttataagtaatagctatgttgggagtccatctgaagacttttttcttagtgacttgcacagtcaaaatgtttagaaactattgcattaggcatcagggaactgttaaaacattttaaacaaggaaatgatgtgatccaaattgaatatggtccaatttgccttttctttcccctatagagttctttaaatttttaaaaattttagaatgttagtacttagaaagaaacattagggagcatcaaccctgtgtcataagtaagataactgaggcccaggaatattaaataattagaaccattaatttgtggctgagctggagccccatccaacctgggtctcatcttctcccagtggtcctttgtggccctgtgcgagtgctttctctcttcctgaatgcatgtccctattcttcagcaaatactcttctcatcagaattatgacatgtgggaatcaagaggggagtaaaagggcatatttataaaaaacgtggaaaccaagaaatctgttttgtaaaaatgaatcacctatttagcctcagggttctgttgactctttagctgtcaacatggaagtctctaggtaccgattcctgcaggttctgttttcataatgccagacccatcagcagtttaactgagacataccgttgtacaatgtcattattttaggtattgtatttgcaaggccagcggtctaagtaagagattaaactgaacagatttctgacttggtaagacagagactttctaaggggtacactgccccactttatcttaccccagtgtatatgaagaaacacatgtttacccatgggaatgtgtatgtatttggatctatttcacagagtatcttataaaaaccgacatgaaaagaaagtctgatttatagaatcctatttcctgacattgtgaatactagttcaggactttgctaactactttttgaccagtgtgactgatttatttccccatgccatcatcaacccagctatgcaagtacaggaagacagggtatctaataaccagatggtgaacaagatctgtattctcttgggtatactaagctattctgaaaattcagtttataggggtacagactaagggttatatatctccaaacaaatgtgtttgtcaagttgatgatcatgtttaccaagatccttttatcaccagctgagtcctcttttagtggcttaggtcaccctggaattatttcaaaaaccagcctgatgtttagaacctcctgtgggctcgggcttgccagacacaaacctaaaatgaagcctgtagccttcatggtagcaaactgtaacctcaagcacaattatatgaatcatggacaaatgttttcactttcaagcaagtttttgccgcagcaaaaatgaccacttatctaagaggctgcatatttatatatatataaacagtttttggacataagaatcttgactattatttcccacagagaattacagatttatatatgtgtgtctatgtgtatatatatgtgtgtgtgtgtgtgtgtgtctgtgtgtgtatatatacatatgtgtgtgtgtgtgtctgtgtgtatatatatatatatataaacaccatattctgtgtcttttatatatagtatcacttgattattataattaccatgaagtgccattgttcttctcattttataggtgaggaaactgaagctcagagaggtgaaataacatcacaaagctaagaggttgtaaatttggcacttttaaaattatctagttattacaaaagttgatcttcagatcaacaaacttaactgacatttcctttttgggccccattttctactctgtgaactgaggaggattgaattcagtgattctcaaaccagagcatacgtcagaaccacctggggggattcttaaaacactgattcctgggcctgcttagagtttctaaatcagaaattctctggagcgattaagaactggtgtttccaataagttcccaagtggtggttcccagccacactttgagatccattggagtagatgatctctcagtgtcttccagctgttacatcctggagggtcagcaacctgccatacttcattggtgtgtgaccaaaaatactgcttcttcatggagtgactttcctactacttttgccaagtttgttggttagccaggaaaattctcaacatgaatggaggaaaatgctgatgaaaatcactccttcctgtatttattaactcatttgccagactaatatttactgagtataccctttgcagatattgtgctacatactggagatagcacatgtgaagatactcagcccctgcctgcgagatgcctatcaactatggagaaaacagatgattaatttattgttattactaaaagggaagtgctgagacctatgagaataaaatacttctctaggatttgtgattatgacttcaaacttttcctaaacaggactattttctactgtggtcttaagtcataaattgtctattctctgtatctagttcgattctgttcttagctttttgaggtatttctttattgggacaggtcagtaagtggcattttcatttattttttaccaacctaagcatttccttcctgccctagatgaaaacttagctttgttcaaaatttgcattttcatttttagcctatggtgacagtttaaatcaacagcaaaagcagaaacccttgtctaaagcaatttcctcactgttattccaacttcagtgaaatgagaagtcctggggagatgaattcagactgtcttctctactcccaccccttctcctaacagtttggcttcttgaaaaaaaataaaagatgaaggaagcaggggtcttgaagggaagatgtctactgtaaaaaaaatagggaaaggaaatagtgtactgataatggttatcatttgttgagtgtgcattatatgccagggactgtcgccaaacattgtacatgaattagcaggtaaacttccccagtaaccaatgaggtacaggtaccattattatcttccttttacagatatggaaattgaagctcacagagggtagataactgtcccaaagtctcatggttatttgatggaggaacaggaattcaaaagcaggcctgactccaaaatctcatgctttttaccagtaaattagatctccagtcatttcaatccctgcatttttcatagggatggtgctgactcatttggcttcctggttttctgactcatctcactgaacagggccagatccgatatgtcttctgcattctcccttatatcatctttctccctgctcccttttctattatggtccacctactctatcatcttctttccatgggccttaaaggaataccttcttgtggactgtctctgtgatgcagtagaaatctggtaagcttgccagggtgtaaaaagtgcatttgtttaggactgtaatgtttatttgaaagggactttcaatcacagacatgacttttttatgagcctcattatatatccttgtgattggaaaaatgcatcagtaaataatgcctccatgaagagtcactctcacttgcattattttaaaagatttggtaataaaaagtactcagattattgataatccataattaatatgaagtaaataatgtgtgttttcaaataaaattcaccatgataagtgatgagagtatgggcttttatatttctttgtaagtcagagacttataaaagataggttatccatcactaaggaatatgtagacacattaattttagcattcagttttttttctctcttttctaaaaaacatgattctattcttcaaaagaaagagtggttttattatttttccagctctttaaaatggttcaaaaatcttggcctgcagacatctttttaaaaaatcaatttttcaataatttagagtgaatcacacccataggggggatgtgctttcaaaataattaaagtagaggaggcaggattatagatcttgagaaaatgtgcttggaaaatgtcctttgatttgttgtgaaccccaaagctttgaataaaataggataggactggaatcaacttctgaactttctcactagctagtggcatgttaccagtagtccagagaatgctgaatgcccatctaatctacactgtcatcccttttattaacaaaacttaggcttttagggtacatcagggtctttcattatagactacatttcccagctccctttgcagctacacatgttcatctaagttttggccaatgaggtataagcagatgtgtcctgtgggattcctgagacgtctcctttaaggagatcaggcagtggccatcctctttccctcccctgggtcaggtagattggctggtcaggtaggttagcagtgactttggataagggggacagacgccatactccagggatggcagaacagtgagcttttgtggaacttccataccagccttggattcactacctctggactttgtttgtatgagtaggaaatttgtttatttgtttttgctgttgtttttgctttattagaaaatcactgttttgtagatttgtagctacacttaatcataactaataaaaatggtgactcataaggtttgggaaaacaacagttaaattaaggtagtaagtttagctatcattattgagcacctactatttactaggaactgttctaagatctttatttgtaatagctcacataactcattcaacagtctttctaagagacttacccccattttacagatggtcagtcacagagaggttaaataacttgcccaagatcatacagccaagccaggagttaaaatcttcagtctatctcttaaactttctgtaaatcactgtgatgaagtgacttgacaacattctaaaaacaagtaaaactggacctaaactccaacttttccctatgtaggatacctgtctcctagacttgttgctaattatgttagttggcctctggcacatcacttagagcccctgtgcctcagacttaacactaataagaggcatgggacaatacctcaccattgtttagtatccattctgagcctggcactgtgccagacacacagatgtgtgaatgacagcgcacccagagggagaccatgcgttggtcaaggagacaaggcctgaacacttaagaagagccaaggaacagcaagggaaatgcagaaccacaatgtcactacatccaggagggttcttggtgcttgatatgtggctagcaaccagtgaacatccctggaaccaagtggcaatgcatgttaagtgccctgtgagcaggcagaaataaatgttttgaatcaaaagaggaggggagctttggcatctaaaggattcagggacacatggtgagtgctttggttcatgttggttgtgccagtaattgaaggagtcttgtagttggtaagatttggggaggtgatgggaagttaggctcttcccccttctggctttctctgccccagggctaacagggctagttcctggaacaccgtctgtgctcccctgtcttgggtcctacacacagctacctacctgtcagcttgggatgctttcccagcctttcatcctagctaccttcttatcctcctggtctcagaaaaaaatgacatgacctatatggagtctctcctaagtagaccacatcccacttacttgctctactgtgtggtgaaatcccatcaaaatggaggatatggttccaaagtcagtgcatactgtgagcagtgaatcagccaagagaatccttgaaaatccctgagggagctatctccacagtggaaactgataagctatctccagtaagtctaacacattaattccggtatttcttttttccctgttcgagatagctgtcctattttaaagtctaggttgtatgaaaaaaatctaggttacatgtagccaagctataggttatacactccaaggagtctcatgtacatagaccatgatgggagtgacacacccctgaggtttttcagtgtatatagaactgtacatagtggaggtattagggtcagatgtagcaaaaggagatattcacactaaaagaaaatagaaaccgaagccaacccagggaagagctgatttacactccattctcgggttgagctccctgtgtaggatggtgaaataaatcacttgcattatttatattgtttaatttctctctgcatctccttcatttgcttcctgaagcctatgtacagttgactgtgtgtgtctatctctgcaaactacagatcttcacttcctattataacacttatcacatttgaatttttcatggattgtaattatgggttaaatgtgcctgccagattatacattccatgagggcaggggccatgtccatctcattacctgctgtggcccagcacctgcatggtacctggcacacagtctttccaagcagttctgtcctagacattgttgtggctttcttctcacccgccttcaggaagatccacccaacttctttctcagttactcagcattaagatctgtagttgctgaggcactcagttaagcttagggtggagctaaaacctgcctgggctggtgcttctctgatacagaaacccctgaaactgatgattatccagaaatacttgatctctttgggggcctgaggagctttggaccaccttaactcatcacctccttaagctcccctacctctaaatgctcttctcaccgctcccactcccaccccctcccccttgccccaaggctcctcctcagcccaactaactgaggctctttcacaatcctaaaagcatcatctttgttttaattttttcttttatcttcaaaagcatctaaaagtaaaaacaactaaagaaaagccagaaagtgaatgaagcagaaaaacaatttcagcactctgatacagtaccccaaaacaattttagttcactttgcctttttttgtgccattttaacgcagttgaaaccatgccgtatatgccagtgtgtagtctgcagttttaaggtgacattattgcatattcatattttcatgatattctttagaagcataattttaataatgccataatattttattgaatgctgtaatgatatttttaagccttctattaaggttggacacttaaatgtttacctttttttctctagtatgtaaatattatggtacaaatacacaaaaatactgcagggaacctttttattttctgcatctgacagactcgcagaaatggaattactaagtaaaaaatacaaactctttaaaatagatttttatttcaggtgatacttaatgcatattaagtgtaaaaaacttagaaaatacataaaagtatttcatccagcatttacctccaagagatggctaattttttgtatattttctgtctttttgatgtatgtgtatatgtgtgtgtatatatatgtattatgtatatattatatataaatatgtattatgtatatattatatatattatatgtatctataataaaatttatactgtattgatatattcatactatatatgtatcattactttacacaattgaaatactttatatgcatgttgttaaaactcttcaaatatacagcttttaatttactgtgtaacgatttttaaaacaacacttttcttgtatcatttaaattttttctgatttcttctattttgttgtatttgtatacataccttgtcagcattttatgttattccttaggatggattccagtaatggatttaccaagtcaaaaggtataaatttttaaggctcttggtgtatattgtcaagtttctttccaggaagattttgccaaattgcatttccaacagtccataagattataaagcaatggaaaatagcatgtcctttctgttttaatttctatcttattaactcttagtgaggttgagctttttccttatatgttattcatgtatatcttcttttgtgaattgtctagatacttaaaaggctaagaatatttggaggttatttttaaaaaataattttttatttttaattgacgttttatacatatttagggggtacatagtgatgtcacagtacatataatgtgtagtgatcgggtcagtgtaattagcatatccatcatctcaaacatttgtcatttctttgtgctagaaacattcaatatcctcctaggtatttgaaaggatatattattgttaactatagttattctacagtggtatagaatactagaacttattactcgcatctagctgtaattttgtgttttttaataaatctctccctcttcccctcttccctctaccattctctgcctctaatatcctctactttttacttctatgagatcaacattttttagcttcaacatgtgggcaagaatatgcagtgtttaactttctgttcttggcgtatttcacttaatataatgtcctccatttccatccatattgctacaaatgacaggattttgttgtttttttatgtctgaatagtattccattgtgtatgtatatcacattttctttgttcattcatctattattggatacctaggctgattcatatcttggctattgtgaacagtgctgcagtaaatgggagtaaagatatgtctttggtatactgattttgtttcctttggataaatgccccagtggtgggatcagtggatcatatattagttctgtttgtagttttttgaggaacctccatactgttccccataatggctcttctagtttacattcccaccaatagtgtaagagtcctttttctctgcatcttcaccagcatgttaattttttgtcttattttgataatcactatcctaactgggataagatgatatctcattatggttttgatttgcatttccctgatgattagtgatattgaacattttttcatatttttgttgtccatttatatgtcttcttttgagaaatatctgttcagatcatttgccttttttaaaaaatttatttttaggagacgggatttcactgtgttgcctagactgtagtgcagtggcacagtcatagctcactgcagccttgaactcctgggctcaagtgatcttcccacctcagcttcccaagtagctgagactacagatgcacaccaccatacccacctaattaaaaaaaatttttttggacagggtcttgctatattgcccaggcaggtcttaaactcctggcctcaagcaatcctccagtgtcagcctcctaagtctctgagattacaggcgtgagtcaccatttgccaatatttaaatcaggttggttgtttttttcctgtaccaatggttgaattctctgtgtattctggatattaatgtcttgaccaatgaatagtttgcaagtattttctcccattctataggttgaattttcactgtgttgattgtttcctttgctgtgcagaagcttgttagtttgacataattccctttttaaaaattttttcttttgttgcctgtgctttttagatcttattcataaaatattttccctggccaatatcctgaagcatttcccctatgttttcttctagtagttttatagttgcaggtcttgtgtttaggtctttgatccattttgagttgttttttgcatagagtaagagttgggagtctaacttcattcttctgcacatagatatccagttttctgagcaccatttattgacaagactgtcctttcaaagcccagtgaatgctgttggtgcttttttcaaaaatcagttggctgtagataggtggattaaagtctgtgttctctgttcttttccattggtctgtgtgtctgtttttctgccaatactgtgctgttactgttttggttactaaagctttgtaatatactttgaagtctgaaaatgtgatgcctccagcctgcttgcttgcttgcttgcttcctttcctttcctttcctttcctttcctttcctttcctttccttccttccttccttccttccttccttccttccttccttccttccttccttccttccttccttccttccctccttccctccttccttccttccttccttccttcctttctctctttctctctttttttctttcttctttcttttttgcttaatattgctttggcattgtgttttttgtggttccatacaaattttaaggcttttttctatttctgtgaagaatgtcattggtattttgatagggattacgttgagtgtgtaggttgctttgggtagtatggtcatttaataatattaattattctgatgcatgagcatggaatgtctttccatttatttttatcctctttagtttctctcatttgtggttttccttgtagagatctttactaccttggttacattattgtatttaattatttttgtagctattgtaaatgggattgccttcttgctttgtttttcatctagtttgttgttcatgtataaaaatgctactgatttttcatgtcaattttgtatcctgaaaatttactgaatttgttgatcaattctaagagtttttttggtagaatgtttaggtttctctatatatgtgaccatgtcatctacaaacagggataatttgacttccttctttccagtttagctgttcttttttttttttcttgcctagttgctctggcttattcaaaggttgttgacacatacatagatacctattttaaaagagtggcatgtgagaaaaatacaggaaatagagcccaataagatatgaatatttgaatttgctgatccattctttcatataggactataagatttaactcttaaaacttcaaaatttttctgtatgtactttccatcttgtaaagttataatagacgcgtgtcgttcttattggagtcaatgaattgggctctgtcatttgttgagatatcatccttctggctctggagttctgtaagaaaatgacaatatatttagggtgataaagctaatatctcaagtctcaattgtttgagagccagttatcagattacctttcacttctgttcctatcattttgttaataactattgttcatttatttatgtacttattgtctggtaccccactataatgcgtccatcaagagagcttacatctctctcagtagtctgtttccttcatttcctccaaatttccattaactttttaatctgtttgcttatttgggtttctgtctttcatattaggggctctcttcagatgataaggtgatccttggctgtctgtttcatgcttgagaatggggtactaaaaagatgactgggaactctatacatgcataaggcttatcaacagtggtttgtacttgtacggtgatctggatggcttgtttagaaggggaaatcctctgccagtatttttggatttttttctattagtttaattaacatccccagagcaaaactttcaatctttcaatatctaattgcagaaataaagcctggctgctggagttcaaggggctagcataggaaagagactagatgactccagtagatattatgaaaactttcactaaatcctcctttttcactttaacttttttactttcagctgcctggtatccactatctagatgccttctgtttttcctttccaggtaataaacctcgagtcttttgccaagttgacaaaagggatggtcacaccagtgtcaagtcagtactgagtctgcctttttattaaacaggctttcagccagttttactattttcagtccctctttactctcacttctagagatatcatctgccaccaaattcctaagcactttggggttctataaggcaaattgagttactttttagcttttgtcacaatcaattaaggcttcaggttgcttcaaattgttaaattggttaccatttatctttttactttttaactttcatgattttgttgctgctattattttctgtcatatttttgtcttgatgggtttgtatattttaaaaaaatacctcttccatgtcatactcattaggatggctactattaccaaacaaaacacacacacacacacacacacacacacacacacaaaacagaaagtaagtgttggtgaagatgtggagaaattggaaaccttgtgcagtgttggtgggaatgtaaaatggtgtggctgctgtaaaacatggtggtagttcctcaaaaagttacaaacaatattaccatatgatccagcatttcatttctggccatatacccaaaagaatggaaagcaaggactcaaatacatgtttgttcacccacgttaataaaagcatcattcacaatagctaaaatgtggaagcaaaccaagtgttcattagtggcagaactgataaaatgtgatatatacacataacagaatatgattcagcattaaaaagggagggaattatgacacatactatagcatggatgaatcttgaagatactatgttaaatgaaataaggcagtcacaaaaggaccaatactgtatgatccttcttatatgggatacatagagtagtcagattcatagagatagaaagtagaatgatagttaccagggatttgggggaagggggaaaggagaagttagtgtttaatggatatagagtttcagttttgcaagatgaaaaatgttctagaaatgggtggttgtaatgatttcatgatgtgtgaatgtacttaatacaactgaattgtatgcataaaaacagttaagatagtaaatgttatcttacatatattttaccacaattaaaaaatttttaaaaacaatgaaaaataattccactttacatttattttattctcttcttgggggagatagagactaattaatgtattcaatgtgttgcttaaaattaaatctattatttcttagtttacagctaagatgagcctttttagggctaaatcacttgccctggtcacagatctagtcattggcagcctagggtttgattcagttctgggaggaaggcagggtttgtatctgctgtgatacatagatcagttcgattcattctttcattagccagcattagaacacctttttcattccagcactcttgaaggtagcagtaagcaagacagtaaggttacatcacattaccatgtgagatggagaaaccagacagtaagcaagtatatacataaacaagacaaatgcaaatgtggctaattgttatgatggaaataaagtgctggctgaaatgtgggtagggaaggcttctctaaggaggagacttcagagttgtgacatcaatgtggagatggcctaatcagtgtgaacatgtgggcaggagtgttcctggcagaagcaacagcaggagcagaggcccagggctgggaataaggttggcatgtttgagaagatagaaaagaccagtttagcagaatgtactgaggaaggggaaggacaagtgatggggtaagaggtgtaaaaaatgcagaaccttgtgagccttggagtaaagcagccaaagctttcctaggtatacagaaagccactagaggggtttcaaagggaaatgatgattttactttttaacattctgttggctttcactttgtatctactgtatagcagatggtaggttgtagataccagaaatgcaatatgtaatactgttgcccacaaggaaattatggtctggtgaggaagaaagagcagagagtgccagaaaaatatagcagcatattccacagtgtacactttggggtactagaggtgatttttaggaaacaaaaattctttatagtagaacaatttatattcctttgggtatatacctactaatgggattgctgggtaaaatggttctttgagaaagaagttctctaagttctttgagaaatcaccaaagtgctttccacaatggctgaatgaatttacattcacaccactagtgtataggcattcccttttctccacaacctcaccagtatctgttatcttctgactttttaatgatagccattctgactgatgtgagatggtatctcattgtgattttgattttgatttctctaatgattaacactttttcatatgtttgttggttgtatgtcttcttttgaaaagtgttcatgttatttccccattttttaatggggttatttttcgcttgttaatttgcttaaattccttaaatattctgggtattaatcctttgttggatgcatagtttgcaaatattttctcctattctgtaggttgactgtttactctattgatagtttcttttgctgtgtggaagctttttagtttaattaggccccatttgtcaatttttgcttttgttgcaattgcttttgacatcttcatcgtgaaatcttagccagagcctatgtctagaatggtatttcctaggttttcttctagggtttttatagttttaggttttatatctaagtctttaatctatcttgaattgatttttatatatggagtattgattttatatatgatttttatatatggtatacaattaggtatataatacctaattgtatttcctaggttttcttctagggtttttatagttttaggttttacatctaagtctttaatctatcttgaattgatttttatatgtggtataaggaaggggtccagtttcaatcttctgcatatggctagttatcccagcaccatttattgaattggggggaggggtctttccttattgcttgtttgtgtcaactttgttgaagatcagattgttgtaggtgtgtggctttatttctgtgctctctattcttttccatggatctatgtgtctgttattgtactagtgtcatactgttttagttactgtagccttggaatatagtttgaagtcaggtaatgtggtgcctccagctttgttctttgtgcttaggattgctttgtctattcgggctcttttttggttccatatgaattttagaatagttttttctagttctgtgaaaaatgtcattggcagtttgatgggaatagcattgaatctgtaaattactttgggcagtatggccattttaataatattgattcctcctttccatgagcatggaatgtttttccatttatttgtgtcatctctgatttctttcagcagtgttttgtaattctcgttgtagagatctttcacctctctggttagctgtattcctagatatttttattttttgtgtcactattcaaaatagcaaagacatgaaatcaacctagatgcccatcaacagtggaccggataaagaaaatatggcacatgtataccctggaatactacacagccattaaaaagaataagattttgtcctctgcagcaacatgaatggagctggaggccattatcctaagcaaactaatgcaggaacagaaaaccacatactgcatattctcactggtaagtgggagctaaacaccaagtacatatgaacacaaaggagagaacagtagacactggggcctacttaagggtagaggttgggaagagggtgaggatcgaaaaactacctgtagagtgctatgcttatcagctgggtgatgaaataatctgcacaccaaactaatgtgacacgcagtttacctgtgtaacaagcctgcacatgtacccctgagcctaaaataaaagttaaaaaaaaataaaatagatgaacaaataaataaataaaatgtggttactagattgattaaaaaaatgtctacaatcaaatcaggttggggattcatatgtgatatttccttagagattctcagtgcacaccagcatattaaagtcccaattgttacatcacagaaacctgtgtactttgttcaactttacatttcctaaatttatttgcacaaatagcttctttcaaataataccttttaacatctttttaaactcctctgggaaacactgatttaaggcaacatgacaattatatgttaggtgttatggcaataatgaggggggcctaactaccacaactctgggtgtgaaacaggtaagcattcaggattgccttcctggagtaggtgacccctgaattgcttccagaaggagtagagaggttagccttgtgaagaatagagaagggtatttcatagagaaagaactgccaaaacacagatatgtagacccaaacatcccacatcatcatccttggaaaatagatttacaaatttccagcaggaagaggaaaaaaagtgcttgaagtgtgctggtttctcaccttagtggaaataattgcttaaaaaaacagccagaggctggacacggtggctcatgcctataatcccagcactttgcgaggccgaggcagcagatcagctgaggtcaggagtttgagaccagcctggccaacatggcaaaaccccatctctactaaaaaatacaaaaattagccaggcgtggtggcaggcacctgtaatcctagctactcaggaggctgaggcaggagaatagtttgaagccaggaggcagaggttgcagtaagccgagatcatgccactacactccagcctgggcgacagagccagactccgtctcaaacaaacaaagaaacaaaaaaaaccagagtagaatgcaattctcctcatctggatttcagcaagaattgcccatttctgttcagccgtaggcctccatcctctgttgccagtctgttcttctgactctcacctgtctcctttctgcacacagaaggccagagagaatgaacaattcttccccatgtcagttggctcacccttcctggaagtgtggatttcctgttagtacctgcaactctgtcggcgctgctatttctgtcttcgcgttgtttcagaatactctcacactgctgccccatttttccgtacgcagtcttccaggcccttttttgcacctgatttttgccaggcagcataattagaggatgttacatttccctgaaagagcatattctcatggacaacaggacacaagggagtaagaaagcttcaaagatgctggagggtctccctcctgtaccccaacctgtgccacttggtataacaggattctacatgagttagcttttctttattgttattaggagattaataaaaattgacctcatttatttagtgcttactatgtaccagacactgtaccaagaatttattatcattcaactttcacaaccctaaaatatgtgtattttacaaatgaggagaagtaggctggcgagtagcttgcccaaagtcattcaactcagaagagaggccatcgtttaatcttagattgtacttgtaaaattcacacatccaatacataatgcctttaaatgttctcattgttaacatttattttctttggattctgtgcctatttctgcttatgtctccggattacctgggagcttttaaaaataagaatcctagggttccactttataacattgaccagaagtcaagaatggggcccaggaattgctattttcagaagctccctaggtgactctaatgcagggctcttcataccttggtgtgcgtcaaaatcacctggtgagggaggatggctgggctccacaccacagtttctgcttcagtaggtctagggtggggactgagaatgcacacttctaacaagttcccaaatgctgttcatgctgccatcctagcacttgagcatttttcccaatatgtgtatgatccccctcccccaccaactgggtgacgtagatagaactttaagtgtcattaagttatgtcatgttttgaatctttctctgctcgatttccacgtcaacatgagtgagggcttcagggattttactccatcattttggctaaatgccaacttggcaaattccactcctcccccggagggactgcaaatgccagtgtcctccttcattcaggagtgaggtcattgtctgtgtggttaaaagtggacactttctgctgcttctgcttttgcactgtagtagaagtttcaaggagctctattttacagttccaaattaccatccctcccctctttaatgcttccaagatggatagtctctcaccataggttaatgtttagattttgatctctatttctcagccccccaaatctggatgatcctctggtgccagagctgttgcatgtatcacccctggacactttcttctctgcttgaaccagagaataattatatatagtagttcccccttgtccatggaaaataccttccaagacccccagtggatgcctaaaaacatgggtagtactgaaccctatgtatactatgtttgttttttttttttttttgatctggtaactgagaggattactaagcggacgacagggaggtagtgcctacagcatggatttgctggacaaagggatgattcacatcccaggtgggaccaagctagataacgtgagaattcatcacactattcagaatggtgtgcaatttaaaacttatgaattgtttatttctggaattttccatttaatatttttgtactagagttgaccatgagaaattgaaaccatggaaagcgaaactgcagataaggggagactgctgtgctagagtgctatagaggatttcatttggaaaaaaaaagttttggtcctggaaaaaaagtttaagaacatagtcgtattccatttcttcatatgtttgagatatttctggctttggtgaaacataggctaggaaaagaacctaacatcttattagtgtaactgaacaacagtaacagcagacttagcctttcttccttatgtgcaacattacctgtgacctgactcttgaaacatagctgctattaaagtacaagtgagtcatgcatagcagcttctccttgcccagttaatttctctgtaaaatctttactctcttttattcatgtatatatatgtatgtgtgtgtgtgtaaatatatacatatatatgtttgtatttccctttaaggatttcaaacacaaagaccctagtcatttgattgtctctgtactgtcgaattttgcctacaaccctgactgtagagacacattgttacctgttttccatattctgtctagtaaatgcttggttgtcaggacaacggcatagaaggtggaagctcattgataaccacgtgaattctttaaacaaatatgatcagagcaaattccagggtatgcttgaaagtagatttaaggaagagcaaaggtttcagacatatccttccttttataaacttgatattcatctttaaggatcagcaacagttggagttactcataattttatttaaaatcctgaataaagatatcaccttagttttatggtacgtttgtcattccagcttgttaggcatgagtgtgttgttactgacagagcccctggaggacaggcagacactgtggttctccatggtctctcagtaccaggcacagagcaagcacccaatacatattataggaataaatgatctcaaatcttcacagtgcctcttatagatggcttttatgatatatatctgcagagaaactgaattcagggattttaagtgccttttttgcaaggcccttaaagtttgggaaagtaggtgcatggaattagaactcagattatcctgacttctaagatcacactcttcattgtagcacactgccttcttgccaaaaaaaaaaaaaaaaaaaaaaaggaagaaacatgtaaaaagacagaccatttctaagatgaaatgtgtgcttttcaaaacaatagcagaaaaccttcttcaaaggtaaaatagttggaaatagaagaagaaataatatgtaatttagcgttcgttgaggataagcaattaatcctgccctccaggggtgaatttatgtctagcctatttgcacatgaaagtacaagttgggcttcatttctatgcaagtaagacatctggttgggaagtgaaaaattttgtcagttacctgaatcatgtttggtctacatgatagaaaagcccctgatgtcttcagatcaccagaagacatttggcattgtatagttaacaccagatccactgactgagtggttcacctgagagttgctgcttgacatcctgtagattcacccattgttaggaggctgttaccattttgtaagtcagcagtttgcaaacagtagtccagacgagaaaccaacgctggcccttgacaaagtgttcactggtgtgtgatgcaataaatacatgaggtcataaaaggaagtgtatttaccttaaaaaagaacatcctttattttgagatcctctgcttcctatgtttttagtgatacaattttgtgtcaaataaatcctcattgtaagatttggttttaattagtaaatgagacaggataaaaaattgagaaacctatataaatccctagttttctttatgtgatctttgtatttgattgtgaaaaaaaaaagcaaaattgtagaaaccactgctttaaaccttgtaatatttttagcacaatgacacctaaagtattttcatgtatttcccaagttttccttttcctagaagtggggtaactctccatggtagaactgtttgcatgggtcttgaaagcattggacatcttaacagtcaagtattttgctgacaaaataatgaattttccttttgaaacaagcgttttgttcttaaaataactctaaagagaacaccttctgcacttttaaagcatttccctctgaaggcatgccgtggagacatgaccatagggagaaactttttgtgctagaaaactgaattccaccactgtgaattttttaacagctttcacaggttctgcagtttgctctcatgaccccaaaagcatatatctccacatgctgtaacatcaaggatctctcctcaagctttgtaagctcggccagaatgagctgagtaccctctgtgtgtcaggcgatgtccaatacactgggaatagggagtcataataaccataattttatctgacttttgtctagcatttgtcatgtggcagacaacatgctaaaacacttatttgcattatcttgcttgattcttataaccactctgggagaaaaataacattattatagcctttttacaggtgaggaaaccgttgcagggaagttaaatcacttgcccaaggtcacaagccctgtgagtgataaagccaccaccatccaagcctgtccaccccctaacctgaactcccaagtgctatgctaaaccacctgcctcttatggatatattatctacaaaaagagctctgccctcaaggcgattataatctaaattagaagagggaagcacaagggaaaaagccattatgtagagcagaatgatgtaattccaaaaaacatgctgttggattgtagaggaaagagtgattaattatgatctacccagggaaggctttttgcatgtggccttaggctaggtgagaacaaaatagggcaccagcaattatctagagaattgggtcactgtgggtgccaaagtggatgatgatttcaagctaaaaagactatgctctgaatagttcagaattggccgcccacactcctggaatctgttgaatttttgccaactcccttgttctctttgtgacttattgccctggcttagatgagcttcctactccaggtgggggaagatgcaggatggtgctgccatagcagggagtgctgacaacgtggaagaagccttccttgagtcaggagctctggattcaatctagactctgctcccacaactggttgactccagggaagccacctccttctctgggttcagttttctctactgtaaaatgtatacactgaagttgatggtctgtatgggccattcaaaatcccgtgtctctgtttttggaacagagaaggaatcagaggagaggactggaagaagctaaaagattcagcatgttcggatttcatgactcttgtggttttgttcctagacaggacctaccaggggagcctcctgcaaatgaggtggtcttccttttctactcatcacattctatgcctgccctctctaacctacatggtatagtaggaagacgccataccatggagtcagagaatcttgggctaaaatcctgaccatgtcccattacatagtgactttgaacaaattatgtaatctttctgtgcttgtatttctacaactgtagaataataggttgcaatatcatagactcttcatgtagagaatctaattctattactataaaatctaattctaataccattggtttggtgttagcaatgaaggtgatagcaactgaaaagtaagaagagcagtgactaaaagctcataggttttgataaatgggcactattactattataatatttattgtgttaaaatacaaattatgtacagcactcctctgaacactgacctacaatagttaccagttgcttgttggacttcttgaaccagacttgaccaggcaaagagaatttgagaacctctatttcactaaaaaggtggtatctacaatatcttgccactgtagcatctgctatgtgtaatgagatgcttgggcctgctggtggtcacctattttctaggtatacgcattggcttttgtggtgtcgccatatatatatatatatatatatataaaatatgtattatatatataatatatatacatgatatagatataattaaatgttatattcaattaaaataaatataattttaaattaaatataaggaacatgagagttagcaggaatcatgggtgaaaaaaatatgtataataacaccacaaatgcatatatataggtttttgcccatgattcctggttaactcccatagcccttattataacattggggcacttgaggcctcaggcaacagtctctctcagtgaccccctctggtccttcttcacctgcccaaggtaggatgctaatttgattatggatcagaagaccctcattccagagagggtcctgccccatagcctagtggaaagaatgctacacagagaggccaaaaaaagtctgagcagatagtccttgctggatttagatcatatgctttttgtccaatcatatttttacatggttgtcaatcatgcctgtgtaaaaaagcctccataaaaacccaagagtacagggtttggagagctttttgattgctgaatacatggatgttcctggagggtggagtgcccagggaaggcatggaagctctgcgccccttcccccttaccttgccatgtgcatctgttcatctgtatcctttgtaatagtatttataataaaccaataaacgtgtttccctgagttatgtgagctgctctagcaaattaatcaaacccaaagacagggttgtgagaaccccaacttgaagccagtagttcagaagttgtggaagttggacttgccactggtgtctggtgcgtggggttgggggcattcttggggactgagccttcaatctgtgagatctgatgcaatctccaagtagataatgtcagaattgaactaaatgacatccagctggcgtctgctacagaattaagtgcttgcttggtggttgggagaaactcctacacatttagtaacagaagtcaccttctatgtggatgattgctgtggtgtaagaccagaggaaaaacatgatttcagagtttttccctcaacagccttgagatactccattttaataagatagagagatgaaagtgtattactggtgggattatgttagaaaacacatttcttgtcccagtagcattcaagatcaagagttaaacttaatacagtctctcctctttactctcccaactgatattcagcttcctgtgtgagtgtatgtttaatgtttttgtctaaattaattgatctttgtcttatgatctctcgtcttaaaaaaactaagttcagctaaatgaacattgctgagaacttatgttctagacactgctgacgttgtgctgaggggaaatgaatatagaggtaaataaaataatttgaactattctctgtctagtgggaaagagagatcgaggtataaataggggaaaaaataaaacacaacgtaagggtcataatttttaagttggattaaaaatatgtgtgtgtttctttattaaacacctcttataggccagactatcgggccagggatataacattatataaaactcagtccaaattgcataggtgtctacaagatgtaataactacaagatggcataagaagaggtattggatgggaatagtgtcgactagaaagtaagctacttgagcgtaggggccttaactatcttgttccttaatgcatttttagcattagaacagtgcttggctcgtatcaggtactcattaaacatttctgtagtaagtgatgaggctatcataaagttttgtttccccacccctaaaccagattgtaggttcagtctgaaaggactccaggaccctctctgctggtaagacatggtgccactttgtactctcccagccaatctgattggcctcttgactttggcaaaactgagctgggggctggcccccagtgccaagcacagaggaagcagggtcacatgccacccatgcccaaagctctttctgacatttccatgggcctggaaccaactctcctcctgggtttcatctcattatatgtgggaagacaaaagaacactgaaccttccagttaattcaacaccccgcccccacttaccccttcctggagaggataacagttctgttgaccattataatgcattttctgtctcccagcagtccacatagtcattaatttctgctgctgacatcaggaaagaggattatgtgtgtgtctgaaactgttcccaaagtgctcattagtcatagataattgaaaaactggtaggggaagatttggtgtaataggagcccccgcctgtgaagagggactgcaaccaccagataattgtagattccagcttttgaccactcagactgaatctgcccatccaaatgggaattcagcagacttgagcctaagagctctcagagtgatagtgtttttacatacccaggtgagggtgtgtacaccgagacagagacagccaaatcaagagaataggtgaactgcccttgggtctctttcctgccttcagactgtggagcagtgtttggaaaaagtgtccagtattctcctttattttgtttttatttcaacgtaagattgttttgatcacaaaagacatacaaggtcatgggatataagaaacacaaacattagagaagagtaccctacactggatcccaacccatgctgtgacaaaattctagggtttttctggaagtttatgtgcttacatttttatatccttttctttaaaaaaaaaaatcacatgatcatactaagaatactattctgcatcttgccattttttctgaatttatcttggagttccaaatctataccttaattcaagttcattcattttaatggcaaggtgggattctgaccagatttaagggggaaaaacatcttttaaaatattatacaagaggctgggcatggtggcttatgcctgtaatcccagcattttgggaggccaaggtgggtggatcacttgaggtcaggagttcgagaccagtctggccaacatggcgaaaccctgtctctcctaaaaatacaaaaattagccagccgtgctggcgtgtgcccgtagtcccagcaacttgagaagccgaggcatgagaatcgcttgaacctgggaggcagaggttgtagtgagctgagattgtgccactgcactccatcctgggcaacagagcgagactctgtctcaaaaaaaaaattacacaagaaatgtagaccaattagaaattagagaaaaaagaaaaaaaggaaagaaaaaagaaatcactcataattcctccacccagagaaaacctattttctgtatttttttcccctaggaatgtatttttacaaatagttcatctactttcattgttgttgttcttacagctgttaaaagaaaacctttaggcaaattaaatttaacagtttaactgtgcaaagaatgattcatgaattgggcaggtccccaaccagaataggttcagagagacttttgctcagccacatggttgaagagaaattacggacagaaaaagggaagtgaggtacagaaaaatggaagtaaagtacagaaacagctggattgggtacagctctgcatcggccttatttgaacagagtttgaacagttggccgcctgtgggtggttgaagtatgtcttctgtgattggctgagactcagcttctagttacaagagtaggttacagtgtgtttacaaatccagttaagttacagtcactgtgtatgaagaaacctttaggctgaagttacaaacggacacctttaagttaaacttaatttaacaaaaggaagtcatatactgcatgttttgcagcctctatttttcacttggtttgactgttttaaatataaaaattattccccaagcttttctttacactgtgtgtttatcttcttttttatttatttatttttttgagacggagtctcattcttgttgcccaggatggagtgcagtggcgcaatctcggcttactgcaacctctgccttcctgggttcaagcgattctcctgcttcagcctcccaagcagctgggattacaggcaactgcaaccatgcttggctaatttttttttttttttttttttttgtatttttagtagagacggggtttcatcatgttggccaggctggtctcaaactcctgactttgtgatctgcctgcctcggcctcccaaagtgctggggattacaggcatgagcaaccacgcccggccacatttatcttcttaaaaacccaacctgagcacttacagtcgtgcccctctgggcaattcctttttgcctggccacgcctgaagccctccgctgcctcttgtcccgtctgttccagttctctgttcctccttgttcccctttttgcgacatactaaatgcctcaaacacaccatgcccctcagggctccctacaggaaactcactttttgctctgctgtcatccctttccccggagcatgccagcactgaaaccaccaatctccaacttgcctttccacacaggcttgaaagtcatcttcaccttgaagactgtattcactctactagccaccctaactggaccctccacagttctctgggaacaccatgtacacatttcacctttctagcattttctacatggccctaagagtcttagtttttcatcatctttgtcccaaaccacaatatgagacctcagcacctagatcttagcacatggtagatggaaatctatgcaggcaatcattagttctattgtttctgaaatgtttgttaaaatgcatgaatgaatgcttgaatgaagcctagaaagaactgcaaatgctcaggcagtgaagtcttgatttctgggaaaagcaatgctgtgaataatttaattttatggtgaaagaaaagccaaacaaggattatattgggaaaagttgtcaggaggcactaatgtttgcctctgacagctctagtgccctcagtgtacctctggctgataaacttagagtgtgattttgaaggggtgatttctcagggattctcacctatttctatcatcctctctcatgccaagctgtttcattttggtctctaaataaacaaagctccttcctgcttggagtccagatagcctattcctgaaggctgtggttccaaatgaaagatgggatatttgtccttgtatatatttattttcatccctaaccactggattgaggagaaggctggttcactgctgtaggttgggttttccagaagcaaaggctgagacagatttggggggataaggtgtttattagggatggttggctgtgaaagaaggaagagagagaaggactgggtagagggaaaagagctgaactgaggtgcattcctgcagcaccttggtgaactcagcagagtctctggagtgagtggtgtctatcagagcccttctgcctctgctttgcaaagtcaccaggtactggctgtcctgggaggtgcatcaccttgggaaggcagctctctgcaactgaggcaggccctggaacatctggcagctgtctgctgactttactccatccttaagggggagtttgagccatggtatctcagtctctaccatgcttcctatatccacgcaaccactgtgacctgttatttcttgttccatggaatcccttctgtctgcctctgtttctacatctccgttaccaatatctcagtgaagatccttatattctctctctttctttgattactgaaatagattcacactattttccctaaccccagtctatcctctgctataatactgccagagagtgcttaaaaaagcacaagtttaatcgctttcctcctggcttaatgctcctttagtggtttacagtgggcttcatgattaagttcaaacacttaagtatggattacaaggccctgcatccactgccccatctgcctccccagcttcctctgtccttcaacacccaccccctaccagttcacaccccagcctatgttccaatttacctagcccttttgatagttcccttaggggccccttctcccttttttctgtccttgctcaagacgcatcctctgctgatgaagctccctgtggtcctatagcctataattagacccagatctcctgtctgcatgcccaggactctctctgcctcgcagtggtctgcagcctcatgttctgagcctagaggacatagaatcaaattaagctcctttaccagctaaggtttcttcctaaattactatagagaaaacttggaagagtgccccaccctgctaatcctgtctagaaccttttttataaaaattacaccttttatgtttgtggagattgggggtgaaggtggaacagaatttccattttgaccttcctatgaaaaccatttttaaaaaatctcaatttagtaggcaagatttctaaacggtgctcctttttctttttcttttttctttttttttttttttaacatacataatgcttgttctaaaaatacttctcttgatcctttcatccattcagaacccatttttaaacaacttttactccaaaaggtaatgtaatgaataagagcagaggtgtggatatcagtcagagtagaacccatggcctgtcttcagctcttaggctgtctctagggtgtttatttttcttctgtaaaccacaattttcccatctgtctgtaaaatgggggtagtatgggtcctattgtacccttcacagagggttaatatgaaaatgaaatgagaaaatgcatgctatgtccttagtgcagtccctagcatgaaagtgctcagcaaactggagtgcagtctctcctgtgttagatactagccatagtgacataattaagatattgtccagaaccgtattatacaaagccaaggacactgctctcttccaggtttctgctactttggcatttgaaacagaataagattttcctgttctctgccccatcctttgagcatcttatacttatcctccagaccatcagtgtccaatagaaatataatatgagccacatatgtaatcttaaattttttagtagccatgctgaagaaagtgatactaatttttaatgtatcttatttaacttagtatattcaaattattattttaacatggaattgatataaaaattattgaggtattttacattcatttttccagatgaaatctttgatatctggtgtgtattttccgcttaacacctctcaattcagacgctagatttttgttggaaatacttgatttagatttcttaaattaatctagaaaaagtagattcgcatacccaagttgttccgaacatacttaaaagtttttcagtaactgaatttaatatcagtttttaagttgaagttaaaactaaataaaactaaataaaatgaagaatttagtccctgagttactctagccatacttcaagtgctcagcccacatgtgactagtggctgccatattggacagcagagttcttctagaagtcactgcagaggtttcagtcttactcttcttagctaaacttgttttcatattcaattgtagatagaagctcttaaaatggataaaaatggtgtcgtcaaagtgctttggttccatttagaggaggttggttaagctgttcactctctgacccctctcccaacctccaccctcacctctacccccagaggtcctggagcacctctgcccagtccttgagctccatggaacaattaacaagtggcatcttagcactcaaaaattgctgattatgcacccagattctatcttggggctcaaaggggtcttaatatatctatgagtcaactcctagcccctccctgcagtgcagaaatactatagaatccttgggggatgagagagggctcgggctctgtttaacacctaggagcagatggatcatttcattctattctgtcttacgtggttctctgggttcttatcttgtcttcctaactaggttgggggcaaggactgcttttcacagccccacagcacccacacaaagcaagacaatcaattcttaactgaaggcctgactgcaagaattcaaggtcacttgaaaaatcagggtcactgcattgcacaactccaaagaacatcattcaaattgtattatatgattgtgcaagtggcagccttgtaaaatttgcaaaggtttagactggaatattttttccagctgagaaaaactttttaactaattatttgttggtacaaagtacacctttttcctcttatcctctgccaggaagcaactgaaagagtaagttttcttgacttaggaatatacgttcattagagagggtgtatggatgtgtgaacatgtgggtttacgtgcgtttaagtaggttagtagatctgctgtgttaggaagcccatttggaatggtttgagcatttaaaccttgtatttaagaggctactgtgtttatattccttttgaaatttcccattttcagaatctttatctggtttgaatgatgctttagagttccttgtttgtaaagctccacaaagcatgacccataggtaccaagcacgtacactaaagtcactggatgagcaaagggactcttgatgactgcatggtttttatctttgcaaatgcagaggagggaggagagagcaaagagtttctcttaaaaaaaaccctctgtttacttttgtgtttttcaaactgatggtgtttgttttttctcatgtctacccaggaaaccaagtgctacctcctggagcttctcttggaaatgggctcacaccagaggcagcaagagaccttggccttctccctgggattgcggtcgcagcttcactcattgatgcccatgcaggaggactaggtaatctcttatttgttgcctacagccaaaaccgtattcaaatggaatattccctagaaccgaagacactccttttctgtttttaaagcaaaggtcaaggactttggtgtttcaggatataataatgaaaagcctttttacagctaggcatttggatagaattacagaacttttcattaatgataaaatttatttataattgtattaatttctttatacatggcaatagaaaaaaatgtatttgaataactttctgcatagttcttttgtttactgaaaattcaaaaaagatatgttaatttcttgccacacttagctctactgtttttttgtaaggtactccaaaacccttataagtctcttagatttattttaataatatatttggcttatgtcctgtatccagttccttggctgcagtcttgattttatcttgtacataactctcaagtctttcattcatgtattcatttgttcattcataaaacacccgttgaacacttaccatgtccaggcatggtgctagaagacagtgaacttaaaacaaaaccaaataaaaccaaagtctcttccccagcttttaatgggaaaacacacagggaaacaaagaattacagtaaagaatgatgacttcctcatccttattgcaggttgtgtgtgttttttgcaggggaagttgttctggttctcagcatctctcatctcaactgtagccatatatttttttcctagcctttcattctaacaatgttttgttttaaactatgatttataattcatgagatcaatttagcaggacatgaccactgaatttgcacaacagaatggaacagaattgaatagaacaaagtggaaaacatcagagtacatttcacaaagtaagggaaggcactgctttgtggagctgtgtttccattctgtgtgtgtatactttcagacacttccatactctgcccatgcatttacacctctgtgacttggcacacatgttctttgtccagaatgattggtcctccacttctccagctggctaactcctcctctaactgcaagacccatatcagatgctttctgctctgcatagccttccatgaaacactcaggtgtatttagaaattctctaaattatgctttttttcagcacactatttgaagaaatgatcatattgcattgtaatttcaaatatatctgcatgtcatttccattagagtgtgaactccttgagaacaggaacattatgttatctgtcctgtatccttcatgccaagccctatgtctggttcctatagctgcttattaagtttattaaatgaatagtcacattaaggcaagaataaggtgaaatggctttaaacagtagagtgaagattaatctgttttcttatgcaacggattattaaatggtgccttgttctacatactacatggatttccagagcaggatcgctctcatcaatctatggacatgtctgtcctgttcatctctctgtcctcaggatctaaaacagtgcctaagaattagtaaacaactcataatatatgtaggttggttgaatgctatgtaacgtagttctgattacaggcaaggttgtttctctccaaatacttttcagtgtgagcaatgtgtgcttttgattggaatgttaagattttggtttttacatacaagcacagagagaacttgaggtctaggcagacatggagtgtttctgtcccctagcaatcctgacattccagatcatgtgtgaggccacaaaagctttctctgtcatgctttttaaattatccctggggtgacagtgtcaatcatccacccctacctgggtgacaatcacttggctgggaccggcatatgctgaaagaaagagaactgctgcttgaagagccgcaggcactacagtttccttgtcagtttcccagacttccctcagggacgtgccaaaacacaccttctcacttctgcccaggactcactatgtcctccaggaggggagactgtcaatgaccctcacctttttcctaaacagagatgttcagtggcagaagttttacccttagaagctttggcttaagccttttgttccccgtaaaatgcaaatgcttgtaagtgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactgtaagtcaaattaaacctccttttcttccttgtctcgggtatgtctttatcagcagcataaaaacagactaatacagtaaattggtaccagtagagtggggcattgctgaaaagatacttgaaaatgtggacacaactttggtactgggtaacaagctcatagagggaagagacttgccttgtctctgatgagactttggactgtggacttctgggttaattctgaaatgagttaagactttggaggactgttgggaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgtatgtacctaatacctgtacccgcattgtatctaggaagtaactgacttgttttttattttacaggctcatgggtggaagggacttgacttgtctcagatgagactttggactgtggacttttggattaattctgaaatgagtaaagactttgggggacttttgggagggcatgattggttttgaaatgtgaggacctgagattgggaggggccaggggcggaatgataatgatttggctgtgtctctattcaaatctcaactaacttatatctcccagaattcccacatgttgtgggagggacttagggggagggaattgaatcataagggccagtctttcccatgctgttctcgtgatagtaagtctcacaagatctgatgggtttatcaggcttttctgcgtttgcttcttcctcattctttcttgctgccaccatgtaagaagtgccttttgccctccaccatgattatgagacctcccagccgtgtggaactgtaagtcaaattaaacatcctattcttcccagtctcaggtttgtctttatcagcagcataaaaatggactaatgcagtaagttagtaactttcccccatatttttgttagtggaaagatagaatagtttttttttgttttaatggaaagatagaataagaatcttggattctttaaggcctgaacttagatgccagcagtggctgggaagggcacaggaaggtgatagtccatgatgacgggttgatacagacttacttaatatatgttgactatgttttatccttattatgccttcttatgccttcttatgcctctttctttacccttcaccttacagccaatccaagagttggatatctcaaaaaaattaggaggcctgggtgcaaatgtttcctttcatttctacctttcctatacccctattaggatgtggaggtgaacagatgcctgaaaatcttgaaaaggttgtccatgggtccaactctatattaactaaatataattgagtgaatgcaacctgtcagtgattggtctaggcactggagattattagcagtgaacaagtcaggcaaagtccattcgttttggaaagaaaattctcattgttctcccctgcctgcatgtttgtagcttaatagtataggtttgggacagctaatccctgagacatattgtgatgctatgacaagggcactcaaaatggaattttaagttctggatttagattgtgtttctgcctacaaatatggtgcttcgcagaacttttgtctcctgttatgcagtgagagagtgagagacaacagaatgcaggattcactactttgtgattctgtataggttgaggtcagtaatagcctcaagaactggctaaatgaaccctgtgttaagagatttctgaatgtcaagtacagacacagctttggatttggaattgccacccaggaagaggccatccaggcctctcaccaacaaaccctgacaactgtagtcacttcaaatgctgacctggcatggcctgcttgaaaccccacattctgactagtatgaggggtcagcactctgctttagagaaatacccctggactttcattcccaagggaggcctgggatgggaggataaagatcaaagaagcaagcaaaactcaacccatgcttttcccagttctggaaaaagaggaggaagggctttgtgggaataaaaatcaatgataaaagaacattttgttcttaaggtgctggttagtaagttctccagcagacagtcagaagataggagtagctttgtttgcactttgtgggggtggttctggccagggctcctgctgctgatatttttctagcttataaaaataacattaacttttttccaggtcttttcttggctccagcaccccaactgccctgaaaggcaataacaacctgatttctgtctcaggcccttctcttctcagttgctctttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagacggggtttcaccgttttagccgggatggtctcgatctcctgacctcgtgatccgcccgcctcggcctcccaatcagttgctcttatctggcagacagactcctgattatccatcaaatcttgaatcctgttctcctctgggaagccctccctgacttcccaagttgacttaagcactctctttttcccccactgtgtcttgcgcttgcaggtttgtgtgtgccacattgcctcatctactaatttataaactctttgggcaacctgttgtttcatactcccactgcagcagcctgcagagtgctttacatatggaggacccttaacacatgcgtatttagtgaatgagtgaatgaatgaatggcattccctccatgaggaacggatattacaactgagagagagagtaacctctcattcaaaggcaattgtccctatacaatagttatacttggcttatttctgcaggagcaaaagtttgggttcttctagatgtttggaaatctgtctcctttttgccctcatcacattaccaagtttcggccaagagcaagctttgttccttggtttagcacaactatttgattaccaatattggattatttggcagatgttgaactggcttaaattgctcatctgggccagatattgaattggtttaaactgctcatttcaattgcagagccaggccaaaatgaggattttgaatttcttttctttttaaatggaagaatttattgagccagtcttgcaaaaagggcctttggttcatgccctagaacaacacatagtttgttccagtaaacaataaaacatgccaataacatttctcaccattatcagtgttctagaagacaggataaaggctgcgatctaaagcctgcgactttagataatgtgatttggggggaacatttatttataagtagtatatatactaaatgtagcatgatggataaagaaatatacttattggcaatagtccattgcgtttgtaaacttttgatttatgaagcatgatatggtttggatctgtgtcctcacccaaatctcatgcaaattgtaatccccagtgttggaggggtccctagtgggaggggattgtatcatggtggtggatttctcatgaatggtttcgcatcatccccttggtgctgttctcatgatagtgcatgagttcccttcagatctggttgtttaatagtgtgttgcaccaccccactctctctcttgcttctgctccggccatgtgaagtgcctgcttccccatcaccttttgccatgatcgtaagtttcctgaggcctccccagaagccgagcagacaccatcatgcttcctacacagcctgcagaaccttgagccaattaaaactctgtcttctataaactgttcagtttcaggtattcctttatagcaatgcgagaatggactaatacaaaacacatctatgttcattatagaatttgctccttatagcaactttgtagtgaagttaggacaggtatgtgttccctcattttgcacagcaaacagctgaggctcagtgtattataaactcaagaatagatatttatcttacacttagttcttaaggcaactttatacatactattattctatttgtcagatgagacagttgaggctcacaagactacctaacattctgagctacacagttaaatgagagatgcgtgacttaagcccatgctttgtgcacacttatcactgtgttataaagaatggcctacctatttaaacatgatccactctgctctttaatttgaccctaaaaatgtgagcaagtaacaaattttgaaaaaggaaagtctttaatatttattgacgacccactttactagttcatggggttagacagtgactatgagagagaagtggacttctgggaatttgtattctagtaaagaaaatagacaagtaaataaacagttacggttacttgtgccgtgtatggaaggctttggaaaaacataaaatgggcctaaaattgagacttaaacaattattaaaggattcctagagggagtgatgtccagtaatctaattacgacactgctttccctgttattgcttcctggtaaagtggaatttatatattttttgcgacttttaaacttcaactaggcttcatttctaataataaaataataacattgttaattagaacaaatacaaccaccactctgactggtactactatgatgaccatttcttacatgtgtcctatgtgccaagtactctacctgatactgctcagactttatatcttgctcctcacgataagcctacaaggtagaggttgtttccccattctgcatgagggaattgaaggcagaaagaataatgtttccacaatcacataactaatctcatagcaagatttgaaattgagtctgcctccaaggttcatatatcttttctctaggccagtggttctcaaccaggggtgatttgacccctcaggggacatttggcaatgtctggggacagttttgtttattgcttctggggaaagggaaatggcactggcctgtggtgggtagaggccagggatgctgccaaacaccttacaatgcccaggccaaccccctgcaacaaagaattatccagcttcaaatgtcaaatgtcagtagcactgaaggtgagaaaccctattctctcctggaacacctccagtgatattatttctcttcatcaattcagcttatttctatagaagccaaaaagcagcccacaataagggttttgctgatacattagtactttgttgaaatgtgttttgtgaaattgactcttcagtaaaagtagttgtgagattaagaaaataatagaagtgaagcctgaggagtagggaggacaggatggtttctagctcatctatttcagagtcaagccacacgggacaacttggccgtctttcagcacatcatgcacattccacctcctttcctttgttactcatccatcagcactcagtctaaatgttactttgtggaaacatctccaaatttaatccattcttagaaaagcaccaatcactctctatgctgtatctgtgaaatactttacaactatttcagttttttcaccaaatcatgttcacgtttgtatgcccatcatccagcatgaaatccacatagctggtcttcactaaatcaatgtaattatttaattactattattagtaattaagataataaatataagagggttttgaaaaatccagaataagaattggtaaatataggtgagggagactttaagaaaatatagattcccatgccctaccctgctgaggatgcctggaatcttgttctaagtgtggaaaatgtcacctggtacccagaggagacagcctggggggatgagttggcactgaggacactggggtcagaagcagtattgatgtgtttctgccaagtaggcagatcagaccagagcagaaccgtgctgcgcaggagccaggccaggcgctggccaaaagctgggggcaggagggagcttgtccaaaatgagagagaatatggatccaaagaggcagacggtctgcaagaaattgggggtggggggggattagaaatgcagataaagtcatgccgtggaatctggaaggagaaaaccgtgccagtccctgagcagatagagcaaggacaactctgggagttcctggatgtgaatcacagagggcagaggaagaacgtattcatgggattgcaagtttattgttttaagttgaggttcggtttaatgcgacccactactgcctgagacctcggcagttcatgagccgtggcaacagctcatgtgatggagggaggggcagagagcatacgtggggggaaggataactgagtttcctgttcccaggctccaaggctttcttggagtgctgtgattctctggactgcagaaggctggccttagctgagagaccagactttgactctgtggaagaaaaccgagagaatccagggcctggtgctattgccagctccccatgtgtccccagtttttaaatcttgtgccacacgtcagtgtatatggctgtgaacctgccatgaaaccataatattttgagtttaatacatacactcctgtttggataatgagtaatcataggctttagaactaaaaggctgctcaaagattctgtataccaaattcttcaatttgcagatgagaaaactgaggcccagacaatggtgaatcatccaaagttaccccagcatattactttcagagtcaaatttagaatctgagtgacctagttcatcagccagggtccccgccccattgtactacactgtctccagattaggaaaagggaatgactcctgatttgttattccattttataccttatatcccatttaatggccacaggcagcttcactggtggttattaaataggtaatttagttttcctgagccacacttgagtaaatctctttgttttgttgtcacaatctacaaaaagctccaaagaatctcctccagagctggaaataataaaaacacctgctattcgagttccttccaaagagctcaaagcagttatttttatttcacctaccaatcgttgaatacctatgctgtgccaagtgttttgctaggtacttgactattcactattgtgagctcacaaccacactgtgagctacaattatttttggactttaacatacaaggatgaaggtttaagaacctgccaaaggttacattttaataaattataaagttgggttcctggacccaccgattgcagagcctatgagctctcccgtgttgacctggctagtgaatctatttgtgtgtaggtatgtttgtgcctttacttacgttagcccatacttacaccaatgcatatttgtatctatagtggaagatagagcttctgcttaatatccttctggacgtttgtagatctattttatggatgagaaagttgaggcccagggtggagaagtgactctaataaagtgtatttaaagcagcacaggagtctgggttccatcaatcatggggaataaggccaggcttattagatcagggtaggaatgggatgcgtagctattggggttgtgtggtggagagataaacaatattaatgttgacgttaattttgtttactaaatttgttaattaatgcttacaatctcaatctcaaagattaatcttaatctttttgtagtgacttgctgtttttaaactacccttggaatagggaaggtatttttacctcccacgaatggttgggaaaactgaccttcgaggaggtgaagggatttgcctaaggttacaggaccaggaagactggatccaagactcaaacccttatttgtgtgcctctgtcttcacatcagctttagtgcaacccttgcatcaaacaatggaaaagtagtacctagtaaatggagcaaggtgtcttattctgtgcccagagcctctcattttaaacaagctctgatcatctcatctactacagaactgtatctggtattctggggccatttttaaacagaaggtttcacttattctctcctgtattagtatatggccgagaaaattagctgagctgttattttcctttgctgaactggggaacaaaaacaaaaaaacacacagtaatccagccactggttctgacactgccaagcacctgttaggaggacttcctactccaagttcaaaaggtacggactgctagaaaagtgtgtgtttgggggcccagagtctaagattgcacttgcgtcactggctgcaagagtaggatcaggtccactgtttttcatggcacaaaaactcaacagatagtgcttcacatccatatactgtttctaagcactaatgtttactttgggtcttgcacatcagcagctgatggtgggaaaatacacatctctagttattgccccaaggcggcagcctcacatctaaactgctggcttcttccttattatctctccacaggcctggttcatttccttgttttcagttttctcttagctgtgcattcatatcagtcattgtaaagagcaaagagaaataattttaaaaattttccatatgggcatcttgagcattgcctcagtacactctgtagctagtatagatatctggggaaactaagaaggaaaatttctttgaatatagaaaaatcatactagtctccagttatatcattcaacagcagtccccccagcccacctttccatacctctaatctgtatctgtgctttgtactatgactctgatgtaagagtttggctctctgaagatggtaaaaatttaaatgcttgaggtaaacacagtaagatagttaaaaacacactactggttccatcagctgtctctttgcccttggaagtcatctgacactgatggcagcagtgacccatctggagcagccactgcgaagatgctggctgcagtagaggaatgcactctgcagagctggctggggccagaacaggtgggagccctgtcccctaccaagttggcagggtgggagccccatgctcccaggcacatctgcagccgcccagctgcggctctggacctgggcatccctacgctctcaggggcccaggaagccccccttcctttgcagacttggaaatgcttgctcctactccctggcctcttcccattgctggtgcctgctctggagtggggcagagttgtggctgagcccagtgctgtcacaatccagccaggtgtacatgcacttgaggtggtgctgacacgctagcctcctgccaccttggccctctctggaccttgggcgccaacgagcatggcaggagctgagggcagctcggctcaggcctgcaggtgcctcagtaggaacagactgggtggcgggttgatggcaggaggaagcagacaggctcctgggcagaaaggagcgggtccctggcgaaaccccaccttcaagccagggacagtccgaagcctggtggctggactgccagttccaagtggagtctgtggcccagagtgagaacttgtgttgctttttctgggtccacccatggctacccatggaccaatcagtactcatttcctcccttctgagcccgtaaaaatccctggacccagtcagacacggacagactcaggactaccagctgcaggaaggagctacccactttgggtttctccacccattgggatgacctgcctgcagaaaggagctacccacttcgggtctcctctccactgagagctggacactcatctagacgacctgcctgcagaaaagagctacccactttgggtcttctgagagctattctgtcactcaatgaagcttctctccaccttgctcaccctgcagttgtctgtgtatctcattcttccaggttgtaggataagaactcaggacccactgaatggcaggactgaaagagctgtaatacaaacaaggctggaaacacatccctccggctcactcgctactttgtgggcaatgaggagagaagagctgtggcccttcatggagcccagacctaggggctccccaagccaggggtgtgacactgtctttaaggctttgaggttcatggcatctccaagcctccaggtgcccgtgttcccctcatccagatgcgggtgcccatagcagaagccccatgcagcacatcagatccagctgcagccttgcgtggagctggcacctgtgccagcacctgtagctgcctcccctgccacagcagcttgcttgtctggttgtgtgcagtggccggactctgcacttgctcacccacacacccctcactgctccacgcctgggtcacccttggtaggtgtgggatccaggatggtggcgtgagctgagcccagcctgctgggccaagtgggtggaatgagcccagcaggcacgagcaatactcaggcagaagatgccaccagccacagaggtttccggctggcaaagtgacaccccgaggatcccatgacagtacttcatgcctcagttcccccatctgagaaatgggaataatagtacctcttgcatagatttgagtaataaatgagcttttatttgtaaagcacttagaataatgtctggccatactctgtgtgtgtttagctatgattaatgtgattgcagtaaagttacattatgaatagtagcagtgagcaagagaaaatcaaagatttattacttgatttacaggtagatgacgtcttccttctgtgtgtcaggcattgttataggtatgttagatacagtggtaaacaaagccaagctccttctcttatagagcttctatcctactggggacgttcataaactcccatttaaacatatgtatttataggtatatgtaagtatacatatatgtattgtatgtgtgcataactgtgtgtctctgtatatgtgcatatttataagtgtcttcatacacatgtgtttatgcatggatctggtatttatacatgtatgtgtattacatgtgtatatctgtatgtagttgtgcatgcatatgcatccatgcctgtgtctgaatgcgtgtgtgtatgtgtatatactgtgcatgcacatgtttgcatgcccctatttgtatgtctgtttatgtgtacatttatgtgtgtgtctgatttgtgatgtgtttatgtgtatgtgtgtatattctaatgttcatgagtgtatatgcatgtgtccgtatatatgtatgtgtatatgtgagtggatatgcatgcatgtgtttgcatagggtactgctgagtgttatgaagaatagtcctgattaaagtgatggaaagttccaggaggtgctactggtatacagaggtcaggaaagttcagtctagaatggggacatttgaggaaacataccttaatgaagagaggaaatatttcattgtgtaaaaagcaaggcagagattttttcaatcagcaaatatatgttgagcacatactttgcctcaagcatgtgctgggcactgggaataccaggatgaagatgacccagtcccttctctagatgactcagcagctggtggaaatgggagatctgtattcagaaaaatcctaatacaacttgcatactgcttttccaggcggtgtaaaaatgttacaagagtatagggaatggatcagccagctcttccaggacaagttaggaggtgaaaactcctagaaagtgaaaacttggataagccttttaagaagcagtagtagaatgtgcagaggctcagggacgttaaaatgcccttcataatcaaggaacattttggtgtggccacctcgccattcaaatgtgcgagaggggcagcgagaggcagccgggaagacggagcctgtgtagcacactctgactggaatcagactgcctgggttcaaacccctgttttgccacttgttagtaaagagcttacctgctctgtgcctcagatttcccttctgcaaatggggatgggaatagtgcctcacagggttattttagagatgccttctcctgacacattgtaagcactcaacaagtgttagctactcccagttggaagctagaatgtaaaaggccttaaattcccagccaaagagattgaatgctaaaattaatttcaagcaaacctatctgttcaaatagctttctcagcactgattttgatgtgaaaaatatctggaatattcttcgttatcaagcatgtgccttggtagtgtaattacagtttttaatactaatggatgatcttccattaaagtagtaaaaagataccatctcattttaagcttagagcaaaagcttacttaagtgaaattaagcagatatttattttgtcaggctctggggaggattccgaaattatttgctccctactagtgcctagcactttatctttgcaaccgcacttaccctgtagagtcatagttgcacaggaaactgtattcctgcatctctaccttcagtgtttcacgatcactgtttctcatctgccaggcctgagggtgggcagtgctgatttcactgtctcatacccactcttctttctgccagtgtcttttgtgagagcaattttatctctgcccctttctcttcaccccattgtctcttctccagtcttcaaacccaaacaaaaaacatacaaagtttgctcatattcactgcagtctgagctgctgaatgttcttccagagccccttaggatttctgcacccatacttgtaaatgtttgcatcttcattttgttggtggtgatgacaaattaccccacataacttgcctctgttcctgttttagttagaaattactgtttactggagacagaatggaaaatgtatgaaggggcaacatgagaaaataggttattttgattacttccaatcatccatcgttaatcgaattcataatatagataaccaaataaaaagattatttcaatttaaacttagaatgacttataggtttttttaatctgatttccattcttattacttcttgcagcagttttcaaacttgagtctgcataggcattcatggagctagttaaaatgcggatggctgggtccccaccaccacaactcattctgatcagtggctttaactggggcctaaatatctgcactgtatccagcccacacatgagcctgatgaacttcaccagtggtaccttaaaagatagcaagaggggcagactaattagactcaacgttgtttaccatcaaaaactgtctgtacataatccagaaagagcaaagttgaatccaggctaattgaaagactgcattttaaattttttgtttcaaaagtagagcaataaagagtttttccaatgtgttatacttcccatgagctggatactacctgtttacctagatgccacttaatgtggacagcaacttttatggctgtgcacattctcaccacccccatttaaagagaggaaggagactcgcttagactcaggcagctagtgtggttgaacagagagaaccttggtctgtctggccccagcttgctctcttttaccattatatagcttcacccaagccagcgttaacagctgtagatgattttcttctaatgttctaaaacctgaagacatggggcatcttttaaccaaatgctcagctctagggaaagctaagcctcttctattttgttgaaagataaagtgttaggctgtcgatctgtattgttacaggtccctgggctggatttagcctcaggagttaaaagtatatcagccttgtgactcaccaccatgaaaccctcagatgggagtctcctaccagtatcaataatatgaatgaaaactttatatgccttctggattgaggcctctcacagctcaaagttgtaaagaaaaacccacgcaattggattttgtgaaatatattaaatatgcccagtaatgtggctcttcaaaggaatttatatactgtctgctttactgtggtgtatcattatagctcagccaaatgcgtggcctaataatttgtttcccttatgcatatccatcattaaatgtaacatgcagacaataactatttaaacacctaaatagatgattatatagctgtctgtcccacttagactgtgaactttttatgaacaatggaatctagtcatcttcatctctgtgtctcttagctcagtaaatgaatgaatatatgcatgaatgaatacatgcgtgaatgaatgggtttgcttaacatgctaagcactagactagttactgtggcaaatacagtgatacaaagaaatagaggcagatggattgagttctacaggaattttaaaaagggaagaatcactttcagttgaaacagtaaggcaaagaaaagacaaaaatactaatatttattgagggaccttcctgatagaaatatgctagagagtctacatgtataatcttcacattgactccagcagcttgctcaaggtcacacagctggcagtgagaaccccctgaggttagctaccatggtccttctgggaagtgggaagggatagcctttgaatgaatctgggagaataggtgtattctccactggaagcaatgaaacgtagagtattctggatggagagaataacataaatggaggcactgagatgaggtcgtggaatggtaagcatttcagtttggctgaaatctatgatatctctaagggattcctggaagaagaggatataatgatcaaataggtggagatagattgggagtctgtcccatctgagtaccgttttggagtttgtgcttcctctttctccctggaggcattggcaaatcattgaaggtgatctcaagccagagattcattttaagcatggctttatatacttttatacacaatagttgggggaaaaggcaaagaggtttcctgaaataggttttggcagtggggcttgaaaagaagatagggagtttgacaactttttaaaacaaatccatgcattaggcacaagttatttaaaatttttgatgttctttatattcttctagctctttctatttacatagctattactaaattaaatgtataaaagtatttttcctttttaatttgaaatagatttcatctcatatttggcagaagataataataacttgttaacttcaaggcagtcagggtaattcatccagtctcaaactgggcattcatttaaatctattgtcttagatggagatatctagtatactcactcatttaaagtagagccgtaaatcctgaagttaaataagcaaaacaaaaggcctcccaaagctgagaaaacacttgccatagagtgcacatactgtaggaaagtacaaggattattctccggctgtcacccagcactgctaacttagaattatagataaaatatgctgtaattttaataattaatagctgactatgcaaaaatattattttctcctagcttcaaccaacaggtaacatatctgcctttcatgtcaggtactgtgctaggtactaaagatataaatatgaacaaattatagtctctgtcctcaaagagctcccattctgattggacaaacaggcaagtaagccatccgagtatgatgtggaaagtgtctgataaaagcatgtctgggctattacaggagtctaacctcactttacctgagcaagttagtaaaattccctccccttcccccaaaaatgattggtttgacacttaaagatgaattggagggagaaataggaatttatcagatggacaagacggctaggcaggaaggagggtgagaaggagagggaagcagagggaggtagtatgcaccaagatccagaagcatgagggtacccctttggctgcagaataccgagtatactatagtgtagagtatgctgaaatagaagtgtgagagatatatgtggggacaaagtttttgagggccttgaacatcatttaaaagagattggaatttttatccttaaggtactagcttgtaaacagaaactttagaggcagtgaggttaatggaccagaagacgggactgttgtaagagaccttgaaggccagaactgacgcagttccaaggcagtatcaatggaacaagaggggacattaaaaaattaaaaataggctgatgaacagtgatggggtcctttaatgcatgggcttaaagtgctacatatatagctctctgaagcaagagtgcactggacaatgatggcatggcactatttaacagaagtaagcagagtctatgtgtcaggaggattgagtgtaagtctcaaatctgcccttaccagttatgtaacttctacaagtcacctctttaaacctcacttttttatataggtgtgaagatcaagattcatgctttttcttctaatatatccacttttatatgccaaaattttcctactattgaagtggtattgttggaataaatgtgatcacaaatagaatgtatttaattcattaatttattcacttgccatttattgaatttttttttctggcaacaatgggctgtcctcttggtcccccaaaataaaaagctggtgaaaattaaatgtatccacatattcaactcacaaggcaccagagagctactaaaggacttgaggggccaagatcaaaagagaagcctacagagctgggttcaacatttccacccttttatacgctgagcatttactgacttgctgagatttggactcaacatttccaccattttataatacactatgagcatttgctgagttgaaacctgcaactcagaggccaagaagctaaacaccagtttgggcagtctgcaggctggaagtatatatatttgagtttggacatcattgaagagggagaatactagtaaatcctctaggtgttatttgggaccccgaaagtcagtgtaaactaaaaatagacaaactttacaaaggccaaagcctgggtttgaattaaattaacatctgattaaattcagatcatctatccctacttgagctaactgcaagaagcaaggttatatcctttctagaggtaggtaacataatcagaagctcaagttataactaaaaggtttcatatgtaatgtctgcattgagtagaaaataagcatgtaaaatatgaataatttcaaaaatcaagagtaaaaacaaagccacagaaaagtccatatgctggtggtatttgacatgaactctaacatatctgtgattaatatggtcaacaaattataggagaagatggagaattcagcagagatctgggaagtagaaaaagaagtggggattctagaattgaaactaataactgagattaagaattgactaaatggagtaaagtcaacagcatacaatataattgaaaagagaattagagaactgaaacatagatctgaaaaatctatttatactacagccagtatacaaaaggatggaaaatacatgaaatacacaaacaagtatgagatatatggagcatggtaaagaggtctaacagaggtgtagttggagtccaagaatgagagaagagagataataaatcatacatagaagctatatttgaagagatattggccaaaagtttttcaaaacttataaaagaactcaagtgagttattttaacttttgaataatcaattaatgcaattccatattaaaaggatgcaagagaaaaattaacagttgtttacaaatgcttttgatacaacttagcacatattcatgatttttttaaaaatcatggcaaactacgagtagaaaggaacttattttgattaaggatatcaacaaagaaaaaaacataatgcaaatatcatacttaatggtgaaatattacaatgttccaattcttaccacgtttattccacagggcctatctagtgcaacaagtcaagaaaaataaatggaaaatataagaattagaaagaaagaaagctaacatcatagatgatacaattatacacatatagaatgtcaaaagaatctatagataaaatattaaaattaataagtaatttagcaaggttgctattgcagaaagtcaatacaaaactctattttatttctctaatccagaggcaaccatttagaaaataaaaattttagggaggagccaagatggccgaataggaacagctcccgtctacagctcccagcttgagcgacacagcagacggtgatttctgcatttccgtctgaggtacggggttcatctcactagggagtgccagtcagtgggcgcaggacagtgggtgccgcgcaccatgcacgagctgaagcagggcaaggcattgcctcactcgggaagtgcaaggggtcagggagttccctttcctagtcaaagaaaggggtgacagcacctggaaaatcgggtgactcccacccgaatattgcgcttttccgacgggcttaaaaaacagcacaccagattatatcccgcacctggctcggagggtcctacgcccacggagtctcactgattgctagcacagcagtctgagatcaaactgcaaggctgcagcgaggctgggggaggggcgcccgccattgcccaggcttgcttaggtaagcaaagcagccgggaagctcgaactgggtggagcccaccacagctcaaggaggcctgcctgcctctgtaggctccacctctgggggcagggaacagacaaaaagacagcagtaacctctgcagacttaaatgtccctgtctgacagctttgaagagagcagtggttctcccagcacgcagctggagacctgagaacgggcagactgcctccttaagtgggtccctgacccctgaaccccgagcagcctaactgagaggcaccccccagcaggggcagactgacacctcacacagacctgcagctgagggtcctgtctgttagaaggaaaactaacaaacagaaaggacatccacaccaaaatcccatctgtacatcaccatcatcaaagaccaaaagtagataaaaccacaaagatggggaaaaaacagagcagaaaaactggaaactctgaaacgcagagcgcctctcctcctccaaaggaacggagttcctcaccagcaacggaacaaagctggacggagaatgactttgaagagctgagagaagaaggcttcagacgatcaaattactccgagctacgggaggacattcaaaccaaaggcaaagaagttgaaaactttgaaaaacatttagaagaatgtataattagaataaccaatacagagaagtgcttaaaggagctgatggagctgaaaaccaaggctcgagaactacgtgaagaatgcagaagcctcaggagccgatgcgatcacctagaagaaagggtatcagcgatggaagatgagatgaatgaaatgaagtgagaagggaagattagagaaaaaagaataaaaagaaacgaacaaagcctccaagaaatatgggactatgtgaaaagaccaaatctacgtctgattggtgtacctgaaagtgacggggagaatggaaccaagttgaaaaacactctgcaggatattatccaggagaactcccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtagggttatcctcaaagggaagcccatcagactaacagcggatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcttgaaggaagtgctaaacatggaaaggaaaaaccagtaccagccactgcaaaatcatgccaaaatgtaaagaccatcgagactaggaagaaactgcatcaactaacgagcaaaatcaccagctaacatcataatgacaggaacaaattcacacataacaatattaactttaaatgtaaatggactaaatgctccaattaaaagacacagactggcaaattggataaagagtcaagacccatcagtgtgctgtattcaggaaacccatctcacctgcagagacacacatagactcaaaataaaaggatggaggaagatctacctagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatgtgcacccaatacaggagcacccagattcataaagcaagtcctgagtgacctacaaagagacttagactcccacacattaataatgggagactttaacacctcactgtcaacattagacagatcaacgagagagaaagtcaacaaggatacccaggaattgaactcagctctgcaccaaggagacctaatagacatctacagaactctccaccccaaatcaacagaatatacatttttttcagcaccacaccacacctattccaaaattgaccacatagttggaagcaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatcttctttgaaaccaacgagaacaaagacacaacataccagaatctctgggatgcattcaaagcagtgtgtagagggaaatttatagcactaaatgcccacaagagaaagcaggaaagatccaaaattgacaccgtaacatcacaattaaaagaactagaaaagcaagagcaaacacattcaaaagctagcagaaggcaagaaataactaaaatcacagcagaactgaaggaaatcaagacacaaaaaacccttcaaaaaattaatgaatccaggagctggttttttgaaaggatcaacaaaattgatagacctctagcaagagtaataaggaaaaaaataagaatcaaatagatgcaataaaaaatgataaaggggatatcaccaccgatcccacagaaatacaaactaccatcagagaatactacaaacacctctctgcaaataaactagaaaatctagaagaaatggataaattcctcgacacatacactttcccaagactaaaccaggaagaagttgaatctctgaatagaccaataacaggctctgaaattgtgtcaataatcaatagcttaccaaccaaaaaaagtccaggaccagatggattcacagccgaattctaccagaggtacaaggagtaagtggtaccattccttctgaaactattccaatcaatagaaaaagaaggtatcctccctaactcattttatgaggccagcatcatcctgataccaaagccaggcagagacacaaccaaaaaagagaattttagaccaatatccttgatgaacactgatgcaaaaatcctcggtaaaatactggcaaaccgaatccagcagcacatcaaaaagcttatccagcagcacatcaaaaagcttatccaccatgatcaagtgggcttcatccctgggatgcaaggctggttcaatataggtaaatcaaaaaatataatccagcatatacagaaccaaagacaaaaaccacatgattatctcaatagatgcaggcctttgacaaaattcaacaacccttcatgctaaaaactctcaataaattagatattgatgggacatatttcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggtaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagatccaaatcatgagtgaactcccattcacaattgcttcaaagagaataaaatagctaggaatccaacttacaagggatgtgaaggacctcttcaaggagaactacaaaccactgctcaaggaaataaaagaggacacaaacaaatggaagaacattccatgctcgtggataggaagaatcaatatcatgaaaatggccatactgcccaaggtaatttacagattcaatgccatccccatcaagctaccaatgactttcttcacagaattggaaaaaactactttaaacttcatatggaaccaaaaagagcccgcatcaccaagtcaatcctaaaccaaaagaacaaagctggaggcatcacgctacctgacttcaagctatactacaagggtacagtaaccaaaacagcatggtactggtaccaaaacagaaatatagatcaatggaacagaacagagccctcagaaataacgccgcatatctacaactatctgatctttgacaaacctgagaaaaacaagcaatggggaaaggattccctatttaataaatggtgctgggaaaactggctagccatatggagaaagctgaaactagattccttccttacaccttatacaaaaatcaattcaagatggattaaagacttaaacgttagacctaaaaccataaaaatcctagaggaaaacctaggcattaccattcagaacataggcatgggcaaggacttcatgtctaaaacaccaaaagcaatggcaacaaaagccaaaattgacaaatgggatctcattaaactaaagagcttctgcacagcaaaagaaactaccatcagactgaacaggcaacctacaaaatgggagaaaattttcacaacctgctcatctgacaaagggctaatatccagaatctacaatgaactcaaacaaatttacgagaaaaaaacaaccccatgaaaaagtgggcgagggacataaacagacacttctcaaaagaagacatttatgcagccaaaacacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttgaaccattgtggaagtcagcgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgttagggacatggatgaaattggaaatcatcattctcagtaaactatagcaagaacaaaaaaccaaataccgcatattctcactcataggtgggaattgaacaatgagaacacatggacacaggaaggggaacatcacactttggggactgttgtggggtggggggaggggggagggatagcattgggagatatacctaatgctagatgaggagttagtacgtgcagcgcaccaacatggcacgtatatgcatatgtaactaacctgcacattgtgcacatgtaccctaaaacttaaagtataataataataaaataaataaaaatgtttaaatagcatgatttacaataaaataaaaatattaagtacctaggaaggaagatgtgtaagacatctatgcagaaaggtataaaacattgagagtaactaaagaagtcataaataaatcgagggatatatgatgttcattgattggaaaacagtattataaatgtgacagtttcttcccggttgttctatagattcagtgtacttcagttcagcattctagcagatttgtgtgtaagaggatggaaattggtagacatcctaaaacttagatggaaaggatcaataataagacagtcttgaaaaagaacaaagttgggaaaactccataatgccagatagcagaacatattacgaagtaattaagaatggtattgagggaaggacagacaacccagaggaaaacagattaaggagcccagaaacaaactcacacatgtatggacagttaatttgtggcaaagatgccgttgccagagctgtaaggaagcaatgtatttttcagtgaaatagtaccctgccgattggttatcactatggcagaaattgaattttggcccttctccttatactatgcatacaaatacattccaaacagattaaaaacttaagtatgaaatttaaaaaaataaagttcctaaaagacaaggtcttcatgactttgagatagacaattttcctaaataggacattaatgtaagtacaaccataaagaaaaggattggtaaataagactatgttaaaataagaaacttcttttcatcaaaagcttccattaaaagagtgaaaatgcaagccacaaagtggaaggaaatagttgcaatgcatataacaaaagatgtgtatccagagtatgtaaagaatgtctacacattaatgagaaaagaacaattattttgacagaacaatggttaaatgtgtataaatgtgtgcatatatacatttgagcagctttgcagaaaagaggatatacaaatggacaataagatacgaaaaattgtccagccttgttagtcattaggaaagtccaaattaaaaccatactatgatatcactacacaccctgcaggttggctaaaatcaaacggtttgataatgccaagtattgatggggatatcaaacacctgaaatgctcaagcattgatgtggaaatatgaccacactttgggaaagagtttggcagtatcatgataggctatgattcagcagtcctattcttagacatatatccaacagaaatgtgtaccagaaaaaatacgtatatagtaatacatgtaaaaccattatttgcaataggcaaaaactgcaaacccccagttcccatcaataatagaattcatcaatgtttggtatattcgtggagtaaaggattttatggcaacaaaaatgtacaaaatattgctacatgcagcagtgtggttgaatctcacaaacatgggtgactgaagctggcacaaagaaaatacaccgaatggtttaaaaattaagcaaatcctgtggtgtagacatctggacagtggttatctctggcaaggcatggtatttggaaaaggacatgaggtttatttcttgatctggataggtgtgtttactttgtaagactccactaaattctatacttaaaatctgtagctttttaatgtaggttatacttcattgataaggtttattaaaaatatcaaaggctctgggccgccctgtgctaggcactgggaatgcagacatgagtatgaaataacctggctctgaagaacggagaggaggaggtgagtggtaattaataaacaattagagaaggagtttgttagaagtgaagtcagggtgtgtcactttatatgtcagcacacaaaggagcaactcccaactcaacacacttcctgcctgtattaggtgcttcataaatgttaaattctactcccaccttgctatactcataatcatgagtaatcaagtaagggaaaaattatgttatgaatcctcttttttagtgcacaatccatgttagtgatagtggtggcaagtaggcttttttatttgtctgtttgtttgtttgttttttgatgtctttaacagtgagccttcctcaaacaatgtattagatagaattgcaacttcctcagctgaaattatttcatcagtgattactttctccatggaatgttaatacattgagtttctcttgtatatataaccagggattctgagcctctttcatctctgccttgggccacacagccccatagaaagatgatggaagggagaagaagggaagaacacctgccagcctgccagaatttcggctatagattggcaagcagacagctgaatggagggaggatatggacaatgaaaaggaccatctaacttgagggcacagtgcccaccgacagcacagcaggtgctgccaggcctgtacagagctggaaatcctggcaagatggtagctgctccatcttgtctggcctagttactgcctctggcccatgctgaagggagtctggggagttaccattccaaagaactcacaagaaaacagaactgacttggatatattccaggtttgcctagtggtacttcaaaatggtagattgaatgttattttaaaagtcattttaaaattatttcctttgaaatacagaatttaataggagaaaaatcagaaggagaatgaaaaataatatggatatgcagaatatatccgaaagaaatgtgtacttcaatgtaccaaaaatatgtacagggatacagataacaccatttcaacagcttaatggttagaaagaagtatgatttctggagccagactacctaagtttatattccatgctgtcacctactgtctttgtgatcatgtgtcagttactgaacgtgctgagtctaaatatttcatctccaaaatgggcatcatcatagcagttgtaagaattaaataagttaatttacctaaaacactcaaaacagcacctgtcctgcgtaaatactacacaactactagctgctgctgatgataacagctaagccatttttgtggctgagagtcagcagccacagccagggtggaggagatccttgtaatcataaggtcagaggaaagagggcctcagtaaagaaggcttcttaggcccatacagcgggaattacttcttgccaaaaggcttgtttgtcctctcttgaagccatgattagtctgcctctgccatgtcgttggctcctcaggagattacaagctctctgaggacagagattacattttttttcaagtattatttccccagcagtgctgagcacagtacctgatgtaaagttgtgctctgtaaatgtttactgaattgaatccttctaaacagaggagggagatactattaatcagggctgaacgtgtgacagcactgttctttcaagccaagactatatgtatgttctttactttttttttttttttttttttttttttttttgagatggagtttcactcttgttgcccaggctggagtgcgatggcacgatcttggctcactgcaacctccgcctcccgggttcaagcatttctgtctcagcgtcccgagtacctgggattacaggcatgcaccaccacgcccggctaattttgtatttttagtagagatggggtttctccatgttggtcaggctggtctcgagctcccaatctcaggtgatctgcctgccttggcctcccaaagtgccgggattacaggcatgagccaacacacctggctttttttacttttaaatcatcatttcccttttagagatgggatgtcagaggcccaaaaaactcagttcatttgcgtgaggtcatgtaaatggtgatatctggaagtgtctccctcaaagtcagtgccctccctcacaggcactcattccctaaggcacctaggatgggcacagagaaaggagaaccaagcttggctggggctgctgtccagagaaggtgggcaggtgtcaagagcaggtgcagaggtggagaggagagctaaatcttgtcctcagtagaagcagagatgtcatttcaactgcaggttttgaaaaatgtcagtgcatacttcatgagattttctgaattcatttttactctcatcttctacactatttatctaagctgttgttctctttgaaactatgtcagccacatgtcattcattgtgccacaaccctgggctttttatcctgcttagggttttgttttgttttgcttgttttttctccccagctgctctgcctatcacttaattctctgagccctctggcctgagtcttatccggtggtgtgggtcaccttacaatcccgtttctagtctcctgggagtagtggtggcaggcgagggatagaatcaacatccaggttcagaatctatttgtcttttttggtcttattgtccgaagcttgagtcaaggataaattaatcagtctagaggtgggagagccctctaaccctccccagggaaaatcctagcctttatagaaacttggcctggttttggctctcagatttaattccaagctgtgaagaatctgtcaatgttcaactaaccctgacaaaacctttggaagtttctgttgcaaccgaaactcttatcacaggaggtggtactgagcttggcatcagaggttggagagagaagagagctagcctgctaattaatattttttttccttaaatttcaggcttttttttttagtttaaatgttctaaagaacctgtcctgtcacttcccatctgtttcctggtgttttcctcaagcatctcactggtttgttttatgtttttgaggggattatctggggtgctgattactttccctaccttcaaggagcctttgaataattttataaatgagaccatttgtctaggggcaagagaaggttgctgaaggcaacctagtcctgctttctcccaagagaaattgtacactaacatttgtttagtagtgcctatatcccaagtacaaggctcttgccttatacctaggatgagcaactattccagtttgccccaagataagctggggggtttccttgggtcctggaccttaaatagagtgtagacgaggagagttatcttttcttctgtctatcctaggttcatagctggggcccttttaacaaaagatagattaacaagagagaagcatacacatttatgtaatatgttttatgtgatatgggaggtatcatacagaaatgtagacccagaggaacagttaaacatgagtatttttatgttaggcttgatgaagagtagacagacatggaaaaatatgatagggcaagaagggcatgatttaatggtaataaactggggaacttagcaaagcctgttagtgcagtttcatccgtgtgatccttcatctccagatacaaggatggtgctttcctttgagtacagggagggcacctctcacatgagggtcttatgacctgcttcaggggacagtcagaaaatcctaggtttaatgacctgctttaggggagaatggtgggggaaaggtaagagtgacctctatgcctctatgattttctcagataccttcagcttaaactattcaaaatactaacatgccatattttgggatagcatgtcctgaaccccatcaagtgcagataccaggaaaaatgaccctgtaaaggaaatgccattatttccaccttacaagtgagaaaagtgagtttcgaagaggtgtgttcacttacagaagtttgcacaggaaactggtggtgagaaagaatcaaatatacatctgtcagacttcagacccagaactttacactaaccaacttcttcagaatgcagagttccatctccttcagactgtgtagctcaacagttttgtaccatctggctatttttctctactgtgtatttgactttgtctcttttgtctcagggtgtacttgaaagcctttacctccccatcttccttccctgatggctgatatacttctgcctcacctgctttaggagcccctgcctccaaccatccaaactaggtcaggggctggggctccttccttctgttagactattcagatctgagtcactggtcattcgcatagtgtcttataaatgtctgcctgtgtatttttccaccactgctagactgggatcttgtagaatacaaggaaacaactttcatctttagatttctagcacccagcatagttcctggcttataattggggatcagtaaatagctgttgaattaatcaatttataaattttcaggaagcatttgtgtgccttcgagtcacagtatttgatctatttaaggacttattccataagatgcatttgtgatgcttaggccagttctcttaatttttttttctatttttaatttttacaaagtaatttttgtgagttaacttggctgtttggattagatttcaacctgatactttaccatgcctaatgtctgagaatgagaaattgtcttttctgaagtcatagatgataatgtccaagtaatctagaggctgtgttgaagttaggaagaaaggaatttctgacatcaagtttttgctttgtcttcactgtggatttttctagttttctctaagtctcaaatttccaagctatacatattagcctacctttgagatttgatctttctgggtaggaaggagaaacaggagtgagacccagttatcagaaggtctgttctttgttctctccactcctcgcaatacaaccagcctcttgaattggtttctgattgctctaagtcatggaggagtgtggcatgaagacagaaatgatgaatgccatcccaagttaaactgcagtatgcatggtgctacatgtaattgtggcttttcatgaaataagcagattttggtttattcttaatgtttaaaatgctagcctgggttatacctactacctggtacctcattttccttattcctttgggcccgcaattattttgtcatcagttgtatagtcaaggacagaaaacagatgttccaatcaatctaagtaaacccaaataactctggcaaagcacacaccgtgctgaaatcaaatgaactgttatgccaagccttgctattaacaccaaagattggaagttgttggtagtaacatcaaaaatggtgaaaatatattgagtaaactgtcccagacattgttcccctcagttaatctccatgatagccctataagccacattctatcatcattccaattttatagatcaggagactgagacataggaaacttaagtgatttgacctacttgccagacttgaaaccaagcagtcgagttccagtgcccttgctttgaaccattacgccctaactagttcatatatctagtaaatgtctgtttacatctcatgtagaaaaagaccttccctattatcttgctctgcagagggtgggagggttggggtggggagggggcagtggcagtgtcaaggtgtgtaaaatttctctgttgacttaaagcataggatgatgatgatgatgatgatgatgatgatgatgatgatgatgattattattattattatttgagacggagtctggctctgtttcccagtgcaatggcgcgatctcggctcactgcaatctccggctcagtgcaagctctgcttcccaggttcacgccattctcctgcctcagcctcccaagtagctgggactataggtgccgccaccacgcccggctaattttttgtatttttagtagagacagggtttcactgtgttagccaggatggtctcgatctcctgacctcgtgatccaccctccttggcctcccaaagtgctgggattacaggcgtgagctaccacacccagtgcagtaaaagtaaacctactttaggatttagttggggtaagttctagaccacatttctttcaaggtcaaagcaatacttcatgaaacattgggattacctttttgacttttttttttttttttttttgagatggagtctcgctctgtggcccaggcttgaatgcagtggcgcgatctcgattcactgcatcctccacctcctgcattcaagcaattctcctgcctcagccccctgagcagcttggactacaggcgcgtgccaccatgcctagctaatttttatatttgtagtaaagacggggtttcaccatattagccaggctggtcttgaactcctgacctcatgatccacctgcctcggcctcccaaagtgctgagattacgggcataagccaccatgcccggccacctttttgactgttttactccccttcatttgctaggcttgaggttaaccctttgggtttgctttagtggcattttgacagtaagtcctgaaagagatctgagttcagctatcctattgtctaggaatagttggagttcttgtaagtagttgaaaagaaaggaactagcttctgtgaactccacgagataatgtaggataaggtagaattagagtcaggtagatctgggtgtgatatagtcccaccccgaggtcccccacaatttagtagtgtgggaccttgtagaagttgcttggaaaactttactctccttttctctatttgtaaatcaaagtgataataactaccttgcagtatcactgtgggaatcaaatatgataatatttgcaaagtgtcaagcacaaagcaatctcccaataatcaaggatcttagaacctttagtctttaccagtgatttttgacaaggtatgttgtgaggctccagtaattacattattacccatgagttgtcactcaaaaccaatcaatatttttcacctttattcatatttaagacacggagcctttgtccgtgattaaatgtgctattgttacctagaaaatgtcttgtgctttactagtatgtgacttctgccacacacattcatttattcattcattcattcatcaacaataacaacaaaaaatagtgagctactgcagtgtgaagacttgccctggcctccgtttgcttatagtgtagtagagggatttgtttgtgttgtctgtgcagacacataaactaaagttacagtgacagaatctgtagagagtcagaagatgggctacaaaggaaggaggcttggtcggttctgctggtctggggtgttttggggatgtggggagatgtgatcaggaaaggcttctgatgctgcaactgagtcttcaaaatggagttggtgttccccaggattgttatgggatgaggtgtattggtggaaaggatatcctaggcagagggagcaaagtaaacaaatgcttagtggcaaggaccaccaaatcacattcaggaataaggagaaaaggtcccaaccatatggaaccctgctcatgccaggcaattctgcaggtcgtggatggcgtatctcccatttattgagtactggtgtgttccacctaaatctcatttaattctcacagcaactttgtgggtgagtattgctatccaaattcttcagatatggaaattgaagttctaaggggtcaaggcatctttgcccaaggggatgaaagagggattcaagtctaactctgaagaagtagataaacaacaaaaacagcaataacaataataaaagtaataaaaacagcaaaggttcatatagtactaggcatgttttaacctgtaccgttcaatataatatccactagctatatgttgctacttaaatgtgaattaattaggatagaataaaaaattcagtcctcagttgtactagccacattttcagggctcaattgccacatgtgtctggtatctattgtatcagacagtgcaaatatagaacatttccatcatcacagaatgctcttattagcactgttatgggtactttacacctatattaacatatataatttttataatctgtgaggaggatactattcatattgtagagatgtggaaattgaggcataaggaagataagaaacataaagaagataagaaatcacatgatgaatgagtccttatttttaagcactgtgccataatactaactcaatatattgtgttctgtttaacataaatgaatgttagtcaaaataatggacttcagtgtctgcgtgtatgtagtctggtgttaagtcttctgcagagaacacgtctttgatatgattcttatccttccagaagcatacagttgtcaatttgcatgtataaagctggtggtcactagagagtcttctctggagcccttcctctccaggaactccagaaacctcccagccagctttggcaagaaactcactggatgggattcatcagtcagttcattcatccaaatgactgaatcaagagtctcaaacagatgtagtcttaaataatgttcaaaacccttcttatcctttttgatacttcagagaaggtgcctgaggttattaaaagagaatctttttcaagatgccaacacatcagactcaaagactgaaaatcctagttgagtccaacttctacctctaagttactaaataaactcgactaaattacttcacctttctgaaattcaatttcttcaactgtgaactggaaataaaatacacatatcacaggattttctaaggactaattgaaggttacagtgtttgaggatactttgcaagctataaagtactttatatggctataaagtgggagataattataacacaaatgcgagaactcaggatgtttttcttctatataaccttgtaagctttcaaaactgccacagcgtgataaattataggaaaatgtactcttaatcataacatttgcaaagtctcttttttattttacataaatatagtagggactcaatgcttgggtggaagtattgttggttggatgaatgggagagatgaagggagacagcatattaaataagagagctgttcatgaagttttaaatgttccttttttaacattctttttaaacattgcttgatatgaactatgtgtgttacatggagggttgggagacatttaattcattgagttagcctgtttttctgctatttgttttttagttcaacaaacatttattgagcaactgccatcagttgggcattgtgcaagtttcagggaaaacacagttgatgatgtcactgtttttttatgcctgtttcttcatctgctaatttttctccttaaacattttgaggattgcagaataaactgacactggtatggtcatatgaagggccccagcggtaccgagggctgcacttgtgtcaaattgtttcctgatgtacacatgcagcctgtgagttctctgtggatggcaaaatatgtttctccggaaagaagaaagctcctcccaccttttcttgcttttccctgcttatctctgaacctcttttctcggggatagcccatcaaagcactgtgtggccaaaggaaaaataagatgtcagctctccgactcatgtggtcttgcagtgaacatcagctatgcatggctgctgaattggggtggacattaggcagagtgtagagaacctcttgaggggaaatgaggccagtcctgcccaatatatataattttaggtaaggagatacctcagcttgtattttaggagaagcactgtgtatatactgagaatggctgaggaaggacctccatttgtaattcatttctctcattgtggggatgagagaaccagttcaaacttttaggccatttgtggcagaattggggctgaaactcttgtttttctaactcttagcccatggctctcactgagtttcatggtgaactagcacttccaagtatgttttcattatgtaagacaattataacatcataaagtgaggagtatagaaagaacataagctttggagtcagacagaacaaggtcaaatcctggcactgcttcttaaatccatgtggccttgggcaagttacctgaacactctgctctgttcttctacttctgcatctattaagaggaagaaagaatgtttaccttttatggatgttgcaaagattaaatgagagaacattcaaggagctcagcacagtacccagcctatctttgatgttgatatgtttactagaaaggaagaatccagttgtctcttgagagggggttcagatgatgatgatggtgatgatggtggtggtggagagagtgatggtagtgatgatggtgacagagctaccattaaacatctctttttaagcatttctgcaatatcacaacaaccatgtgatgttgtgattttcctcattttatagcagatccttctgtctccaaattccatccttttctcataatagcacactagttctcaggttctaagtctagatatagcagcagtgaatctgccaacccaagaagaaacaaataaatatttcctacacatttctttttccttcattttaattcccttttcgtattgactgaccctgtaacattaactttgcctgtactttatgtttatgcaaccagtaaatgtgggtgattctcaggaattccttgaacctatttatgatactgtggagcagcgtggccaactccttttctgtcaaggatctcagaatcaatatatttaagatcccaagattttgagatgtacagataagtgaacattggttgcctggctattggatttttatcttagagaaaaacctgtgagtcttggtggggaagaaccagcactttggaatcagattacctgaatgtgaatcacagcccagttccttgtgagctgcatgaccctggtgaagttactactcatttctaagcttcgattttcttatccataaaatgaggataatactaataccaatgacattagtttgttgtaagaataaaatgagacatgtatagaaagagcatgtaaaaagagctcagttaaaatgagctcatatcttgggttattcctgtacaaaagcctttgtgccctgaatggagaatcgtgtcactcaggattcactcagcaaaacacaaaccactctaattgtttaaaaaaccagtaacttaatacccaaaaatggcgatcctgatgatggaggagctgagaagggctacattccctgtgaagcaaatcagagatcagtgaaatggaagcagctaccatccccaggctggagggactaaggagggaggagggaggtggtgttctcatagtctgagggcaggggacaccagccgatgctggagccatggcagccctgtcaacagagcccgagtggtggaggggaagcagctgctgcctggcacagaagagaagtagataggctcttgcttccccttgcctgcaggggtagccccacaatactgagcagagcagcggacttgatctgaaaacacataggccaaggattcttgcaggctaaagtctcagacttctattgcctggttgtggatatgtaactactgtgataactaacacagaaagtttggaagagtcttacttccccctgttgctagacctctgaacaatagcagagattcacaggttgctgtgccccagaaggtagaatttggaaaaagcagtggaaaaccctcgaaagctgtaagaggcctgtctctggcctttttctcacattactttctagcaagtatctgagcagccagtgccttcagtatctggggatttgtggtctgatgagacattcccaccctgccgtttacctggctaacttctgcagaattgagtatagactgaacttccttgggcccctataggtgggttagctgcctttgtggcccctcctgtgatacactgatttccctgcactgaaatactccatttaggcttccatctccttcccaccagactgtgagcagggacttgtcttcttcatccttgcatccccaagcatttgtactcttacttcctgtattgagctagctactgtggtaggtcctgggctatgcatgtaagtaagagtgccagctactagcaacttttattatagaagggaggcagatgggatatatgatgttttaaaattacccatgtcttttgtgctagggaagtccattgcatgagactatttaacagggagaatcgtctgtcctagagggtcagggaagccctataattaggagtcggcctgacagcgaggttgggggaatggcattccaggcagagggaagagcaaatgtgaaggtcttgaggtgggaaacagcattaaggattagagattgagagcaaacgtggcattgcctgggagctgatgaggtcagcaggacctgttctctcctgtgtccaagtctctgcgtcctgcctgagcactttccacccccagctttgtgttgtagtcctgcaagtctgcgtgtttgtggcttccacatcacacctagtatatatcgttttgtgcatagaaggggcttattggatatttgaacaaatgaatacaattccaggccctaaagagtctttctagctttcttgtcatatttataactttagttgccctgcaagtatcaaggaatacgagctctatggggaagaagcctgaatttataccatttatgggaaaccctctgctatttggcattctgttactaggaactcgctctcagtcattctctccttcacaattggagttctgcgataagtagtagtaagaatggtgacctagggatgccagaaagattcagtcatcagaccatcctttgcttttgcttctttgggactgagatgtgatgtgttaaaccagattccatttggctccgctccttcttagcagtgaccttgggcaagtcagttaacctctgcagaccttagtttctcctctgatgtctaacattaataatatctatgatagtgttaaaatgagaccatgtatgcaaatatgtagcatagtgcctggtatttagtgagcagaaaataactgatagctgctgcttttattatgacaatcacaattactgccattattataacgttgggtgccatacattgaccagaacaaagcaaaatctgagcaggcttccgaggtttcctatgcaggcaagtatgccctttgggtttctccttgagactgccctacacacaggacccttcctccatgttgtttgactattaaaaagaagatttgttaatgcttgtttttagctttctctccctctttttttatgtgttaaagaggatttgtttttgttttcctttctcacaggagtgattggggcagatgtgagagggcacggcctcatctgtgaggggcagccagtgacgtcacggctggctgtcatctgtggaacgtcttcttgtcacatgggggtgagtccactgagcacaaaggcaaggccaccacacagcaggaggtagcctggaaggagaccctgagtgctggcttcttcaccctttcacttctttcctcttttccctgcctgccccttgtgctttgtctagccagaagcccagctccccactctacctcccttgcttaacatttgctggatctttttccaggggccaaattcttagtaagcatgaaaaggattgagtgctccctttgacgtcaccctggccagagagcccaggcatgaatggtgacatctgatcctaaggtgacaaagtctagctcccccagactgatctgtccctaatgggtagcggggtcttctcggcaaagagtgtctgttttccttggccagggaactctctctcaatcaatataaatccatctccctgggagcgtcctgatgatctatagaattagcctgcgtatcatgacttcaaaagaacactgataagcaattttcactttgttaatttttctccatgaattagtgaaaaggctttctccaagattgcagttaaaatttagtgcctgccctaaaatttatatcttctttaaatgcatgagtctgaaagcattccattccgataagtacccatttctaccatatttttatttaaaagtcattactctgttaaacttaaatcgacgactctttggaattttcccagataagtataatagagggcagagtgggggaggagcagggagatgagcagagattagagcgggacacagcccagggcagaaccaaagcagctatggaggaaattaagtgggatgtgagactgttttgcaactgtagggacccctgagcctttttaccatcagatattctagttcagttgatataaatacatgtacttacttatcaatccctgctcttgtgctaaactgtggatataagaatgacatcggctcagtgggatgagatgaagttataacaggtattagaatataatgtgaggccccccaatgtagatacaaattgaactcatgatactaagcatctgttatgtgccaagcaatatgcgaggtattcttgcacatggcatcccattttctatggctgagggagccagcccgagtggtttccagtcccacttcctcagtttactaagtgtgggcctttgggcaaggtacttaaactctctgggtcccagattcctcatctacaatatgtagagagtgacagcacctgtcagagtgctgcaagaattaaatgaggtgatactaagtgctccacatgcagtaagcacatcacaagggctcactcttaatcactaggactgttgttgttactgagcagaaagcaaacagtggctgactctgcctgggagggtgcagggtgatagaatcttcttgaggtgacatttgtgctggactttaaggaaatagatttccttctgtttgggctctgggcagtcttgaatggaatttttctaagtttaaaaattgcagcatatttggccagacacagtggctcacgcctgtaatcccagcactttgggaggccgaggtgggtggatcacctgaggtcaagagttcaagaccagcctggccaacatggtgaaaccccgtctctactacaaatacaaaaaattagccgggcgtggtggcaggcacctgtaattccagctgcttgggaggctgaggcaggagaattgcttgaacccagaaggcagaggttgcagcaagccgagatagtgccattgcactccagcctgggcaacaagagcgacactccatctcaaaaataataataataatttcagcatatttcttctgctcagcagcccttttgtaaggctcagctgtccctgaagggagagatctgcagaggcctgaggcctctttaagccagaaggcaccagcccaggagccagcccttctttcccttgatatgagtctacacttgttagattgtcttcactgaatactgatttaatcctgtttaaattatctcttattttcacagggatacatctaatcaggcttctcctgggagatctgaatctcaggcatttttaccccactcaattcagatttctgaacagaagcaaatctaaatggatgcaagtgtctctgtgatggcctgcttcttagtcttactgtctcttaatggagatgaggctggctttccctacccatttaatgtacacatttgggacctaaagcgtagaaaagtccagtaattttcccaaagtcacaaagctttgaagttcttgagctaagaactgaaatctaactctgattccaaagctcatactcctccttgcctccctgaattgtgcatgaagatgatgtacccatagaggaatggtgagaacatgggcttttacattgtccagaggcaagcttgaacatctgctcatgcatgttttggccctctgacctgagtgagctacttaacttctctaagcttcagattcttcatccatcaaattggggataatgatgccagtctcacagggttgttgagtaacatgcattatgtaggtttgtacctagcacacagcagacactcaaaaatggtggagattgttattaaactttcctagtgatgtaaacggctcacatgaagcaactgtttgggctttaacgagtttgatgggcagctgcagttggttgcgatgaatgagggccataaaaggccagtttatgatggctgtgttgtgctggaaataaagtccccacccccatcctgctttgtacttgggagtgggaagggaccctctgggccaaggggattaatcatcagctttaatgttatgtcatgagggtgagactgtggtcatgctggcatgggaaagtgcctttgatctcctcaggtgctgggaacccagcaacaataacacctttgtgaggtctaggagaggtgcaggtctgaggaaacactcccagggagactcaaggaccccctttgttgtggttctggcaaataaaaccgccactgtgaggaaaaattaaccaaacagaacacagggaccaaagggtgatgcgggcttttcaaaaagtggttttcagcatgatctgaaggatcctctttcttcctgtctgcttacttctgatgtttccaatttagtagattgagacaaaattcccaggaacgttttgtgcttgatccaggttgcctctttctagatcacccaaaaagaataaatgaatgaacgaatgaccacataagtgagtattggtaaatacttagaagcttcgtacctccaggttcctgttgcttccaggaatctggagaaaaagcctgaggttgaacataagacatgttaataaggcctttgatattttagaagatacaagcatgggctgcacatttatcttccttgtgggtgatttaattaacaggggaaaaatgccattctttttttaactccatgaaagcagagctgcttgttcagagttaattactaccaagtcaccaaaaccccagataatacacagcaggggttagccagaggttgaaaagtcatggggtaagatggagctgatccttgccattgtactgacatccttttcttgagctgtcaggttgggttgtaacttggcaacttgtcttccagttagcatgtcagatggggacaggaccctgggggggtcggggtagggagaaacactgaggaggtaagatttgagcagaacaatacctgaagagagctgggaactacatctgcatcttaaatcgctcagaactgaagttttttcagtcttaatattgagatagtggttctctatcattgaagggatgtggagactcaaagacataggctcatacgctgcccccaccacttactgtgtgaatttaggcaggatgcttcatctttcagtgcctcagtttctgcatctgttaaatgtgagtgatagtatttacccataaagttttgttcaggttcaaattaggccatctttgtaaatgacttggcactgtacctggcacaaaataccaaatatgatattgttattaaaaatgagttgttaatcacatgaacaatccatgtggttatggactagaattagagacatcagtatgaactcatattgggggaacccacccccaatatttcaacgtaggttctttctattttccgtaagtgtcagccggctgagaaataaagagaaagagtacaacgagaggaattttacagctgggctgctgggggtgacatcacatatcagtaggaccatgatgcccacctgagccttaaatccagcaagttttattaaggatttcaaaaggggagggggtgcaagaacagggagtaggtcacaagatcacatgcttcaaaggcaaaaaggagaacagagatcacatacttctgaggaaacagtacaagggcaaattcagaactactgataagtgtctatgttcagctgtgcatgtattgtcttgataaacatcttaaacaacagaaaacagggttcaagagcagagaaccgatctgacctcaaatttaccagggtgggttttttccccaccctaataagcctagggtactgcaggagaccagggcatatttcagtccttatctcaacctcataagacagacactcccagagtggcttttatagacctccccccaggaatgcattccttccccagggtattaattattaatattctttgctgggaaaataatttagcgatatcttccctacctgcacatctgttttaggctgtctgcaagaagaaaaatatggctctttttgcccgaccccacaggcagtcagaccttatggttgtcttcctatgttccctaaaatcactgttattctgttctttttccaggtgcactgatttcatattgttcaaacacacatcttttacaatcaatttgtacagttaacacaatagtggtcctgaggtgaagtacattctcagcttatgaagataacagggttaagagattaaagtaaagacaggcataagaaattattaaagtattaattttgggaactgataaatgtccatattaaaatgaaatcttcacaatttatgttcagagattgaagtaaagattggcgtaagaaattataaaagtattatttgggaactgatatatgtccatattaaaatgaaatcttcacaatttatgttcctctgctgcagctccagccagtcccactgtttgaggtccctgacttcctgaaacaaactcatatttagtttaacatagatgcagatggatgcatatagaaatagttatggatatatatacatatacaggttagtaaacacatatttatttcctggctctgttagctgagatggtctagaaataaggatacctcaagagctagtttttacaagcacatagtgtccagatcatggtatctaataccattatccaatacaaagaaccaggactccttggagaaatagttgattttaggattggaataggaaatatacaagatgagcttggagcatttgcagtgccagaaagttaggaagttctcaacaaaaaagatgagaatatgtcacagggagccaactgtgggagctcccactagccaaaactggaacaatttaagcagtaaaatgaagtattatgaattataactcaaagtataacataaatatccataagaccatactgacataaattattttgaataaataaatcaatgaaaagaagagagacatctcccatgcagaaagattccaaataatttatataaatgttccaccatcaaggaggtggagcataactttccactccttaagtgtgggctgcacatagcgatttccttccacaaaatatggtatggaaaacgggggaagagtaattttacattggagaaatatgagaaacagcatccacgtgacaaggtcaacatcaacaatgataagtcatgttgatagtacgtacccttgatatgatgtaatgaaaatgacactttgtctctgttgtgttcatcccccaatcctataagcccagtctaattaccaggaaaacaccaaacagatcttagttaagggacatcctataaaatacttgaccagtatttctcaaagctgtcatccaggtcatcaaaaaacagggaaagtcagagaaactatcacagccaagaggaacctaaagagccatgataactaaatgtaatatggtatcctggatgggatcctggagcagagaaagaacattaggtaaaatctaaggaaatctgaataaagtatggtcttcagttcatgataatatatcagtgtcattcactgtgacatatatacttgacaagatagtaatgataggggaaatgtaactggatgtgaggtatatatgatctttacaaccatcttatattgtaaaactattctaaaatttaaaatttatttttaaaatattcattaactattcactcataaagaaaacttttttttttaatttacctggctaagtgctaaaagtcttcataagataaaatgtcatgcctgccttcaaagagctcaggcacattgagaaagacagacagaaaaaggagatactacaatacaaaatggtaactactatagttaatgcatggctggagtgtggtggaagtaggaagaaggggctgtcccaagtcttgggtagatgaggaggttttcctataggaagagatatttgcaggatcatggcttccccgcccccactgagacactgttcctgccagcccaatttctgtagtaggccctttcctcagtcttctccactttgtttttctttgctgtgtccacaaagcctcacagctgacttcccctgaggcctgagcaggatgtgggtgtgtatgagccctttgggagggcaccacagggagacagcacagtcatgtattatgaactgatggtcttctgttactagctgagaagagtgggcaagtgggaccagtttctctgtcatggtctctttaacaagtgacattggcagaagttaccagaggggtggagtgggatgggattccacacggtacagtagaccactgttacacctaacaatgaaagtgctgaggtgctgctcagaaggtgcctcgcttcctctttgtttaccaggacctgttgtcgtcagccctctaggaaccagcattctcaggacactctctgtgtcaagactagctctcagactgcatgttttgaaaacaaagtatatgctaggcattgattcggcgaggagagggttgatgtggttcagtggacaatgagagacagactgtgcactcaagaagctcaaggtagcttgtttttcaagacatttgagaaacatagaaacattatgctggactgagtatgtttaatatctctgaacccaggcagtagcaccctttcctcaatcctcatgaggagataagcagtaatactacttgctaccatctgttgaccacggaccatgtactaagcaccttactaaaactttgtatcatgtaaatagctcaacaatcctaccaagtaggcaccatactgtccctcattttacaagttaggagactgaggcaaagagtggttaagtgggtcacacaatgtgtaggaatgcaacactttgagccctctggaagactgaccagagagtccttcctcctccctttcagctgtatagcttccctcaaaggcctagaggaaagggagaacagactcaattaaaagggccaaacatgagcaaatgtttgaacagacatttcaccaaaggagaaatttgaatgaaaagcactggtcattagggaaatgcaaattaaaaccacagtaagattctctactactcctactcatcttagaatggctgaagatgtgaggaactgtagctctcacacaccactggtgggaatgtaaaatgatgcaaccattttggaaaatggtttagcagttacaaagttaacatattcctactacgtgatctagccattccactcttacaaaagcatgtattcatacaaaaatttgtacagtaatgttcataccaacaaataaagctttgtaatagtccagcactggaaacaaccgagatatctttcaagagtgaatagatcaactcttggtgtatcaagagaacaaaatactactaagcagtaaaagggaatgaaccataatataaggtacaacatggattaatcacacaaaataattatgctgagtgacagaagccattaattcttccaggcaacttgcagtcttttgtggaaaagtgggctcaggccagctgataggtagattccccctaaaggcttttgttcctggccttctgagatgctttgtttcacctgactttgccatgttcctggtggactttcagaaacatgaggccagatatccctgcccagcttttatagaaatggaatgtctggatcacagggtagatgtaagttttaagaaactgccaaactgttttccaaagtcactgtaccagaaacgaatgcaaactttcttgaataaaaaatagttccattatttaaattcttgcaaaagcaaactaatatatagtgacaaaaagcagatcagtagttgcctggaatcatgaaatgggcacaacaagggccaggaaagtaggatcaaaaaggggcacaaggaaagatttgggtatgtttatcttgattgtggtaataacttcactgatctatgctatgtcaaaactttccaaatcagacatcttaaatatgtacagtttattgaaagctattagctcaataatgctttttaaaaacagaaaaaagatcgattttgtatctggagactttactgaagttgcttatacacctaaggaattttaaggctgagatgatggggttttctaaatatacaattatgtcatctgcaaaccgagataatttgacttcctctcttcttatttgaataccctttatttctttctcttgcctgattgccctggccagaacttccaatagtatgttgaataggagtggtgagagagggcatccttgtcttgtgccggttttcaaagggaatgcttccagcttttgcccactcactatgatattggctgcgggtttgtcataaatagctcttcttgttttgagatatgttcattcaatacctagtttatggattgtttttagcatgaaggggtgttgaattttattggaggccttttctgcatctattgagataatcatgtggtttttgtcattggttctgtttatgtgacgggttacaccaataatagagagtcaaatcatgagtgaactcccattcacaattgctacaaagagaataaaatacctaggtatacaacttacaggggatatgaaggacctcttcaaggagaactacaaaccactgctcaaggaaataagagaggacacaaacaaatggaaaaacattccatgctcatggataggaagaatcaatatcgtgaaaatggccatactgctcaaaataatttatagattcaatgctattcccatcaaactaccattgactttcttcacacaattagaaaaaactactttaaatttcatatggaaccaaaaaagagcctgtatagccaagacaatcctaagccaaaagaacaaagctagaggcatcatgctccctgacttcaaactctactacaaggctacagtaaccaaaacagtatggtactggtaccaaaacagatatgtagacccatggaacagaagagaggcctcagaaataacaccacacatctacaaccatctgatcattgacaaacctgacaaaaacaaggaatggggaaagattccctatttaataaatggtgttgggaaaactggctagccatatgcagaaaactgaaactggaccccttccttacaccttatacaaaaattaactcaagatggattaaagatttaaacataagacctgaaaccgtaaaaaacctagaagaaaacctaggcagtaccattcaggatgtaggcatggacaaagacttcatgactaaaacaccaaaagcaatggcaacaaaagccaaaatagacaaatgggatctaattaaactaaagagcatctgcacagtcaaaaaagctgtcatcagagtgaacgggcaacctacaaattgggagaaaaattttgcagtatctccatctaacaactgttcagaaatcagttagagagcctctggccttagtgtctttgggctctaaccacagaaaagccacccttcagaccatgctacgtttttagagctgtgttctctgggtgatgtctataacagcactttacagcttcctcagaacaccaaagaaaacgttccccagaggcaaagggtgtggcctgggcctggggggcccatgtttcatccaggaccatgaggcactgcacagtgtttgtttgttagaggagcagaggatgctcaaaatcattagtcgttagggaaatgcaagtgaaagacacagtgagatccactccacacttactagaatggctgaagttgtggtgataatgtggggaactggaactcacatgccactggcaggaatgtcaaatgatgcaacgactttggaaaacattttagcagtttcataaaacctactctaccctgtgatccagacattccatttctataaaagccaggcagggatatctggccccatgtttctggaaacccactaggaacacggcaaagtcaggtgaaacaaggcatctcagaaggtcaggaacaaaagcctttagggggaatctatctatcagatggcctgagcccagttttccacaaaagactgcaagttgcctggaagaatggtgtaagttcttcctctagaagtagaggacgaaaatggtgcagctgtgttttagctccctcctgattggcagcatgggttcttctcccaagggtacaagggaatggggtgggatgggggtggtatatgggagtggaaagttctggaggactgccttgattagcagcaatgacaataacagctaatatttattatatgtttatcatggtctatttggatttttttaaccctcataataaccttatacagttgtcagaattatcttaccaatttatggggactgaaactgaggctcagagagacaagtgacttatccaaggctgtctagctagtaagtcctttctttttttttaagacagagtcttgtcgcactcttgctcaggctggggtgcaggtgcgccatctcggctcactgcaagctctgcctcccgggttcacgccagtctcctgcctcagcctcctgagtagctgggactataggcacccgccaccatgcccggctaattttttgtatttttagtagagacggggtttcaccgcgttagccaggatggtctcgatctcctgacattgtgatccacccgcctaagcctcccaaagtgctgggattacaggcgtgagccaccgcgcctggccgtaagtcttacagataggtttgccactcaggcagttggattccagagctcagactctcaacaataagcagaatgatgagacacaggctgtgggatgggttgaccataaacacacgtgttttgtgggaatgaggtagagtgattacacagcagatctttcccagagcctgatgagaactgcacagttaaggctggatcacagctagaccgcagtgctttcattttccctttttcccagtcttccaaatcacttcctttcaagaagccaccagcctaatgataacaataaaaataaacaacatcacttgtcaccatcatcccctgggaagagagtatttatgagactccctatttaatcttcccctgttccctgctgcgctgtggtcaagtaccaaatttggcaatgtgaagacatgcggctgacttcccaactcatgaagatgtttttctatttgtttggagagcatgatgaaaaccacattgattttttttttccttttcctatttaccacacatctgttgtgtgggtgattctgatattgtggctgctgagggttacctggcagtaaccctcagtaagaggagagggtttgtccttttccagaagtttggtgtggatgaaatagatgatgaggcagtcatggtggagccctaaccaagcattgggtcccgtgccaagtgcctgcatgcatgagctcatttagttctacatacatttagttcagaggctttagtatttatgccttgtttttctcttagtttttcatcctcttctcctattctgtttgtgtgttccaaatgtctgttttttcatacattacatttttatatcttttgaaagtactcttaagagctgtcagaagtttgaggtagtttctactctttcacttaaccaatggttagagccccaggagaaataacagtgagatcaaagaactcagaagaaccaatgggaagctttttgagcaatcagcactgaaggaatgaaattgaaagtccctacgtaattaaccatcagtggctccctactgccaatagaaaaaaaaaagttcagatgagacaatgagtggaccttctggctgtgttcttatgggtttgggatatattgcattagaataaaaccgaagtcttaaatcctaaatgaaagttactgtcagttatactgacagtgatactgtcatgtatgttgtaaatctttttgttgaaagataatttacataccatgaaatttatccccttgtatttttaaaacatctagagaactgagtatagtgatgtttgagaaagaggagacttactgcccattttttaggttacattatgggatgatactagtgtgtggtctttattacttagggagataacagaaggatatcatacaatagtacattgccatttacttgtatgtacctgacacataataggtgtccgttaaataatagatatatacatgagcataaggacagacagaaaaataccagttagcaactgtaaaggtttgttggagaagaaatcgtgccatacctatttgatttctgttctctgatggagtgaaaggctgggcagagaaagggagatacagcatataaaccaccaagttattggtcaggccttaggttctttccttgattaactgacccttcccacatgccacagcagcattggttaagtcagtcacacaattttatctgtgcacaaccgagttgtccactgaattatacctcaaagcaggccaaaaatatatatatatatgtaaaactgattgaaaagcattaagaacaactaattgccaatttgtatttgggctgtttagttgatcgttgtagccttgtgtggcaccaggcaaagactaagccacaattctgttggttgaggaaatatttaactggaagatgcttttgaatgaatgatcagctacccaggtactatttgacatacagcagtcttggggcttccatgacttattctcctatcatctgtttgcatgataaaattacaggtttccatgtaatctttagcagatgtatttgctatgatcttggaagacagggcatagcttctctggaattaagggaatggcccaggaaaaagaagaggtgcccacagataaaatggtcagttatttttatatatgtgtgcattcttctgtggtgtgcagaacaccaaattgcttggacctgtttattcccacagactcacagtcaaactggtcctgaatattaaatctgatggtttcattctcctgataaaaatcctttgtcgataaaaaatcctttgtcaagtctcctgaatgctagctaggcatacgagatccagcattattgcccctgtctacctctgataccattccgtgctatccctcaccattcatcctgtgttctagcaggtgcatctgcacacgcttgtttgaattctatggaaccagagatgtttgagcatagagaatgaccagattttaggcagttaatactgtatatatacaatataatgcataacactgccagtgaagtttggagcagcacctgtaatcgtgcatactaatatctctacagtaaaacatatgaatattcacaccaaacaggttaagtcagctttaaatggcttgatccattcagatcagattttaccatcaaatgaattgtgaaaagacttttggtatttgaaatgctttgggttgaagaagtgtggtagacctgtacttgcttttcttgaaaagagcctgtgctctcttattcatctggcctttgggcatgttgttttccctgcctggaatggccacatctccctctgcctgttgagtagcatcattactagaatcatcattgcatatactgaggatttactatgttgttactcccagcaaattctatggtcgggggggcgggggggggtgttcttattgtattacatccccccagtgtttagatgaggaaactgaagcttggagaggtcacagagctaggaagaggtagagctgaggttgaaccaaaaagtatggagacaacaaaccttgggttcttagttactacactgtccgtgtgtgcgtcttccccaaaggtccagttcaggtgtcaccttcctaaggccctcttcccttcctccaccacgtttaatagattatgactcctctgggccttcacagctgtttatgcatagctgtggtgcactgcttctcattctctgtctttcccatgagcctaaactccttgagtagttggggaaaaatgtctacttcagtgttctatctctagggcatacagtaggtagtcaacacatagtttataattaagttagtttaaagtgatacggtaacagataacaatttgtatcatcattaaaataaatagtaaacaccaaatcacaagttcaaggatataaaatttggatttacaaaagaaaaaaatactcagaaaaaaaaaggctgctcatttttatgcatggtatgtaaagaagaggaatttggggacaacagttcaagaatgggcaaggaacacatttatacttaaaaattatgacagctaggatttattaaatacttcacatgtgacagtttctctgctaggcattctgtgtataaactttctaatcctcacaacaaatatgtaaggctaattgtcgaatccctgaatggacaaaaattatagctatataagaaagagaaagatatggtaaccatgtcttagatcagaataaaaagaacaaaaggtaatgatcctaatatattcagatttaacataaattaagcatcattagaggacagtcacataaaattgcacaatagaatatatttccacatctgagagatgatggaattgaggtcaaagagattacaggctagtatgtggtattttatacccattccttgaattatgttaacatggtaccagaagtatatcttgctgtcctcctcagaactgggtgcagttttgagctctgcttttgtaaaaagctgttagaacctgaaagaaccacataacacagctgtaatattcaagagaaagtgggtcccacgaacaaagattgagattgttcagagaaatggggtggttctgattgcttaatagaaacctcacaggttggctctattattttcttgtttatggaagtttttgtgaccgtaagagctaacttttccttggtgctttagagtttattaaacgtcttatggaatttgatgctcagaataactaagtgaatcagtcagagcagatgttttctttttttcaaatgagactcaaagaaattaagtgatttgttcagtgtcccacagctaataaatgatagggccaagactcagatatgtatctgagcagacccctgagccatgtccactgcaatcttgcaatccttggttcatcttcatttactcaaattgaaggatcctgcggctggtgaatgtctggttcattgcagaagagttcctggttccttgtctctaatttccattgtgactgtgaattctccattgagctgcaagccagtgactgtcaattaatgtgcacaaaatatacctgggtaactgttttaaaaatgcaattcctcaggcccctctcccacagggtctgattctctaagtcttgctggaagggatatatgagaatctgtaattttaacatgtgcccaggtgattctaatggaaaactttcaaaaaaactgctttaagctctttcagagtagcaattatatctttacttcattgtttccgtagtgcctagcagagcaccttgtacatagacagtactctaaatttacacttgatgaatataagagtgaagtaaataaatgtaaaattaatgtaaaatgaaggaaaacaagtttgagaatcagtcagttcctgccagatttggagcacactgaggaatccctttatctccatcctttcaaataaaatatctcttggtaggtctgggtaagacatactgagaagtcatgacttggacaaagtacctggtagaatctgccaacaattagagattgtggaattcttattttctcatggaaagcaggatggagtgaaacagtgagagatcctgtttgtagttctgtgcagacaaacccagaaaccagaacgcagacacaccaggacgcaacaggaaaccacaaaggcctgagatctttcaatgtaaataggaagtcagagtttacttccgaacccacagtgccaagctgaagtgcagtgtttaatccagctctctacccagcccttccttgagcctgggcacagatgaaagatgatgatgccacctgggtaaaagcattcaaaaatgtttgttctgatcaggtcttggagtgagcttcttttgtttgtgctagtgaataatttgggacacaggtgcactttgcatttgaaagcgttaattggtctccttggttttccctgccatgatatttgaagccacatcttcctccacaaagtaattttaatccatatacattcaaaaagcacttgtcatggacagccgtctttcatataccccatctgtggacccctgggtccaggtgcagagtagtggaacattggtgatgcttaatatgtactctgtgttcattgcattgacatctgtaatctcatttgattactactattacactgggaaataattaataggatacgatcatcaccattttgaaataaggaaaatgtagtctggtagaaaacacatggatgttaaagttaggcagatctgtgttcatgtccaaaagacttaagctttcttaccagactgctttattttatgtagccagttgtttagagcattcactctgtgccaggtactggagagaaaatggtgagcagtagacctagactgtacagtgtagtggaggagatgaatactcagcaaacaattacaaaaatgtataattacagaccttgataagtgctttgctttcataccctgctgggggaagtataaattgggcagtcactttggaaaacagtgaggcattgtctgatcaatttgactgtgcacatgccctgtactctaccaattccattcctaggtaggaagctggagaaacaattgtacttgtgtaccagtaagtgcccagagacaagtaagtacaagagtattcatagcattattttttataatagctacaaatttgaatcaactcaaatttcatcaataatagcatgaataactaagttgtattatattcatacagtggtagacatacttaaaatgtaggaactacagctacatatgacaacatagatggatcaaacaattttaagtggaagaaacaagacatgaaagagatacatacagaattatttcattcatagaaaattcaaaaagaagcaaaaaagacaatgtcttttaaaaaatgcctacaaaagcactaagcttagaaaagacaagcaagggaataattaccacaaatatcaggacactggtgaattagatggcttggaattgcaggttgttgaggttaaaagatgctttcaggaagagcttgagggaactagcatttgcttctgaaggatacatgagtacttaacagtttttttaatgttcacataagttttatacactcctctgtatgtatgatatgtaagtgctagaaagcagagaagctatcagaacatagagccaagtgccatataatttgggtggtctagaaggcaaggcagtgatgtttgagctgggagattttgattaggtaactaagcagagagcctgacggggagggagtagggttgtgcatggcagtggtcaagagaaaaaatttgttcagaaagagagtacagaagaataagcagaaggaaattggcagctttggtgtggggcaagagagaagaatgctacaagtaaaggctggagaagcaaaaaggggtagcatatgctgggcttgtaagccttctgagggattttagtcttttatgtaagagaaactgaaaggttttaagcacagtggataagataattgaattacaaaggatggaaataattccagtttggagaacaaattggcaagagacctgagtggtactaggatactaggaaaccagaagaagactgggagtctgtgtgagagatgatatcatactaacttgtctcagattatggtgggggagatgagatgtcgatatattggaaagatgtttagaagataaaatcagcagcacttccttggtgtgaaaactgttgaggctgcagggcaaacacaatagaggcttattaggtatctcacccaaactcctaagatgagctgctccccagtgagtagagatatctggagagagagcagtagtcgttcaggcattccttggacagactggattcactagagagaaacatttttggtttgcactgtcagctttgtttttaggttgttttaaatattttacccttgtctcttatgaaaggtcttctcaagaagtagccatgtggacacgatattgctttggtagtaattctgccaaaaatgcctgacttgaatctgatcatgaggaaatatcagaaacccaaattgagggagattctataaaataacttgcctctagtcttcaaaaatgccaaggtcataaaagaaaaactacaggaagatcaaaggagacgaaagagacatgatatctgaaggacatgtgtgatgctgaattgaattggagaaacttttttaaaagttttattgtaaaggacatttagtggataatagatgacattctaataagatcagtagattagataatagaattgtatctatgtatacttcctgataattgtattatggatatataagagaatatccttgttattataaaatacacactgaattattgaatattttggagtaaaaggacattatgtctgccactttcaaatggttcagaaaaactacatacatatacacatatgtgtgtgtgtatatatatgttcatatatatacacacatgtatgttcatatatatatgtttatgaacaatatgtgaacaatatgtttatgtaaaacattgggaaaatctaggtgaatattatacaataattctttgttctatttttacaactatttcataagtgttaaatcatttgtaataaaacattttaaaagtgttttttaatagaaggaagtagtcatgtgaaggccatgcttatatttggcataaccatgagttaatataccactcattgtgccccatataaaatcccacttgagaatttattttagaatttaccatttggaaaagtgttgttcaatctcaaatggtgtattttcatctttccagtaataaaagctatataatggattacatttttcttctggccctggaagccaaggaaactcagagttaaaaatttaacactcaagctaaactgttgagccttctactacatagcatatttccattcttctttttgctgtaattgtcttgcattactgtttctagtcactctgtactatattatctgtgtatgtatgtttgtgggagtggtagataaaatatctcaaactctttgtattagtttcctatggctgctattgtagcaagttgccatacacttggtggcttaaaacaacacacatatattttcttatggttctcgagactagaagttcaaaaccagtttcactcagccaagatcaagtgtcaacagggccgtactccctctggaggttccaggggaaaacctgttccttgcttcttccagcatctggtggctgctggcattccttggcttgtggccacatcattccagccttgccttctgtggtttcattgcctcctcctcatctgtggtcacatctgcctctccctgtctcttacaagaacagttatgattgcatttaggccaactcaaataatccaagattgtctcctcatgtcaggatccttaatcacatttgtgggtcctttttttttctttcttttttatttttttgccatatgagtaacattcataggttccagggatttgaacatggtgatcttttcaggagccattattcagcctaccataccctttatggaaagaagtgacatttaaatgtgttttttaaggtacataaaaataaagtattaatttatttggaaaatataaagtacttctgcactctgtgtatagtgaaggaacaaagataaaagaaatcaaatttctgtttagtgatttttcattgcttttatgaattacattgaattttctattatatttcctatttggttatttctggaatagagaaatatatttgactttttttagaaagtaaattatttgttaatatgaatgaataatacctgtgagatttccaatgaaaagaagcaaagttttatacatcaaatttgcttccaaatgctaatatactaaaatcagtgctagttatgtttaatataggttgctgagaaaaatagttatcttttatggtttttaaaaagtgtatgttaatttatttttatcgtttatttcttactgacaaatgcaaattgtatatatttatggggttcaatgtgaattttgatatactatatattgtaaaatgattaaatcaagcttattgacatattcattacctcacatacttttttgtggtgagaacatttaaaatctactctcttagtaattttcaaatatacaatacatttttattaactatagtcaccatgctgtgcaacagatcttcaaaacttattcctcctgtctaacccaagcttagtacaatttggccaacatctctgctttaccccttggcaaccccaccctaataaccaacattctactctctacttctatgagttcaactttattaagctttacatataagtgaaatcgtgcagtatttatccctctgtgtgtggtttattttacttagcataatgttctccaggatcgtctgtgtcactgcaaatgacagaatttccttcttttttaagactgaatagtattttgttttgaatctatggcacattttcttgatctgttgatggacatttaggttgatttcatatcttggcaattgtgaataatggtgcagtgaacatgagagtgcagacatctcttcaacatattgtttgcatttcgtttagatacacccagaagtagaattgcctgatcacatggtaatttgtcatttttttgaggaaactccatactgttttacaaaatgcctgtactagtttacattcccacagatttttaaaaagttaatcttctacccactaaccttgctaaactttcttatttttttaaaatgtgcatgtattatatatgctctgcatgcattataaatgttacagtaatttttaggtacaacactaaatattctcatatggtttggatggtcagtgaaggcttctgtaaggaagtgatatctgtgatattttggttaggaaaaaagtggtccaaacatagaggacagtatgagctatatatacaagatcatatcatctgcaaattttgcttctctcttcccttctttatatcttcttttgctgttaatttttgtctaattgtgtttgctagggcctctggtattatgctgaacagttgtggtgataaaaagcattctcacatgcacacatatgtttattgcagcactgtttacaatagcaaagatttggaaccaacccaaatgcccctcaatgatagactggataaggaaaatgtggcacatatttaccatggaatactatgcagccataaaaaagaatgagttcatgtcctttgcagggacatggatgaatctgggagccatcattctcagcaaactaacacaggaacagaaaaacaaacactgcatgttctcactcataagcaggagttgaacagtgagaacacatggacacagggaggggaacatcacacactgaggccagtcggggggtagggggaaaggggaagggagagcattaggacaaatgcctaatgcatgcagggcttaaagcctagatgacgggttgataggtgcagcaaaccaccatggcacatgtatacttatgtaacaaacctgcacgttctgcacacgtatcccagaacttaaagtaaaataataaataagcattctcatcttatttctaatcttagagggaatgtatataaaatttttccagtgagagtgatatttgctagagattacagacagacagacagacagacagacacacacacacacacacacacacacacacacacacatttccttatgaaattgagtaaatgatcttccaaagcattcagggcaaatagcagcccatgttttaataaccctaagaattattttatatgatagtcccattccatggccatggagctctgtcactatactgtgaacttctctatggcaggaactattcattcaccattgtatccttactctgaacttctctagggcaggaaactgttcacttgccattggatactcagtatctagcacaatgcctgtaagttaggcattcactatccattcaatgaatgaatggatggatgaacgatagttaatatctgtttcattctcaaagctagcaaattctttttaagcatgagccaaaaatatcactactttccattttctttattcaatgagttgagctcattttgccgccatccttacctcctcccagcacctggtacagtcagtagtcatttgacatatgaaggaataaatgaatgagtcaatcacagagcattctgctgccagttgatagactttgcccctaaagattctgaactttatttgaactgaagccaggtggttaaagatgatttaatcaggacaaaaataaaattctactctctttaatggaataattgcttattgcattttcttcttaaagttggccattcatctccttaaagttggccactgtctttcaatttatatatgttgtccatgaattattgaaagtgattattctgaattaagccaaaattattcacaaagaattgtcttggtgtgtgactagagggttcagaattccagtattacttggagagaggggttgggtatagtggtaaacttaaagtttacctgcaaaaaaacagtgttgaatgcctgagtatggcaaatccaaaaagtaagtatttggatttattggtgaataagggagagaggttggttatcaaaaaaagagcagttaagtaggaatatgttagtagttttaaatactttatgatggctctaatcatatatgtacttcctatttcaaaaggtatttcatttcataagttagagtaacacccaatattagaatttcagtgtccagaaattgattaccttctcctgacttggaactctctgctcaaaagcctttgatgactcttcgttgcctggagagtaaaaatttatttagccctagccagcgctgtccacctgcactcctaccatacacactctctgtttcagccacatgtaacagaatgttaccatagggctcttcctatcttggaggtttcgaacaggccccagagcccagaccacctatgcagagcttgctaaaagattgtgaaacttgtgctaaacgtcaccctgaggatataaaagaggtggaagaagtcagaggtcaagactaaggaaagaggctgaggttgatgattgtatctgagagagtagagcaaaaagtgaagacaaggaaaaggtgtgtgggtccagcacaagggagccagctggggatatcttaaaaggaatcccatccataaggttcaactagaggagcagaatgatcccagagcaggacttgatcacctgaaggccaggactgaaagggagttgtgggcagaccactggacggagagatagccagctttggacaggcaccacaccctgaggacataatgaagccagataacaacgtatatgcatcaagtgagaccttccccaggcaccttgacccctgtatggaggaaccccaaaacacccagctgtccagcaggaaaaagtagaaggaggagagagagaagccagcaagtccccttcttgaagtgtgtatacgctaagcctgaaatatactgtagctgcagaagggagaattttcaattagccaaaatgggagttttaattattataatagagtgtacatatttactgctagaagctggcctgaggacttttataattgaagagtgtaggaatacagtggatccccctgaaatttcatcccaggaatgaggaagaacagttcgtggaacaaatttaccaaggagaagagaatagagctgttttttcctgcacacccataatggtactacagatccttcaataaaccagaacacacacaaggctggggttgtcctctcgtccctctcctacatcagcaaatctgtctctacgtaatcatgtaagactacagcttgctttaatagctcccatcttaagaatgggagggggagagcgaggtagaagaaaaaccttgaccttatatttcgccctcctgttcccccatttattgtctttgccacacagcttctcaagtgctgtataatcccattcctcccctcccactctctcttgagcccaatcagacatttgtacaaacttctccatgaaaataacccttgaccatttgtttcgggctcctgtgaccagggtctgtgttcctaaatccagtagtcctcattcagatcgttctgttggcagcattgggcacagctgcgccctcccttctcaaaacccctcacttgcatgtagttgactctttggtcccattgtctaattgctctccatcaccagtttctaaattttggaaggcgttaagcctctgcccaagacctcttccctgcccatttccccttgcttcttcagtgacctcattaagactcaaagctttaagacaccatctgtagagtatgacctccaaacatatatctccagcctgaccctgatatcctaatatatttaatcacctactcagcatttcttcttggctttctaatagatacctaaaatttagcatgtcaaaagcctaattcctctcagcccccaggaaatctcctctcactgtctttcctagaacatgaaagaacaattctattcatacacttgcctatgtcaaaacaccttgaaaacatccttcatccctctctttttctcatattgtgctccagtaaatgctgtcagttctactgatggaatccaccaatgtggaccacctagttcaagcagttgtgctccctctcttggtttattgacacagtctcctgactgtctccctgtttttaccactgggccctggattctgttctcacagcagccagggtggcctcttgaaaacttgcctcagattatgtcattcctctgctcaaaacctttcaataattttgcatttcactgagaattaaagccaatgtccttaaaaataaaagatctgttcctcttacttttcagctctcatcttctgtcccctttctcactgttcacaccactgcagctgccctgattctttgctgttcatgtaagatagcaagcacacctctgccacagggcctttgtacttgctcttatctctccacctgcatcactcttaactgcatgcttcactcactcactcccttccagtctctgctgtaatgtaacctcatcattaaggtctatccagaccaccctatattaaaataacaacacttgccttcactcactgcttaacctctctatccttctttatttttctacacacagttatcgtcctacgctccactggactgtaagttccatgaagacagaactttgttttttcaccactgaatccccagccccttcaaagtgccttgcatgtaatagactctcacaaatagttctcaaatggagggtgcttcctaacttgctttagcctttccacatgctgttctttctggcaagagttgcttccctttaccccccgccttgttacaccccagccccaagtgagcctgttagaatcctgtgcatcctctcagactccagtttcatacaacctcctctgtgacaccgcgtgagtcagatttaattcctctttccccagaactcaaagttttcagttttattttgctttaatcaagtttgtacccttaaccactacattgtgtgtctttcagactcttgttctttcttgattttaaggctttagagatgacaaattcagcaaccgcaggtccttctcatgttgtagaattgtaaagtagctgttttttaactgcatgcaactgtatgaatcctaaacctagaattttcaatccctctattctaccgcatgtattttcatttctccttctttttctactacttcctcttcatcacaaaaaaagtcccaagcacatattatatgttattcattttcttcaaacatctttcacttaatagtttagagaaaagcccatctattccattgagtgacctttcctatgactatagaaagtggtcagtttttctgtcccttggcctgtttagcagttgaaatgcacctgacagtttgtattacaaagctaaatggtggtggccagtaaggagtttgataaacttttcatgtaatttatacataggggaaatgacactggctgttgagcacatgaagtcattttctttcttccctgaaatgctttgggggagaagaccaatcagtcatcttagtgctgcacctccatagtgagatctgcattaggtttttgaccaagaagacagtaatattttatgacaaaacttggaaaagttaaaaattcacagatgaacaaatgctttttctcattatttatctttttattctttcctatttttattccctgagaccatttgcatgaggggaaatttaatcaggatccctagttgagaacatttctattggagaaaatggaacctggatatcaaattatctcacaacttcttctgagtgacatacactgaattttatcttaaatagcttgtttagaagctattggtcaccagcttaaatagcaccttttcattataacattgcttctgttgttgcattcataacattttatttgctaaaaatgtattaactgtgtctctcccatcagttcttgagctttggagggctgtggctgtggcttattcatctctccatacccaaagactagcatataatagacatacagtaaaaatggaaagactatattgagctgcagtctaccctgtccaattaaaagtcagtggacatttgttgaataactgctatgtgccaggtattttgaaatatttggtgttatttaatctttatagtgaccctaaaatgcattgttatcccttagttatagatgagagaaagtacataagtggtttacccagctagtaagtagcagacctgtctttgaatgtaacccatgtaaagcaaaattttctgtcctttctcctttattagagcttaagtgatctttcagggaccgatatgtttagctatcaactctgtaataacatgaaaaatatttatttagctgtgatcatctatttgataaattgtcagagtgataaacccaaaaggagctttaaagatcattcagcctgtaatcccaaggtggaaagatcacttgaggccaggagtttgagaccagcctgggcaacatagtgagacccttctctcttaaaaagaaaaaaaagctggatgtggtggtggtgggtacctgtagtcccagctacttgggaggctaaggcaggaggatcacttgaacccaggaatttgaggctgcagtgagccatgatcatgcccactgcattccagcctgagaacagagcaagaacttgtctcaaaaaaacccccagaaatcatccaattcagtattctaatttcagatgcaaaaattgagtcccagaagggaaaaggtcttggccattatttcttctgtcagttggaatcatgttattcttctccttttgcactgtccttacagtaattacttttaaatccttagcaagtctgattatcccctgcatggtatggcctgtgatgacctctccagcctcacgttgcactactacccctcacagtttctgtccttcatctgtggcatagaacacactctattctctgcttcctgtccctctgcctatagcacccttccctctactccttctcctaagtcctacttacccttcacatttagctcaggcatctaatatcctctcgctggaagctttcagactagattaggtggtgtatctatgtgcatccatggtacatacctgtcatggtgcgtatccttctgtgtttgttgttagttaactggcttatgtcttccttgctgtgaattccttgaggacagatattgcggagcattcatttctatatcaccacggcctcataaagctcctcacacaaagtcagctttcaggaaattttgaaagaaataatcactcacttggattcaggtctgaagtgaggcaaacattagagatgtgatggtgttgaatactcatcgtttttgatattttgaaggctctcccatgcttgaggatccaaaggagtttaccattttgtaatgccacagatgtgtactggtgtctgtaatgctcaggtcccatccttgagcttcaccaggaacatcagtaggaagatctggcacaggctatgtggagagcctcctcaccccatgctgatgatctcatagtatctggtcactgccactaaggaaaaataaatgcctgcaggtccttttataccatgatgtaactaactataggaagtgtccctatgcaacatctttcatcttacctgaatcaaagcttcaatgaatgaagttctcttcggcccatcatcctgcaagaaactggtaggatgatggcattgggaagctataagggtgattctgacttctctgaaatgacatacattccttgtcaatattatgtcagcggaaaacttgctagccttagaaataaaaataaaggtcttatttttacattgacactttcaatctaggtaaacttgaataattcatttgatatttcagaggcttcatttcttcatctaagaacatgaggatcttttctatttatggaggtatcttgaggattggttgaagtagtgagcatgaaaggtctctagaaaaccttggttgtttagacatgttttagggacattgaaatggactgcgcatggaggaagcttcatggggggcacacctgaggggcatttcctcaatgggagagcacctttgcccttcacaacattcacacacccctcctgggtattggtgccaggctagtgccctgatctgagtccacctctgaacagtcaccctcaccaagataccccgagccaggagagccagtggagcacatctaagccaaagatgtcaaagagagtgaggagtgagaggtccaaattcaactggagaccctcaagatgagacctgttttgaatgagagagagatgaccgtgcagggtggaagcaggtctgatgcagctgacagctaaccactgctgctcggaagtgtcgacggctcaccacttatgtgttggcttttgttcctggactactcaggtggtttaaaagaccaggtgaaattgaggcaataatgaatagcttaccaaccaaaaaaagtccaggaccggatggattcacagccgaattctaccagaggtacaaggaggaattggtaccattccttctgaaactattccagccaatagaaaaagagggaatcctccctaactcattttatgaggccagcaacatcctgataccaaagcctggcagagacacaacaacaaaaaaaaagagaattttagaccaatatccctgatgaacatcgatgcaaaaatcctcaataaaatactggcaaaccgaattcagcagcacatcaaaaagcttatccaccatgatcaagtgggcttcatccctgggatgcaaggcttgttcagcatacacaaatcaataaacataatccagcatataaacagaacaaacaacaaaaaccatatgattatctcaatagatgcagaaaaggcctttgacaaaattcaacaacgcttcatgctaaaaactctcaataaattaggtattgatgggacgtatctcaaaataataagacctatctatgacaaacccacagccaatatcatactgaatgggcaaaaactggaagcattccctttgaaaactggcacaagacaaggatgccctctctcaccactgctattcaacgtagtgttggaagttctggccagggcaatcaggcaggagaaggaaataaagggtattcaattaggaaaagaggaagtcaaattgtccctgtttgcagatgacatgaatgtatatctagaaaaccccatcatctcagcccaaaatctccttaagctgataggcaacttcagcaaagtttcaggatacaaaatcaatgtgcaaaaatcacaagcattcttatacaccagtacagacaaagagagagccaaatcttgagtgaactcccattcacaattgcttcaaagagaataaaatagctaggaatccaacttacaagggacgtgaaggacctcatcaaggagaactacaaaccactgctcaatgaaataaaagaggataccaataaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagctcatatggaatcaaaaaagagcccacattgccaagtcaatcctaagccaaaagaacaaagctagaggcatcacgctacctgacttcaaactatactaccaggctacaggaaccaaaatagcatggtactggtaccaaaacagagatgcagaccaatggaacagaacagagccctcagaaataataccacacatctacaaccatctgatctttgacaaacctgacagaaacaagaaatggggaaaggattccctgtttaataaatggtgctgggaaaactggctagccatatggagaaagctgaaactggatcccttccttacaccctatacaaaaattaattcaaaatggattaaagacttaaatgttagacctgaaactataaaaatcctagaagaaaacctaggcatcaccattcaggacataggcatgggcaaggacttcatgtctaaaacaccaaaagcaatggcaacaaaagccaaaattgacaaatgggatctcattaaactaaagagcttctgcacagcaaaagaaactaccatcagggtgaacaggcaacctacagaatgggagaaaatattcacaacctactcatctgacaaagggctaatatccagaatctacaaagaactcaaacaaatttgcaagaaaaaaaccccatcaacaattgggtgaaggatatgaacagacacttctcaaaagaagacatttatgcagccaaaaggcacatgaaaaaatgctcatcatcactggccatcagaaaaatgcaaatcaaaaccacaatgagataccatctcacaccagttagaatgccaatcattaaacaggaaacaacagatgctggagaggatgtggagaaataggaacacttttacactgttgttgggactgtaaactagttgaaccattgtggaagtcagtgtggcgattcctcagggatctagaactagaaataccatttgacccagccatcccatcactgggtatatacgcaaaggattataaatcatgctactataaagacacatgcacacatatgtttattgtggcactattcacaatagcaaagacttggaaccaagccagatatccaacaatgatagactggattaagaaaatgtggcaaatatacaccatggaatactatgcagccataaaaaatgagttcatgtcctttgtagggacatggatgaagctggaaaccatcattcttagtaagctatcgcaaggacaaaaaaccaaacaccacatgttctcactcataggtgggaattgaacaatgagaacacatggacacaggaaggggaacatcacacaccggggcctgtggtggggtcgggggagtggggagggatagcattaggagatatacctaatgttaaatgacgagttaatggatgcagcacaccaacatggcacatgtatacatatgtaacaaacctgcacattgtgcacatgtaccctaaaacttaaagtataataataaaaaataaaagaccacgtgaaatgagcaggcttgggcaattcaaagcctggaaaaaaagtggtagagagggggatttggggaa

SEQ ID NO: 1085 - DNA, 4814 bp, Homo sapiens
gtgtggtgagagaaaaaacaaggaacaataacagaggattatgttcaaacatcagtgaagggtgctattattggaggttcattaaaataactttaaatgggtttttctaagttgttctcaatgccatcttttattgtggcaaggagctgttcacagagcattgtttgaaactgtattgaaatacactagatttggtgtattgttgcagggaacaagagtcatttcttttttaatgttcgcctggttgtgtgttgcttttgctttaaaacacccaaatggctctctgttgccccagtctcgtatctattgctccttggcatatatggcttttgaggtcttccagtgctagatctctgtcctcttcctagctttagctcctgactccaagaacagcattcctgggcttctttcagtccctcaaacatgcagtgccttgttttcccttgcctgcttcatctgtgcagagccatgcacctgggatgcccgaagccctttcctatgctctcaccagccccctgatccccaccgtgccttgccttttccccctcatcaaatcagtagaacatcaaccgctcagggaggctcttgttgattcctgagtagatatctgctactgtcccatcaagaaattcatcacaggctgtaataacatgttcaatctcatgcctgtctttttgactactttaagattgtgactttctctgtgtcaaatcccagtgcctagcatagggtttagcacattataggtgctcaggaattcttactgaatgagtgaatggccatagaacaagatgctgtaacacagtgtgctgtggaacataaaggagtcttttgggatatatattagagtgcatggtgtttttcttatgtacagcagggtatcgcaaataaattggttgttgtgtaagttactaccctatttataaaggactataatttggctgctgattttgcaaactgtcatggcatcgtgtggttttgcagtgtgtgctgggagagggtgctggtgaaggatctgaagaggcaatgcattgaatcacaggactttgggtagagagatctgcagcttcctgcagcctaaccttgcacagtccaatccagtgttacagatgccatgatgtagccctgcagagtgtcttaaattttaatgtgcatgcacgagtcacctgggtatctggctaaaattcttactcagccagtctgcggtggggtttcagattctgcatttctcacaagctcccaggggataggacactgtggggccagggactccacctttatgtagcaggggctagaactcagtgctgcagggtgcagcaggcctgtgagttgattggcagaacctgttgtagcagtgcagtaggtagaccctgtgtagtaaggactgtagtgaaggggtatatacagttaagtatagaatgttctggtgaagttattgttcagggcacacagcaggctgttgctggccagcatgtggtaggaggaaggtggtggtttgggtactaaagggcagactctgtcgctgagtgcatgatggagcagtggcttgggaagaagcgtgtgctggttctgtcctctggtggggatgttgtcagatattgagttatccattcagtgggtgatgaggttaggtaatgttctaggtgatggaaacatagcactaaaaataattaacatccctgccttcatggagcttatattctagggagagtgggcaaaataataaacatagaaacaagtaaaatatacgatgtgtcagaagttgataaacattatgcaggaagctgaagtagggatggagattggaagagccaggtcagggagatgtccttatgatagagtaggtggagaaaatgacgtttcagcaaatacaggaagaagatgagggaggtgggagccatgtatatatctgggtgaggggggagagtgatttggttggtagtagcagatgcaaaggccctgaggcaggagcttgcctggcatggtcaagggagagcaaggagtgcaggtgcctgagccaaggggttgagggagaaaggaaaagggggtgtgagatcagagaggccaaaggaaagcacaggccactgaaggatctttggcttttacaccaactcatgagccaagaaataacatgttctgactttgggtttttaaaggatccctctgagtgctgcagggacaagggtgaaatcagggagactggttgagactcttgccataatccaggcaaaaggtgataggagcttgggcaggttggggctgtttgagaacccccaagttggcatcctcaggtcctccccagttcctggcatcttgtaggcactcagtcattgtctcatggagacatgaaggcgctgatgaacatgagtccctgcagactgcccacatgattgctcctcaagtataaaacatggtagccaagagtttggtcccagtagcaataggatgaatgaatgaaatagatggtcaggaaagcttctgtgatacagagcgctggcttgcagggcatagagcaggaggacatggttgtgctcttggttggacttcctcctgtccatcctgttgcaaagaatgtagtgatatcggagggtgcagtggctgagggctgtacccagggagttgctttgtgtctgggtgatccagctcagaattttgctgacttgtagcaaaaggtgcattgagcctttggcatggatgagcatattttattgcagaagtggtagtacatggagctataatgtcacaggacaagatatgctaggtaatatgttcacattgaaatgcctaatggagagtttggtggcattcatgtattgtcacgaattggcttaatgaagtcctgtcactcttcctctgaaaggctcccatagtgtccataacacctaatgaagggcttactgtgaaaactgggtagggggatgagcccagggtacaaggattcagccgcctcagaagacaacccaggtagcagcatagaagcagtgaggtgaagaggaagagaaagctaagtaggcttcattagagtccttggagtcttttctgctttttatttatttgttttttcattgtttttaattaattgcccaggctggtgtcaaaatcctggcctcaagtgatcctcccacctctgcctctgaaagtgctgggggttacaggcgtgagccactgtgcctggcacctgtggagtcttaagcgctaaagtgtgtgtacaatgatctgcccagtagtaaacatggctctagtattcttttaaaatattatcaatcagatcatcaattgttctaaaatatggtcaaccagattgtcaagtgttctaaaatatgatgcatctgatcgtcaatgctctctgggcagggcttgaggagtacaacctgatgagaagcagacgttaagatcccctttcctccactcctgacattggagcaaccatccagtcctgtctagacatcactacaatgctcattccctccttccttccattctagcctgtgtcaggcctcactaactccaaacccacttgtatgacagactgattccaatcatttctgctcttgttaccgattcttatctgcactttacttaaagccccataattttgaggcatctggacagtaggaaaggctgaaaacctggcaagcttttatagcttgcaaaggtccttgtcctatgctctgttagtatcatttccaaaatactacttgggctatctgatcacatcccattgcccgtatcctctgagagtctaaatgctgaactgcttcagaaactaaatcatactcacaggacttggtttctcagcaattttatcatctgaaaacattgtttatgtagctgaggtcaaaagcttcaagtactgctttaatgagctgcgaatctgttcatgtgacattctcttccaaacccaattgccctttacactgtatgagtaagtgcctctgtgtgtgtgtgtctgaatgtgtgtgtttgatgtgctgacatttctgaattgaatccagaaagtgtaacctttgtatgtttgctgttaaaactccaaattcaagccttaagaaaaggatctaacacttactcaatgtgatttatttaagcacagaacctaactcccccaaagtatcaaatactcaagagaacaattcatttttgaaaattgtgatttaaaataattctcataaaacctttactgttcaaatatattagaaaatatattgcatttttgtctgcatcaggcactgttttaactgccttccatgaattgcctcatttaattctctcaaccctgtaaggtagggttatcaccacagtatagatgaggaactagagcttggaaaagttaaggcatttgcccaaggtccagcaactagaaagcagaggagccaggacttgatccctggactgtacactgcacaagacccttgtaaagattattagaagcacttggagcccctggtaaggtttgtgattgtgctaccaggagagtcatgataacaccatcgaatggtgtctgttacataatagaaaaagactgagtattcttacaattcaaatgatttaaatttattttaaaatattgcaacaaataagtagcatcttcacagcttttataattcgttgtcaggattttaaaagatgcaaatcttatttgttccttagggctttgattttgaggctgacaaagacggcatgcattgactaacctctgaaagaagggcatggcagcattgaaatgaggcagccgagacaggctcattaaggagtagaggtttccctgctcatttctggttgttcttttggggtatccactgtgtggagtttgcaga

SEQ ID NO: 1086 - DNA, 7291 bp, Homo sapiens
gtgtggtgagagaaaaaacaaggaacaataacagaggattatgttcaaacatcagtgaagggtgctattattggaggttcattaaaataactttaaatgggtttttctaagttgttctcaatgccatcttttattgtggcaaggagctgttcacagagcattgtttgaaactgtattgaaatacactagatttggtgtattgttgcagggaacaagagtcatttcttttttaatgttcgcctggttgtgtgttgcttttgctttaaaacacccaaatggctctctgttgccccagtctcgtatctattgctccttggcatatatggcttttgaggtcttccagtgctagatctctgtcctcttcctagctttagctcctgactccaagaacagcattcctgggcttctttcagtccctcaaacatgcagtgccttgttttcccttgcctgcttcatctgtgcagagccatgcacctgggatgcccgaagccctttcctatgctctcaccagccccctgatccccaccgtgccttgccttttccccctcatcaaatcagtagaacatcaaccgctcagggaggctcttgttgattcctgagtagatatctgctactgtcccatcaagaaattcatcacaggctgtaataacatgttcaatctcatgcctgtctttttgactactttaagattgtgactttctctgtgtcaaatcccagtgcctagcatagggtttagcacattataggtgctcaggaattcttactgaatgagtgaatggccatagaacaagatgctgtaacacagtgtgctgtggaacataaaggagtcttttgggatatatattagagtgcatggtgtttttcttatgtacagcagggtatcgcaaataaattggttgttgtgtaagttactaccctatttataaaggactataatttggctgctgattttgcaaactgtcatggcatcgtgtggttttgcagtgtgtgctgggagagggtgctggtgaaggatctgaagaggcaatgcattgaatcacaggactttgggtagagagatctgcagcttcctgcagcctaaccttgcacagtccaatccagtgttacagatgccatgatgtagccctgcagagtgtcttaaattttaatgtgcatgcacgagtcacctgggtatctggctaaaattcttactcagccagtctgcggtggggtttcagattctgcatttctcacaagctcccaggggataggacactgtggggccagggactccacctttatgtagcaggggctagaactcagtgctgcagggtgcagcaggcctgtgagttgattggcagaacctgttgtagcagtgcagtaggtagaccctgtgtagtaaggactgtagtgaaggggtatatacagttaagtatagaatgttctggtgaagttattgttcagggcacacagcaggctgttgctggccagcatgtggtaggaggaaggtggtggtttgggtactaaagggcagactctgtcgctgagtgcatgatggagcagtggcttgggaagaagcgtgtgctggttctgtcctctggtggggatgttgtcagatattgagttatccattcagtgggtgatgaggttaggtaatgttctaggtgatggaaacatagcactaaaaataattaacatccctgccttcatggagcttatattctagggagagtgggcaaaataataaacatagaaacaagtaaaatatacgatgtgtcagaagttgataaacattatgcaggaagctgaagtagggatggagattggaagagccaggtcagggagatgtccttatgatagagtaggtggagaaaatgacgtttcagcaaatacaggaagaagatgagggaggtgggagccatgtatatatctgggtgaggggggagagtgatttggttggtagtagcagatgcaaaggccctgaggcaggagcttgcctggcatggtcaagggagagcaaggagtgcaggtgcctgagccaaggggttgagggagaaaggaaaagggggtgtgagatcagagaggccaaaggaaagcacaggccactgaaggatctttggcttttacaccaactcatgagccaagaaataacatgttctgactttgggtttttaaaggatccctctgagtgctgcagggacaagggtgaaatcagggagactggttgagactcttgccataatccaggcaaaaggtgataggagcttgggcaggttggggctgtttgagaacccccaagttggcatcctcaggtcctccccagttcctggcatcttgtaggcactcagtcattgtctcatggagacatgaaggcgctgatgaacatgagtccctgcagactgcccacatgattgctcctcaagtataaaacatggtagccaagagtttggtcccagtagcaataggatgaatgaatgaaatagatggtcaggaaagcttctgtgatacagagcgctggcttgcagggcatagagcaggaggacatggttgtgctcttggttggacttcctcctgtccatcctgttgcaaagaatgtagtgatatcggagggtgcagtggctgagggctgtacccagggagttgctttgtgtctgggtgatccagctcagaattttgctgacttgtagcaaaaggtgcattgagcctttggcatggatgagcatattttattgcagaagtggtagtacatggagctataatgtcacaggacaagatatgctaggtaatatgttcacattgaaatgcctaatggagagtttggtggcattcatgtattgtcacgaattggcttaatgaagtcctgtcactcttcctctgaaaggctcccatagtgtccataacacctaatgaagggcttactgtgaaaactgggtagggggatgagcccagggtacaaggattcagccgcctcagaagacaacccaggtagcagcatagaagcagtgaggtgaagaggaagagaaagctaagtaggcttcattagagtccttggagtcttttctgctttttatttatttgttttttcattgtttttaattaattgcccaggctggtgtcaaaatcctggcctcaagtgatcctcccacctctgcctctgaaagtgctgggggttacaggcgtgagccactgtgcctggcacctgtggagtcttaagcgctaaagtgtgtgtacaatgatctgcccagtagtaaacatggctctagtattcttttaaaatattatcaatcagatcatcaattgttctaaaatatggtcaaccagattgtcaagtgttctaaaatatgatgcatctgatcgtcaatgctctctgggcagggcttgaggagtacaacctgatgagaagcagacgttaagatcccctttcctccactcctgacattggagcaaccatccagtcctgtctagacatcactacaatgctcattccctccttccttccattctagcctgtgtcaggcctcactaactccaaacccacttgtatgacagactgattccaatcatttctgctcttgttaccgattcttatctgcactttacttaaagccccataattttgaggcatctggacagtaggaaaggctgaaaacctggcaagcttttatagcttgcaaaggtccttgtcctatgctctgttagtatcatttccaaaatactacttgggctatctgatcacatcccattgcccgtatcctctgagagtctaaatgctgaactgcttcagaaactaaatcatactcacaggacttggtttctcagcaattttatcatctgaaaacattgtttatgtagctgaggtcaaaagcttcaagtactgctttaatgagctgcgaatctgttcatgtgacattctcttccaaacccaattgccctttacactgtatgagtaagtgcctctgtgtgtgtgtgtctgaatgtgtgtgtttgatgtgctgacatttctgaattgaatccagaaagtgtaacctttgtatgtttgctgttaaaactccaaattcaagccttaagaaaaggatctaacacttactcaatgtgatttatttaagcacagaacctaactcccccaaagtatcaaatactcaagagaacaattcatttttgaaaattgtgatttaaaataattctcataaaacctttactgttcaaatatattagaaaatatattgcatttttgtctgcatcaggcactgttttaactgccttccatgaattgcctcatttaattctctcaaccctgtaaggtagggttatcaccacagtatagatgaggaactagagcttggaaaagttaaggcatttgcccaaggtccagcaactagaaagcagaggagccaggacttgatccctggactgtacactgcacaagacccttgtaaagattattagaagcacttggagcccctggtaaggtttgtgattgtgctaccaggagagtcatgataacaccatcgaatggtgtctgttacataatagaaaaagactgagtattcttacaattcaaatgatttaaatttattttaaaatattgcaacaaataagtagcatcttcacagcttttataattcgttgtcaggattttaaaagatgcaaatcttatttgttccttagggctttgattttgaggctgacaaagacggcatgcattgactaacctctgaaagaagggcatggcagcattgaaatgaggcagccgagacaggctcattaaggagtagaggtttccctgctcatttctggttgttcttttggggtatccactgtgtggagtttgcagagatcttaataaaaatatcaacctacatttatatactgacaaacaaatagccaagagccatttaggacacacagcttggagtctgtttatctctctccacctatctacacacccatggagaacccatttaaacttcagatcaaaccaggctccctttagatggttggaattgtcaggttcctgagccaggtgaagttcctaaatcagtttctgtcttagtccatgttgtgttgctatgactgaataccacagactagataatttataaagaaaagaaatttatttcttacagttctggaggctgggaagtccaagggtgaggggcttgcatctggtgagagacttcttgctgtgtcatcccatggcagaaggtgaagggcaagagagagtatgcgtgcatgtgtgtgcatatatatgcatatgcatacatgtgtgtgcacatgcaggggaaagatacggagccaaactcatcccttttattaggatcccactaccaagataatgttgttaagttctcatgaggtgccacctctcaacactgttgcattggagattcagtttctaacacatgaactttggcggggcaagtcaaccatagaacctaccagatacatgactttgagtcatgtactattatattattatttattattattattgttattttgatactggtccatggcccagggattggggatccctgccctaaatcgtgaggaagattgaggcccatgggtgccactggttggtagccgtcagcttcttaccacctaccggcacctccatagtcatcttgacctccttgcccagcttccatctctgtcttagcaaatatgttttccctcccccaactcatgtgagacttaccctcactcctgctctggactccagcctcttgatccttcatgcttatctcccctgtttagtctgtctacagcttctctctgtatcaacaaaactcctatggtttcaaataggaatctgatttaaactgacttttaagcaaaaaataatgatagttagtattcagatgtagatggatcatctacatctggtcccaaacaatgccagcagggaaacatttatctatatcccttaggattactttccccactgtgttgacttcattcttcattctcagaaggctttcttgggcacatagcaactcccaatttatgtcccattatctctgcaacttctaccaaagaaaagggcttcctttttataaaatcccagcagcctaggactcaatctttttggaagattattgggtcatatgcccatctctaagggaattgctcactgcaccagggggatggaatgtgctgattgaccgggcctgggtcaccagcccctcttagccagagagctggatctaatccagacattttgaaaaaagagaaggaatgtcctatctaaatcagacattttgaaagaagagaaggaatatctcctttaagaaaaaaaagccactgtcatggccgggtgtggtggctcacgcctataatcccagcactttgggaggctgaggcgggtggatcatgaggtcaggagatcgagaccatcttggctaacacggtgaaaccccatctccactaaaaaatacaaaaaattagctgggcgcggtggcgggcacctgtagtcccagctactcgggaggctgaggcaggagaatggcgtgaacccaggaggcggagcttgcagtgagctgagatagcgccactgcagtccagcctgggcaaaagagcgagactccgtctcaaaaaaaaaaaaaaagaaaaaaagaaaaataaagccactgtcactagaagaaaagacaatgcctgctggctgggcaaaaacagcagctgtcctttctgactctatcctggccttctcctttgtgcataaacctgctatgtctttttcatgttaaaaatcccctacctcaaacctgggaatcctccttactactactcttactactgctatgattactaccctaccttactttgcatacaaacacacttttgaaagagttgccagttcctgctatttccacttgatgacaatttattgtttcctcagtttggtgcaatctggcttctgctcccgccatcctattgatatttttctcattgagtcatcaatgacctgaaaactgcctcttctcataagcttgtctcatctttcttgacctcaccatattattaggtgctctaatcctttctcctttaaaaaaatgtgaaaaaataaaatattcaagcagcatcagaagctacaaagtgaaattaagattcccctcacccatggctcctagctaggcttcctggttctccttcccagagacacccattgcaaccaggttcttgtgtgaccttctagagaagatgtgttcaggcccagaaatagtctacatcacacacaaggatgttagcatgctgtgtacaatttctgtatcttgcattattcccctctgtcttggagattgtttcttat

SEQ ID NO: 1087 - DNA, 24 bp, Homo sapiens
aaggtcacagttgaaaaaaatata

SEQ ID NO: 1088 - DNA, 7543 bp, Homo sapiens
aaggtcacagttgaaaaaaatataccccctgttaaaagttactgtctcttctttattacatttaaatttattttaagcatttatacccttcactgggaaaactgactagccataagcagaaaactgaaactggaccccttccttacaccttatatgaaaattaactcaagatggagtaaagacttagatgtaaaacccaaagccataaaaactctagaagaaaacctaggcaacaccattcaggacatgggcatgcgcaaaaacttcatgactaaaacaccaaaagcaatggcaacaaaagccaaaattgacaaatgggatctaatcaaactaaagagcttctgcgcagcaaaagaaactagcatcagactgaacaggcaacctaaggaatgggagaacatatttgcaatctactcatctgacaaagggctaatatccagaatctacaaagaagttaaacaaatttacaaaaaaaaaaaaaaaaaaccaacccatcaaaaagtcggcaaaggatatgaaccgacacttctcaaaaaaagacatttatgcagccaacagacatatgaaaaaaagctcatcatcactgatcattaggtattatgattaggcaaatcaaaaccacaatgagataccatctcacactagtcagaatggcaatcattaaaaagtcaggaaaaaatagatgctggtgaggctgtggagaaatgggaatgcttttatgctgttggtgggagtgtaactcggttcaaccattgtggaggacagtgtggcgattcctcaaggatctagaacaagaaatatcatttgacccagcaatcccattactgggtatagacccaaaggattataaatcattttactataaagacacatgcacacctatgtttattgcagcactatttacaatagcaaagacatggaaccaacccaaatgcccatcaatgatagactggataaagaaaatgtggtacatatacaccatggaatactatgcagctataaaaaagaatgagatcatgttctttgcagggacatggatgaagctggaagccatcatcctcaacaaactaacacagaaacagaaaaccaaatactgcatgttctcattcataagtgggagctgaacaatgagaccacttggactcagggaggggaacatcacacaccggggcctgtccggggtgaggggcaaggggagggagagcatcaggacaaatacctaatgcatgtggggcttaaaacctagatgacaggttgataggtacagcaaatcatcatgacacatgtatgtatatgtaccaaacctgcacattctgcacatgtatcctggaacttaaagtaaaataaaaaataaaaataaaataggtgggtggagccaagatggctgaataggaacagctccagtctacagctcccagggtgagtgacgcagaagacaggtgatttctgcatttccatctgaggtaccaggttcatctcactagggagtgccagacagcgggcacaggacagcgggtgcagcataccgtgcgcgagctgaagcagggcgaggcattacctcactcgggaagtgcaaggggtcagggagttccctttcctagtcaaagaaaggggtgacacacggcacctggaaaatcgggtcactcccaccctaatactgcacttttcccacggccttaaaaaacagcgcaccaggagattatatcccacacctggctcggagggtcctacgcccacggagtctcgctgattgctagcacagcagtctaagatcaaactgcaaggctgcatcgaggctgggggaggggcgcccgccattgcccaggtttgattaggtaaacaaagcagctgggaagctcgaactgggtggagtccaccacagctcaaggaggccggcctgcctgcctctgtaggctccgcctctgggggcagggcacagacaaacaaaaagacagcagtaacctctgcagacttaaatgtccctgtctgacagctttgaagagagtagtggttctcccagcatgcagctggagatctgagaacaggcagactgcctcctcaagtgggtccctgacccccgagcagcttaactgggagacaccccccagtaggggcagactgacacctcacacggccgggtactcctctgagacaaaacttccagaggaacgatcaggcagcagcatttgtgggtcaccaatatccgctgttctgcagccaccactcctgatacccaggcaaacagggtctggagtggacctctagcaaagtccaacagaccttcaactgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaactggaaactctaaaaagcagagcgcctctcctcctccaaaggaatgcagctcctcaccagcaatggaacaaagctggacggagaatgactttgacgagttgagagaagaaggctttggacgatcaaactactctgagctacagaaggaaattcacaccaatggcaaagaagttaaaaactttgaaaaaaaaattagacgaatggataactagaataaccaatgcagagaagtccttaaaggagctgatggagctgaaagtcaagggtcgagaattacgtgaagaatgcagaagcctcaggagccgatgcgatcaactggaagaaagggtatctgtgatggaagacgaaatgaatgaaatgaagtgagaaaggaagtttagagaaaaaagtataaaaagaaatgaacaaagcttccaagaaatatgggactacgtgaaaagaccaaatctacatcagataggtgtacctgaaagtgatggggagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaagctcgggttacccacaaagggaagcccatcatactaacagcggatctctcggcagaaactctacaagccagaggagagtgggggccaatattcaacattcttaaagaaaagaattttcaatgcagaatttcatgtccagccaaactaagcttcataagtgaaagagaaataaaatcctttacagacaaacaaatgctgagagattttgtcaccaccaggcctgccctaaaagagctcctgaaggaagcactaaacatggaaaggaacaaccggtaccagccactgcaaaaacatgccaaaatgtaaagaccatcaaggctaggaagaaactacatcaactaacgagcaaaataaccagctaacatcataatgacaggaccaaattcacacataacaatattaactttaaatgtaaatgggctaaatgctccaattaaaagacacagactggcaaattcgataaagagtcaagacccatcagtgtgctgtattcaggagaaccatctcatgtgcagagacacacataggctcaaaataaagggatggaggaagatctaccaagcaaatggaaaacaaaaaaaaagcaagggtcgcaatcctagtctctgataaaacagactttaaaccagcaaagatcaaaagagacaatgaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgttaacattagacaagtcaacgagacagaaatttaacaaggatatccaggaattgaactcagctctgcaccaagcggacctaatagacatctacagaactctccaccccaaatcaacagaatgtacattcttctcagcaccacatcacacttattccaaaattgaccacatagttggaagtaaagcactcctcagcaaatgtaaaagaacagaaattacaacaaactgtctctcagaccacagtgcaatcaaactagaactcaggattaaaaaactcactcaaaaccactcaactacatggaaattgaacaacgtgctcttgaatgaccactgggtacataacgaaatgaaggcagaaataaagatgttctctgaaaccaacgagaacaaagacacaacataccagaatctctgggacacattcaaagcagtgtgtagagggaaatttatagtactaaatgcccacaagagaaagcaagaaagatctaaaattgacaccctaacatcacaattaaagaactagagaagcaagagcaaacacattcaaaagctagcagaaggcaagaaataactaagatcagaacagaactgaaggagatcgagacacaaaaaaaaaactcttcaaaaaatcaatgaatctgggagctggtttcttgaaaagatcaacaaaattcattgaccactagcaagactaataaagaagaaaagagatgcaataaaaagtgataaaggcgatatcatcaccaatcccacagaaatacaaactaccatcagagaatattataaacacctctacgcaaataaactagaaaatctagaagaaatggataaattcctggacacatacaccgacccaagactaaaccaggaagaagttgagtccctgaatagaccaataacaggctctgaaattgaggcaataattaatagcctaccaaccaaaaaaagtccaggaccagatggattcacagccgaattctaccagaggtacaaagaggagctcgtatcattccttctgaaactattccaatgaatagaaaaagagggaatcctccctaactcattttatgaggccagcatcatagtgataccaaagcctggcagagacacaacaaaaaaagagaattttagaccaatatccctgatgaacatcgatgcaaaaatcctcaataaaatactggcaaaccaaatccagcagcacatcaaaactcttatccatcatgatcaagttggcttcatccctaggatgcaaggctggttcaatatatgcaaatcaataaacataatccatcatataaacagaaccaatgacaaaaaccacatgattatctcaatagatgcagaaaaggcctttgacaaaattaaacagcccttcatgctaaaaactctcaataaactaggtattgatgggctgtatctcaaaataataaaagctatttgtgacacacccacagccaatatcatactgaatgggcaaaaactggaagcattccctttgaaaactggcacaagacagggatgacctctctcaccactcctagtcaacatagtgttggaagttctggccagggcaattaggcaggagaaggaaataaagggtattcaattaggaaaagaggaagtcaaattgtccctgtttgcagatgacatgattgtatatctagaaaaccccactgtctcagcccaaaatctccttaagctgataaccaacttcagcagtctcaggatacaaaatcaatgtacaaaaatcacaagcagtcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtgatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgttacctgacttcaaactatactacaaggctacagtaaccaaaacagcatggtactggtaccaaaacagagatacagaacaatggaacagaacagagccctcagaaatagtgccacatatctacaaccatctgatctttaacaaacctgacaaaaacaagaaatggggaaaggattccctatttaataaatgctgctgggaaaactggctagccatatgtagaaagctgaaactggatcccttccttacaccttacacaaaaattaattcaagacggattaaagacttaaatgctacacctaaaaccataaaaaccctagaagaaaacctaggcaataccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaagcaacctacaaaatgggagaaaatttttgcaacctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaaaacacatgaaaaaatgctcatcatcactggccatcagagaaatgcaaatcaaaaccacaatgagataccatctcataccagttagaatggcgatcattaaaaagtgaggaaacaacaggtgctggagaggatgtggagaaataggaacacttttgcactgttggtgagactgtaaactagttcaaccattgtggaagtcagtgtggcgattcctcagggatctagaactaggaataccgtttgacctagccatcccattactgggtatatacccaaaggattataaatcatgctgctataaagacacatgcacatgtatgtttattgtggcactattcacaatagcaaagacttggaaccaacccaaatgtccaacaacgatagactggattaagaaaatgtggcacatatacaccatggaatactatgtagccataaaaaatgatgagttcatgtcctttgtagggacatggatgaagctggaaaccatcattctcagcaaactattgcaagagcaaaaaaccaaacaccacatgttgtcactcataggtaggaattgaacaatgagaacacatggacacaggaaggggaacatcacactccggggactgttgtggggtggggggagggatagcattaggagatatacctaatgctaaatgatgagttaatgggtgcagcaacaccaacatggcacatgtatacatatgtaacaaacctgcacattgtgcacatgtaccctaaaacttaaagtataataacaataaaataaaaataaataaataaaaaataaaaataaaataaaaattc

SEQ ID NO: 1089 - DNA, 1802 bp, Homo sapiens
tggaaatacatgtgtaaaaactacagtccctacagttttctgtgaattcataatccccagagaccagcagacctcagaaaccaaccaagcaatgggaggagctagaaactcaatggtatcagccaaaatgagcatggagtgttcactcagaatgaggaaccaccgaggaggtgtgcgtcatcagcctcactcacagagaaggaagcctacgtggtcacaagactgagctgtaagagggaggggcaatgcgtagtcagcccagatagagctcaaatgttttaaaatttaatacgttttttattataaggtctaaccaatccctagcaatgacacaatatcactctctcagctctcagttggcacctcctggtagggtgagtttagaaggatgaaggaggaaagtgagaggatagcaatcaagtggattcccttcaacagcacgaaccacacttctcatgagacccctggagggttatccaaagcacagattcccaagcttcgcccgcggagacgctgctttggtggcactaggggaacctcgcaatctggatgctaacctagtaccccaggtgattcttatctacagtggttctcatccccgatacataaataataaatgtcagcgcatcccaaaacttgctcaaagtcaaggtcacttatctaacgtgagtgccaaagcccaaacggaccacagactccagacactagtgacctttccattcaaccctgggaacgtatgagccaaaaaacatgctaaaaccagcgacagtagaatgcaatggtattcagctgctccatgccacacgtactcatgtctgcaaacccttgctagcgggcacctgccagaagcaactctgttacaggatggaatctcacaggttgttcccctacccagcacatatgcggctttcgctaaaccatctgctgctttgctgacaaggacagaccaaggaatttccatgctgcggtctgtcagcgtctgtcacagggccaccaccctttgattgggcgaggaacttggaactgagacctgtcctccaggagaccaatgtgaccctcccagggcagagggagtgctgccacttcacacgtcctctcacccgggcttatctaactggccacaggacaagttctgtgttttgtcggcctgggaaatctaatggaaaggactattattagaaatatttatcttatcaaggaaaatatgctcttaaaatgttcaagaaaggatgctgcctggttcccaaggaatagcctgaaagactatatatatatataatatacactcatacacatatacatattatacacacacatacacatacatgtatatatgtgtgtgtatttaaatgtaatatgcatatgaatattacttaggtaagcatatattcacaactgcagtagtatgttacctttatttttctttcagcagttttttgaagtaaacttcatcatctgactgcaggggttaatgaatattctagtgcttctcacactctgatgtgcacatacatgagtcattcaggaaccctgatgatatgcagattcctattcagcaggttggatggggcccgagagcctgcatttgtagccagctcccagggaatgcttgaggcccaggcaggagccactctgagcaatcagattccagcttgtgatgatgtttgcatcacacataaaacagcacctgtcaaagcttagaatatgtaaaacaaacaaaactaagttcaaattaaggcactctttcttagatgattcagaaggaacttcagaatttgggcaatgcctcttagccatcatta

SEQ ID NO: 1090 - DNA, 1246 bp, Homo sapiens
acccacccataatatttgcgttttacagaggaaatttagagatgacaattttggcatgaaatgctggttttccaatggtgaaatttcaggcagtttcacaaatttatgctgtgtcagccattgcttgagtagccagatgtttttataaaatggccattcatcatcactccataaccagattgccaagtatgatcataaggaaagaaaagcagagttaagaaagaaaattagaactgtggagtattctaactaatgcttggtagaaatctagatccttttctttttttttttttttaaacaaaattcaccttttgttcaagaacaagtccttggtaccttagtctctaccattctattcgagtaaataagctttatctcctatgatgtgaaaggtagtttgaagtacagtccttaacctaagagaaagaaagatcttagtcttctattaggagcatatgaagcctattgaagtgtctgaacacttcccatttgctgctaaagtagccctgaaacagagctgaatattgccattctcttttaattgggtaaccttgcaaaggtgagagcagctaagagctagctgacctccttgatattggtcagtacctgaagaactgggctgtgactcttgtcaataactgtagggaagccacaaaaaccatcaagtaaaaggtagctgacctcctatggagggcactgtttgctgctgaggtggatgttacattgtataaaattgttttgaatgtacaggaaaagccacatactctattttcattatcttagattataaccctatgcagagcccctattttagagactggtaggaattcaatctttactgtattgaagggggttcttttctggagttttattaatatctgaggtctcatggggcacaaagcaattaagcatgtcatatagtctacctgtgtcagtgctgggaagctcatagaccaaaccttcagggactcttaaatctgaaggctttacaagtgacagaaatccaatccaacctatcttaaacaaaaatagtaactatttttcacattattgaaaagtcctggatagtagcctgatcttaggacacagctagataaaggtgctcaaacaacgttatgaccctgtctttcatatctggatgagtttcatgccccatggtgaaatgttggctgcctgccatcccaggcacccatccttacatcctggttcttctagtgaatataaaagacctctgtagctcttcaaa

SEQ ID NO: 1091 - DNA, 5862 bp, Homo sapiens
ttgatgcaaacataatgattaaatactatacaatcattaaaaaggttctttttaaagaacttttctctatttttttatatgtttttttgagatggagtcttactctgttgcctgggctggagtgcaatgatgcaatctcagatcactgcaacctcctcctgggttcatgtgattctcccacctcagccttccgagtagctgggactacaggtccgcatcaccacaccctgctaatttttgtatttttatttatttttattttttgagacagagtctcgctttgttgcccaggctggaatgcagtggcacaatctcagctcactgcaacctccaactcctgagttcaagtgattctcctgcctcagcctcctaagtagacaggagtgtgccaccatgcctggctaatttttgtacgttgagtagaggcagggtttcaccatgtcggccaggctggtctcaaactcctgatctaaggtaatcctcctgtctcggcctcccaaagtgctaggattgcgggcatgagccaccatgctcggccctaatttctgtatttttagtagagatggggtttcaccatgttggccaggctggtcttgaactcctaacgtcaaataatctgcctgcctcagcctgccaaagtgctgagattacaggcatgagccactgcaaccagcctgttttctttttcttttcttttctttatttttttttttttgagacagagtttcactcttgtcacccaggctggagtgcagcagcacaatctcagttcactgcaaccccgtctcccaggttgaagcaattctcctgcctcagcctcctgagtagaaccagcctcagttttcagttgggatgtttctcttattatttagacataggagttctttatatattctagttacaagttctttatattatttggtgatattttttcccagtctgttgcctacctatcttttcatatttttaaaaatttaacttctatttttttttttgacacagggtcttgctccgttgcccagtctggagtgtggtggtgtgagcacagctcactgcagcctcgaactcctgggctgaagcatcctctggcttcagccttccaagtagctgggcctgcaagtgtgtgccaccacacccagctttttttttctttaagtgtttagagacagggtgtcactcacgctggtctcaaactcctggcctcaagcaatcctcccacctcagcctcctgaatagctggatttacaggtgcaaaccactgctcccagctcttttttttttttttttttttttgagacagagtctttctctgtcgccaggctggagtgcagtgccgcgatcttggctcactgcaagctccgcctcctgggttcacgccattctcctgcctcagccttctgagtagctgggactacaggtgcccgccactaattagtccggctaatttttttgtattttttagtagagacggggtttcaccatgttagccaggatggtcttgatatcctgaccttgtgagccgcctgcctcggcctcccaaagtgctgggattacaggcatgagccaccgcgcccagcctcttttcacattcttaatgatgtcctttgaagcacaaaagcttttaatttgatttagtccaatttatcaatattttcttttatggatcttgcttttgatgtcattttaagaagtctttgtccaactccagttacaaagattttcttgttttcttttagatgtttttacattgaagtctgtgatccattttgagttaatttttgtgtatgctatgaaacaagggtctaagttctttttgtttttatgtgactatcatgctgtcctagcaccatatacagactttcctcaatttacatgggttacatcccaataaacccatcataagttgaaagtatcagtaagtcaaaaacacatttaatacacctagcctattgaacatcatagcatagcatagcctactttaaatgtgctcagaacacttacattagcctacagttgggcaaaatcatctaacacaaagcaaattttatataaataacattttctatataatatacatatattatgagctgggcacagtggttcacacttgtagtcctagctccttgagaggctgaggcagtaggattacctgaagccatgagtttgagaccatctgggcaacaaagcaagactctgtctcttaaaaaaaaaagatatatatatatatcatttttgggggaggatctcttgaggccaggagttcaataccagcctgggcaatatggcgagactgcctttctacaacaaaaaaattcaaaaagtagccaggcatggtggtctatgcctctagtctcagctactcaggaggctaaggtgggagaatgcttgagcccaggaggtcaggctgtagtgggcaccactgcacttcagcctgggtgacagagagacaccctgtctcaaaaaaaaaggaaaccaaaatagaatggttgtatggatactcgccattaatgtacacagctgaaagcaccatagtaaagtcaaaaaactgtaacttgaaccatggtaagttggggactgtattggcaagaccatccttttctcactgaattgtctaggcacctttgttgaaagtgaattgaccataagtgtaaaagtttacttctagatcctcaattctgttccaataatctatatgtgtatctttatatcactgtcataccgtcttataattgtggctttgcagtaagtttcaaaatcagatagtggaagtcttccaactttgttcttcttttctaaaattgaattatttgcaattttgctaaattttaaactcagcttgtcaatgtctacgtaaaagtatgcatggacttttaaaaggattacattaaaattttctttaaattttttttttcttgtagagatgaggtctcactttgttgcccaggctggtctcctactcctagactgaagcaatccttctgcctcagcctcccaaagtgttgagattacaggaatgagccactgcacccaacccaaaactgttaattaatttagaaagaattgccatcttaacaatattgagtcttccaatccattaatatggaatatctattatttattttaaaatttatctcagcaatgttctttgtttttcagtgtacaagaattgcactttcattaaatttatgcttaaatatggccgggcgtggtggctcacacctgtaatcccagcactttgggaggccaaggcgggtggatcacctgaagtcaggagtttgagaccagcctgcccaacgtggcgaaaccctgtctctactaaaaatacaaaaaattagctgggcgtggtggtgggcgcctgtaatcccagctactcgggaggctgaagcaggagaatcgcttgaacccaggaggcagaggttgcagtgagttgagatcgggccactgcactccagcctgggtgacaagagcgaaactctgtctctaaaaaaaaaaaaaaaaaaaaaaaaaaaattgtgcctaaatattatattatttttaatgtcattgtgaatggaattttcctttttacagctttattgaagtattactcatgtacacaaaattgcacacaattaatgtatacaattttttctcaatatgggcaaatgttttattcatatattatataaagttcattatgccaatttatcaggtactaatcattaaacaaaaatttttttaatttttttttttttttgagacatggtcttgctctgttgcccaggctggagtgcagtggtgcgatctcggttcactgcaacctctgcctcctgggttcaagcaattctcctgcctcagcctcctgagtagctgggattacagatgcatgccactatgccaggctaatttttttttatttttagcagagatggggtttcactatgttggctagtctggtctcgaactcctgacctcaagtgatctgcccatgtcaggctcccaaagtgctgggattacaggcatgagccaccacccctggtcccccaaattttttttaacttataagtgtacttaaaatttctttttattttaaaagcatgtcatccttgcataggggccaagctaatcttctctgtatcgttccaattttagcatatgtgctgaagtgagcacaacaaattttttaatagataagaaatattgtatacatttattgtgtacatgttgttttgaaatatgtaaacactatggaaagacaaatcaagctaattaatatatgcattacctcaaatacttatctttttttgtggtgagaacacttaaaatctactgtcttagcaattttcaacaacacattattattaactatagtcaccatgttgaacttattcctactatcacaggaataagtatcctttgatcaacatttccatcccctactctctcttgcaagctcctggtggccaccattctactctccgagttcaagtttttttagattccacatataagtgagatcatgtgatatctgtctttctgtgcctggcttatttcacttaatataatgtcctccaggttcatccatgttgtcaaaaatgacagaatctcttcctttttaaggctgaatagtattacattgtgtatatacaccacattttctttatccattaacccactgatggacacttaggttgattccatatcttggttattgtgaataatgccacaatgaacattattgtggttcattggtgcaggtatctcttcaagatcctgattcaattctttcagatatatatatccagcagtgggattgttagatcatgtaacagttttatttttagtttcttgaggaacttccatactgtcttccatagtggcagcaccatttttaatctccaccaaatgtgtacaagcattccaatttccctatatgcttgccaatatttacctttttttcttttgataatagccatcctaacgtgtgaggtgatatctcaccgtggttttgatctgtatttccctgatgattagtgattttgagcacttttttttttttttttttttttttttttgagatggagtcttgttcttgttgcccaggctggggtgcaatggcgcgatcttggctcactgcaacctccacctcctgggttcaagtggttatcctgcctcagcctcccgagtagctgggattataggcacgtgccaccacacctggctaattttttgtattttttttttagtagagacagggcttcactttgttgaccaggttggtcttgaattcctgacctcaggtgatctgccagcctcggcctcccaaagagctgggattacaggcgtgagccaccacacccggccttaagcaccttttcatatacttgttggttatttgtatgtcttctttagaaaaatatctattcaagtcctttgcccattttttaattgggttatttaggggttttttggatattgatttgtaagagttccttatatattttagacattaaccccttatcagatacatggtttgcaaatattttcttccctggaattgttttcttaatttcattagtgaattattcatttatttatttattgagagggtctcactctgtcacccaagtgaagtacagcagcgcaaatgcagctcactgcggcctcgacctgctgggctcaagtgaatctcccacctcagcctcccaagtagctgggaccacaggtgtacaccaccacccccagctaatttttttatttttggtagagacagggtcttgccatattgcccaggctgctctcaaacttctgggctcaagcaatcctcctgcctctgcctcccaaagtgttgggattacaagtgttagccaccatgccaggcta

SEQ ID NO: 1092 - DNA, 7014 bp, Homo sapiens
ttgatgcaaacataatgattaaatactatacaatcattaaaaaggttctttttaaagaacttttctctatttttttatatgtttttttgagatggagtcttactctgttgcctgggctggagtgcaatgatgcaatctcagatcactgcaacctcctcctgggttcatgtgattctcccacctcagccttccgagtagctgggactacaggtccgcatcaccacaccctgctaatttttgtatttttatttatttttattttttgagacagagtctcgctttgttgcccaggctggaatgcagtggcacaatctcagctcactgcaacctccaactcctgagttcaagtgattctcctgcctcagcctcctaagtagacaggagtgtgccaccatgcctggctaatttttgtacgttgagtagaggcagggtttcaccatgtcggccaggctggtctcaaactcctgatctaaggtaatcctcctgtctcggcctcccaaagtgctaggattgcgggcatgagccaccatgctcggccctaatttctgtatttttagtagagatggggtttcaccatgttggccaggctggtcttgaactcctaacgtcaaataatctgcctgcctcagcctgccaaagtgctgagattacaggcatgagccactgcaaccagcctgttttctttttcttttcttttctttatttttttttttttgagacagagtttcactcttgtcacccaggctggagtgcagcagcacaatctcagttcactgcaaccccgtctcccaggttgaagcaattctcctgcctcagcctcctgagtagaaccagcctcagttttcagttgggatgtttctcttattatttagacataggagttctttatatattctagttacaagttctttatattatttggtgatattttttcccagtctgttgcctacctatcttttcatatttttaaaaatttaacttctatttttttttttgacacagggtcttgctccgttgcccagtctggagtgtggtggtgtgagcacagctcactgcagcctcgaactcctgggctgaagcatcctctggcttcagccttccaagtagctgggcctgcaagtgtgtgccaccacacccagctttttttttctttaagtgtttagagacagggtgtcactcacgctggtctcaaactcctggcctcaagcaatcctcccacctcagcctcctgaatagctggatttacaggtgcaaaccactgctcccagctcttttttttttttttttttttttgagacagagtctttctctgtcgccaggctggagtgcagtgccgcgatcttggctcactgcaagctccgcctcctgggttcacgccattctcctgcctcagccttctgagtagctgggactacaggtgcccgccactaattagtccggctaatttttttgtattttttagtagagacggggtttcaccatgttagccaggatggtcttgatatcctgaccttgtgagccgcctgcctcggcctcccaaagtgctgggattacaggcatgagccaccgcgcccagcctcttttcacattcttaatgatgtcctttgaagcacaaaagcttttaatttgatttagtccaatttatcaatattttcttttatggatcttgcttttgatgtcattttaagaagtctttgtccaactccagttacaaagattttcttgttttcttttagatgtttttacattgaagtctgtgatccattttgagttaatttttgtgtatgctatgaaacaagggtctaagttctttttgtttttatgtgactatcatgctgtcctagcaccatatacagactttcctcaatttacatgggttacatcccaataaacccatcataagttgaaagtatcagtaagtcaaaaacacatttaatacacctagcctattgaacatcatagcatagcatagcctactttaaatgtgctcagaacacttacattagcctacagttgggcaaaatcatctaacacaaagcaaattttatataaataacattttctatataatatacatatattatgagctgggcacagtggttcacacttgtagtcctagctccttgagaggctgaggcagtaggattacctgaagccatgagtttgagaccatctgggcaacaaagcaagactctgtctcttaaaaaaaaaagatatatatatatatcatttttgggggaggatctcttgaggccaggagttcaataccagcctgggcaatatggcgagactgcctttctacaacaaaaaaattcaaaaagtagccaggcatggtggtctatgcctctagtctcagctactcaggaggctaaggtgggagaatgcttgagcccaggaggtcaggctgtagtgggcaccactgcacttcagcctgggtgacagagagacaccctgtctcaaaaaaaaaggaaaccaaaatagaatggttgtatggatactcgccattaatgtacacagctgaaagcaccatagtaaagtcaaaaaactgtaacttgaaccatggtaagttggggactgtattggcaagaccatccttttctcactgaattgtctaggcacctttgttgaaagtgaattgaccataagtgtaaaagtttacttctagatcctcaattctgttccaataatctatatgtgtatctttatatcactgtcataccgtcttataattgtggctttgcagtaagtttcaaaatcagatagtggaagtcttccaactttgttcttcttttctaaaattgaattatttgcaattttgctaaattttaaactcagcttgtcaatgtctacgtaaaagtatgcatggacttttaaaaggattacattaaaattttctttaaattttttttttcttgtagagatgaggtctcactttgttgcccaggctggtctcctactcctagactgaagcaatccttctgcctcagcctcccaaagtgttgagattacaggaatgagccactgcacccaacccaaaactgttaattaatttagaaagaattgccatcttaacaatattgagtcttccaatccattaatatggaatatctattatttattttaaaatttatctcagcaatgttctttgtttttcagtgtacaagaattgcactttcattaaatttatgcttaaatatggccgggcgtggtggctcacacctgtaatcccagcactttgggaggccaaggcgggtggatcacctgaagtcaggagtttgagaccagcctgcccaacgtggcgaaaccctgtctctactaaaaatacaaaaaattagctgggcgtggtggtgggcgcctgtaatcccagctactcgggaggctgaagcaggagaatcgcttgaacccaggaggcagaggttgcagtgagttgagatcgggccactgcactccagcctgggtgacaagagcgaaactctgtctctaaaaaaaaaaaaaaaaaaaaaaaaaaaattgtgcctaaatattatattatttttaatgtcattgtgaatggaattttcctttttacagctttattgaagtattactcatgtacacaaaattgcacacaattaatgtatacaattttttctcaatatgggcaaatgttttattcatatattatataaagttcattatgccaatttatcaggtactaatcattaaacaaaaatttttttaatttttttttttttttgagacatggtcttgctctgttgcccaggctggagtgcagtggtgcgatctcggttcactgcaacctctgcctcctgggttcaagcaattctcctgcctcagcctcctgagtagctgggattacagatgcatgccactatgccaggctaatttttttttatttttagcagagatggggtttcactatgttggctagtctggtctcgaactcctgacctcaagtgatctgcccatgtcaggctcccaaagtgctgggattacaggcatgagccaccacccctggtcccccaaattttttttaacttataagtgtacttaaaatttctttttattttaaaagcatgtcatccttgcataggggccaagctaatcttctctgtatcgttccaattttagcatatgtgctgaagtgagcacaacaaattttttaatagataagaaatattgtatacatttattgtgtacatgttgttttgaaatatgtaaacactatggaaagacaaatcaagctaattaatatatgcattacctcaaatacttatctttttttgtggtgagaacacttaaaatctactgtcttagcaattttcaacaacacattattattaactatagtcaccatgttgaacttattcctactatcacaggaataagtatcctttgatcaacatttccatcccctactctctcttgcaagctcctggtggccaccattctactctccgagttcaagtttttttagattccacatataagtgagatcatgtgatatctgtctttctgtgcctggcttatttcacttaatataatgtcctccaggttcatccatgttgtcaaaaatgacagaatctcttcctttttaaggctgaatagtattacattgtgtatatacaccacattttctttatccattaacccactgatggacacttaggttgattccatatcttggttattgtgaataatgccacaatgaacattattgtggttcattggtgcaggtatctcttcaagatcctgattcaattctttcagatatatatatccagcagtgggattgttagatcatgtaacagttttatttttagtttcttgaggaacttccatactgtcttccatagtggcagcaccatttttaatctccaccaaatgtgtacaagcattccaatttccctatatgcttgccaatatttacctttttttcttttgataatagccatcctaacgtgtgaggtgatatctcaccgtggttttgatctgtatttccctgatgattagtgattttgagcacttttttttttttttttttttttttttttgagatggagtcttgttcttgttgcccaggctggggtgcaatggcgcgatcttggctcactgcaacctccacctcctgggttcaagtggttatcctgcctcagcctcccgagtagctgggattataggcacgtgccaccacacctggctaattttttgtattttttttttagtagagacagggcttcactttgttgaccaggttggtcttgaattcctgacctcaggtgatctgccagcctcggcctcccaaagagctgggattacaggcgtgagccaccacacccggccttaagcaccttttcatatacttgttggttatttgtatgtcttctttagaaaaatatctattcaagtcctttgcccattttttaattgggttatttaggggttttttggatattgatttgtaagagttccttatatattttagacattaaccccttatcagatacatggtttgcaaatattttcttccctggaattgttttcttaatttcattagtgaattattcatttatttatttattgagagggtctcactctgtcacccaagtgaagtacagcagcgcaaatgcagctcactgcggcctcgacctgctgggctcaagtgaatctcccacctcagcctcccaagtagctgggaccacaggtgtacaccaccacccccagctaatttttttatttttggtagagacagggtcttgccatattgcccaggctgctctcaaacttctgggctcaagcaatcctcctgcctctgcctcccaaagtgttgggattacaagtgttagccaccatgccaggctagggctgaataaattaatgagagaataaaaagagtgttttcatgtttcttacatggatgaactttaagttttttaagttttctctcatccttgttttatttatttatttgtttgtttgtttgagacagggtctcactctgttgtccaggctggagcactctggtgccatcacagctcaaacagccttaacctcctaggctccagtgatcctcccactttagcctccagagtagctgggactacagacatgggccaccatgcccagctaattttttattttttgtagagatgagatcttgctatgttgcccaggctggtctccaactcctggactcaagtgattctcccgcctcagcctcacaaagtgttggaatcacaggtgtgagccaccacacccagactgtatatttattttcaaatataatcattttgatagcagggatatcttcttattcagctttgcatttatggcaaatagtaggcaacttaataaatttgttgaagaaatggaatatagcaaaactttgaattagccatttatattaaaagggaaaagagaccagcctgggtaatgtagtgagaccccatctctacaaaaaaattaaaaaattagccgagcatggtggtacacacctgtagtcccagctactcaaggggctgaggtaggaggattgcttgaggacaagagtttaaggttgtagtgagctatgattgcaccattgcattccatctggagtgacatggagagaccctgtgaccaccccccagaaaaaagggaaagaagagagcattacttttttcttttcttttctttcagacagtctcactctgtcacccaggctggagtacagtggtacaatctcggctcactgtaacctctgcctcccaggttcaagtaattctcctgcctcagccttctgagtagctgagattacaagcgtgcgccaccacgcctggctaattttgtatttttagtagagacagggttttaccatgctggccaggctggtcttgaactcccaacttcaagtgatccatccgcttcagcctcccaaagtgttgtgatcacagttgtgagccaccacgtccagccagcattacttttttcaagggttaagaacatgcctttaaatatcttgataacttgcttgag

SEQ ID NO: 1093 - DNA, 1727 bp, Homo sapiens
gtaaccttgggagagtcatcttacagccatcctgtagggtattaattaccagggacacagactccagccacgggtgtcgggtgtcgggaaccatgcccttggctacggtatccctggaaacacagcatgcccttggcctgaatcccagaataccccagagaggatgcgtgaagatgggtccctgaaacaagagcacgtttgcaggtaaaaatccccaaggagctttggggtcttggaccaaggtggatgggtgcaggggtggggtcaagtttctgctagtgtttctcaagctccgtaccctcaggagcagctgttcatgtgtgaatgttgagtagtcctattccagagctaagttttgtgaaacggagtgagaagggggcaggggaagagacagaggtggacagcctctctctcattccaacatttatctctagagtaagcaaaggtgggaaactggagaaatctcgattaaaacgcagatccctttttttttcttttgagacagagtctcaatctgtccgcccaggctggagtgcagtggtgtgatctcagctcactgcaacctccaccttccagattcaagcgattctcctgcctcagcctccctagcagctgggactataagcacgcgccaccacacccagctaatttttgtatttttagtagagacggggtttcaccatgtttgccaggctggtctcgaactcctgacgtcaggtgatccaccagtctcagcctcccaaagtgttgggattacaggcgtgagccactgcgcccagcctaaaatacggatcctaacagacaaggggagatcaaacctcagatagtaaagagcacgcccccatccatccacggcagctgtgggccgtaatggggcgccaggcaagattttctagacaaccctgttaaactgcacccgctgggcccccgcttcgaatctgagacaatcaatctgacctggcgctgacaggtttgctgtggaacaatttgatgcactccccaacagagaacaatggcctcacagaaggttcatgaatggaggccattcgaaagctttcttgtaagcaaagaagggaggttatcagccttcctgggcaatttccactttgactccaagacgctttttgccctctgtatgtcccgcctcgggtggggtcttcagctttgctcttctaagagattaacttgcaagcagcaccagttacagccactgctgctatcttgtgttttagcatgagcctccctgaagcaaaatcatctcaaaatctctgaaatgtaacgtacagaatttcccacaggcaaaacagtgcaaagttgggaatatcttcagtggtacccactgcctttctgtccatgctgctaccagcttcctagagcttcccctggtgggccagggtttccaacagacaccttcccccataagtgctcacttcattcgcattgggttagaactctcccgctccaacttcccgtttcttcacagccccactaacactggccatttagttcaataaactaattggagggggatgctaatgaccggtaatgacttaaggcactcacactttgtaaagaacctcagcaatttaatataaaaacagggtaagtaacgcaggcactttgcaggctggtggaggaacacgttttcagaacagagccctgagctttcttcagtttataccttgtccagagaattaaatacacagcaccaggggaacaaatccaat

SEQ ID NO: 1094 - DNA, 5456 bp, Homo sapiens
ctgagactgcagtttagagtctaggtatctcccgcacacggagatggggctgtccccaactagaactgagagctaaggaggaatgacagggcaggagaatccagaagaaggggcttctgtttcccccttcttccatccatccatccgtctttctcgaggcccaggtagtcttctaggtaccaagaaaataatggtgagtaaaacagcccctgccctctcagagcttgtgttatggttgataaaaatatgaatttgaaacagaacctgcaaagtaatcctcacttcctacaattgcaacttttgaaagcttaaagtgagccttctaatttttttttttttttttttgagacggagtctcactctgtcgcccagcctggagtgcagtggtgtgatctcggctcactgcaagctccgcctcccgggttcacgccattctcctgcctcagcctcccgggtagctgggactacaggcacctgccaccgtgcccggctaattttttgtgtttttagagagacggggtttcaccatgttagccaggatggtctcgatctcctgacctcgtgatccacctgccttggcctcccaaagtgctgggattacaggcgtgagccttctaatttttcctccaaattccaaacaagtttttttaatgtgggaaaatacacagtataaaaatttaccatcttaaccatttttaagtgtacaggccaatagcattaagtacattcacactgtcatccaaccgtcaccaccactacccgtctctagaacttctttcatcttgcaaaactgaaactctgcacccactaaatactaacttcctatttcccctcccccagcccctggcagccaccattctattttctgtctctgtgaatttgactatttgactaagggtccggcgtggtggctcaaacctgtaatcccagcactttaggaagctgaggaaggtggatcgcttgagttcaggagttcaagatcagcccggccaacctggcgagaccccgtctctacaaaaaatacaaaaattagccaggcatggtggtgccacacttgtagtcccgcctacttgggagggtgaggtgggaggatcacctgagcctgggaggtcgaggctgcagtacgccaagatggtgccactgcactccagcctgcatgacagagtgagaccctgtctcaaaaaaataaaaataaagaatttgaccattctaggccagatgcggtagctcatgcctgtaatcctagcactttgggaggccgacatgggtggatcacctgaggttgggagtttgaaaccagcctggccaacatggtgaaaccccatctctactaaaaatacaaaaattagctgggcatggtagtccatgctaattccagtcacttgggagactgaggcaggacaatcgcttgaacccaggaggcggaggttgcagtgagctgagatcatgccactgtactccagcctgggtgacagagtgagactgtttccaaaaaaaaaaggaatttgaggccgggcgcagtggctcacgcctgtaatcccagcactttgggaggccgaggcaggcggatcatgaggtcaggagatcgagaccatcctggctaacactttgaaaccccatctctactaaaaaatgcaaaacatttgccaggcgtggtggcgggtgcctgcagtcccagctcctcaggaggctgaggcaggagaatggcgtgaacccgggaggcggagcttgcagtgagccaagatcacgccactgcactccaagctgggcgacagagcgagactccgtctcaaaaaaaaaaaaaaaaaaaaacaaaaggaatttgactattctagtacctcatatgagtgggatcacaccacacttatccttttgtaactggcttcattagcataatgtcctcgaggtgcccccctgctgtggcatgcgttggaattccttttcgaggctggatgatgttccgttagaaggataccatgttttgcttatccattccctggttaacagacgctgggttgcttccaccttttggccattgtgaacaatgctgctaatgctggtgtacaaatacctcaaggccctgttttctaatcttttgtgaatatgcccagaaggcggactgctggatcatacggtgattctatctttagggtgattgtatctttgtgttttgaggagccgccataccgttctccatagtgactgcaccattttccattcccaccaaccgtgcacaagggccccgatttctccacctccttcccagcacttgttattttctgctttttgatagaccatcctaacagatgaaaccaaacatgctttatatcaagtaattttaccttctcgtattgtgtaaaattgataagataccaaagtagacaacagagagtaagaagccccatgtgctcctcactaaccactataatgatccacgcagaatgaatcttgtttgacttcactcccactcccaacaccgataccacttattttgaagcaaatgccagacatcatataacttcccctctcaataccgcatcatacatctctaaaagataacaactctttttaaaactaaccatatcaagtccaatagagcttaaaggtaaaaaataaaataagctgggagaggtggcttatgcctgtaatcccagcactttgggaggctaaggagagtggattgcttgagcccaagagttcaaaatcagctaaggcaacatggcgaaacccgtctctagtaaaaaatacaaaaattagccaggcgtggtgatgcacacctgtagtcccagctacttgggaggctgaggtgggagaatcgcttgagcctggctggtagaggctgcaatgagtcataactgcaccactgcactccagcctgggcaacagagcaagaccctatctaaaaaaataaagtaaaataaataaaaactaaccataatggcagtattacctaaaatttcacaattatttaatatcatcaaatacctaatcagggttcctatttatctgcttgtttggtgtatcaaataatttcactcaagacttttctcgctctgtagggtaagtttgtgttgtttcactccgaattccgctatgaaagaaaaatgaaagcactgataaccttgaacagtaatgcttaggggtttccacaatgtcgccaattcttttttcacctttaagtatgtttattaagtaggttttcgtagatgttatttatcaaattgagagagagcccctctattcctaactttgagagttttcatcatgaatgaatgaatagcatcttctgaaatgctatttcggcattaattggtatgctgtgacttttcttttttagcgtattgattggtgaattattgactgtcaaatgttgaaacagtcttatgtatgtggactagatcctatacggtcatggtgtatcattcttcttgcacattgtttgatttgatttttgttgaggactttttaaatgttttgttgagatcgccattaaaatattttgtcagtatatttcaattcacttttcttttgaaaattctgaaaattctactggcatgaatatatccagttttgtatactcagcatcaaatattacgcatatttcggagcacaggtcaggcgccgtggactcccttttgctgaccactgaggctaatctagcggattcagctatatgaaaggcaagagacagcgacaatcacaaggctatttttgaaaaatcagggtgtgacgatcgcaaatgtgcttttaaaaattaggattaaaaaaaaaacagggccgggcgcggcggctcacgcctgtaatcccagcactttgggaggccaaggtgagtggatcatgaggtcaggagatcgagatcatcctggctaacaaggtgaaaccccgtctctactaaaaatacaaaaattagccaggcgtggtggtgggcgcctgtagtcccagctactcgggaggccgaggcaggagaatggcgtgaacccgggaggcgggaggaggcagaacttgcagtgagccgagatcgcaccactgcactccagcctgggcaacagagtgagactctatctcaaaaaaaaaaaaaaaaaaaaagatggaattgtttctcctgttaaacctggcttaaatatagcaaccctaaagctgaaagacaaagaatttgaaggtttgtagttaaagtggcaggacttcctaaagcaaagttcacaactttttcagatcacaggctttttgctctgttgcccaggctgcagcctccaactcctggactccagaaatccttctgcctcagcctcccgagtagctggggagccaccatgtccagctagttttaaaatttttttgtagagaaggcggtctcactgtattgcccaggctggtctcgaacttctgggctcaagcaatccccctgccttggcctcccaaagagctgggattacaggagtgagccaccatgcccggcccaaatcctttttttttgagatggagtctcgctctgccacccaggctgaagcgcagtggcacagcctcagctcactgcaacctccgccttctgggttcaaacaattctcctgcctcagcctcctgagaagttgggattacaggtgcccaccaccatgcccactaatttttgtatttttagtagagatggagtttcagcatgttggccaagctgctggtcttgaactcctgaccttaagtgatccgcctgcctcggcctcccaaagtgctgggattacaggtgtgagccaccacatgcggccccaaatcctttttagtttaatgttaagatttctggccgggcccagtggctcatgcttgtaatcccaacactttgggaggctgaggcgggtcgatcacctgaggtcaggagttccagaccagtctggccaacatggggaaatcatgtctctactaaaaatacaaaaattagctgggcatggtggcgggtgcctgtaatcccagctactcgggaggctggggcaggagaatcatttgctactcaggaggctggggcaggagaatcatttgaacctgcgaggtggaggttgcagtgagctgagatcggtcgtgccactgcactccagcttaggcgacagcgagactccacttcaaggggaaaaacaacaacaacaacaacaacaaaaaaaacaggccaggcaccaacccaaaacataagcagcaagtgtaacagcaatgccggtattccacactgacttccatcctgagcttcctaaacaactctcatatgccatggctggcagtctctcttgaatgtcacaggtgtgatgtggcagcctctccagcagagagcctcatgtccacctacagcagtgagatttccagcagcaaaggctttagcacaatccttccagaagttccaaagctgacaggtgagatgcgcaggaagggccactcttaaaacacttaggaaataaggggtctccctcatgattgggctg

SEQ ID NO: 1095 - DNA, 7182 bp, Homo sapiens
ctgagactgcagtttagagtctaggtatctcccgcacacggagatggggctgtccccaactagaactgagagctaaggaggaatgacagggcaggagaatccagaagaaggggcttctgtttcccccttcttccatccatccatccgtctttctcgaggcccaggtagtcttctaggtaccaagaaaataatggtgagtaaaacagcccctgccctctcagagcttgtgttatggttgataaaaatatgaatttgaaacagaacctgcaaagtaatcctcacttcctacaattgcaacttttgaaagcttaaagtgagccttctaatttttttttttttttttttgagacggagtctcactctgtcgcccagcctggagtgcagtggtgtgatctcggctcactgcaagctccgcctcccgggttcacgccattctcctgcctcagcctcccgggtagctgggactacaggcacctgccaccgtgcccggctaattttttgtgtttttagagagacggggtttcaccatgttagccaggatggtctcgatctcctgacctcgtgatccacctgccttggcctcccaaagtgctgggattacaggcgtgagccttctaatttttcctccaaattccaaacaagtttttttaatgtgggaaaatacacagtataaaaatttaccatcttaaccatttttaagtgtacaggccaatagcattaagtacattcacactgtcatccaaccgtcaccaccactacccgtctctagaacttctttcatcttgcaaaactgaaactctgcacccactaaatactaacttcctatttcccctcccccagcccctggcagccaccattctattttctgtctctgtgaatttgactatttgactaagggtccggcgtggtggctcaaacctgtaatcccagcactttaggaagctgaggaaggtggatcgcttgagttcaggagttcaagatcagcccggccaacctggcgagaccccgtctctacaaaaaatacaaaaattagccaggcatggtggtgccacacttgtagtcccgcctacttgggagggtgaggtgggaggatcacctgagcctgggaggtcgaggctgcagtacgccaagatggtgccactgcactccagcctgcatgacagagtgagaccctgtctcaaaaaaataaaaataaagaatttgaccattctaggccagatgcggtagctcatgcctgtaatcctagcactttgggaggccgacatgggtggatcacctgaggttgggagtttgaaaccagcctggccaacatggtgaaaccccatctctactaaaaatacaaaaattagctgggcatggtagtccatgctaattccagtcacttgggagactgaggcaggacaatcgcttgaacccaggaggcggaggttgcagtgagctgagatcatgccactgtactccagcctgggtgacagagtgagactgtttccaaaaaaaaaaggaatttgaggccgggcgcagtggctcacgcctgtaatcccagcactttgggaggccgaggcaggcggatcatgaggtcaggagatcgagaccatcctggctaacactttgaaaccccatctctactaaaaaatgcaaaacatttgccaggcgtggtggcgggtgcctgcagtcccagctcctcaggaggctgaggcaggagaatggcgtgaacccgggaggcggagcttgcagtgagccaagatcacgccactgcactccaagctgggcgacagagcgagactccgtctcaaaaaaaaaaaaaaaaaaaaacaaaaggaatttgactattctagtacctcatatgagtgggatcacaccacacttatccttttgtaactggcttcattagcataatgtcctcgaggtgcccccctgctgtggcatgcgttggaattccttttcgaggctggatgatgttccgttagaaggataccatgttttgcttatccattccctggttaacagacgctgggttgcttccaccttttggccattgtgaacaatgctgctaatgctggtgtacaaatacctcaaggccctgttttctaatcttttgtgaatatgcccagaaggcggactgctggatcatacggtgattctatctttagggtgattgtatctttgtgttttgaggagccgccataccgttctccatagtgactgcaccattttccattcccaccaaccgtgcacaagggccccgatttctccacctccttcccagcacttgttattttctgctttttgatagaccatcctaacagatgaaaccaaacatgctttatatcaagtaattttaccttctcgtattgtgtaaaattgataagataccaaagtagacaacagagagtaagaagccccatgtgctcctcactaaccactataatgatccacgcagaatgaatcttgtttgacttcactcccactcccaacaccgataccacttattttgaagcaaatgccagacatcatataacttcccctctcaataccgcatcatacatctctaaaagataacaactctttttaaaactaaccatatcaagtccaatagagcttaaaggtaaaaaataaaataagctgggagaggtggcttatgcctgtaatcccagcactttgggaggctaaggagagtggattgcttgagcccaagagttcaaaatcagctaaggcaacatggcgaaacccgtctctagtaaaaaatacaaaaattagccaggcgtggtgatgcacacctgtagtcccagctacttgggaggctgaggtgggagaatcgcttgagcctggctggtagaggctgcaatgagtcataactgcaccactgcactccagcctgggcaacagagcaagaccctatctaaaaaaataaagtaaaataaataaaaactaaccataatggcagtattacctaaaatttcacaattatttaatatcatcaaatacctaatcagggttcctatttatctgcttgtttggtgtatcaaataatttcactcaagacttttctcgctctgtagggtaagtttgtgttgtttcactccgaattccgctatgaaagaaaaatgaaagcactgataaccttgaacagtaatgcttaggggtttccacaatgtcgccaattcttttttcacctttaagtatgtttattaagtaggttttcgtagatgttatttatcaaattgagagagagcccctctattcctaactttgagagttttcatcatgaatgaatgaatagcatcttctgaaatgctatttcggcattaattggtatgctgtgacttttcttttttagcgtattgattggtgaattattgactgtcaaatgttgaaacagtcttatgtatgtggactagatcctatacggtcatggtgtatcattcttcttgcacattgtttgatttgatttttgttgaggactttttaaatgttttgttgagatcgccattaaaatattttgtcagtatatttcaattcacttttcttttgaaaattctgaaaattctactggcatgaatatatccagttttgtatactcagcatcaaatattacgcatatttcggagcacaggtcaggcgccgtggactcccttttgctgaccactgaggctaatctagcggattcagctatatgaaaggcaagagacagcgacaatcacaaggctatttttgaaaaatcagggtgtgacgatcgcaaatgtgcttttaaaaattaggattaaaaaaaaaacagggccgggcgcggcggctcacgcctgtaatcccagcactttgggaggccaaggtgagtggatcatgaggtcaggagatcgagatcatcctggctaacaaggtgaaaccccgtctctactaaaaatacaaaaattagccaggcgtggtggtgggcgcctgtagtcccagctactcgggaggccgaggcaggagaatggcgtgaacccgggaggcgggaggaggcagaacttgcagtgagccgagatcgcaccactgcactccagcctgggcaacagagtgagactctatctcaaaaaaaaaaaaaaaaaaaaagatggaattgtttctcctgttaaacctggcttaaatatagcaaccctaaagctgaaagacaaagaatttgaaggtttgtagttaaagtggcaggacttcctaaagcaaagttcacaactttttcagatcacaggctttttgctctgttgcccaggctgcagcctccaactcctggactccagaaatccttctgcctcagcctcccgagtagctggggagccaccatgtccagctagttttaaaatttttttgtagagaaggcggtctcactgtattgcccaggctggtctcgaacttctgggctcaagcaatccccctgccttggcctcccaaagagctgggattacaggagtgagccaccatgcccggcccaaatcctttttttttgagatggagtctcgctctgccacccaggctgaagcgcagtggcacagcctcagctcactgcaacctccgccttctgggttcaaacaattctcctgcctcagcctcctgagaagttgggattacaggtgcccaccaccatgcccactaatttttgtatttttagtagagatggagtttcagcatgttggccaagctgctggtcttgaactcctgaccttaagtgatccgcctgcctcggcctcccaaagtgctgggattacaggtgtgagccaccacatgcggccccaaatcctttttagtttaatgttaagatttctggccgggcccagtggctcatgcttgtaatcccaacactttgggaggctgaggcgggtcgatcacctgaggtcaggagttccagaccagtctggccaacatggggaaatcatgtctctactaaaaatacaaaaattagctgggcatggtggcgggtgcctgtaatcccagctactcgggaggctggggcaggagaatcatttgctactcaggaggctggggcaggagaatcatttgaacctgcgaggtggaggttgcagtgagctgagatcggtcgtgccactgcactccagcttaggcgacagcgagactccacttcaaggggaaaaacaacaacaacaacaacaacaaaaaaaacaggccaggcaccaacccaaaacataagcagcaagtgtaacagcaatgccggtattccacactgacttccatcctgagcttcctaaacaactctcatatgccatggctggcagtctctcttgaatgtcacaggtgtgatgtggcagcctctccagcagagagcctcatgtccacctacagcagtgagatttccagcagcaaaggctttagcacaatccttccagaagttccaaagctgacaggtgagatgcgcaggaagggccactcttaaaacacttaggaaataaggggtctccctcatgattgggctgtaaccttgggagagtcatcttacagccatcctgtagggtattaattaccagggacacagactccagccacgggtgtcgggtgtcgggaaccatgcccttggctacggtatccctggaaacacagcatgcccttggcctgaatcccagaataccccagagaggatgcgtgaagatgggtccctgaaacaagagcacgtttgcaggtaaaaatccccaaggagctttggggtcttggaccaaggtggatgggtgcaggggtggggtcaagtttctgctagtgtttctcaagctccgtaccctcaggagcagctgttcatgtgtgaatgttgagtagtcctattccagagctaagttttgtgaaacggagtgagaagggggcaggggaagagacagaggtggacagcctctctctcattccaacatttatctctagagtaagcaaaggtgggaaactggagaaatctcgattaaaacgcagatccctttttttttcttttgagacagagtctcaatctgtccgcccaggctggagtgcagtggtgtgatctcagctcactgcaacctccaccttccagattcaagcgattctcctgcctcagcctccctagcagctgggactataagcacgcgccaccacacccagctaatttttgtatttttagtagagacggggtttcaccatgtttgccaggctggtctcgaactcctgacgtcaggtgatccaccagtctcagcctcccaaagtgttgggattacaggcgtgagccactgcgcccagcctaaaatacggatcctaacagacaaggggagatcaaacctcagatagtaaagagcacgcccccatccatccacggcagctgtgggccgtaatggggcgccaggcaagattttctagacaaccctgttaaactgcacccgctgggcccccgcttcgaatctgagacaatcaatctgacctggcgctgacaggtttgctgtggaacaatttgatgcactccccaacagagaacaatggcctcacagaaggttcatgaatggaggccattcgaaagctttcttgtaagcaaagaagggaggttatcagccttcctgggcaatttccactttgactccaagacgctttttgccctctgtatgtcccgcctcgggtggggtcttcagctttgctcttctaagagattaacttgcaagcagcaccagttacagccactgctgctatcttgtgttttagcatgagcctccctgaagcaaaatcatctcaaaatctctgaaatgtaacgtacagaatttcccacaggcaaaacagtgcaaagttgggaatatcttcagtggtacccactgcctttctgtccatgctgctaccagcttcctagagcttcccctggtgggccagggtttccaacagacaccttcccccataagtgctcacttcattcgcattgggttagaactctcccgctccaacttcccgtttcttcacagccccactaacactggccatttagttcaataaactaattggagggggatgctaatgaccggtaatgacttaaggcactcacactttgtaaagaacctcagcaatttaatataaaaacagggtaagtaacgcaggcactttgcaggctggtggaggaacacgttttcagaacagagccctgagctttcttcagtttataccttgtccagagaattaaatacacagcaccaggggaacaaatccaat

SEQ ID NO: 1096 - DNA, 16461 bp, Homo sapiens
ttcttgccactcatactgaagttttcatccatcagagaaaaaaaaatcttcatatggcctactatcactacaaatgatgacagcagtactaagaaggatagtgagcacttgtacagcacttggtatatgcccagtatgcactaagtgctctgcattcagtatctttttaactcttcataataaccccatgtcattggtactgttttcatctcgattttacagatgaggaatctgaggtgaattgagaggtaatagctcagggtctaatagttagtaggtagaacaaggatttaaactatgtctacttgtaatacattatttatatggcaatttgcttcactaataggatcgatccctctataatggatcctattagaatggaaaatgatgggcctagagatattttcacataaaatatggcttctatagaatgtattaataatgactatcaaacacccatttggaccataggtgttatgggatggaggaggacaggaaggaaataagaaatttagtccctgccctattgctctgagaagtatctgggaagccaggcatttcctggtctagataggattatgtttcaacattggctaggacctccagatttcacacacatccacccacatgtggacagcatgagaataataaccaggtaacctgtacagctaatcaaaatgttcttgctatcagagaacaccagtagatgcatgagtcatggacagaaggtggcaaggctttgtggatgaaagaaaagctatgaaatactaccacactgacctcttctatactggatggcacagtgccctggaaaaataaatcaccacacgagcatgaaatcaggattgggaaaatacacaggaaatacaagaagaatatccctatcagatccttttaaagatctgcctaaccggacagttcagtgctgatgtgagtaactcctttcaagtttacaatatactagctgaaagtttttagaaccagggttccaaatacattaataaagatttgtacaggtgtgtagggaagttaataataaattaacagtgaacttcacactgaaataataacttctttgcagtaaatagctacacatattaaaaaattaaaactgatgaaaaataaaattagagttcctctctcctccctttctcactatctctcaaagtgacaggccatacaattaaaggctgtttctttgcaaagtccatgctttgcagttctaatcactcgagtgatttatagaggaaatgatgttttgcaggtactctaaaacagagctgcactttgtccagtgtgcaaggccatgcttaatgaaaaactttaaatttggaaggaaaaaaactgcagtaaaaagagaagaattatgaaattttagtatttacttgatttattaatgtttccttgtgcatttctttttataatttgtgtcctggctaaggcaggaaggcaaaacaaatgtccttttgtttatggctttaaaaaggtcataagaataacaaaaggatacataaatactgatgactatatctttccctatttcactgtacattaatttaacagtctgctactgaaatactgctgttggttaagcacagagttaactatttaaaaatattcttgtctttttaacccaatttctttcaaggatataattaatccagttaagaccgttcttaaaatatgtgcaggtcatgatagaaatgtcacttgtcaactctctgatgcatttcagatctgctctgccactatagagttccagacagacaggaaacattgtaaatcactgaagaaacatacaagttaagaactgtgattttgttacttaaaattactgaaaaatagacaaaattcaagcatatatcaggagcgtaaatgtagaaatctgtaagcatttacccagaaaggtgcagatcattaaactaataaagctaactcatattcagtgcccaaggatatatcaaattttgtaaaaacaactttaagtcaccggaggcaaggagagctccaagttagcacaaagaatgttgatttcaccggggtgtggtgactggggataggcacacctggcaaaactccattctgtgggctactaaatctctgtatttgttaggttgtgctatattgtgtatttcggttctgccacccaaagaaggtatccaaaataacttgtggtgggcgtggaggaatcacatattaaaagtcccaaagtctgtgcctccttcatgcttgtgcagctgtcttccagtgtcactgccttgtagactgcacaatcatggtgtgattctagatagctcagctccaccacagaaataaaggggataaaatgaacagttggcgagatactgagactgcagtttgaacctctataggactaatgcttttaggttgttctttattttgttgctttgctttcttttgccaacagcagcgggggcttagctcttattcaaccatatactttttaaaatctctactcagtggtactgatagaaaacattttcaagattccactgaaaaagaccagagctttgtaagggtagtggagttctctaggtggaaaaataacttcctcgcctaatagggattggacaccaccacccacatcttggtctcaatagcaccaaactttaaattgccaatctagccaggcccttatgctaaggccgaagtgagtcttaccttcagtgtagaagctgaaaagcaggtaggtgtctctgattcagtctagcctgaccacatgcactttttggtctaatcttaaaatacttaaatgtctaacaactacttctgtttcccagctattctctcctaatatttatgatatatcttggctatttgacagtagatttgagtcatatagttaagtcatatagttaagtcaactatttgagtcatatagttaagctatcaactttctatagacatagtttgccttatactataacatacattcttcaaccttacactatacagcaaagtatttattattgtttctatcaaaataatatcttacattcctgtaatttcttatagttgctaagtactctttagatgttttttcccatttatatctcacaacatcctggtgaggtagctgatattatcctcatttttccggatcagaaaattgaagaaagcataaatcccttgttcaaggtcatagagctagttagagaacttggcagaatatgaaaccaatttgtttaattctaattacagtgttatgtccacaatacctctccctcaatcaaaataaaaacgtttcaaccaaaataagatgccacagcagttttttaaagaaattaataaatttatataaaaacccatatacagtttagcacaaaataatatttcaaatttaagtatcttcaattatccttgcaataatccactatcaaaagccattgcttaaactaatcccccctttaagtatactaaacaacgtgctactgtgtgtatttgtgtatccgtgagtgagtgtgtgcatgcttgcctgagctcatttaaagggatacctttatcctgaggtttaaaaacagtgaggtctgaattttcattgttaaaagcagatcatggagcaatcaatcagctaataaccatctattaatatctgatgtactatgcaacatgacagagtaaatgaaaataagaataagatgcatttcctacatttgagtttctataatctagcgagaggacaaggaaacaacacatctaccacatcatcatcatcatcatcatcatcatcatcatattagcaatgacattaatgccgacattcattcactacatacttctcacattttaggccagcactggccaacagaaatataatgtgagccacatatgtaatttttaattttccagtagccaaattaaaaaaggtaaaaagaaacagataaagatgaattttatttaacacatatatctagaatgttttatgcacatgttaataaaaaattatccagatattttacatactttttcatattaaagtctccaaaatccaacgcagtcaatgaattacataacaacggggaaacattctgagaaatgtaccattgcatgaacattacagtatacttgcacaaacctaggtagtagagccaactacatacctaggatatatgatatagtcttatggtgcctaggttgcaacctgtacagcatgttactgtactgaatactgtaggcaactgtcgcactattgtaagtatttgtgtatctacacagaaaaggtacagtgaaaatatggtatcttatgggactaccattgtgtatggtcccttgctgacccacatgtcattatgcagcacatgactatattttacacttatggcatatcacaattcaaatgtaaattttcatcagaaatacttgatctgttttagatttcataaaactgatcattgaaaaagtaaattcatgtacccaacctgtaccaaatatacttaaaagttttctcataacgaaattgagtatccaaaaaatcattttcctttaattttcacaagtacattgacaaaactggttcacttttgtttaaaagaactgatttgggccaggcgtggtggctccttcctataattccagcactttgggaagccaaaccaaagccaaagtatggcttgaggccaagagctcaaggcctccctgggcaacatagtgagaccccatctctacaaaagatttttaaaataatatttttttaattagctgggtgtgtcccagctgctcaggaggctgacacaggaagattgcttgtagtccagaaggtcaaggctgcagtgtgccatgatcacaccactgcactcaacctgggtgacagaatgagaccatgtaccaaaaaaaacaaagaaaatgtttgttattttaaagtaaactgggcatggtgaggcaggcctgtagtcctagctacttggaaagctgggacaggagaattgcctgagcccaagagttcaagactgcagtgaactatgaccaggccactacattctagcctgggtgacagagtgagacttcatttcaaacaaaaaaaaaaaaaaaaaagaaagaaaaactgatttgactttgaagtataagcatatcagtttcaaatccatatcggttcaagttaagtaagctaattaactcttgtgtcaagtcagtattaacactggattcaaaggaatatttgcataaattggaaaacaactctaaatttatcagtatcaacaaagagctcttcaaattctagtttttgtagccaatatatataatggtatttataattaaaatcttctgcacattaatcattactattgacttatattatgaaaaccttcaatttcaacatgaattctaatatctgcctagctagttgacaaattaccttgtcctttcctgagactttcaaattagttcattcaaaagtagtgtgatctgagtcagaaaacataaaccatactgctatattcccttttttttttttttttttggatggagttttgctcttgttgcccaggctggagtgcaatggcacgatcttggctcactgcaacctctgcctccccggttcaagtgattctcctgcctcagcctcccgagtagctgggattacaggcatgcgtcaccatacccggctaattttgtattttttagtagagacagggtttctccatgttggtcaggctggtctcaaactcccgacctcaggtgatccacccactttggcttcccaaagtgctgggattgcaggtgtgagccaccgcgcccggcccatattccctttttaagtactgaatacttgggcaagtgcccctttttgtttcaacaaaagatcatctttggttggagtaaatattatgctatagaaatctgtgtaaaactcgtccaggactccaccaacaagtgctgctaaagatcacaaggtcactgccttcactgtcttccatttctttctgcaggtccataaaccagcaatgatctatgaatttacacttatagactggataattttaactactagtatgtgtcacactttttgccaagttaactactgtattgtactctgtccagcttcagaatacagtcgaatgaagcaataagagaaataccagcctcttgaaaaattccaataaatacagaattcggtctaagagagctgggtcaactgtaatagaaattaattttttcatatccatctgaaattctttgaaacagtcaaatgtttgaattgaatgttcttaaaacattcaaaaatatctctgccacaaatctgttatttttggcaaaaaaaattacaacatttatttataaatcttaaagtctgtattaatcggacaatggatcatcatactgtataacttacacaaagctaaaggaaagtaattgaaatgtttcaaatttcaaatgggtcatgtagtctataggcaactgtttagtgaaaaatatctttaagtttttgtgaaatatatttttgtctcttctcataattttctaataaaattttggtacctgcaataattccttctgccatctctccatcttaaactggcttcctctatagtgcatgaatccaagacactgtataggtggccaaagttacaggctcatactctgttaaaatttttaaacttaatgaacatttgatatagtttagatttctgtccctccaaatctcatgttgaaatgtgatcctcaatgttgaaggtgcggtctagtgggaggtgtttgagacagggggacagatccctcatgaatgagtgttactgccatgctaacatctgcagaactgagagccaaataagcctcttttctttataagttacacggtctcaggtattcctttacagtaatgcaaaacggactaataaaacactaaattctgctttcaggcaattacttccatcaattcttcattgacctttgagaaaaaacttctcatcaaatctaccacagatttcttgaaaatgtcttaatattgcccatttcattttctttacattttttatacaattgcaaatgagattcatcatgaagtccctagtctctttgtgttcccactgctttgatcatactactaatttctgtatctgtactcactccgcaacagtagtatgccttcacttcaaatttaaaaactgtccatatttatttactaacaagtgatgtagttaccttaattttatatatcacttaaacatttctgggggatgagggataaaaatctacatgtcaggtaccatgtacactacttgggtgacaggtacactgaaatctcagattttaccaccatacaattcacccacgtaaccaagaacttcttgtaccccaaaagctattgaaataaaaaatttaaaacaaacatttcaatttaattactaatgataatgtacttgcatcactataagctgcactgtctgcacaaaatatttaataaatactataaagtgagaacacagaaaaagtatatactgaataaattatttgacaccagcaagattggtagtgtgtttatgtatgctaatgtagtcttaccaaaacaagaaaactgtgtttaacagaaatatatcgtgcactgcttccatcttaaaaatccagttcctcgggtacgctagtcacactgaactgctcgacagacacatgtggcttatagctattgttcctgatcatacgatgagaggctgtgttcatggcagtctgtatttattaattgtggtaattctcacaaggaagagaagtctttactctaattatccccacattacagacaatggaatttaggcaaaagtaattaagtgacttacccaaagtcacaaagctattaactggggaactgggatttcaacccagacagtctgactccagagactcttatccactattccacaccgccagaagttcaacaacagcacagggtttcatgagagatgaggcaagagatgcagagtgtgttaaaaatatatatataaaccaaactactttgcaatgaaaagaaggaagccagaactcacaggaagacgtcgtgaaagagggagaaagacttgagctgcgtagtccaagataaatgctgcagataaacagcccaggcagctgagcgcaggaggagtaggtgtgcgaagcgcgagcaaagtgtgtttagccatgaacaggtaaagtgagtcagctgtggagttaatgcagcaggctaaaaaatggcccccaaaagacacagccacatcctcaccactgaaatctgtgactgatacctcatattagaaaatcatctttgcagatgtgatgaagttaaggaccttgcgttggggagactggagattatcgtggattatctgggtgaactctgagcataatcgcgagagtccttataagaaacaggcagtgggagatttcacccagtcagaagacgaggccacgagaccacagaagcagagattagggccatgtgccccaagtcaagggattccagcagccactagaagttagaagaagaaagcaaggaattctcctcttgaagcctccaaagggaacatggcctttctgacatacaccttgattttggacatccagaactgtgagaagacagctgtgttgtttaggccactcagtctgtttcaaaagccataggaaactaatacagcttagaacctctcaaaacctgcaacatgcaaagcgaccttgtgaatcagcaagaggtcaatctagcaagcagtcgttcccagtctatttaatgagagaatacccatttcccagaaagagagagctggtggtgaaagcatgcaccttttagcatctggcatacctaacattcctctaacaaagtttgggaattcctaacccaagtcacattctggaaggcaatttaatcaagtaagtctgaactttattcaaacaatgcaaaaacgatcgaaggtttttaagaaatgttgcaagaagtcaaccatttggggtgaggaaatccaggaccctgtgaccctggattcagggtagcttcaaagtagcagaatgcattgctttggaagataaaacatgtcagcagctgagccagccctcccagctgacagcagtgaactctgccctgatggaaccacctcctctgggaagtgctcctgtcatgagggatgctgacaaactaaagtggcttcacagtgtgacgagtgagaaatgacataaaagaatgaaagaagtgttgtgctagagagcaatattcaaatgggaaacaaaatagcagtaccttcaagtaaacgaaaggctaaaatatattgttaataacaaaaaatgagctacaaacggttcaataaaagtcaaaggtgaaaccatcaaggggagtgggatcaggtcaacaggaagctgcccatgggcatctgcagtaagaagcacctggccagtatggatcttcctgtggagacaagttatcaggctgccacaggagaagaaaacccacactgcataggaagctggacctcaaaactgaccagcttccacaagtctaagatttcatgacctaaactggacacaggcctgtttatcatacgcacatgtagagctggaataaaaactgaatttcaaaaatattgtgtgaaactaggggtgaaattcaaaatattgaataacctgcgtagcacaggcactgacccaccagaacgtatcccagcttatgtgcctacaggtaggtgcccacctcctgaatttcagccttcataaaaccgtgaacgctgacggagagttggaaacagattctgaacaggcagggatgaagaggggaggggaagaaactactgccgtttaaaaacttcacttgaactgacagcaggtcccccattttgggaagccacaggatgtcaaggaaaggtgaccaggtaggctggaagccacattctaaatacagcatctctgaccacaaacggccggcagccacacactgtggccctgccatctccaaggccactgactcagcacggctgcgacctaacgacacactgggaagtctgggtttggttttggttgtgcgtgctctctctctctctctctctctctcttctctttcttctcccccacaacactcctcctcccacctacactcccccttctctccgaccccgctcctatagcatacattttggttccactggttgccggcttatccatttggcggtaactgtctggtaggttaatgcccaacaataggcacttgtattttcttatacgggggaggtaaattatggcacttgaacaaagaccttactatttaagttttactgcacgtttactacaagccagtttcaattttacgtttttgtccctaggccataagagaaaaaagagcaggttcctgttcatattcgaaggagctgtttaaataacaataacaacaatacctggcaaaagcgggatctgttataggtcgaattctgtccccctgaaaatgtatatgctgaagccctaacctccaggacctgggaatgggatgttagttggagatacggttggtgcagatgtaattagttaagattaggtcatactaaagtaggtggcccctaatccaatatgagtggtgtccttatttaaaaaaaaagaaagaaaagaaaatctggacacaggcaacacccagcaagaatgtcacaggatgatgaagtggaatggtgtttctacaagccaaggaacaccaaatattgccagaaaaccaccagcggcaaggtaaggggcctggaacagatccttccctcacagccctcagaaggaaccaaccctgacaacaccttgatcatggacttccagcctccagagctatgagacaataagtttcagttgcttgaaccacccagtctgtggtactttgttatggcagccctagtggactaacacaagaccaaaagaatcaggagagtggcaactgaaaggtcaggcaaggtggccgggcaagtttggaggaaagagtttccactctttgcacctctagttaactgtcaggaagcccccagactcgcctgcctgtcacactggctttctctggggtccatcatccatcgctcctgagcttggcataagctgctggtccttcctcaactcttccagctgcccctgtccctcacacactcattcagtggaactcacaattctaaatgccgattcaaccaccactttctcagaaatgcatcctgatccctccagcctgcatcagaccccactgtttcccactggtctgtagggtctacaaggacaggaccatgactgcattgctcaacatgatgttgctggttggctggaatacatatttgctccataaattaaaattcattgtccttgggttactaatctcacaggtcctatggctccagcagacacgccaatgccctgatgatgtctacaacttttatagcaaacctgtatcaccagcttggcctctttgtcttaaaacatgagatacccctgggctctggtctcccacattgtcaattgaggggcactactgaccctttctctgcagagccacacgggctctcctttcccctacagaacttctcagacttaaccactgccatccactcccatccccatcatctgggcagtgtccatggtcttcctgccccagcatccaggtgggagcacccacacaccaggataaactgactgtgctactctttacttaaaaatcagcttgatttccattgcctattctaaagtaattttttttaaaagcagaaatcaaatctatgcaagggattaccacagaactgtctggtttctgggtggggaagctgtgaatggctgtgggagaggcaaggcgcctcccaagcagtggcctcccactaccctttgtgtcacactcccaccccacctcttagcaaatcttgaggcattccaggtaactcagggctcctcacaacagtgtagaaatcacaggtccctctggttaaatccagcctttttagtaaaggaatcaaggctcttcatttaactatcacctccattgtcaaaagcataaccaaataaaaacaaacatcttcacgtgaacattccatatcttggctccaattcttccctcccatattcattcattcattcattcatcagaaatctgctgttttaggaagtggtccaaggttacagagatgccttgccttcaaaaaacagcaatgcagtaaataagacagttgtgtccattgacatatgtaaaaacagtaataataaaaataacaggcaatatttaccacaggcagcactggaagtattctatgtgcattagccttctgaacaaccctttagggagggtcccataattatcccaattttaaggatgaggaaataaagagtcttgaggaggtcaggtcaggtcaccagctagaaagagggcaaaggaagattacaaaccatacgttctatgctattttaggtgatcccagtcaggtgtggtcacaagaggccacacagtagaggctcaggaatcagctgattgtcctcagtgatcctagagacaggaggcccgccatgcaggccacactggaacgcctcaggctggtgagaggcagagtgggcaggaggaggagagaactaggccacagtctttaatggacttccaggaaaaacaaggcggggcagggtgaacaggttaggagtggctaagttgaataatttcagcaggctttgggctacagaggtggtctctagttgcctggcacctagccttgaatgatgtaagcaagggaatactgcttcctgaagtgtaagggccagatagaggaggtctgggtatggactagttggtttgtatctcaaaggcatgctcctggctaggccctggctccctctcagaactggctagacctgcaagggcagcctcttcccaaccacaatggtttctaagatgtcaaaacatcataatatatagaaaataaaaaccgtaaataatacaccagactacctgacttcaagccttcagcaactgtgcctgctacatccccagcatagtgactgcacaaagtaaggccaggtaggagacacaatgaaggcctctggaaggtgagaaaaagatccacaaaggcagcactcaaagcacatcaacaataaaggaaacatagaagcttccacgaggataagaataaaagaaggactttccaagcaaagggactgggcaataaaaaggcaacctggccagtccagttggctgctgtgccttgatgtctctggggccagggtcctgggacagcactaaagatgaggatggagacgcaggcctgggcaagaatccctaattttcaattaggtgtatgataacaggtagtatgaatagatttcaagggtttattaagcactaagtatagtgtaagctcacatataacagaaacatttagtacccaaaacaccaaacgtatctaagaagccttaaatatcaaatttttagaccgggcacggtggctcatgcctgtaatcccagcactttgggaggctgaggcaggtggattacctgaggtcaggagttcgagaccatcctggccaacagggtgaaaccccatctctactaaaaaaaatataaaaattagccgggcgtggtggtggatgcctgtaatcccagctactcgggaagctgaggcaggagaattgcttgaacccaggagatggaggttgcagtgagctggcacggtgccactatactccaacctgggcgacagagtgagactctgtctcaaaataaataaataaataaataaataaataaaataaagagacaacccaatggaaacacagatggcccgctgcatccacggattaaaccaacgtcagatggaaaatattcagaaaacaaacaataaaaaaacagcaatgccacatttaaaaatatagtataacaactatttatacagtgtttacactgtattatataagtaatctagagatgatttaaagtatacggaggactgcagtcccagctacttaggaggctgagacaagaggatgccttgggcccagagttcaggaccagcctggctacatagcgacatctatctcaaaaataaagtatacaggaggatgtacgtaagttatatgcaaataccacaccatctcatatacgggactaagcacccatgagggttcctggaaccaatcgctcatgcatactgagagacaactatgctggcaagtgcatgggcaggtatgtcatagaagacaaaacataagtcaccagtaatcacatgaaagatcctgagttttcattagcaatcatggaaatgcaagttaaaaccacagcgaaataacgtttcacacctagcagattagccaaagtttgataaactaccaaaatcaattattaatgaagatatgttaggaagacatgttcttgtgcactgttggtaggactgtaaattggtaaaaccactttacaagatcaacagtcatttattttccaatgttgaagttgctcataccgcaagatgtaggatataccttgaagacatatgaaggtggttaagttcctaaataagggtagtgatatgaacacataaaggatgggcaaagtcaacagttacagggcaagaggaaggaagacagtcgagttaactgaagaatggtaaaaatgggtgggctggtttggtgggaaaagattatacttcgttttgggcattttgagtctccggcattaacaaaatactcacagacaggaattatgttatattacatgatctctaatgactcttgtagccctaaagctttgtgatcttatgatactatcagaaagggccaaattccacggctcactcaagtattttgctataattaacttcttttgtactctgtattcttgcacactcaaacaagctttttaacaacacgcccctctcaaaatgtctttatagtagggatgtttgatttttttcttggttcttcagctagacaatcagttcctgaaggggtatgaaagtgttgatcttctttcctcagagtgccttctactacaatacacaaagtaatttttccccctaaatggaacaaaggaagagttaactgttaagtacaatctaacagcaaagtcttcctaaagataaattttcagccagccttttggagatggaaaggaacttacttagcagagaagaggaaagtgatattattcttggtagaaagaacggtgcatcccaagggtatgaagactggaaagaggatattgctgatagatctggtacaccattaactggcactgcaggaccaaaggtgaaggaaaataggagtcctatttgacttatacttacccagttgattcttaaactcaagatgtttattttcttttactattgtagagtcaaaggcagtatactgggatgaagagaaaaacagtactattcagaaagctgtttggttttgatgaaaccttaaaaaagttaccggttggccaaaatgcaagagcgatggtctgaaacaaatcatgaagataatcaaaatggtaaccatttaaacctctgacacagcagactctgccaagagtagaaaaccaatactagcttgcccccactcacatacacgtttagcgtccctaatttcagcagtacgtgacattggttgctagcccagaagagatgcataagactctgaacctaaagtttccagtgatttggtccaaaaggatattttgataaaattccaaatggggaaggaaagacctagacatcggactcctataattttgaaaccttagcattaattatctccagtctggcgttaagacattggaaacctctgcatcattcccagatcatcactctagagtcccctacatttatcaatttatccctcccctctccacatacatgccaccaccatccatcaagtgagaagagcaacaagcttgtatttctcacagggattcatttcttaatgagatgcttacaaagcagatcatgctacaaaacacagacctttttctttaagagactcaaaaaaatgtaaagatgtatccaagcctagtacatgctttaaatttagagcaagtcccctgagcatactagataattccacaacgtagaaactaaaagtagttgcattttatgcataatgacacagatgtgttgctgacaagttgtcttaacaaaatatttatatattgactcacatttgaaatacgttaggagtagaatcttgggtaaaagcctctaaaaaggttgttgtatattagacattctcaaagtgcggcacccataccatagaattaaactccctgtttcagtcctgtgttttgaaacacatttttactattcctggaaacactttcacatttttgtcagacgttgagtgagcaacagggtaaataacttttcaaaagcatttttagagtagtaaaaccttaagttccttgctagaagggctgatccaaaataaattaaatgctggtatgactaagccaagtgtggcaaattctgatttgcagtgtggacacctccagttaatagatctattcagtgattcaacatgcacctccaagtcgtaagc

SEQ ID NO: 1097 - DNA, 22189 bp, Homo sapiens
cctgcctaggttcaatccttgttacagaaaactctttagttgtaaagataatgtcccaatatgacccttttaagtttaattttacacgtgggctattaagggtatctattttatattaaatgccatactattttgagcaatcaccatggctttaacattttcaagacacagaaatattttcctttttttttttttttgagacagaatttcactcttgttgcccaggctggagtgcgatagtgcaatctcggctcactgcaacctccatctcacaggttccagtgattctcctgcctgagcctcctgagtaactcagattacaggtgcccaccaccacacccagctaattttttgtatttttagtagagacaggtttcaccatgttggccaggctgttctcaaacccctgacctcaggtgatccacctgcctcagcctctcaaagtgctgggattataggtgtgagccacccatcctactctcgcaagaactaagctaggaaggtgggcagatatttggcatctcgggtaactgaggcacaggggggttagccaacttttctaatatcacactagttacagacaaagccaggactagaatcctagccacccactgttttgaagtagaaaataatctccttcctcccactcctctacctggcaccaaaacatgtcaaaacccaacaaaataataagagaccataaaagatacattttcaaaccaagttgatgtagtcattttccattacagggtattttatggatgaaacagtgcttccagttctaatcaagtgacccaaatgcagagaagtcatgtaattttagaacactccagagctcagaggagggagaaaggatacagcacctgagattttcccggtctgggtttttgggggactggcactgcccatgcagttgttcagtgttgtttggaggtggatttagattgctggtggttgtaggtccagctttggggccaaagggcagggcaccagggtcccatggggccaggtttcagtgttcctgacgcctatcctgttcttccgaggggatggaccctcacttttcatgaagtactcagaaatgttccagacagagttatgtaaaaattaaagaccaattccagaaattcacagaatcatgttttgactacagtatgacaactacctaaaattccacaactatgaaaagctgaaagaaacacagaaagtttctgtgtttctcaatgaccacagatggctaaaaaaaagactgatctcacatccacacatcccccacacacaccccatcccaacacctatgtacgagggcaagccatcctcccgcaacacaggaagactagcatttttctcctctcttccaatacagatgaataagtagcccagacagacaaacgaaaagggaactttcttacatgcaatgtgagaacctggcccctctgaactgcatgctaaatcatactgtatgtttctacttaagcaccctgtggcggcttctttgaacaggatacggtcatggtactgggctaaagaaaccacaccactaataaaacgaatctctttgtttagatcatctcaggcatcaggaaatagaataaccccttctgcaagaagagaaagcactcgtttgcactgcctttttatgttctttaactccatgttgtctaattactcctaaggcatcttcccagctaatcggaattacaatatcaaggtaatctgtgcctccaataagcaaaacacaaacacttcaatgattaacaaatgatgctgttttgaatgagaatgaaaacttccaatgatttaaccactgctgtgaagaatacggagacagaatataatagaaaggtgtttatacctaggtcatgtttgtaacacaaatcattggacaaaatctctgtcagactcacaaaattcaaaagaccatggggattaattaatccaaccctctcattttacagatcaggaaatggagattcaaagcaggtaaatgtttattgtacagtcacagttaggaagtagcagaacctgcaaccaaaaaataaaaatgaaaaccaggtctctggactcccagacctcagaattttgcactaaaaaataccggggaaatatctaaaatgaagaggctggactaatgactacaattgagaacccggtaaaacagacaaatggaattaccaaagtgaagaacaaaaatagagccaataattatcaatagagcaataattaactaattagtagaaaggaaatgaggataccatcaatatttaaaacacagaaataactcccatctcctatagtcttcaaaggtgaaaaatatttccccataaaagctgctgtcaccaaagaaccaactttcccttcctttgatttacctcctgatacagagaagcactgcaatccagcaacatgatcaataacctctgaataatgaagaatcgtttatgtccagcagctaagatactctttacatagccaccccttccctcctttcaagggcaatagcctcgcaaacaggtgctcagtggttgcacatacacctcaaacctatcaagaaaagagagccgctctgtggccagacacaataccttctagtattgggtgatgagtgtaaggctaaccaagtatcagcatttcagaaagaggccagaggctttcaatcatccttgatattggtctaccatggcacagaattctctcccccaaaacacactcagtttcagtacattgcaatgttatgttatgtccatgattagtttgataagaaaaaaaagatttacatataaaaaatatcaaacagggaagaaatgccctaaaagattaatttaaaaaaaaatactttccccaatgtgataggtttttaaaaaatggtacagacgtgttttttcattttttgactggtagtaacactacagagtttttggtgtttgtggccttaatttttttttcagggaattatatatacactttacctatttttctagtaggctgtgttttaccaattggtttgttcttggaagtatcaagaacatgtacaaaattgactaattttcacctccaataaaagccactcaaaaactgatattttgaagcaggctagcaaatcttcagtctcttttatattgcaaatgattattgtaaacccttagtataatattagagcaaggaagaacgcaaatacaatgtgaactcaggaattcacatctttgcacaacccaacatgtgtaataatactactttcaacatactaaaataattttctataatttaggcaaactctataagaaaaatgagactaaagggtttaaaacaagcaggtacaaaggaagcaactgttggtaaggtatagaaagattaatttttaattaaatgattaggagaaaaacagcacacacacacacagatactccaataaatacagtcccagaaatgctggagaagcctcaaagggacaaccagtccccaacttacgatggatccacctacaattcttcaactctatgatggtatgaaaacggtacacattcagtacactcctcaacttacaatggagtccaagataaacccataatacattgaagatactgtaaatcaaaaatgtacttttgatattttcaacatacgaaggatttatagggacagacccccactgtaagttaaagaacatctgtaaatccaaaggcatctattaacagcctacgtgtgtgctaggtggtacataatatatagatacagcaagggtgagtccacctgctcatcactacgtgaatacaagcatgcccaaggcatacagtatctcactggttttccttttttttttttttcttaacgtaagctccttttatttgaacctctattttcctctccctccctccatcccattcttgccactcatactgaagttttcatccatcagagaaaaaaaaatcttcatatggcctactatcactacaaatgatgacagcagtactaagaaggatagtgagcacttgtacagcacttggtatatgcccagtatgcactaagtgctctgcattcagtatctttttaactcttcataataaccccatgtcattggtactgttttcatctcgattttacagatgaggaatctgaggtgaattgagaggtaatagctcagggtctaatagttagtaggtagaacaaggatttaaactatgtctacttgtaatacattatttatatggcaatttgcttcactaataggatcgatccctctataatggatcctattagaatggaaaatgatgggcctagagatattttcacataaaatatggcttctatagaatgtattaataatgactatcaaacacccatttggaccataggtgttatgggatggaggaggacaggaaggaaataagaaatttagtccctgccctattgctctgagaagtatctgggaagccaggcatttcctggtctagataggattatgtttcaacattggctaggacctccagatttcacacacatccacccacatgtggacagcatgagaataataaccaggtaacctgtacagctaatcaaaatgttcttgctatcagagaacaccagtagatgcatgagtcatggacagaaggtggcaaggctttgtggatgaaagaaaagctatgaaatactaccacactgacctcttctatactggatggcacagtgccctggaaaaataaatcaccacacgagcatgaaatcaggattgggaaaatacacaggaaatacaagaagaatatccctatcagatccttttaaagatctgcctaaccggacagttcagtgctgatgtgagtaactcctttcaagtttacaatatactagctgaaagtttttagaaccagggttccaaatacattaataaagatttgtacaggtgtgtagggaagttaataataaattaacagtgaacttcacactgaaataataacttctttgcagtaaatagctacacatattaaaaaattaaaactgatgaaaaataaaattagagttcctctctcctccctttctcactatctctcaaagtgacaggccatacaattaaaggctgtttctttgcaaagtccatgctttgcagttctaatcactcgagtgatttatagaggaaatgatgttttgcaggtactctaaaacagagctgcactttgtccagtgtgcaaggccatgcttaatgaaaaactttaaatttggaaggaaaaaaactgcagtaaaaagagaagaattatgaaattttagtatttacttgatttattaatgtttccttgtgcatttctttttataatttgtgtcctggctaaggcaggaaggcaaaacaaatgtccttttgtttatggctttaaaaaggtcataagaataacaaaaggatacataaatactgatgactatatctttccctatttcactgtacattaatttaacagtctgctactgaaatactgctgttggttaagcacagagttaactatttaaaaatattcttgtctttttaacccaatttctttcaaggatataattaatccagttaagaccgttcttaaaatatgtgcaggtcatgatagaaatgtcacttgtcaactctctgatgcatttcagatctgctctgccactatagagttccagacagacaggaaacattgtaaatcactgaagaaacatacaagttaagaactgtgattttgttacttaaaattactgaaaaatagacaaaattcaagcatatatcaggagcgtaaatgtagaaatctgtaagcatttacccagaaaggtgcagatcattaaactaataaagctaactcatattcagtgcccaaggatatatcaaattttgtaaaaacaactttaagtcaccggaggcaaggagagctccaagttagcacaaagaatgttgatttcaccggggtgtggtgactggggataggcacacctggcaaaactccattctgtgggctactaaatctctgtatttgttaggttgtgctatattgtgtatttcggttctgccacccaaagaaggtatccaaaataacttgtggtgggcgtggaggaatcacatattaaaagtcccaaagtctgtgcctccttcatgcttgtgcagctgtcttccagtgtcactgccttgtagactgcacaatcatggtgtgattctagatagctcagctccaccacagaaataaaggggataaaatgaacagttggcgagatactgagactgcagtttgaacctctataggactaatgcttttaggttgttctttattttgttgctttgctttcttttgccaacagcagcgggggcttagctcttattcaaccatatactttttaaaatctctactcagtggtactgatagaaaacattttcaagattccactgaaaaagaccagagctttgtaagggtagtggagttctctaggtggaaaaataacttcctcgcctaatagggattggacaccaccacccacatcttggtctcaatagcaccaaactttaaattgccaatctagccaggcccttatgctaaggccgaagtgagtcttaccttcagtgtagaagctgaaaagcaggtaggtgtctctgattcagtctagcctgaccacatgcactttttggtctaatcttaaaatacttaaatgtctaacaactacttctgtttcccagctattctctcctaatatttatgatatatcttggctatttgacagtagatttgagtcatatagttaagtcatatagttaagtcaactatttgagtcatatagttaagctatcaactttctatagacatagtttgccttatactataacatacattcttcaaccttacactatacagcaaagtatttattattgtttctatcaaaataatatcttacattcctgtaatttcttatagttgctaagtactctttagatgttttttcccatttatatctcacaacatcctggtgaggtagctgatattatcctcatttttccggatcagaaaattgaagaaagcataaatcccttgttcaaggtcatagagctagttagagaacttggcagaatatgaaaccaatttgtttaattctaattacagtgttatgtccacaatacctctccctcaatcaaaataaaaacgtttcaaccaaaataagatgccacagcagttttttaaagaaattaataaatttatataaaaacccatatacagtttagcacaaaataatatttcaaatttaagtatcttcaattatccttgcaataatccactatcaaaagccattgcttaaactaatcccccctttaagtatactaaacaacgtgctactgtgtgtatttgtgtatccgtgagtgagtgtgtgcatgcttgcctgagctcatttaaagggatacctttatcctgaggtttaaaaacagtgaggtctgaattttcattgttaaaagcagatcatggagcaatcaatcagctaataaccatctattaatatctgatgtactatgcaacatgacagagtaaatgaaaataagaataagatgcatttcctacatttgagtttctataatctagcgagaggacaaggaaacaacacatctaccacatcatcatcatcatcatcatcatcatcatcatattagcaatgacattaatgccgacattcattcactacatacttctcacattttaggccagcactggccaacagaaatataatgtgagccacatatgtaatttttaattttccagtagccaaattaaaaaaggtaaaaagaaacagataaagatgaattttatttaacacatatatctagaatgttttatgcacatgttaataaaaaattatccagatattttacatactttttcatattaaagtctccaaaatccaacgcagtcaatgaattacataacaacggggaaacattctgagaaatgtaccattgcatgaacattacagtatacttgcacaaacctaggtagtagagccaactacatacctaggatatatgatatagtcttatggtgcctaggttgcaacctgtacagcatgttactgtactgaatactgtaggcaactgtcgcactattgtaagtatttgtgtatctacacagaaaaggtacagtgaaaatatggtatcttatgggactaccattgtgtatggtcccttgctgacccacatgtcattatgcagcacatgactatattttacacttatggcatatcacaattcaaatgtaaattttcatcagaaatacttgatctgttttagatttcataaaactgatcattgaaaaagtaaattcatgtacccaacctgtaccaaatatacttaaaagttttctcataacgaaattgagtatccaaaaaatcattttcctttaattttcacaagtacattgacaaaactggttcacttttgtttaaaagaactgatttgggccaggcgtggtggctccttcctataattccagcactttgggaagccaaaccaaagccaaagtatggcttgaggccaagagctcaaggcctccctgggcaacatagtgagaccccatctctacaaaagatttttaaaataatatttttttaattagctgggtgtgtcccagctgctcaggaggctgacacaggaagattgcttgtagtccagaaggtcaaggctgcagtgtgccatgatcacaccactgcactcaacctgggtgacagaatgagaccatgtaccaaaaaaaacaaagaaaatgtttgttattttaaagtaaactgggcatggtgaggcaggcctgtagtcctagctacttggaaagctgggacaggagaattgcctgagcccaagagttcaagactgcagtgaactatgaccaggccactacattctagcctgggtgacagagtgagacttcatttcaaacaaaaaaaaaaaaaaaaaagaaagaaaaactgatttgactttgaagtataagcatatcagtttcaaatccatatcggttcaagttaagtaagctaattaactcttgtgtcaagtcagtattaacactggattcaaaggaatatttgcataaattggaaaacaactctaaatttatcagtatcaacaaagagctcttcaaattctagtttttgtagccaatatatataatggtatttataattaaaatcttctgcacattaatcattactattgacttatattatgaaaaccttcaatttcaacatgaattctaatatctgcctagctagttgacaaattaccttgtcctttcctgagactttcaaattagttcattcaaaagtagtgtgatctgagtcagaaaacataaaccatactgctatattcccttttttttttttttttttggatggagttttgctcttgttgcccaggctggagtgcaatggcacgatcttggctcactgcaacctctgcctccccggttcaagtgattctcctgcctcagcctcccgagtagctgggattacaggcatgcgtcaccatacccggctaattttgtattttttagtagagacagggtttctccatgttggtcaggctggtctcaaactcccgacctcaggtgatccacccactttggcttcccaaagtgctgggattgcaggtgtgagccaccgcgcccggcccatattccctttttaagtactgaatacttgggcaagtgcccctttttgtttcaacaaaagatcatctttggttggagtaaatattatgctatagaaatctgtgtaaaactcgtccaggactccaccaacaagtgctgctaaagatcacaaggtcactgccttcactgtcttccatttctttctgcaggtccataaaccagcaatgatctatgaatttacacttatagactggataattttaactactagtatgtgtcacactttttgccaagttaactactgtattgtactctgtccagcttcagaatacagtcgaatgaagcaataagagaaataccagcctcttgaaaaattccaataaatacagaattcggtctaagagagctgggtcaactgtaatagaaattaattttttcatatccatctgaaattctttgaaacagtcaaatgtttgaattgaatgttcttaaaacattcaaaaatatctctgccacaaatctgttatttttggcaaaaaaaattacaacatttatttataaatcttaaagtctgtattaatcggacaatggatcatcatactgtataacttacacaaagctaaaggaaagtaattgaaatgtttcaaatttcaaatgggtcatgtagtctataggcaactgtttagtgaaaaatatctttaagtttttgtgaaatatatttttgtctcttctcataattttctaataaaattttggtacctgcaataattccttctgccatctctccatcttaaactggcttcctctatagtgcatgaatccaagacactgtataggtggccaaagttacaggctcatactctgttaaaatttttaaacttaatgaacatttgatatagtttagatttctgtccctccaaatctcatgttgaaatgtgatcctcaatgttgaaggtgcggtctagtgggaggtgtttgagacagggggacagatccctcatgaatgagtgttactgccatgctaacatctgcagaactgagagccaaataagcctcttttctttataagttacacggtctcaggtattcctttacagtaatgcaaaacggactaataaaacactaaattctgctttcaggcaattacttccatcaattcttcattgacctttgagaaaaaacttctcatcaaatctaccacagatttcttgaaaatgtcttaatattgcccatttcattttctttacattttttatacaattgcaaatgagattcatcatgaagtccctagtctctttgtgttcccactgctttgatcatactactaatttctgtatctgtactcactccgcaacagtagtatgccttcacttcaaatttaaaaactgtccatatttatttactaacaagtgatgtagttaccttaattttatatatcacttaaacatttctgggggatgagggataaaaatctacatgtcaggtaccatgtacactacttgggtgacaggtacactgaaatctcagattttaccaccatacaattcacccacgtaaccaagaacttcttgtaccccaaaagctattgaaataaaaaatttaaaacaaacatttcaatttaattactaatgataatgtacttgcatcactataagctgcactgtctgcacaaaatatttaataaatactataaagtgagaacacagaaaaagtatatactgaataaattatttgacaccagcaagattggtagtgtgtttatgtatgctaatgtagtcttaccaaaacaagaaaactgtgtttaacagaaatatatcgtgcactgcttccatcttaaaaatccagttcctcgggtacgctagtcacactgaactgctcgacagacacatgtggcttatagctattgttcctgatcatacgatgagaggctgtgttcatggcagtctgtatttattaattgtggtaattctcacaaggaagagaagtctttactctaattatccccacattacagacaatggaatttaggcaaaagtaattaagtgacttacccaaagtcacaaagctattaactggggaactgggatttcaacccagacagtctgactccagagactcttatccactattccacaccgccagaagttcaacaacagcacagggtttcatgagagatgaggcaagagatgcagagtgtgttaaaaatatatatataaaccaaactactttgcaatgaaaagaaggaagccagaactcacaggaagacgtcgtgaaagagggagaaagacttgagctgcgtagtccaagataaatgctgcagataaacagcccaggcagctgagcgcaggaggagtaggtgtgcgaagcgcgagcaaagtgtgtttagccatgaacaggtaaagtgagtcagctgtggagttaatgcagcaggctaaaaaatggcccccaaaagacacagccacatcctcaccactgaaatctgtgactgatacctcatattagaaaatcatctttgcagatgtgatgaagttaaggaccttgcgttggggagactggagattatcgtggattatctgggtgaactctgagcataatcgcgagagtccttataagaaacaggcagtgggagatttcacccagtcagaagacgaggccacgagaccacagaagcagagattagggccatgtgccccaagtcaagggattccagcagccactagaagttagaagaagaaagcaaggaattctcctcttgaagcctccaaagggaacatggcctttctgacatacaccttgattttggacatccagaactgtgagaagacagctgtgttgtttaggccactcagtctgtttcaaaagccataggaaactaatacagcttagaacctctcaaaacctgcaacatgcaaagcgaccttgtgaatcagcaagaggtcaatctagcaagcagtcgttcccagtctatttaatgagagaatacccatttcccagaaagagagagctggtggtgaaagcatgcaccttttagcatctggcatacctaacattcctctaacaaagtttgggaattcctaacccaagtcacattctggaaggcaatttaatcaagtaagtctgaactttattcaaacaatgcaaaaacgatcgaaggtttttaagaaatgttgcaagaagtcaaccatttggggtgaggaaatccaggaccctgtgaccctggattcagggtagcttcaaagtagcagaatgcattgctttggaagataaaacatgtcagcagctgagccagccctcccagctgacagcagtgaactctgccctgatggaaccacctcctctgggaagtgctcctgtcatgagggatgctgacaaactaaagtggcttcacagtgtgacgagtgagaaatgacataaaagaatgaaagaagtgttgtgctagagagcaatattcaaatgggaaacaaaatagcagtaccttcaagtaaacgaaaggctaaaatatattgttaataacaaaaaatgagctacaaacggttcaataaaagtcaaaggtgaaaccatcaaggggagtgggatcaggtcaacaggaagctgcccatgggcatctgcagtaagaagcacctggccagtatggatcttcctgtggagacaagttatcaggctgccacaggagaagaaaacccacactgcataggaagctggacctcaaaactgaccagcttccacaagtctaagatttcatgacctaaactggacacaggcctgtttatcatacgcacatgtagagctggaataaaaactgaatttcaaaaatattgtgtgaaactaggggtgaaattcaaaatattgaataacctgcgtagcacaggcactgacccaccagaacgtatcccagcttatgtgcctacaggtaggtgcccacctcctgaatttcagccttcataaaaccgtgaacgctgacggagagttggaaacagattctgaacaggcagggatgaagaggggaggggaagaaactactgccgtttaaaaacttcacttgaactgacagcaggtcccccattttgggaagccacaggatgtcaaggaaaggtgaccaggtaggctggaagccacattctaaatacagcatctctgaccacaaacggccggcagccacacactgtggccctgccatctccaaggccactgactcagcacggctgcgacctaacgacacactgggaagtctgggtttggttttggttgtgcgtgctctctctctctctctctctctctcttctctttcttctcccccacaacactcctcctcccacctacactcccccttctctccgaccccgctcctatagcatacattttggttccactggttgccggcttatccatttggcggtaactgtctggtaggttaatgcccaacaataggcacttgtattttcttatacgggggaggtaaattatggcacttgaacaaagaccttactatttaagttttactgcacgtttactacaagccagtttcaattttacgtttttgtccctaggccataagagaaaaaagagcaggttcctgttcatattcgaaggagctgtttaaataacaataacaacaatacctggcaaaagcgggatctgttataggtcgaattctgtccccctgaaaatgtatatgctgaagccctaacctccaggacctgggaatgggatgttagttggagatacggttggtgcagatgtaattagttaagattaggtcatactaaagtaggtggcccctaatccaatatgagtggtgtccttatttaaaaaaaaagaaagaaaagaaaatctggacacaggcaacacccagcaagaatgtcacaggatgatgaagtggaatggtgtttctacaagccaaggaacaccaaatattgccagaaaaccaccagcggcaaggtaaggggcctggaacagatccttccctcacagccctcagaaggaaccaaccctgacaacaccttgatcatggacttccagcctccagagctatgagacaataagtttcagttgcttgaaccacccagtctgtggtactttgttatggcagccctagtggactaacacaagaccaaaagaatcaggagagtggcaactgaaaggtcaggcaaggtggccgggcaagtttggaggaaagagtttccactctttgcacctctagttaactgtcaggaagcccccagactcgcctgcctgtcacactggctttctctggggtccatcatccatcgctcctgagcttggcataagctgctggtccttcctcaactcttccagctgcccctgtccctcacacactcattcagtggaactcacaattctaaatgccgattcaaccaccactttctcagaaatgcatcctgatccctccagcctgcatcagaccccactgtttcccactggtctgtagggtctacaaggacaggaccatgactgcattgctcaacatgatgttgctggttggctggaatacatatttgctccataaattaaaattcattgtccttgggttactaatctcacaggtcctatggctccagcagacacgccaatgccctgatgatgtctacaacttttatagcaaacctgtatcaccagcttggcctctttgtcttaaaacatgagatacccctgggctctggtctcccacattgtcaattgaggggcactactgaccctttctctgcagagccacacgggctctcctttcccctacagaacttctcagacttaaccactgccatccactcccatccccatcatctgggcagtgtccatggtcttcctgccccagcatccaggtgggagcacccacacaccaggataaactgactgtgctactctttacttaaaaatcagcttgatttccattgcctattctaaagtaattttttttaaaagcagaaatcaaatctatgcaagggattaccacagaactgtctggtttctgggtggggaagctgtgaatggctgtgggagaggcaaggcgcctcccaagcagtggcctcccactaccctttgtgtcacactcccaccccacctcttagcaaatcttgaggcattccaggtaactcagggctcctcacaacagtgtagaaatcacaggtccctctggttaaatccagcctttttagtaaaggaatcaaggctcttcatttaactatcacctccattgtcaaaagcataaccaaataaaaacaaacatcttcacgtgaacattccatatcttggctccaattcttccctcccatattcattcattcattcattcatcagaaatctgctgttttaggaagtggtccaaggttacagagatgccttgccttcaaaaaacagcaatgcagtaaataagacagttgtgtccattgacatatgtaaaaacagtaataataaaaataacaggcaatatttaccacaggcagcactggaagtattctatgtgcattagccttctgaacaaccctttagggagggtcccataattatcccaattttaaggatgaggaaataaagagtcttgaggaggtcaggtcaggtcaccagctagaaagagggcaaaggaagattacaaaccatacgttctatgctattttaggtgatcccagtcaggtgtggtcacaagaggccacacagtagaggctcaggaatcagctgattgtcctcagtgatcctagagacaggaggcccgccatgcaggccacactggaacgcctcaggctggtgagaggcagagtgggcaggaggaggagagaactaggccacagtctttaatggacttccaggaaaaacaaggcggggcagggtgaacaggttaggagtggctaagttgaataatttcagcaggctttgggctacagaggtggtctctagttgcctggcacctagccttgaatgatgtaagcaagggaatactgcttcctgaagtgtaagggccagatagaggaggtctgggtatggactagttggtttgtatctcaaaggcatgctcctggctaggccctggctccctctcagaactggctagacctgcaagggcagcctcttcccaaccacaatggtttctaagatgtcaaaacatcataatatatagaaaataaaaaccgtaaataatacaccagactacctgacttcaagccttcagcaactgtgcctgctacatccccagcatagtgactgcacaaagtaaggccaggtaggagacacaatgaaggcctctggaaggtgagaaaaagatccacaaaggcagcactcaaagcacatcaacaataaaggaaacatagaagcttccacgaggataagaataaaagaaggactttccaagcaaagggactgggcaataaaaaggcaacctggccagtccagttggctgctgtgccttgatgtctctggggccagggtcctgggacagcactaaagatgaggatggagacgcaggcctgggcaagaatccctaattttcaattaggtgtatgataacaggtagtatgaatagatttcaagggtttattaagcactaagtatagtgtaagctcacatataacagaaacatttagtacccaaaacaccaaacgtatctaagaagccttaaatatcaaatttttagaccgggcacggtggctcatgcctgtaatcccagcactttgggaggctgaggcaggtggattacctgaggtcaggagttcgagaccatcctggccaacagggtgaaaccccatctctactaaaaaaaatataaaaattagccgggcgtggtggtggatgcctgtaatcccagctactcgggaagctgaggcaggagaattgcttgaacccaggagatggaggttgcagtgagctggcacggtgccactatactccaacctgggcgacagagtgagactctgtctcaaaataaataaataaataaataaataaataaaataaagagacaacccaatggaaacacagatggcccgctgcatccacggattaaaccaacgtcagatggaaaatattcagaaaacaaacaataaaaaaacagcaatgccacatttaaaaatatagtataacaactatttatacagtgtttacactgtattatataagtaatctagagatgatttaaagtatacggaggactgcagtcccagctacttaggaggctgagacaagaggatgccttgggcccagagttcaggaccagcctggctacatagcgacatctatctcaaaaataaagtatacaggaggatgtacgtaagttatatgcaaataccacaccatctcatatacgggactaagcacccatgagggttcctggaaccaatcgctcatgcatactgagagacaactatgctggcaagtgcatgggcaggtatgtcatagaagacaaaacataagtcaccagtaatcacatgaaagatcctgagttttcattagcaatcatggaaatgcaagttaaaaccacagcgaaataacgtttcacacctagcagattagccaaagtttgataaactaccaaaatcaattattaatgaagatatgttaggaagacatgttcttgtgcactgttggtaggactgtaaattggtaaaaccactttacaagatcaacagtcatttattttccaatgttgaagttgctcataccgcaagatgtaggatataccttgaagacatatgaaggtggttaagttcctaaataagggtagtgatatgaacacataaaggatgggcaaagtcaacagttacagggcaagaggaaggaagacagtcgagttaactgaagaatggtaaaaatgggtgggctggtttggtgggaaaagattatacttcgttttgggcattttgagtctccggcattaacaaaatactcacagacaggaattatgttatattacatgatctctaatgactcttgtagccctaaagctttgtgatcttatgatactatcagaaagggccaaattccacggctcactcaagtattttgctataattaacttcttttgtactctgtattcttgcacactcaaacaagctttttaacaacacgcccctctcaaaatgtctttatagtagggatgtttgatttttttcttggttcttcagctagacaatcagttcctgaaggggtatgaaagtgttgatcttctttcctcagagtgccttctactacaatacacaaagtaatttttccccctaaatggaacaaaggaagagttaactgttaagtacaatctaacagcaaagtcttcctaaagataaattttcagccagccttttggagatggaaaggaacttacttagcagagaagaggaaagtgatattattcttggtagaaagaacggtgcatcccaagggtatgaagactggaaagaggatattgctgatagatctggtacaccattaactggcactgcaggaccaaaggtgaaggaaaataggagtcctatttgacttatacttacccagttgattcttaaactcaagatgtttattttcttttactattgtagagtcaaaggcagtatactgggatgaagagaaaaacagtactattcagaaagctgtttggttttgatgaaaccttaaaaaagttaccggttggccaaaatgcaagagcgatggtctgaaacaaatcatgaagataatcaaaatggtaaccatttaaacctctgacacagcagactctgccaagagtagaaaaccaatactagcttgcccccactcacatacacgtttagcgtccctaatttcagcagtacgtgacattggttgctagcccagaagagatgcataagactctgaacctaaagtttccagtgatttggtccaaaaggatattttgataaaattccaaatggggaaggaaagacctagacatcggactcctataattttgaaaccttagcattaattatctccagtctggcgttaagacattggaaacctctgcatcattcccagatcatcactctagagtcccctacatttatcaatttatccctcccctctccacatacatgccaccaccatccatcaagtgagaagagcaacaagcttgtatttctcacagggattcatttcttaatgagatgcttacaaagcagatcatgctacaaaacacagacctttttctttaagagactcaaaaaaatgtaaagatgtatccaagcctagtacatgctttaaatttagagcaagtcccctgagcatactagataattccacaacgtagaaactaaaagtagttgcattttatgcataatgacacagatgtgttgctgacaagttgtcttaacaaaatatttatatattgactcacatttgaaatacgttaggagtagaatcttgggtaaaagcctctaaaaaggttgttgtatattagacattctcaaagtgcggcacccataccatagaattaaactccctgtttcagtcctgtgttttgaaacacatttttactattcctggaaacactttcacatttttgtcagacgttgagtgagcaacagggtaaataacttttcaaaagcatttttagagtagtaaaaccttaagttccttgctagaagggctgatccaaaataaattaaatgctggtatgactaagccaagtgtggcaaattctgatttgcagtgtggacacctccagttaatagatctattcagtgattcaacatgcacctccaagtcgtaagccgggcagcaaagtataaatatgagacttacaagcattctctgatctctgagtttgtattcacatctatcaagtttttgtttgtttgtttgtttttgttttttttgagatggagtttacctcttgtcgcccaggctggagtgcaatggtgtgatctctgctcactgaaaccttcacgtcctgggttcaagctattctcctgcctcagcctctcaagtagctgggattacaggcatgcaccaccacgcctggctaattttgtattattagtagagcaggtgtttcaccatgttggccaggctggtctccaactcctgacctcaggtgatccgcccgccttggcctcccaaagtgctgggattacaggcatgaaccaccacgtccggcctgaagttagtcttgatggaaggttctcaaagacctattattacatcctgtgtattatatcagctttgtcaaagaggtgaagtttaggaagctgtgtttcataaaaaccccaaatctgagtaagtctatgggagcaccattcacggacatgcagcaatacggtagaacacgtgagaaactgctcatctggactgcactgtaacacaagcaccctaccctagaggtacaacatgcaggtaccgctgatacagcaggcttccacagcatggttacgaatcatcacatcagacatggagagcacctgagggatcacctaatataactgcttcaccaatgaggaaagcaagaccttgatgacataaaatacggaaaagaataaaaatagacgcacataacatttcttctgcttgctcaaagttatccccgacaatttaagatgattaagggctttatcttggaatgcttagctcacagaaaaaaaaggtaggcaactatatattcttattaattggaaaaatcattgaacagccagtggtttgatttgaagagagcatcagttttgttgatttcattaaaatgaatgtaaagagaacaaggtgtattgactttttatttttttagccacaccaccagcaaatactgcatcacttacatgtgtgtttccttctgtctggaaatcctgggtggacaatttaactgccacagaactcccatgaacaggcacacacaataaacacgcacataaggattatgtgaggcgtctaccacagaatggctttttcagccacctgaacctaggtccattaaaagaaactaggcagcgtggagcagagcagctgtcccaacacaggcagtaatggagctgacaatattcccacgccagttctgaatccagtctattttatgctcttgcgtggattcaaggaaacagaactactatttaaaagtgcatttacaaagagggctttaaaaagcgttagaataaattactttgaagtgtatttctacaacacgcctccagctttcccttcttttcctatttgctcgtccccagaacccaacggtgactatatttaactgactttacaagctgtggggagactgagtacacacagcagattccagccaggattgtgtgcattaactaagtcccaaggttttttgcttgggagctttctctttctttttttcatcttcttcacatgtcttaaaattaccttatatcctggaaataacagaaaaattttaaaagaccctctattttggtttgctgtataggttgagtcctgatatttttaatcatattaacaatatgctcaaggcaaacactgccacgacccagtattcttacagtttgtaagtattttattatttccttgaaaaaacactcattccatctagtacgtattgtgagagaagatcaagtacttgtaaaataattttcatttaggaacaggtatataca

SEQ ID NO: 1098 - DNA, 25851 bp, Homo sapiens
gcacctatgagaaagatgacaggtaatatctagatatctgagtaaagagtaaagagagcacaaatacaataagatatggagactcagtatcctatcagctttttgatgtaaaatggtacagtagttactacctaagagaatagtctatttccatgctggttgctcacttgtgtgctcttctgaaagagtgagggcactgtgcgtctgactggatactggggtactctgtttccaagctgcattacagggatttgaaatatcttacatatatatatatatatatatatatatatatatatatatatatataatatatatatttatttatattatatatatatttatttattccatatacaggcataccttggagatattgcaggttagggtccagaccattgcaataaagtgaatcacacaaattttgtggtttcccagtgcatataaaagttgtgtttatgctattttgtagtctgttaagtgagcaatagcattatggctaacaagagtacataccttaattaaacattttctaaaaaatgcctgcacagagacgtgaagtgagctgatgctattggaaaaatggcatcaatagacttgctggacatgggctgccacaaacctccaaaatttgtaattttacaaattaaagccctcaatttgaaaaacataatatctgtgaagcacaagaaagctaagtgcagtaagacaaggtgtgcctatatatgtttctgtgtatatttaaataacttatattaatagctgcaaacagtagatttcttccggtgtatggctttgtcattgttatcactgatttgtaataatttacctcttttttgtatgttttattattttctgccatggttgataaacaagttaatttactctcagaacagagaatctgcagtattattattaatagtgactgttgacttcttttgtcatctaaacaacttgttagtctgcccttaggcttgacattatttttgttgtgaaagaatattcagtaaaaagttttgacatgtttaaaatcattaaatacttccaaactggtttggaaagcttctctgggctgaaagccagttgattcttatcagtctttttgcatgactgaagtcaattacttcagagcttgaacaactgcagccttggtaaatggtccagtactgtccagtagtacaatatgggaggcttttaaatgctactgtaattggtagtttaacagatgtgttttggttggacaagaatgtaaaagctattttggagcattttcaaaggcatgaagtttaaaataatgtaatgttaattttgtgctctgtaatgtatatcgtaagattgaggtcttaatgtttgtattaagtaagtgaaaatattcaaatgaaacttgtgtagaaaaggaactgcctgtgttcagaaagattctgaacaaaaacaagtgaattttcagaactgaactaacagttgccagagggtgtgggttctgacgatgtcctacctgaggcaggctttgtgactttggaaagccttggttttcttatttttaaagaggatctagtccaacactggtctactcagacttcctcatttgtaaaaaaaaaccaaaaaaaaaaacaaaaacaaaaacaaaaaacactttccttaatcttggaatgcttttcacaagaactaagtgtggcatattggtggctgtatgagtactctggtattataggagttgaagtgtgaggtggagagtaagagtaactgggggtaaaacttagacccaatgtgtccagaagattcagagccttatcactgcacaaaggagcacagattttaaacactgaagtgcccaagttgcatgcaaacaggctgtgggctgaccaccggtttttgtatttattctgaatatagtatgccacaaaatttgaatgtatatgcttttacagatctctgtgctctctctagctcccccaaaatctctgcctgtctttagtttcatgctagactgttttatctgtttgttgcctttgaaagcttttgggtttaccccatgctggagtaacatgtagatctagaaggattttgagcaggaggtagtgttatcagatatggttataaggaaagctcactttagcaatagagctgacacagtagtagcaggtagtgaattctgcaagagaattaatggacactagtcatcttgattgtacttagttatttactgcttcagtgtagttctgttgtgcttaattttcttttcttttctttctttcttttttttttttttttttgagagagtcttgctttgtcgcccaggctatagtgcagtggcatgttctcagctcactgcaacctctgcctcccaggttcaagtgattcttctgcatcagcctcctgagtaggtgggattacaggcatacctcactatgcccagctaatttttgtatttttagtggagacagggtttcgccatattgctcaggctggtctcaaactcctgacctcaagtgatccacctgccttggcctcccaaagtgctgggattacaggcgtgagccaccgctcctcgtctgttgtgcttaattttctaaacaaactctagaacaagttaagtggttaatccacgtgatttttgttctcatttaaaatcctatgcattcaaaatgtgaactccattaccatctctctgatccgcccttggcatagaatttggatgtgtatattacactggactcttggctttaaaaaccgtctatctgtatctgtgggaaagcttttcagatagcccagacaatataaatagccctagatttacccttaagtaacaaatgtgtttctttctgtggagttactcgttgtgtctgagggatcctccctgggttatttttttcctctccaatggactggcttggcatatgattgtcaagaacaggcactctggtcggacagaccttgtttaaatcttctctctctctccaactgtgggccagttcgttaatctacttgagctttggttagttattctatagatcgttttgtggattaagtgaaacatcatactgaaaacacttagttttatcatccagaccagggcactaaacgagaataaaccaacctcctagtttttggatgtgtttgacacgaggggatgtttaggggaaaataatatttgaccatcagactttttgaatgctggagaaagcatgcacaatgtccatgtaggaacatacccatatatacaggagacttaaacatgtgcgtgtatacatccatatacacaaaatgaatttaggaagttaattgaatcgaggagtttctattttataagataaatgtgaacagtacatttgtaatgtaagcagtctacttttttactcaaacaagcagaaaatatccttttttagttttaaactctttgtagacaagattgaataaactagagtggatgaggcacagagaattggttgccaatgggatcaagaatgctagaggaaagggcagagattatcctttcacccagaattgctctgtctctcccttactaggtaggaaaacaaacaaataacagagacaagggctactgctctgcactaatgatgcgtggggtgaaagaagtccttgcacactggctcctctttcctgcttcgttcacaacctattcagcactttctggaactttgcgtgaaaaatttcatagatcccagcaggaattttgtaaaacacataatctttgctcatagccattacccaatgttgtgttccttcaggggctgattgaaaacagagctttcacaaggtctcttgcatgatgctagccttcatggcatttgcatcctgccaagtgatacttctggtgaccatcctgccaagtgacacttttggtgacagtgccttggttgactggtctcagcaacctgctttaatctctgcaattaaaaggtatgaatgagtgaaccagtaaaatgaaggaaaaaatcaacatagtggcgggatacttacatccagaaatatgttatctaagggtgtgatactgggcagccagctttcatttaagaaattagacgtatttttaggaaaccagctttctgctagtgacctacattataaaatattataaactcccaagctggatactataaattgaagatgaagttctttcattttgcagttacacaatggaatattatgtgtcaggtactgttctaggcattgggtatacaaggataactaagaatttgtccttctcctcaaggagttcccacttttgtggcagagagggccttgaaaacaaatcatttaactgccacttactgagtgactagcacaggtgaggcatcctaccaggctctggagaaagagggaaatatagccctgctctcagcaaacacaggtggatgagaagggtataagcagggggctgggaagcagagagagagagaacctaaaaagacttaggcaaaggcgagtgtatgataaaatggagaacgccatagttcattctttcatttttttttttgaagtagagtcttgctgtcacccaggctggaatgcagtggtgcggtctcggcttactgccacatctgcctcccaggttcaagcaattcttgtgcctcagtctcctgagtagctgggactacagatatgtgccaccatgcctggccaattttttttttcataattttagtagagatggggtttcactatgttggccaggttgatcttgaactcctgacctcaagtgatatgcctgctgtggcctcccaaagtggctgggattacaggcagaagccatggtgcttggccagttcatcctttaattttggctctaataaattcactgtatgactaaaatgttactttttcttgatgttattattaatcctgtttaaaattagagcattggctttaattatttttaaatttagacactggttattatttctaaaggaagttataaacaaaatttcatacagcatgccatttgacaaattaatgaagaaatatttaatacatgtgagtatctcatttgttttgttattcaaggggattttagcttattgctttttgctttctgtatgttgaactgatattctttttgggcacctgtttgtataaacgtatcaatttgacctgtacttgaattaactgtttattttttatatgttggacagtactacaaattgctctatttatgaactgtatgtttttcttcaatatgcagtttggaatcctgctgttggaaccttatttgcttctgtatgctcacccttattcactaatgtttgataataatgcattataaaatagcagtgctacttctttatcaaaggcttgcagtatttatttagcatttgcagtttcgaaataattaaacaatgctgatgtacagttcttattgcatttcaaaaacctaaccagttaattagcttaagtggttctctcagccctattgacagttggagacacatagtgctggcttgtcaggctgctaaaatgaaacataagaatggcataactgtggttagcttcttttccccctcacccttgagatatgagttggctttcttttgtgtgagataaaaacaaaaccagatcatatgaactgacacttctgcttcagattaacatgagccttgttattcaatttcatgttggtgtttctacactcctttgcctcactgagatttcattaatcctcatatccttaatcgcctcccctttcccttatgatggtctgttttaagattctattatggttttttttttttttttggatgcctttgaggccatctgaacaatactcttggttaacctgagaatggattacaatctgatcacatacttactgctgtgtttgtgtctcgctgcctgtacagtcaggtggctgttctgcctcttcacccttggctgactttcacccatggactttgaagtgttactgcttctattttcatcaaattttatacaaattacaccgtttttccgcaaatgtacatttagtgaagtttgtttggctccagaatccagtccttttgcaggacaggagcagaggaaatggcagtgaaggagagggaagtccacgtaggaagaaatcccaagactggaggtggattggagacagcaacagaagagaagagcgttggggatggctctgagttgaagctaggtgactgttgacccagagaaagaagttgagaggagaaccacgctttgtatttaggtgggctgtggtggggtggaggggattgaggtgtggagtttgatttttgacattcttgtgtttgtgttggtaagacaccttgtggaactctcctagcagagtttaagcgaatgagcgtatatatttgatgaggtgtatatttgagagtgacagcacagaggtgatcataacaggagccactatttgttgagtgcatactagctacagtgataagtgcttcacagacatgctgtctgtgcttcaatgtcctcacctgtaaaagggatttaatagtaggattcttgtgagaatgaaatgaattgatatatataaagtccataacaatgtctggcacataataagtaatacttaagtgttatcataatcacattttaattcagtatccctttggaaagaggtattattgcaggttgaacatccctaatctgaaacattttgagcactgacatgacacctcaaagtggaaaattctacacctgacctcatttgatgggtcacagtcaaaacttcatttcgcgcacaacattattaaaaatatataaagttagcttcaggctgtgtgtaaggtgtttatgaaacaccttatgaattgaatttcatattagacctgtgtcccatcttcaagataccgcattatgtatatgcaaatattcaaaaatctgaaaatatcagaaatcaatcacttctggtttgagacgttttggacaaaggatactcaatttgtgtacacatcttatatgggggaagctgtgactggagcaatgtaactactctgccaaaggttgcataactcataagtggcaggtgaaatgatatctttttttttttttttttttttttttggagaaggagtcttgctctgtcgcctaggctggagtgcagtggcacgatctcagcttactgcaacctccgcctcccaggttcaagcagttctcttgcctcagccttctaagtagctggggttacaggcacacactaccatgcccaactaatttttgtattttcagtagagacaggctttcaccattttggccatgctggtctcgaactcctgacctcaggtgatccgcctgcctcggcctcccacggtgctgggattacatgtttgagctaccacgcccagcccaaaccatattcttaactctgcttgtctctcacctgcctttgtggaaataaacacctcaacagaggcttcatggtgtagaggaaagacaggacaaaatacctaacacacaaggaagctgttttgcttattaaatgaacaatatgcttttaaatcgtgtaagaagagctttgtaatgaaaatcatcattataagaaagaaaaacttacagaaaggtaggagtgaggcttggtatttgagctcctgcggaagaccaagagggagaagggaagatcagtgtagggcaaagcaaatccaagagagccgggaagataagaggaagaatcatgtagtttctgcatttacggacaaaagcgcttccaaaagtacataagggttgatgctatcaagtgctgcatggaggtcattgagagtgagaactaagaaaaggcagttggagtcacattttggtgttaaccagattaaatttccttttggagcaaaaacggttgactacacatacagttataagaatcaggaacatatgatccaataacatagatgaatcaggaactgaaatttggggtgtagatttattcctttgactttctctccctttttcagttcatgttttaccaatagagtattctggtagcagcactgtctgacatttgtcagcttaattagagatcagttacaaacttggctatcttatggatctgtgatacttcccagcaaatctgaaatgcaatacgggcactgacatgaaatgatgaaaaatatgctaattttaacctgaaaaagctccctattaatgcagcaatttctcttattcatactaattctcatttttttttctgcatcctttgtgtctagtctctccacaattgaaaagctgttttgaccaccacttaagagcaatagactataaattctggagtttaatttgtttaatgtctgtgagggcttgatggggttgggactttgttcactaggtatgaacccattgcctagaaatctgaagaagggtatattgcaggttcttacgggtattcctaggaagaagaaatgatttccaaacagaattagcatgtagaggagaaacgcacaaagaaaaggagatttgatttccacaatgtaaggaaatgtaaaatttcattagaagaaagggaaagaggacattgccagcaaagatggagagaaagaaggcgtgtttaaataagctggtttccaatttagctgaaacatttgaaagtaaacagaagtagagctagatttaggggtgtaagatgtgggcaattaatacatttatatggctcaaaatttgaagagttggaaagcatctacagtgaaaagccccttttcctgccccatttcctcagccactcaggctattccccagagtcactgtgcataattacatatataatacaaacatgtatactatttctcttccctcttttatttttccaaaatggtatcaaactgtatatattcttctgcaccttgccttttttctcactcaacatgtttcttggagctgactctcaagcagtttgtgactatgtaattaggacataggcagctcctgctttttttgttaaatggcactgcaaaatgttcctttatgtgtttataccataatttatttaaccagtctcttgttcatggacattataaccttttgctcttacgcagagtgctgcaaagtgagcagtcttttccacgtgtcatttcacacatgtgcaagtaaagctgtaggataaattcctagaatggctggattaaaaggcaggggcagttacgattttgaaagatgtagccaggtggccttctccataggttgcgagtgtatgaaagacttacttccaagccagtctcttctatgctgcctgctataactaccaattaggaatttatttgggctaataagtaacccatgcctggaagatttaaggaatgtgaccttcctaatgcatattatttttaatcactgtgctttcaacctaatgaccagttgagattaagccacgtggtacatatttattgcaaacctactatttggttctagggaatcagcaaggagcaaggtgttacttctctcttggagtttatattctggtaaataaacaagattattccagagagtgataaatactgtgaaaataatacacatgacaatataattgtaacttggcagggggcaggctaattagaaggagtatactggttatggaaggccccctgaggaagtgatatttcagctaaacctggatgatgtaaaggagccagaaatgtggaaatcttgggtggcagtagcaggaacaacaactgcgaagatcttgagccaagagtaggcctagtggttctagaaacaaacagtagggtagaatagcaaagggactatcatgagcagaggggagcagggcatagcctgaagctaaagaggggcaggggtcagaccaagtagatcctcactgtggtaaggagttgcaagatttcaaatatggatgtgatgttgagatttacttgttaaaaagataacttggagccaggtgcagtggctcacatctgtaatcccagcactttgggaggccaaggcaagtggatcacttgaggtcaagagtttgagaccagcctggccaacatagtgaaactccgtctctactaaaggcatgaaaattaggcatggcggtgggcacctgtaatcccagctactgggagggctgagacaggaggatcacttgaacccagggggcggtggttgccttgagctgagatcacaccactgcactccagggcaacagagcgaaacttcatctcaaacaaacaaataaataaataactaggaggctgtgcatggtggctcacacctgcactttgcgaggccatggtgggaggatcacttgaggccaggagtttgagacagccttggcaatgtagcaagatctgccatctctacaaaaaattaaaatatcagccagatgtggcacatgtttgtggtcccagctacttgggaggattgcttgagcccaggagttcaaagttgcagtgagcagtgattgcaccattgcacttaagcctgggtgatggatgagaccctatctctaaaaaataaaaagataacttgggctgctgagtggagaatggattgggagggggcaagggattaagtggagagagtatgttttgggctgggctgtagtggcagcagcagagatagctatgccttggaagacatatttttgcagaggtggaactgttaggatttgtatgccttatgggtgataggcagaaagaggaatcaaggactcctagaattttggcttgagcaagctaggcatagaggcaggaagagacaaggttggggtgcggaggaggaggagaaatttgaagggtcctagggcattttctgagacgagtggcctggagaatgtgacggaatggactgtttggcccagcccacggaggaggagagtgctgggttttagaaatggggcatctgagaaccctgacttctgtcatggtgcctggagtctaaagtggggagcagagcatccagcgaaggtgggtagtgtccgaaaatctggagaatgtttgtttctttggtatgttttagtttttttcttttacatgaatatctatagatcttccttgatcacaaaaaatgaagttggcaaatttatggaactgtgaaagtaataccttatgtttttgtgaaactttgagagataatttgtctactataaaatttatttaaaattgcacaattgtgatttttcacataatcgtaaggttgttcaaccatcaccactatcttgactgcagaacatttttatcaccccagaaagcaaccctgcgctcactagcaattcctcctactcctccattcccccagcccctggcaaccgctaatctacttgctgtattctggacatttttacaaatggagtcatataatgtgtgttttttttggtgtgattctcttctttcacttaaaataacattttaaagatgcatccatgttgtagcatgtgtcagatctccattcttgatggctgaaaaaatatttccgtgcacggatataccacattttattaatttatcagttgatgaacatgttggttgttttgacttttcggctattatgcataacactgctatgaacatttgtgtagcagtttttttgtggacacattttctttcttttggttatacacataggagtgtaattgctgggttttgttaacttgatttttatcttttgaggttgtatccaactttatatcatttatttatcacagtagctatgaaaggaacctgaagtactgaaggatttgatgggctagaggaaaaagtgcatatgttacaaaaaatatttaaaatgaggttcattcatgcattggttaaaatagggcagacctggacacataaatgtgtcaggagaagtaaacaaaacgtgtaatacttatatagtggaagagtgtattgcaggtgtatgtgtgtagagaagtgtgtagagaagttatatctatatgtaatctcaacagaggtagataaaaaacaatgagaggtaggttaaatgagaagtagattaaaaaacaacggtgaaaaatgattaaaaaacaatgatgagtgaataagtgagttgataccatttatgtaagttaagaaaaccacaaagtaatactatgtattgctcatagatggaaatgcccatatacacacacagaagtacaaaaaggattggaaggatacccacaagtccatgatagtagttgctttgtatccctacttctgagctgcaaacccatgccagttttccttaccatatatttatatataaattatatataaatgtatatatatatattcatatacaaatcatttctgttacatgactgtacatttcttcggagtagggactatgttttcttcaccaatttccattgcctagcacttaagtgtgaacacatatttttgaatgactaactgaatgaattaaatgattttgggaacaagatagggcaggactaatgaataagccactctcccccatcctgctcattgtctctgctccctaccttcatattctgttagtgttgtcataatatgaggcttgcaattaccagagcagttccatatgacacgacatgctaataaagcagatggtgtgtgcaaataagcaggataaaagaggtctttgctgcaaaagtcattgctgtctcctttaaagtatgaagtattttatgatttctcagtagattttatcttcattgtcaaggtaatgattatggatcgtataaatctttatggctttgttgtatcaagtgtcaaattacacagcttaggtagttgtagaaagaaagatgtctgtgatcagattaggaagtcatattactaaaagtttttgccgttcagggaggagttggtctcacttttttgtgttcagatagtggagaactgtgctcccgttctagggccctccctcctttctctttattaacttctccccacgggagaaagaatggcaaattggaaagctcggggcttgacattaatatgagtgaagtcactgtatttccacatggctttcgttctttttttttttttttttgcgggggaaacaaggggtggaggcctgcagaaaggtgccagctatcctctactttttgcctgctgtcttcaggcaataaggagattagggaggtgttcccctggcaggcctaatctggtctatacttcttctagtccagcctttgcctggacaggtaaatcagttcaggtttgctctgtgaacctggccaccttcaggtctggaagaagaacataggaagccctgctgacgtcaggcttaagctgtattctccagcacatttaccagaagcctctggggttgtgtgtgaccatgcctcgaataaagcccatgttctgatccccatctgtctgtcagatgttatttgtggatgttatttgtggttatgcccagttggttagaacctagaaagtgataaaagtgagccatgcagccgggcacggtggctcatgcctgtaatcccagcactttgggaggatgaggtggatggatcacctgaggtcaggagttcaagaccagtctggccaacatggtgaaacactgtctctactaaaaaatacaaaaattagctgggcatgatggcatgcgactgtaatcctagctaccgggaaggctgaggcaggagaatcccctgaacccaggaggtggaggttgcagggagccgagactgcgccactgcactcaagcctgggcaacaagagctaaactctgtataaaaacaaaaaataacaaaaaaactagcgagccctacagctgcaggctgaggttctagttttggcaataagctaaagtgtaaataattttacatttaaaactatggaacaaatagaggtgggacatgggctgcccctgcccacctctccagccagttccccgactcttcgtcttctttctgctgcatgtggtctgaccatcttagttctcaagtttgccaaactttttttcagccatgtgtcctttgcctatgctgttttctctgctaactttctcttttttttctctctcttacttgctgcttttatggtcaagttctaactcttcaagcgtacacttaaatagtaccttctctgaccccgtaggctaggttgattgcttcagtgtactaaggcaaaaataccctgagtatctgtgctcattaacctctgtgtttcccttttgtaagatttatcacaattgtaatcaaatatttatgctatgatatatttgttgcctttctagattttctaacagtcttctttgcattgttacataaagtgtttagtgcagagctgggcactcatatttggtgcctgagggagatttgttgagtgaataaaatagcagtgtccagcagcgacatagactgctgagatatggcatgtcagagtctgaaaggcttctgtccagttggcaagtggaattcattggatgttttacaaagaatagttttagtaaggtggtggggacggaagtgagtttgcaaagtatcttataaaaagctagacttaattactcatttacgcaacattggaacccttacaagtgatttctctactgagagcaacttttcttgagttttactaactcagtagacactgtcagaatctgccagattacaacaaaggggtaaaaattcctgatcacttgaggtcaggaattcaagaccagcctgggcaacaaggtgaaacccgatctctactaaaaatgaaaaaaaaaaaaaaaaaaaaaaatagctgagctgggtggtgcgtgcctgtaatcccagctacatgggaggctgaggcaggagaattgcttgagcccgggaggcggaggttgcagtgagccgagattgcgccattgcactccagcctgggcgacagagcgagactccatctcagaaacaaacaactcccaaggcattatactatgactcttttctcaatgggtagtgaacagaatggaatattcacttcactgcaaagagtcactggcaggtggtgcagagcactgtgctccagaaagagcaaagagcctagaggtttctgatctctgcttatcactcagccaaaagtacagtcatttgcttaaaaaaagacaggtggcataaaaaaaaaagtattctttaatctctctgctctacaggacttgaaacatagccttaaatgactaagtcttcacgtgagcatgacataacctggaaatcttcctataatggaactggccttgtgaaggtatttattgttaagactttccagggtatattttgggaggtgccatgggcagatacatcggcgatactgttacatagtccaggatgttctacttttgaaaattaacaataattacactcaagaccttaggcaagttgactattctcagcactttatatatacagtcgtccctcattgtacaccgggatctcccctacccctcgcctatggtcaaatctgcacgtactcagtcttacagtcagccctgaagaactcgtatatgtaaaaagagggtatctctaggcagtgaggtagctttctgttagctcttgtagggaccatgttcttgtggacttgacaaagaatgttatatcaaaagtcgtaactcctttttcctgatttaaagatgacatttacatggtttttgtgtcccatgaatacggtatttttgatctgcatttgattgaaatgcatttgagctgctcagttgaaacctgtgttgttcaagggtcagactgtattaacctatttaatctttgcagcaaatcctgtaaggaatcagtccttttacagaggaggaacctgaagctcacagagcttaaggactttgcccgaagtggcagaattggcatttgaacctaggcatcctggcttcagaatccatgttcttcccttttaggttatactgcgtctctgtggccacttgatgataaagtcagtaattaggatccactgttgttccctcttgtgcctctgcccttttgctcatgttctcctccctgacactagagcacctgctcccccttcacctgcagtgagtgtctcggggaaacatcagcacagaggctctgctttctcccacccggcaggtccgcagggggttgctgtttcgaaagtattgagtgctctggacaccatgatctgttctgtaggattcttctgtagcaggagctttgtcatggactcagttgccttttgaatgctggtcaggtatcctagtcatctttcacaatgtcgatcatatgggaaaatatgtttctagttctgacaactgaattacatgtacacctttggaacataatctgtttttaggttgagaactacctgtgtattcatcaagtactgaagttcccagtgttcaagaaatgccctatgctattaacagagaattaacaggtttctctaaagaacaaaactaagcttagtatggcctggtattaatccctgtctagaagtttcacaatcaaaagggcaaaatgtggaaaagcaaagataaataagtaaaattggaaaatacgcaaagccgttagagatgtaccagtggctcagaagtaggtaataatgagaaatgcacccaacctctgtgactgtgaaacatgccacccaagctttgggtttttgaaatctgtctctggcacttgaatctccttgtcagtggcaaactggagagctttccatacttctgtgcaaaggaaagcataccccagagcaaaaacaaaataaaatgctacttaatattcaatgtggtgtcctttgaatttaaaagttgtagtgatactattatagcagaattaacattattgtcatattagcattggaactttcccatttatttttggcttggtgaatttgaaagtgttgtttaacagaaaagattttaaaaggttagatgcaatagcatttattttgcacagtttgatggattgccagcagcagggaaaactacaactcagatcgtttcaacaactttctgttcttggatttttcctttctcaccaatttttctttcagagcaataatcattttactgtatatgaaagagatacctaaatatcaggtatctagttaggtgctaatgaactcctcctgcccattttttaattgtttgctttatcatagctctaagtagtcgtgctaatcttttagggggagggttaaggaaagattttacttaattttgggatttactttgtcttttacagagcttgatatgtggcttaacagtaagtaggattatagcaagttgttattttagagaaagtaaacgttatctcattatattcttttttaacataatgagaatctttatggaagaatttgcgacagctcaagaacattttttaaaatttaattttaagttccaggatacatgggcagggtgtgcagagtcgttacatagataaacatgtaccatggtggtttgctgcaccgattaacccatcaccaagtattaaaccccacatgcattagctatttatcctgatgctctctgtccttccacacctccctgataggccccagtgtgtgttgttcccctccctgtgtccatgtaagaacagttctttttaaaggttagtacttggattgttttattgttgtactgtttaagcagctttgttgagaaagagtaaattaaagcttttatcaatttttttttttttaacagcaaatctgtactctccttttttttttttttggtggcccaggctggagtgcagtggcgtgatcttgtctcactgcaacatttgcctcctgggttcaagtgattctcctgcctgagcctcctgagtagctgggactgcaagtgtgtgccaccacgcccagctaatttttgtaattttaatagagacagggtttcaccatgttggccaagctggtcttgaattcctgatctccagtgacccgcctgccctcctcggcctcccaaagtgctgggattacaggtgcaagccaccgagcctggcctgcactctcacttctagttatcaatgttaaatttatcatttgtcactaaataattatgatattcataattaccaaagccttttaaaactgcatttttataatttttgctacttgctgatagaagaccttttgacttaaatatctaagttttagattgacattagttttgatatataaggtttagttttcagtattgagctgctatctgtaaactaattatattttgaagtgaaattagtggagaatggacattttctacattgcgtgagcgtctacagctagagagtatctctaggcagtgaggtagctttctgttggctcttagatgggatcacattctttgggcttgacagtggatgttatgtcaaaagtcataactcctctgatttagagatgacatttagagtactgtaggtttatgagaacctgctcttaaccttaaataacagagctgctgccagggctgctgccttccttcctggtttttgggtgcttgagactcttggaaagtgggccagatgcagtggctcctatctgtaatcccagcacttctggaggcttaggcgggcatatagcttcagtccaggagttgtgagattcttggaaatgtaaagcatagttgatgagagggggaattaaatagcagaccggatggttctcaaaataaaataggaaattagaagatatgaggccttaataacaacaacagcaaaaatgagatgtatctatctataatgagatttctgaatgtcataatacagagacaattctgtatccaattagaataaaacttgttaccttcaagtggaatgaatcaaatgcaataattctatacccagccaaactactcttacataggtggtcagaggatcaatatttaaaaacctgctattattctaactttgaatcctttcaggaaaaaaaaaatttagaaaatacttaaggcattggtgaagtcaagagtgaaaacctcataggaaagaatatgtggcttatatgcaaccgattaacttgagtcaaatctaaataaatgttagtaggttgtgaagctaagtggattcattgacatgaaaaatactatagaatataaccaacttttcttaatactggaagtccttttgaaaaatcaaattattgctgggtgtggtggctcatgcctgtaaccctagtaacttgggaggctgagggaggaggattgcttgagctcagaagttcgagaccagcctgggcaacatagcaagaccccatcacacacacccagaaaacatcaaattatttctttctgtagctctgagtttatatgcatatctaatgaaatgattgaaaaccctactctggcaacacaggagttgggctggcgataaaaggtgggggaaaagcaggagtacttaggatgtgggagaggaaatgatacaaatatgatagactgttaattcctgggaaaaataccagaaacagctgatctgattttcagaagtaatcataaaaatagatagcatttattgaatgttgcaaggcctttgctaagtacttaatattgttacctcattttaccctgtatatcagagatattaatgagctggctaatttatatacctgtagaatgtgtaatgaacactcattagcattatagatatgttagttttaaagtgtatctgtgtccttttaaaatatttccttttaactcttaaattgaaaagtctagggaataatcctaatcaagaaggagttgcaggaaactattgtaaatccaggttgtaaagagaaaataaattggttggtgagaactgtcaccttttccataagataatttaagcacaaatgattacaacaatttacgttttttattgtggccaatatagttgacttggtttaaatcagacaggagaaaagaggaaaatttttattgattaaccaggccctgaattttctgtcttaggaggaggaaattatgtagttaaattgtatgattcctgtcaaaagaacaatgaacttttgagcagattggctgagcagagagaatacaaagcagggctaatgattgtcttcatcaaagagaacttcttgggataagcagatttctatgcttttataagatagatttttttgggggcagtgagaatataaaaacaaattcgggaatgagaggttaatcgataaagaacctgagttgtgttttagtcatggaaacagtggcttttttttttttcagttttgtttttgataaaaagtatcctaaatataaaggaggtatatttccaggtaggactgtgctatgtaactcagtagtctctaaactgattttagttttgcttttgatatctgaatggattaggaaaattccttccaagaaaccagagaccagaagatcagacaaataccatatcagtttctctgctttgaaaattataattcaaccttgtaaaatttttctaacgttgtgttctctgtaaataacacagagtaaaaataagtcaaaccatttgttttttcctctaaatgttctgaacattaaacaaatggttcttggcaaacacatactattttttttttttttttgagatgagtctctattgcccaggctggagtgcagtggtacaatcttgactcactgcaacctccgccttccaggttcaagcgatcctcctacctcaaactcccaaatagttcggactacaggtgcgcgccaccatgcctagctaatttttgtatttttagtagagatggggtttcaccatgtttgccaggctggtctcaaactcgtgacctcaggtgatctgcctgccttggcctgcctaagtgctgggattataggcgtgagccaccatgcccggccatactaatttaattttaggaatgttgtattatagttcattttgaacaaattgtaagaagattattttgtgcccatatgtgtgataatcagaatagcttgatgtagatatttggtatctttttagaataattatgtttagataaatcttttctgtggaaacatattcctaaacatttaagcctagttataccaccctcaaatataagaagtttatgaactttgtgggctgattcaggaaatcttttcacactgataaaaacaggagactttaatattattttgggaagaaaaatgagaaatttgaagatatgtctcttatgaatcttgctgcatcagtttgttttctgctgatagtctggttgatgcacaatttagttttcaaagaatttctcttcaaaaataccggctaggcacagtgttcacaccggtaatcccagcactttgggaggcagaggtaggaggatcgcttgaggccgggagttcgagaccagcctgaacaatgtaaggagactctatctctacaaaaaataaaaaaactagccaggcatggtggcgtgcacctgtagtcctagctgcttgggagactgaggcatgaggatcccttgagcccaggaagtcaaggctgcagtgagctatgatagcactactgcactccagccttggtgacagagcaagaccctgtctcaaaaaacaaatatttttcatccttggaaaaataaaacctaaaataagaagagcagcacaatatttttcttttttttgaagtagcagggctgaccaaagccatttctagccaaataaattatttattaatcaatatcgttaccacattctctatgtggaaaaagtattcaaatcttgaggcctatgttttttcaaacttgagagtcatacagttgccagcttttttttttttttttaagtagtagacaaattgtaagaactacaaaactgaaaattaccttctgtttttcttccccataagctgctgttgaagtgaagtgagctcagggagacaggcctgttgttatcttcctatggcactgatttacacttttacagaagggaaatttatggcccttatctgttgaggacttttatgaatgactggtataaatcaagaattgaatgaatatttttccctttaagcataaatctgtgattgggagattgatttctgagtaactctttggtaacccatttaaattgtcatcttccaattttctgtattttggcataaactgaataactaaaatataacttaataccagcatgatagatttgtttttcttctgttagatactttagaattcatctagacttctcacagacctcgataaataactcagcagtcagaatggaaaacaaatttatatagtggaaatctcattaatgggaatgaacaatacaactgtattcaaggtttaggcaggagaaggaaaatgatagaaatgtatttgtttaattttaaagattcttatgataaaatgatcattaattagggaagataagtagaaaaagacagtcctttctgggacatttgaagactaacagccttttattgaaagtcctggaaaagtatgtgtaaaaagccagccatgatgatcttttacctacacttccttaggagactttccctcagcaagatgtgtctttctaaaaacaaaagataagagacaataggagcccacataggatggaaagctagaaatcaggtgggttaaaaataatttcatctacactatcttccccttctcaaaagatttttaatctgtaaatggcaacttatacatggaaggattataaaatacataaaattactttttatttgtcttctcagatatatggcgtgttctttatcttccccttgttccaagtaattttgttaagcagtaaacaacgtggaagacaggttggtcaggagataagcagttgattccgtgttttttgaagagaacttttatgatagtaggaagaggagggcagtgctggtcctgtagtgcagtcgtgtagtactgtttgctgtgggacaagaggaaggaacagactggcaggaagggactgcagcatggaagggtgctaagtgcgtcactgagtgataagggtgctaagtgcaggaaggcccactggatgggcagggtgagagtgggttcaggttgtaggtgtggagttggacaggctggccttgttctagcagcaccatttactagctgtgccaccctaggcaagtcaccttctctgctcctcatttcccttctctctaaatggtgataataagagaagctaccctctgaagttgttaggattaactgagctgatacatagatgtaaaacccataggacagtacctagcacgttgcatccaacaagtgtcagcaaaatattagcctagccagtcacctgtggccattatcaacatctgtctccagttagtcaccacctttggtcaattctgcatttgaatatttcttaaagatgatttatcttctctgccctcatggccatagccttagtgtacagactttttaactctcaaataaattaattccgtttattcttttagtcaaattttactaaaatccattgtgcagaaaatgacctgttaattttctaaaatgcagatcttgccctgccactctgcttaaatccctgtcatggttttctgtcatccttaaggaatttataattaactttcagcattaaaggcatgcagagttcttcaaaagttagctcttgcttgccttccaacctcatctctcatcagatactttatgaacatcatatattctaattcttactatacctttccaaaaggcagtcctcattttgcacagtgatgcaggactgtaacagtgatggttcaagctgaactacacacaacaatcttaataacagtgggagcaactccagtattcccatgacctttgaatgtttttgttaaaacattaaaaattctctgtcagtgataaatatgtatggaaatgaaaaagtaaaactggtattgatgtagtatactgtaatgtaaaacattagatgaaaggctcacacctgtaatcccacactttgggaggccgagacagacggattgcctgaggtcaggagttcgagaccagcctggccaacatgatgaaaccctgtctgtactaaaaatgcaaaaattggctgggtgtggtggcgggcacctgtaaatccagctacttgggaggctggagcaggagaatcacttgaacctgggagagggaggttgcagtgagctgagattgtgccattggactgcagcctgggtgagaagagcgaagctccatctcccaaaaaaaaaaaaaaaaaaatcagaagaattgagaattaaaaacttatcaggagtagtttgaacagtgcttgtcttcttcatcttgtcatacgatataagatgggcctagcatcttttctatgacttggtgaatttccatactcctttctaagtttggatcagtttcccgtatttcatcctttgtgctttcagtgagtttcattaatgtgaagtttttttgctggcatcacttcctctgggacgtctttattcttttgctaatttatgtgaagctgccttcaccaagctcctgtggctgcacatcattgtctcttagatgtcgttagtgtctcttagatgtcgttagtgtctcttagatgtcgttagtgtctcttagatgtcgttagtgtctcttagatgtcattcccatagtcagctatttcttctctaaacgtcgtttatgtttgattcagatttcactttgagtttaccagtgtttcagtgctgtactttcatctttgctgcccaattccctctttggattacccatttttgtaaaatgtcaagtgggttaatcactgtgagacatggtggcagcacaactatatgcttttctgtctgtgtaccaactcagatgcacagtgaccaatcactgacaggctttgaaagaagtgacgtgattggtcatggatcatgatacagatctgttatttactcagtgattggtgcactgaatagctagtggtgaagtttcttttatgtaattattattgattaatttatcatagtaactgacatttgagtcttattattggcagaatgatgttaattaaactgtggtaactgaaatttatgcatctcagaactgtgcaaagcaaggactgcgagtatgttataaccatttcacaaagtcttaaaggttaaatggctacatacagcacatggccaaaaagtggcagaattacattaacataacttttcaaatatctttgatatttatgttataaggaggcacaatctgtctcttaatgcttctgtcaaattaaatactcatggagttcaaatacaaatggattgtcttcagaaaaaaattattagcatgtgtatttaggtccatagccctataggaactctgtctgtgcttagcttgggctaaccatgtaagactgccaagatttgcataaaaatccaattattgtaaagagctactcaaagctagcaacatacctgaccttatctgaggttattttttggaatgaatcaagagtccccagccttggagtgatgaaaagaccatcatttttatttgttttattctggaacaaataaaaaatccctggaaaggaaaggaacatcccgtagtcaagtggagaaaactggtctaaatagttagcagtggagatattgagatactctgcttaggatgagagatcagcagcagtgggtagggatgttaatgactggaccttaagcttcagggattcagaaataagttcagttagttctcttaggaataagttaaatagtgtctgctcaattcatctggccggctggtagtcagagtccacagtaagtagtcaaatttgaaagttgtaagatacaatccagcttctgcaataatgagaaggctcagtttggagcatctaaaattgttcagggtacaagagaactgagatacacagatggactaaaataatactcagttgtggatagatgaaggctgagaaaaaatatgataaaaggctttttttaagtgcctctaaaatgccaggtcttctagattacttttacttatttgtaatgtaattcttataaacatcttgttagcaggtgttatagttgttatttagaacttttctgagattatagagctagtaagtaatagagttgggttttttgttgtttttaat

SEQ ID NO: 1099 - DNA, 57143 bp, Homo sapiens
acccacaattgctttacttcaaaaattgctctttcttgggtgaataacgtgaatttcatcatacatcctattggcaacaaaaacttttttttttttaaaactaaacctcatttggcctgtgaattgtcccaaatcagccagtgaggaaacattgggagtcctaacccactctgactttttccttactttagggagcaagctgggttggctagagtcctccatccctatctgtgttcgtcaacagcaggtgaccttcacaaatgatgaggacctgaatgcttctggtggctttcacagtggctgatgtggcacatgagaagactacaatgttagtattaaaaaggatgtttagaagtagctctaattgacatggaaggatttctgaatatattaggtgaaaaatgaggttagagttctttgtagagtgtactagcttgtttttacggagtgcttttcttggcatcaggcattgtgctaaggccttcaagttatacagtatcatacatccttacaaccctattttatagttgaggaaattgaggtccagagaagttaaggtcactcacttcataagtggtggaactgatctttgagtgcacccctgtctctggagcccctgttcctagtcctctccacatgaacagcccttcctgggagtctccaagtaccagctttctctgacatagggtcacgcatgcacatgcaagtagaaaagggtgtggaagtcgcatattataaaacaggtaagaaattactgttttataatatgatgcagtgagtatgattaagaaatagaccagcctacttaatgtgcttatctctgttatagggatttctctttttttcctgaatgttctaagttttcaaacattcagcatttataactttttaaaaattatgaaagcaattagaattatttaccataatgtattattactggattttaggaagaatatggtactaaagttgtttagtggttcagactgagagtgcattaatgggaacctgggattttgtttgtttgtttcctatttgagggaacttgaattattgttttgggccttattttgttcatctgttggaaaaaagcatgccatattttaagttacaggctcattataagaataaaaaactcctttgaaagatggattgataaacacatttgtaccatcgatttctggttagtgctgtttaatctttatgattctagtgtcaaattctccccacaactctaatatagagtcaattcatacattcaagttaatggtagatggtagatagtatgcataaaaaatttgaggcatgaagttgtaaatgaaaattaggactaaatttaaatttaaatatacataaattttgtatttaaaactttcagtacagccatgtaccctataatgacattttggtaagtgacagactgcatatataagggtcctgaaagattataattctgtatgtttatggtaccttgtctcagttcagatttgtttagacacataaatacttgtggtatagttggctcctgtgttcagtacagtaacatgctgcacaggtttgtagcctgggagcaataggctatatatcatataacctaggtgtgtaggaggccataacatctaggtttgtgtaagtgatgtctgtgatgttcgcacaatgacagaattgcctaatagtgcatttcttagagcttatccccatcattaagtgatgcatgacctgtatattcaatataatataaatgtaaattggagcattatgtatatatgctgtagtgtagtaggcaacaattgggtagtgcttggatcacagaaatgtgccactttctgagaatgccctagtagatgtacacagcaggggcctcactggccatttttctgccatgtcatctcttggcccttttttatggagctctacaaatcactgcagcgtggaactggttcttgcccatcccgaggtttggatgttcagtttctcctgaagtctacagtatttgttttcaattgtatcccccttttttgcttaaactagacagaattggtgtttttgggcaaacactatttaaaccttttaaaaagggtctgggggtctgggtactgtggctcatgcctataattttggcattttgggaggctgaggtgggcagatctcttgaggccaggagtttgagaccagcctgggcaacatggcaataccctgtctctacacaacgtacaaaaacttagctgagtgtggtggtgtgcacttgtcgtcccagctacttgaggggctgaggtgggagaatcacttgagcctgggaggtcaagtctgcagtgagccatgaccgcaccactgcattccaacctgggcaacagagtgagactctgtctcaaaaaaaaaaaaaaaaaaaaaaaaaaaaggctatcatgggagtgcttaataaacattgctagcaatttcgaatcctattttacataaaagattatagtaatttttaaagtaaggtttttaaggcaagcaaaggaacatgtattgatttctgagtatattgcacatttaattacaacaaatgaaactggtcatcttgtgtttttatttttgttttcatctatctgctttccagactaattggggagcaagaattccttttcctttccctgtttcctttagatgattctgccccttcatcttcgctcctcatttctgtagcttgactttgttctgtagctgtgtgctgttccctgggtgcctgccaggagggcgcttccttctgcctattcctctctccattcattgactatctttaagtggcgttttttccttccctacctgtattaagattttctacttgcagactcttctcccatgttcacaggagctggtttttccttgttgtgcatggaagcacctttggttcatgtttaggatatgagcattgttgacaggcactgttaacaggtgaaaacatctcaaaaggatgcttgattaaaataagtattttgttgttcataagcctctttatttggctttggtaaactaggagcctaaggtaacctttcattccagttttttaagtttttgtggttatattatgcagtttttattatgcagtgcttatttcttatgacaaaatatgagtaggttaaattcataccatatcaaaatgtagtagtgaaagtctctacttttctgatcctcagccccctagttccccctgcttgaggctatcactgtttccagtttcatgagtatttgttcgctgatattttatgcatatacaactatatatgtctttccttgcaaccctttgacattatacagatggtagcatactcttagcttggaggctagtcccagcgcatttttcgcctatattgtgtcttagagatcatttcatattagcacacatgggtataccttgttacaaacatgcacacacagaaaataagctttaaagccgtctgctgtagtgcattggcattataacatagtgtcatgagtcgtagagctggattcaaatcctgaccctgccatttaagagcttgtgaccttgggcaagttgaatcacttgtctgtgtttcaggtgctcatttgtaaagcagagttaatctctctctcacaaggtttttgtaaggattagaggagataatgtatgtaaagtatttagcacagtgtcttgcttaataaatcatagctattattgtactcattaatttatcagatcaaatgaacccctaatgtgtttctccttctcaactgaaatacacagaaggcattacttattacttgtttcgtgaccttttgtcttaccttggttgtccttttcttccaattccatagtttatcttctctcctacttacctcctgaacttatccccaacaaatgttacatatttcttttactttttgagttttcttggcctgttgatgaatatattgacctagcatagcccttgccattgcattaggtaccatcattgttggttttagtactagaaaaactcaacaaagaaggaatattttcttggtgatgctccagagtgaatttaatattgacaatcaaatttattcaagtcactagacaggatgattccttttgtgattgggatttcagctgggatagaactgagatttggatacagatggtacctggcagacgggaataaatgtggggctgaaatgccacagaagcagttagcagtgtgggcctatctgggggtggcctgaggaaggacattcatgaggggggagtaggtggggatgggaaggacaaaaaaccgcattgttaaattaattggcatgacaactctggcagtggggcctcacggagaatgaatgatatgcagggtgtggtgtatgtatgtgtggaaaatagaaaaatgtggtgtgtagaaactggaagaactgtctccctgggttattttaacgttctgcttcagagtacaagcagtttagctgtgggaagcccccacccttttccacaggagagggatggctctcatttgacacaagctgtcatgcttgtaggagtcaggattgttgcacccagaaatgcttgtggagggtcttgtaaggggttgagtgcctgtaagagcatctgggggcttagaccggtggccctcaaggtattaattccttatcagtgtgttcccatctacacccatggctggtgtggcctaaccaagctggcttaccttttagaagtttctttttattatctcctcaagagtacatgctctggcttcttggcctggcaggctttcattacttacatgatacatatatgtactctttgataatcttatgtttttgtcccttgtaagtttctgcaattgtatactgcattgatgaaggagggtctgctctcctctcccagggtgtctagtgatggcctgcatgtctctggtctgtttattgccaactcaagtaccttttttgccattccatcgtgaaagaaatcaaaatatagcattttgaaatacatttgaaatgttctgtttaaggatttcactttagttatactgtttctactttatattacaaatctggtttcctcttccatttgcctatatctaacccattcttagtctttttttttttttttttgcatttgcttttctgaaaatttgagcattgaaagggagggcagcttgatcatggaccagggctttctgagaatgcgaaaaaatgaatttcaccttgccaaatagaattgcctggatgtggtggagggatatgatgaggcagaatcacaattcttctacacttttgaaattgttctccccaatttattccccctttcctcattctcttctgatgtatgggtttaggaagctccggatgactgtttcacacacgcactcccctctcattctctcctgcccgtccttcccaccgcacacatgcgctgaaggaggtgagcattctggagacctgagtctcatttccagatatctttgccatcgtttgcagttacagctttttttttctatttttttccccctatctcttgtaagttctcatattatacatactttgaactgtggagatagccacaagtaaaataaaagtatatgtttttatattctatggagtaagaactcatgttactatagtaacatgctgctctgtagcagtcagaattgtgtatttcagtgtcagagttccctgttaaaaaattagccttaatattgatttcctcctgctcccaccttggttggtatatgaaaaccctaaagatgaagcatttttaactaatttttgttctttacacataatcagaaatcaaactaaatccatctgtgatgttagcttatggtctttctagattttagccaaagatcttgtatattttaagcagttgccctgttttaatattaatcatggccatcccagaataagtcctgcttgacacagggcatttgttcaactagttatctttgttaaaaaagaaaataccataagaccagtcatattttgctgcatctagagtgagaccaaactttataatatagtgataagcttgaccaaaaaaatgtttaacaattttggtatgtttcaggaattggagaaattagtatgttggtactgtaaggaaaaatgtgggttaaaaaaaaaatccagctaggactcagcagtcttaatttaaaccttgtgcttgacaaaaattgaatgttgcctgtatactccagacacaatcgtgaagctcagtttctgtatttttcttctgaaatttaacttctgctaatataacataggatatgtggatgtcttgcaatcctaaaattttaagatatttcagggcttatcaactgaaggctcttgaaatgaaaactactacatgtattcatcatacgtgaaataaaatctttttgaaactaaaaatcctttaaaaaattcacaagcaagatgatactatagaatttcttttgacagattccttagaaacgtcaaaatcaaagtgaaaacaagttggaaaatcctctttgattttgctgggtcacttaatttgagttgatttcttcagagcacataacgtttcttaaagtacagtactaatgacagagtcccaggtggccagccttgtgagctgcgaactttgtcctgttgtactacctctggctctagagactcagcctaggaatgtgaattggtgagaatatgtcagaacctggcttcctattgtaggaactcagtgcacttatttggttgatactgagtcgctataaaaatcattgacatgaatgacaagttgtgtttttttccccaacagttaaagacattttacatacagtatgtgaagttactttccaaagaaacattcttcatgttttcgcaagtttttttttaaacctaatatttaatgcaatgaatgtgggttggtttctcttcttccttcttccttctcctcctcctcctccccctccctctcccctctccctcccatcccctcccccctccttcccctccctcccttccttccttccttctccttccttccttccttccttccttccttccttccttccttccttccttcctccttttctctctctctctctctctttctctctttgtttccattgtaaacatatttgcaggattcagaggtgaaactgtagcggaatgtatacacagaagctctgcttatacctttgttcccccagcctgtttgccctctccctctacaggtcatcatttttattagcttctttctaaagttttttttttttttcacttaggtgccacacagcatcgagtgaactattttaaagtgaacagttgagtagtgttgaatacatccagagtgctgtgtgatcaccacctctagttccgggacagtttcatcccccaccaaaggaagtcccatacgtattaagcagcccctaatgaccatccacccgtgttctgcttctatggatttatctattctgaatattttatatacaggaataagactttgtgtctggctgcttttgcctggtgtgatgtttgaggttcatctgggttgtgttttgtcattacatcatatctttttatgactgaataatattccattgtatgtatgtgccacagtttgtttatccattcatctgttaatggatatctgtgttgtttccaccttttggctattgtgaatagtgttgctgtgaacatgtatgtgtgtttgaacacctgttttctcttctttttggtatatgcctagaagttgcattactgggtcatatggcaatcctgtgtttcacttttcaaggaaccaccaaactctctcccacagtggaaatggaacaatttccaccaacaatgtagaagaattccagttggtcagattgttgcctacacttactttccttttttaaaaaaaattcagtggcattcagggatcttcataatctgagctttgttttcctttgcagtgtaatctcttcctggtttcacatgccactttcagaatactggattatggtaattgcactcttttgctcccttctcttcacctaatgtgttgtccccacctgcccttttcccccacccataagaccttgtctctgtctctgtcgcccaggctggggtgtggtggtgtgatcacagctcactacagcgtctacctcccaggttcaaacagtcctcccacctcagccttccaagtagctgggatcacaggtgtgtgccgccacacctggctcatttttgtttttgtttttgttttgccatgttgccgaggctcgtctcaaactcctggacccaagcaagctgcccatctcggcctcctagagtgctgaaattacaggcgtgaaccaatgcaccagaccaggttttgcccttttgtttgcaggtccctttaactgtgatgctgtctcctagcccccttcccccactcgaccgagggccaggcaaattccaactcatttgctgagtttcagtcttcaccaagtctgtgaacttcaaaagacgttattcattgttacattccctgcatccggcacagtacctgatgtctgatgggaacccaatacatgtttgagtgaatgaatatgttgtataattcttttttctttatcacgattgctgctggtgccgattgaatttccagagcttgctgtaaaagataggaagaaaatatgtggtaacattggccagtgtttgggccataagatgtgtagaggttctaaggaaaaatacacttccaaactcattcacattgctggtcatgttcagttcctgtggctgtaggactgaggctcctgttttcttgctggcagtcagctggggccacacactgcttctagaggtcaacttgaattccttttcgtgtgccccactccatcttcaaaccagcaatggtgtgtcaggtcctttgtatgctttgagtatttctgacttacgtttttagttggagaaactctgggttcatgtacctagatcaggtccaccttaattatttccctgccttcaggttaaatgtgctgtagaatatgacattgtcacagaagtgagatctcatctttagttacaggttccagagtatggggcagaacatttttgaattctgcctagcacagtgtttatagtttattgatctgtagataggttgggtaaaggttcttcttcagccagtaaaatgtcatcttctctgtcttttgattgcagggtttctattacctatgtccatttctttaagccgtttggtctcatattcctctgtgtgttacaagaattgtatcatgttatctatttcatgtagaagtaagcatgagagaaatgagtgtaaatgggctgttggccctcacagtaaaatctggtatctattctagggagatactcatgtttttctcctttttcacattgctgtcgtagggtcagattcatttttcatggtcatttttctggttctcttttagcatttgaaattgagtagattgttttgattgtaagaatgttttttaaaagtaaatttttattaaaatgtatatatggaaaggaagacaaatagtatattgcttgataaattttcacaaagagacatgcacatgtaattaatacccaaatcaaagcattagaatatttactagtaccctagaagccttacctactcaatagctcccttaaaggcagttttttgcttgcctgttaatttgatgaactttcagcctttgaaaagtcgttacaaaaagccgatgtgtaaaatgtttggaggataggataagaataggaggtggctcttggaagtttgtttgctcctgagtatgggacctagtgatcaaagatgaagtggaactagatactttatcttccctgtaataggaaatacactcccattgtataactgtaatttttactcataaaaatgggttttgcactcaaagcaaaagtaggctcttacttttactgttaaaatagaaactggaaaactgttctttagaaaagtcatcctaatgggttcaatttgaggtagttgctggtttttatatttttatttttttgaccagtgctttaagtttttctcctgtaattttattaaacctatgcccaggaaaaagtaaacggcaagatttcagaatctgaaagtttcttacgtttgaaagaaagtcctcccatgcttcatttttcctaacagaaggtaaactttccatgctgaacttgtctctatttttaacagaggacaagctttaggaaactgtattcaagccacatatagtgtggtagattctggtggtggagcagctattagttatgtttctctggaactgcatttatcatcactgttaccaaaagcatcctaggttccttgggaagaagatcttaaagttctctaccaaaccactttttttttttggtgatgcttcagtctcacaggtgatgcttaaaacacagattctgatgtggagatttgagatcttacaaccatagaccatatgttaaacattgactacacaaggattcgtgatctgagcattaatagcctgtttttttcctaattgcatgttttatagtaatcctaacctttaatatataagatcctaacctttatatttaacgtcttaacctattgctctgtatttctttaatgccatggattattgcttacagttataaatgaaataagtaattttactttatattttcattgatattcaacgaataccaatttaaggagagaaacatagatatacttttaaagaatttaagcgtggcacttaagattctttttattataataagcatgtgaagaagctctttttctgtaatcctagttcccaggggccaaaatgatgattaattacagacaataggtttataaaagtaaccgtttccatcatagaagtgtcataaaagattaaagggtgtatcaacaaaatgaaccagcttcctgtgtaaaattattaatattgctaaataatgtagccttatatctgttacaaaagtaccagaaaaattgctggataatgtgttacaaattttttacaaattacatagataatcctcagttctgttgaatttctctgacattctgctcaactagtttttcctgtgcagaaaaatcttaacaggttgatgttacaggaaaagtggcatgcttttagaaaccatgactaggctgcctgaatcaaacatcctcccctttgagaggcctaggaaagaaccatctcgcttggttgtatccagggtacactctcatagggataaagagccaaccaaataaaagggcagacatatacttagctgtacctatctatcctaatgtgtgtatatatagtgaagctattgtacaatatttcttaatgtaacttaataaggtagttagttttttagcctcctaatggcttagtgtttataaaaatgatactcgttcactgcaaattgtagagtatataaaagtgtagagaaagtagaaatcaacagaaatccttttccctcgagataaccgttgtgaacattttggtgaacatgtttctagaaatctctatggttatatacatatgtaaaagtgtacatatctaatgggatcaaattatatgctgttttgtattctctcagtccacaacttgccagttttcaaatctgtaaatgtagatatatattattttcaatggatgtatgctcttccactgtgagtcatagtttagtttactctgatatcactagacattgaagttgttttagttcttcattataaactatgctatgatgaatacagttgtctggtaattctgttagtttagggtaaatactttgaagtaggattgctggctcatacagtatgtcttgtttcccgccacagagctgccctttggaaaggtagtgttagtttacacatccactgagtcctcattgctacatcttctcaccaacactgctttctaaattaattatttcaattcatttattttttatttaattttttatcatggaaaatgtaaatacatgcaatggtagagtatgcatctatcactcagtttaagtaatttcaactcatggctaattttggttcatctacatcccacctgttttccttcttttcattttgtgaagcaagaggcttctcaggctgtcatttaacctgtgatacctcacttttatttacatctgtttattactgaaatgagtattttttaaatatacttactgggtacaaagtggttataaactttaatagtgagttaattgattttcttcctgtgggtttacaccaattgcaaaagtgtaatttagctcttaggttgaataatcttaagctgatttaatcttaagtcagatgtaaagataatgttcagttccagaaaggtaaccagactctgagctggttaggtagcagctgcagcgtttggtcctgggtgtgacatcttaagaagaatattgacaaatgagcatttccagaagagagtgaccagcatggtgatattagagaatagtgtcacacagggaatggttgaaggaaccaggtggggatcttcagtttagagaagacagaaatttgagggaagaggctgatgaatggagacagctatctgcagatttgtcatgtggaaggtttcagggataacaaggaagaagctgctaattaagtagcaataaattttatctcctctctggctgcttagcttttattgattttatttatatacagctgctggaagcaagcgactggttttgtgattaaaatgatgcttttgggtttctaggaaaccctgagatgatctttgtcaggttttacttcacatacccatctctccaaacagggatttagcgttgagatttaaagcggttttgccatataagaaaatatttttcagtagagaaaaataatattccaactgaaagctgtccagtataggcccagaatcccatatctgtagttccaaaataaaaaaaaaatcctgacagcagaatgtttcctaactcatttagaagcaaaacttgacctgaatgactgtgtctttatttatcctacttgatgtgaatattcatacatttctttgcagaaatagtaatgtgtttgattacggtatgcttttccataccccaggaatattatgtaatgctgtaattacccatcgaaaactcatgtctgaattcttaacacttctggcacagagggtgtgtatacctatagttgtcgttctgtcgtatgttgaattatatgcggtgtattttgataccctatcactatgcatgtgtaaaaagggaatgatagtgcttttcctgtttgtccctctggaggctgtgaaaattagattactatgtggagcatattcagaatagaactgcctaaaaataacgtgttactggtatggtattcttattctgtgtgtgtttaactttctgcccgaagataattgggaagaataatgtggaaatctgtagttgaaatattataactgttgaacaaagagatgtcttccagaggcaaaatgacaaatgatatttaaaaaatattttcactttatccaatctgattagtatattgtggtgttattttgaattatttgaaatgaagtaatatatcataaaacagaattaggcttattttaaggtctacacttatgagctcttacaatttgcttttagatatatatattgaagttacttgtaaatgatgatgatgatttcattttagatcatgctaacattctagttcagatgatctgggttgcttgtattagtgtggcaagacccaaacttcacacagaaaggaaaggcagtatgatttctaaaatatttacttatatatataaaaaaacttggttaaaatcaaacagcagaaaaatgtattacataaaagtctccttcccctaatccttgtactcaaagataactggtatgattttttttgtgtatttttttcataaaatctttttatgttagtatatatttcaaaaattcatacaaataggatgatgcgctctccatttcatccctcttttacttatgtgccttagaaatctttccatgaccacacacatagatctattctccttttagtgactgaagtattccacatggactatacagttcagttagttcaggtcatgggctgttaggttgtttggttgtcttttttgtttgttttaaagtaagtagaagtgatcatgcagtgaacaactttgtgcagtttgacatatttttctaagaaaatcaaaaggtagattcctagcatggaaatgtaaggaatcatttaaatatactgataatgctggattacccaaaccaaaggtctcatcaatgtagtcttttacgatgttcaccgatgccgtttatcccctctcttgctactgctagacattatttaagtaggtacgtctttaaatgcatttttcatttaaattaatttatattttgttaatgacaaattaaatttgaagaaaaggttatatatgtatgaggcatatcattttacattttgcagataatggttggtactcatttaagctcccaaaactcttggttctaaaccacgtccatgaggcactctttgatgactctggggaaaagcagattctttcctctcttctcattttgatctccttgggaggaaacaagctcctttttcacatacttttttgaaaacagctttattcaagatacaattcacctaccatataattcatctattgaaagtgtacaattcaatagtttttaggatatttagagttcagagttgtgcaactctcagtagtcaatttcagagtattttcttctccctaaaagaagcctcacccttcttagctataatcacgccacatcttcacaccctaccctaggggaaccattaatctactttgcgtctctatagatttgccttttctggacatttcatataagtagaatcatccgggatgtcatttttgactggctgctttaacttggtgtgctgttttccacactcatccattttgtggtatgtattactacagttggttctctgcattggtgcattctacatctggtgttcaaccacagattaagaatacttaaaaaactgcatctgtactgaacatatgcacacttatttttgtcattattccctaaccaatgcagtataacaactacttatatagcatttatactttattaggtattataagtaatctagcgatgacttaatatatgagagggtgtgcatagcttatatgcaaatactatgctgttttatatcagctacttgagcattcatggattttggtatgcataggaggtcctggaaccaatccgctatggataccaagtagatgtctatacttcattcctttttatggctaaatagtatttcattgtatgtatatgtcaccttttttttcccatttaccagttgattaacagatatttgggttattttcactttctggtgtctgtgaataatgctggcacatactgatttcatgtggacatatgttttcatttctcttgggtatgtacctacaggtggaattgctgggtcatatagtaactgtttaagcatttgatgaactgctagtttcctaagtggctgcattagtttacatttccaataccagtgtgtgagggttccaatttctaacacttattttccttttttaaaataatcatctcctgtggtttaaatgtgttccctaaattttatgtgttggaaacttcaccctcaaattcatatgttgattggaggtgggcctgtgggaggtaattaggattagataaaggtcatcagggtgaggcctccatgatgagactgttggctttgtaagaagagaaagagatttgcactgacatgcatgtgtttgcattgttttgtcatgtgatgcgtcttgccatgtcatgatacagcaggaaggccctcaccagatgccagtgccatggtcttggacttcatagcctccagaaccatgagctatgtcaacttttctttatgaattacccagtctagggctaggcacggtgactcatgcctgcaatctcaacactttgggaggccaaggcaagaagactgcttgagaacaggaattcgagacaatgtgggcaacataacaaaaccatttcgcttaaaaaaaaaaaaaaaaaaaaaccaggtgtggtggtgtacctgtagtcctatctacttggaaggctgagttgggaggattgcttgagtccaggaggctgcagtaaactttgatcctgtcattgcactccagcctggatgacagagtaagaccctgtctcttaaaaaacataaaaatagggctggttgcagtggctcacgtctgtaatcctgcactttgggaggccaaggcaggtggatcacgaggtcaggagtttgagactagtctggccaacatggtgaaaccccgtctctactaaaaatacaaaaattagctgggtgtggtggtgtgcgcctgtaatcctagctacttgggaggctgaggcaggagaatcacttgaatctgggaggcagagattgcagtgagccgagattgcaccactgcactccagtctggcaacaaagcgagactctgtctgaaaaaaagaaaacaaaaaacaaaacacccagtctatggtgttctgttacagcaacagaatatagacaagtgcatgatcctaataagtgtgaagtggtattttgtggtttttacttgtacttcctcaatggctaataatgttgagcatcttttcatgtgcgtattgtccatttgcatatcttctttggggaaatacatatcagatcctttgcccgttttttacattagttgtcttactgagttgtaataattctttttatattagatataagtgctttatcaggtatgattttcaatctgtgggtcctcttttcactttcttgatggcattcattgaagtgcaaaagcgtttaattctgatgtccactttatcttttgttgtgcttttggtgtcatatctgaacacaagtctttaaaggatgaatttgcttggtgaaacacctttcctttggataccaggttcataagattggacacagtcaacatttttttttttgatctcaatcacttattccttgaagataatctcagatgcagcttattttaaggcagtcccaattagttgactttcagatgtgttatttggaaatacttttaaaggtattttgataagaaaatttaagttttacaataaaatgtaaccttgcaatgtagctttgcattttatggtaaacattagttactgcttactttacaggtactaaaaatcaactacttcaatttcagaatgtaactttctcatgccttattttatttcgaccagtattaagcctctttatgcttagaagatggtgttgaatctgtttcaggttaaaaaatactttattcaaactattattttcttaaaagttaatatgtctaaagtttttgaaagacactgatcactgagatgtttggagatttaaactggtttatttttggttatccatggaaaactttaaaaaatttctttattgaattatagttttaagtctccttattttattctcgatgattaatgtacagggcgtggcttacttataagtgtgactaaagttgtgcaaattaatcctagcagggctccatcctttaatgtcagtgccgtcagttgttctccccttattcctattattctggcattatatcttatctgtatgtaaattcttattctgtgggtgaaaagggatatggttcaacaggatccaagaacttaaaaattgccctttttcacatttctcataagtagtaagtctcctaaagcgaagtcagagtcattataaaggcatgataatggagtctgttatctatttggaaaaacaacttttattgccatttataataaatgtaaatggcctgccatttattttagaattactctgtttctaggccctagaaaggctctgcattttataattaaagttagtagaggctagaagaacttataggaatgtcataatgtgctgtaggggacagtgatacttttaaaggttctgacattcagccagtaaggtgcttctagttccagataacttcttttccccccaggaatagatacagaaaatatttttggtaaatctgccaagttttttatgtgattctcattatgttaaattttattatcagtgcctaaataatgctaacattttaagttaaacagttattcagcttaccactttgacattaccactgattagaattgaaggctaagttgagcctggggaacgagcctctttgtccagaaaagggctcttagatttttccctgtcagtgtattgtaaccttttataagggcagcgccaagaaaggagaagctgctacttggggcattgtgtttgactttggtattctcacaggtatgctgtctaggaaagagttcaggtctcctgcttaagaaattgggaactaggctgcttcctgtggttctgttgctttgtcgggggagggagggtacctgatttctactgaaggccaaaatgcagagtcaatatggccggttattggcaaaaattatgatatttagaaacttttggaatgtctgcaatgttttctagacattctagggaggtcactggtgtttggaaagtacatacaaatggtgtatgaaaggagtgtgccattttctgcagaggtgttcgttacatttcataaccttatgttgccatttaatgaggtcaaagaggtttcttgactgtgactatggaatgcttatcttttgttctgtcttgatctcctcctgtctgtgtctctcattatctctgactacttgtatgttggcagtggctttatttcctttcacactcagcctggattccaggctcatctctaactcctacatcagaaccctgaactggcttgtctgttttgtaatctgccctaccatgcatacccctaacctagcacaaacgccctacccttcccttctcttgtacccatgtggctcagcacttctggataaattagaacaactttgacgatggtattggtcagggttcgattatcgaggacagactctaattcttcctactttaagcagaaagcagtttattacagggaattaaatttcttggtgaattgttgagggtacttagaaacgctcctagcaggttgtgctagagtataattcccaaggctgccctgtggaactggactgccagggtggccagcatcctagcccaggcatggggctgctgatttggctgttgctgctccactgctggccccagaaccacaccaccttggccgctgtccacaagagtaaagtggctacatcacacttagtttctctccccacttagttcagtttcattcttaacccagttggaccataccatttgtgttttgcatggttcatgtttatcatgatctgaaggaacctaaatctagagcagaaccccaatgtggtttttcagctttccagactctgcagagctagaaggtgggagtagattgaagtgagtcaatctgcagtattttccacatttatggtttccgagtatagctggctcttcaagattgttttgtagtcctttcacctttccttgataggttgacttgtttgctgatgaaagcagcagttctcattctacgctggcctctttcattctcattagatggtggagcctacgcttgagagaagaagctgtcgggtacgaactccacttaattgtcctcctgttcttccctgccgtccctttcaaatgaccacaggtagctgtcatagccccgtagagagtgtgagaaagcacaggcaggagtcagcaaggttgctgggaggactgaggctctcggaggtggatcctggaggtgagagggccaggtgtgaggacaggagcacgttccagaggccccacgacagcctcgcccagcacatggcaccattcttcacttacaatccagggcactctactttcctgtcttgctggtggcagctcattctgttcccttcgttgaatcttcccttcctatcctcaggttcagtccttattctgttcttgacttctctttgtggacaatctccttagtttatctctagcttcaacctttcccagaagtctagaggtatatttccaatggtcggtcatcttagatagctcataggcttctcacatctaatatgtttgaaaccactcttgatttttcttttttttcaaatctctctcacttagtgtctcccattttaataagtggctttatcatttacccagtaactcaggccccaaatcttggagttatccttcattttttttcttctctaatttatcaccctgaatcccattagtaaattctgttttctctgcttttaaaacataccctgaaaccagtcacttataatcagccttattgctgccattccaggccaccatcatcactaataagccttataaatggtggccctaacttttaacttctgtatccagttgccagagtgacataaacctaaatcatgtctttccactgctcacttagattataaatactattgcacttagaatacaatttaaaatccttgctgtggcctacaaggttctgtgtggatggtcccagttatctttctttatttaccccctaagcattatccacctggcttaccaagttacttccaagctgtctcctgattgttctctatttaaaacaactgctttattaacttactgggataagatacataatggtacttatcttttttttttttttctgttccccagtagactataagcttcataggtaggaatgttattttgcttcttgtgttatcttttcttcacctggtacatagtaggtgctcaaatatttgccaaatggaagatggggacagggaaattattctacaggtcttgtcttaattggaagattgaaggataagagggtctttgtggagaaagtagtctgtaagaaatagtagtaaaatatgggactgatcactactgccaggaagaggaaagtaagcactagaactttcaaattcacagaagcaaaaatgaaatgaatagtaatccaaccagaccagtgggagtcaggaaaggaaaagtagaaactgcaagatagaaaagaaagatgaagaaatgggaatgggccagagatttactgtcttaccaaggtggagcagccccatttctctctaccctcttaggactcaaaatccctggacttcatataacaaagaagcataggaagatgctgaaaggtggagagaagactgtggccactctagagtcctggggacttgagaaatgacaagggtgtcagttcccctccttactatctcccacatgtctagtacagggcactgcagaagcctccatccctgaaccaccagtaggcacagacagcaaaactctgagaagagcctgttccccatagccagaggacaggggaagggagggtggtctaacaaaacagagcttttgtcagtactcactctgctccagctaaaccaaggaaactgccctcctcccttcccaggcttcgagagcaggcagcatgcttcggttccccacccagaggctgaaggcatgcctgagcagagagttaatctttcatatcctgcctggcagaagcaggtggtacttcaattcccctgtcaggtggtgctgacagcgcctagtggggagctgatcttccaccctctgcctggtaggagcaggtgatgctctgacttctctgccagggtagtgtcagcaaggcccaggttagggccatatccagcccccaccagccacaatgaggtggtgctagcagggggctaattaccattacacttgacctcttccatccccatcatcccctggtggggaggtgtgagcctccacacccactggtggcaaatgaggtatggaggagcggagcatgctggcactccccacctccccgcccctcctttggtataaatagggcccccgggggtcctgaacttctgctcctggatgcagcaacaaactggcatggcttagcccttggctttcccttccctgtggtagcttggcccagagggtagctgatcttacacagaggcaacagaaatggtgagttggagccacactttggctgggaaagtgtcagtgagctgaactctcaccccatctgtctgcaacaaggcaatgtgagtcatcaccccacttttgtcagggtgatggtggggagtggggggctagtgggtaactgaatgtgcatacccactcatccctggtattaatgcctttttagcagggaagctgcccactaaaagattaaatttgatctggggtctcttaatatcaaaaacatataggatacaattcataccaatttatacaattctacagatcactcataccaagatccaggaatatcacctatgaatgagaaaggaccatcagcaggtgctaactgatttatctgacaaggatttgaaagctgctatgataaaatgtttcaacaagctattacaaattcttttgaaacaaaacattagaaattctcagccaagaaataaaaataatttattaaaaaccaaaaagaaatgatagaactgaaaaataatgatagtttaaaaatactgaatgggctcaatagagtggcaatggcaggctgagaatcagtgaacttgaagacagaaaattagaatctgcccaatgtgaaaaaaatagactggaaaaaaaaagtctcatagacctctggagtgatgataaaagagataacacttgtgttgttgcagtttcagaaggaaagaatagagtgggaccaaaaaaaaaaaatctgaagaaataatctgactataatttctcaaatttggtgaaagacagaaagctgtagatctaagaagctgagtgagccccagacaggatcaacccaaaggaatctgtgccaagacacatcctgattaaacttgtgcaaggcagatacaggaaagctactgaaagtagctggagtttaacaatgtgtaatttgtaggggaaaaccagtccaaatgagaggagccttctcatctggaatgatggtggccagaagaaaagcagcacaacatttttcaagtactgaaagaaacaaccattaaccaccaattctatatgcaacaaaaatgtctttcaggaatgaggggaaaaggaaaactttcttgcatgaaggaaaacaagttgtggttggttaccaagcatacccttaaaaactaggtaaaagttctttaaatgaatggaaacgaaaacataaggctctgaatttcagaaaggactggaatgggcaaatataggggcacatgtaatagactttttatgagttatatttggttgaagcaaaattttaatgtaatatgatgtagtaaatatatgccgcggaaatatttaagacatgcttaaaaagtggggaagggccttttggctggaaccaaccatcttctgttaatttgccaaaatgatgaacgacaaagagaaaagggagaggcacctggtatgttctctaggccttttagaaaacatggacttgttcttttggccacatacctgcaaatctataagaaagatgatattggagacatcaagggaatgggtactgttcagaaaggaagccccacaagtgttaccatggcaaaactgcaagagtctacgatgttactcagcatgctgttggcattgtaaacaaacaaggtcagggcacgactcttgccaagagaactaatgtgcgtgttgagcacattaagcactcttaagagccaagatagcttcctgaaacatgtgaaggaaaatgatcagaaaaagaaggaagccaaagagaaatgtaccagggttcagctgaagagccagcctgttcccagagaagcacactttgtgagaagcagtggagaggaacctgagctgctggggtgtctctcctatgaatccatggcatgataggtgttaaaaacaaacaaacaaacaaacaaaaaaaaacaccaaaacaagaaaatactctggactgtgtttaaagaaaaaaaaaagtggggagagtaaaggcaacttacatggaagcatggaagcctgtttttcctattttgcttgtgctggtaaaaatgttgataccggtagagtgtgataagttacatatgcttactgtagtccttagagcagccattatgaaaactggtatactcgagcactatgaataaatgaaggtggaattattaaaaaattgacataatccacaggaagaaaggagaaacagaagaaacaaaataacagaaataattaaatggcaggcttaggcttgtcatactaataattggcttaaatatagatgatctgaatacaccaattaaaggatagagattggcacagtggttaagaaaacatccaaaactgtgttgttcaagaaattctcttaaaccaatgacacaggtaggttgaaagtaaaggatggaaaaagatatgccatacaaacatgaatttaaacaagagtggccatattaacattcaaaaataatttcagaataaattaataaagacagaggcataaggatcaaataatgaacacattaggaagacatgatgatcctaaatatgtacacaccaaacagaacctcaagatacatgaagcaaaaactgagctgaaaggagaaataaatttaacaaatactatatacatataaataaatgtaataaataactgaagtcttaaacaccatattcttagcaattagtaaaactatacaccaaatcagcaagaatataggacttacacaattgaccaacagaatctgacatttagaacaatttacccgaaacaatagaataccctactttttaagtgcccatgggacatcatagacattattctgggctataaaataaaaaacgtaaaaggattgaaatcctacagaatttgttctgtggcaataatggaatcaaactaaaaatagtaaaggcaacaggaaaatttctaaataacacatttataaataattcatacgtcagtctcaaaggaaaatattaaacataaaaatgaaaatatgttattaaatatgtgggatgtagcttaaagcagtcccaagagggaaatttatagcactgttataaattaagttgaaaagtggaaaggtctcaagtcaatttaagctcctacctcaagaaactagaaaagagcaaaacaagcctaagcaagcagaacgaagagcagaagtcagtgaaattgaaaagaggaaaaagaaaaatcataaaaatcataaaaagttatttctttgaaaagatcaatgaaatttagcaagactgacacagataaaaaggaataagacccaaatcagtgaacaggaatgaaatagaggatatcactacagaggctgcagccattgaaaggataattaggaaatcccacagataactttgtgctcataaatttgacaatgtagaggaaatatctttagttttaattagctttttattttagtttttctcaaaaactaaaacttaataaaactcaaccaagacaaaatagacaatcagaatgtaggcatacctcagagatgtggcggatttggtttcagactactgcaataaaccaaatatggcaataaaaggagtcacagaaagtggtttcccagtgtatatatataaaagttacatttactctatgaagtgcaataacattttgtctaaaaatacacacagtaattgttgctagaaaatgctgacacaaagtgagcacatgctgttggaaaaatggtgctgatagacttgctgaaagcagcgttgtcactaatcttcaatttgtaaaaaaacaagtaaaattaaaaaaattggccaggtatggtggctcacgcctgtaatcccagcactttgggaggccaaggtgggtggctcacgagctcaggagatcgagaccatcctggctaacacggtgaaaccccgtctctactaaaaataccaaaaaaatagcggggcatggtggcaggcgcctgtagtcccagctactcaggaggctgaggcaggagaatggcatgaacctgggaggtggagcttgcagtgagctgagattggaccactgcactccctggagcctgggaaacagagcaagaccccgtctcaaaaaaaaaaaaaaaatcatctatgaagcacaataaagtgcaataaaacaaggtatactgtaatgttaaagccattaaagaaattgaattcttaattgaaatgctcccttaaaaaagaaaaaatctctgggtccagatggtttcactggacaatttaccaacatttaaagaagaattaacaccacttttattcagtctcttctagaaaacaggagagaagacctagaaaacaggagagaagacctacaaagtcattttgtgagtctagtattaccctgacagcaaaatcagagacagcaaaaaagaaactccacagttcagtatcgctcatgaacttaaaggcaatgatcctcaagaaaatattagcaaatcaaatagagtaattaataaaaaatatttaacatgaccaaatgagatttatgccagccatgcaagactggttcaacgttcgaaaatctatgccacccaccatatcaacagaccaaagaaaaatcagcatctatcagttgacctataaaaagcatctgacaaaatccaacattcattcatgattaaaaattcagaaaactagcaataaagaactttctcaactaaagagcatctaacaaaagccttctccagctaagaccatacttcatgatgaaagatggaatgtctttcctctcaggttgggaacaaggccaggatgttcagtcttacctttgctgtccaaaacagtagtactaaaagatatccagaccaaaaaggaggagcaaaacagtcccagtttacggattacatcattgtttatcctaagaaatctagaaaaaaaacttcttgaactgaggagttcaacatagttgctgcatacaggatcaacacaaaaaccatgtttctataccctaacaaaaaatatgcagaaactgaaattaaaaacacaatgccatttatgttctaaaaattgtgaaaaagatacaaacttcaacatgtgtaggatatttgtgctgaaaattacaaaactgatgaaacaaatcagaggacccaaatgttgccacaaaccatattgacatactggaatattcaacacggtaaatgtgtcagttctccctgaattatcgtagcttttatgcagttcctatataaaatcccagcaaagatttttggtagatacataaaaaggttattgaaaaacctgtatggaaaggcataggccccagaataactaaaacgatctagtaaaagaataaagcagttggaatcactctactgatattaaagctttcccttatagtgatagtaatcaagatacacagatcaatgcggtggaacagagaactaaaaaaatacataaatatgccaaattaatttttgacaaaggtgaaaaagcaattcactgatagattattcttctcaacaaatggtgttggagcagaaattggacatccatagacgaaatgatcaaccttgatctaaattttatattttatacaaaattaactcaaaatagattatggacataaatgtaaaattgtaaaactcttaggcaaaaaaggagaaagttagccaggtgcggtggctcatgcctgtaatcccagaactttgggaggccgaagtgggtggatcacctgaggtcgggagtttgagatcagcctgaccgacatggagaaacaccgtctctactaaaaatacaaaatcagccaggtgtggtggcacatgcctgtaatcccagttactcaggaggctgaggcaggagactcgcttgaacccaggaggtggaggttgcggtgagccgagatcgcatcgttgcactccagcctaggcaacaagagcgaaactccatctcaaaaaaaagaaaaaaaaaaggaagtcttcagaatccagaactaagcaataagttcttagtctttacaccaaaatcacaatccataaaagaaaaacttggtaagttagaaccagttaaagactttttctccatgaaagagcatattaagaggatggaaagacaaggtacatactagtagaaaatattttcatctgtctgccaagagactaatacctagaatatgtaaagaactttcaaaattcaataggaaaaaacaatccagttggaaaatggacaaaagacatcaacagacttttcaccaaagaggatatttaagtggcaaataatcacagaaaaagacatacattcagtattactagccattagggaaatggaaattaaagccatagggagaaaacttctgctaaatggctgaaaaaaaaaaaaaagcaccaaatgttggtgaagatgcagagaaacattgctcatacattgctagtgggaatgtaaaatggtacagccactctagaaaacagtttggcggtttcttataaaactaaacgtagaactatgatacaacttggcaagtgtactcttggatagttatctcagagaaatgaacacataatcatgcaaaaacctgtacaccaatgcttagagaagctttatttataataaatacccctacacaggaaacagcccagatgtccttcagtgaacgcattattgaaccacagtacttctgtatcatgattacttctcacaataaaaagggccaaagtattgatgcacctactgtgaatctccacatcgagtgataaaaagcctattctaaaaggttatatgttgtataattccattgatgtaatatttatgaaatgacaaaattctagaactggattagtggcttccagtggctaaagagcagaagagagtaggacggacatggatgtggctaatgaaagagtgacatgtgggatccttgtggtggtggaaatactctatcttggctgtatcgatgtcaataatctgtatgtggtattgcactagctgttcaaagtgtcattgttgtgggaaacttggtcaagggtgaatgggatctctgtagtatttcttacaactgcttgtgaatctgtaattatctcttaataaaaagttaaatatgaatggactgacttctattagaagacaagattggaaagtgccttaaaatacaggtgataacaagtaactcttcaattgttaaaggggaagatgaaagtgaagagatgggcaaaaagataccatacaaacaaaaaacagaatggcagtgttgatatcagatcagttgagactaacagttgaaagcagtaaacatattacggacatattattgataaaagacatttatgaagaggataaactgtgaaggtgtacagacactaaaccatagttgctaaacacatacaaccaaaaaaaaaaaaaaaaaactagaaatgcatgtatattttcactaagtttagttagatcaaacaaagcaataaaaggaatattttgtaccaaagcctatggacacagtgaaaactgtgtgcaggggaaaaaatctacagaattaaatgtcttcaggattagagaatacaaagtaaaaagtgaacaatgaaactccctacatgttcaattttaaaaaatgttttaaaaatggtggtaaaatatatcctaatttttcatctgaatcattaagtatacagttcagtagcatcaaatacgttcacattgtcgtgcatctagtctccacagctacttttatcttggaaagctgaagctctgtacctagctcaggatccaattttttttctcgttagttgtataagaaaattccgacttacttaagtagtggcagttattagcttttgagaacagtttctcttgcagtttcaagatgtgctttgcttatgttgatatggaagcttaaaagaagaattgtagacagtttatttccaggctgaataaaaatgtgacagttgctcttgttatcataaatagaagataccccaaaatttgcaacaaatgttaaaactgcattaccattctcagaataggtggatatcgtgttcttcttcgttgttgctggactggacgtaatggcatgctgatagcacgtttcaatcagatgggcctgagccctgtctagtgtataatttaccttttcatatatactgcaggagtgtccctggtagtaagttctgagagaatgaacgtaaaagttcagcagtcctaaattcagaaaatgatgagtggtgagcctttgtagttaatgacatgattactgccagtcttactgttgtacagtaataacaagagatgcttcatttccaggtccacacaagcacaaattgacctaccacacagggtagtgctttggggacaacttatgtaaaaatctgaatagtacccatctgattatgactgttgtgctttattacagattttaaaacatattgcaagaagttaagcgtttatagaagtctttgaagtcttgttgtagaacttcgggtctccacggaatgtggtttgatcactgctgcattgaagtacacagagggcatgttattaggaactgcattttggatttggaggattttattttcagataacttacggattttatagtgaaaatgcttatgctgatacctatttcctggtttctctgggacctgacttcttccagataaataatatcttcaaaagaatacattgaaaaaagatattgggacatgacatatgttaggaaacaaaaagagactgaactaaccttttaatataaacgtagtatgtcagcaaaccaaagtagctgtcattaagagatgagaatttcctgaaaaaaattacgtaaaatcctactcagtgatattaacacattaaatatatttaacttagacattcttacaataagcatgatttgcaatgccattttatttaaatggcagagaaaccccaccattcaataacatgagttatctttttttccaggaaattatttctgatttgaagatgggagtatagtaacatatcagggcttgtaacatgttttcagaaacccaaattccaggatggtggcacggctgaaaagactcctcagcgttatctgttttcccaggcgatgccttgccgtctctttcctgtttcagtgcttctctagagtattgcctcctcagtagtaaataatgttgttccatgaaatttgagatttttcatattgaatagcttctcgcagtaatgtttgatcctttatgatgcaggtcaccccatctagatgacacagcttgggctgccgtgacattggtagtcaggcgttcagtctgttggaattgcagtgtcatcacccactgcagttattcggttcttgttttctgtcttttaagcataataattaaaacagttcttttagaataaccccattgttagatgtttctggcacttgtactcctggataaaatgtttttgggtctaatttttaagatttagagtctcagtttttccacattgcaacttgtgatactgcatcctcttctgcttaaaatctttcagggaggttcctactgtcttaagaataaatttcagactcctgtgcatgcacaaatgctgctcataataaagctgattgtgccctgcatgtgggcaccagcgagaagaggagtcctgccagcttgtctgcagctctggggctggtttcggtgggtggggacctttccccttcactgagaggtgtcacctgggctagtggagctcctgtgagcctccgtgcaaggctgttcatctagcttcactttcttcctaggcttgtctctccttcctgccagcactacaacgtacgtatggtcctgatcgatgaagctacttcagattccacaagtgtgctgtgctttctggtgcccttgtggtaataacaatagagttaacatttatttatttttaatttttttaatagtcaaggtctcactctgtcacccaggctggagctcagtgatgtgatcatgactcaactgcagtctccaactcgtgctcaggcagtcctcctaccttagccttctgcacccccacacctggctaatttagtttctttttttttttttggtgtgtgtgtgtatgtgtgtttgtgtgtgtgtgtatatatgtatacatatatatatacacgtatatatatgtgtgtgtgtatatatgtatatatgtatacatatatatgtatgtgtgtgtgtgtgtgtatatatatatatatatatattttttttttttttttttttttttggtatagcagtgttttgctatgttgcccaggctggtctcgaactcctgggctcaagtgatcctcctgattctgcctcccaaagtgctagaattataggcatgagctactgcacccagccctgagagaattatttattctcctccttctctgctaaactaattggagagagtttcacttcatacaccaaagtctgcagttaaattcttgctgttccctgaaagactttgcatcttcgtgcttctgttggttgcccatgccattccctctgcttgctttcactgcctcttgcatccagacgttagccggttaagtggagttgtacttgatgccacttcttccaagaactcttctccaggtgcacaaaccagatttttttttatattcttttagcaattttgtagtactctgacaacacttggcacatatcttcttatactcttttgtatatggagcagtatttttataggtgaaagagtctaattttgcattattagtgtatatatgatatgttggataccagttggagatctggtgatgtcataaagctgttggtcttactatgcctttcccagaagtacctgatgaagttggaacaaaataacttttcacctattctctgattactacagtcaaggctccagaaccctagccattgggctcaaatgtgccgttgaaggtgattttctgttcctagatattttcaacctccctgtttcatttctgaccaatttttagggccagaggctaatccactagaacaatatttccctgtggcatggtttttaattttgttctgaatttagtttatattcctaagtggctttacaagttttttctccccatgccctcagaggaagttatgttcttctgaaccttctgggtaccattttagtaaattaagaattcagttcactgaatgctacccctgtggcctgaaagagttaatacaagtttcttaagtactttattaattctcagggaataatttatgcactagagcgtggcttagtatcgagccagttacaaacacattaaatatgtttttttttttttccttttgtgtagtaagtctctgaaaataagtggaggttcactttaagtgtaagtattttgcttcctaagtacttaaatatgtataattccacaatgagagaaggagtattataacagaggatgaggtggattcaggtcctagctcagccctgcacttctgtgaggccttggtgtgtttacctccctaaatgtctctcacctctaaagtggggacgatgtttacatcacagacagcaaagctcaatgatgatgcacttaggttttaatgcatagcccaggcttactgcttgggtttgattcttggcttcactacttgataactgtgtgatccgaggcaattttattaccctctctgactcagctttttccactgtaagctggaataatgctagtacctgactcacagttgttacgaaggtaagtgtgcagtaaatgtgagccattcatatacatcatggactactatgcagccataaaaaggaacaaaatcatgtcatttgtagcaaggtgggtgcagctggaggttgttagtgaattaacacaggagcagaaaaccgaaaacaacatgttctcgtaagggagaactaaacatcgagtgcatatggacataaagatgggaacagtagacacttgagactactagagcgggagggaggaagacgcagggcggtgaaaacctacctgttgggtactatgcccactacctgggctatgggctcgtctgcaccccaaacctcagcatcatttagtatccccatgtaacctgtgtatgtacccccaaatctgaaataaaagttgaaattgtttttcaaaaagtgagctgttattttttttaaatactcatttggaggactttctgagctgatcaagtgaaataaaataaaaagtgccaagtactatgcctggaacatggcagcaaacagtgaatagaggatgacttttgcttttattaactacttaaggtttatctatagcaagttccagtcttaagatgcacatgtgaaaagctgcctgtcacatgaaagagtttgatgccatgtagcttgtcatgttgtcagactctgtccctggagtgtgcccctcacgtttttgtgcatgtcactgtggcatttatgtgactggtctgcgcttctttctcctttttacccctttggctgcaggatgttgaagtgcacttcagttttgtcgttctcatttcccttctggattcttgctcctctcctacttctgctgcctccttcctcagtcccccattgccttcagctgccctgtggttgcagtttaaaaaaaaacaacaaaaaaaacacaacaaaacaaacacacaacagcctatttagatgtatacctttgactttatgagggctgtggttttgtgggaagagcagggtctcacccttattagactgtggttcataatcacttaaagagaacgtcattcttggagttactcatctgaaaaagaagcctgctcctccaactggaaggggaatggggctggggagggagggggttactgttggatggaactgtgcttggctattggacctgagtgactgaacacagtgtccatgaaggagctggctaggcatgtgttctgcggggaccagccctgtgagggcagaggactaagaagcgaaggatatgggcaaggaaactgtggaagtcatacctgcctttttgggccagagtacatgtatcttttatttttttttgagacgtagtctggctcggtcgcccaggctgcagtgcagtggtaagatctcggctcactgcaagctccacctcccgggttcacgcccttctcctgcctcagcctcccgagtggctgggcctacaggcacctgccaccacgcctggttaatttttttttgtatttttagtagagacggggtttcaccgtgttagccaggatggtctcgatctcctgacctcattatctgcccgcctcggcctcccaaagtgctgggattacaggcatgagccaccgtgcccggcctaagagtacatgtatcttaagaccacatcctggattggtagatacagaaggtttactccttgggcagtgctggactcttgatgaagtagcaggtagaggatgaagtttggggactttgtgcctctcacatttatgcctgctttttaatgtagcccaataacaaaaggtcatgctattggtgatgggtgggtaaggtacctactaacagtaagtttagcttagggagaggtaagccattttaagtctatcagtatataatggatcacagaaggagagagtgggagacactcagtctatcagaaaacataggatggatgtgccacagaggaagaagttgtcacttaacaatgagtgtggaaaaaaacaaagtttatcagtgtctgtgtgggcgttatttatttggggacagcatcctaaggcaggcatattcccacagtggaaatggatgtggtgtgatgccatgaacttgtgaagcaagtgagtccctttgttgtgattccaaatttactcagcacataactgattattatctgctccccagtgtagttgtagtgggacagattacattgcccagaagagttcagtattcagtcttcttggtggttattttgttgtaaattaataatactgatagtatgtcattttgctttttataattgattgtctttaactttgccctgaggcatttttcctaatcaactctagaccatgatagagcctttgggccacaagactaacagtcttaccttgaaccaccagtcagtgaggtgtttgggaaaaccttttcctggtgatgtctcatcttttccttctacagtcaccaatgtcatatttactgtgttaagatgctaggctttgtactggcttgtttacttctcacgatttatcttgcagtatgatagtttgtgtgacactgaaaaaaattagtaggactgttaaaatagttttttccccccattaaaagtagaatgacaccgttttgcttctgaagaatttggctttaactggtttatattttgagctgggtattaaaggagaattatggtagggtaaacacaattagtgacatctggttgccccaagaatcaataatatctgatactacatacataaatagatatctatgttgtgataatatatcttagtttcactgggtaaaactagaagaataaaaaatttgaaaacagcttggttactgactaagctgcagcagttctgagagcctactgttgtcatttttaatgggcagccttgtacttccatagattggttaatcttaaaggccagatggtagttgtattgtaatttcataaagattttatgtcctatgttttgctttcaactagaagcatgagaatttaggaaagttatattgagacatataaataataaaaattggtgaatcattttacctaacaatttattgatattactcaacacaaggagaaaaattagaaaatggaccttaacaccactgtctactatgaagacagtatagaggaggcaggaaaaacagaaagcacacaataacatgatagctataaattcaagtgtcagtaattacaataaatgtaaatagactagaggattctgctaaaagacacgtcagattggattaaaaacatctgagatactaggtttacaagaagcatatctaaaaacaaagatacagaaggcaaaataatggaaaattttatttcaggctcactttaagcaaaataaagctggtataacatgttgatatcagacaacatagaaatcaaggcaaaaggcattagagatgaagaggatcactgcacagtggtaaaaggttcagttcagatataggtacatattatataaagcaaaaatatacagaaacaagaaaaatagctgaatgcacaatcctagtgggaagttaacatacctttctgaatagtacaacttgcagacagaaatcttaggatatggaagacttaaagaacatgatcaatgaacaaatctgacctcatggacattcatagaatgttacagttcctgtataatccattcttttcaagcacatggagcatctgacattgattacatataggaatataaagcaagtattgataaatttcaaatgattgaaatcatgtagagtatttttcttacggaattatagaaggaatcaaccaaaagataacaggaaaatccttgtatgtcaataaattaagaagtatatttcttataatgtataatatataattttataaatatataaatatatatttataaaagtttcatttaaaaagttttacaaaatggaaaaatctgtcacttaaatacaaaatcactgtacttctgaccctactaaatgtaaaaattgtcaggatttgggaggttttttttttgatgtccaaatacttgatacacgttccagagatccccaatatttttgtgaattcttcttaggaggctagtgatcatgtatgtgggattaggaaagtaattgtttgagctaaatgggggaagagatcattcctgctggtagcagggagggtgtgccacgacgagagatctgtggatttactgaaaacacgagatttacatccagagcttagttcacaggctgtggctcctgtttttattcatttagaggctgatagaccagctgtgcctgtagttacgtgttctttggccagacacctaaggaaatttgaggctcagacaagctgaagtagatatttctgtttccatgttgaataacagagccactcatgggctgtcacagatacactgtttggggttttaccattccttcccatttccattcctgaaggaaaaagagaagagatttttctttttttttcagattattactgtgttggtgacctagggaaaccctttttttttctcttctcttttcacaaagttctgaggagcatgaaaaaattgaggtattcacagtgtctggggaggaaatgagttctgtcctgtattttccgaagagtgggaatctaaatcggaacaggcaccaggttgaagaaataatttgtcacatcatggatgcaggaacaagctctacatgggaatactttgttgtagttagggtctgtcttgagggaaaacaagacataaagggtatgtgaaatgttttctggtgatcatatcccaccgtgtcattagttcttttaaagtactttttctatattatcccaatttagctttttttgcaccctgcagcaattctatttctattttgtttcctgttatcattgttcccttttctgagtagaggatagataggtaagtggtgtaagtaatggcatggaaagatccaagaaccattaagtagattatatccctttttactatccttttcttaaagtgcttgacttaattctgaatagccacttacaaactttgatgagtatctttcatcttgggggttattttgaaaattgatggcatttggaataaaagttgctataaccttagtgtacgtttgggtttataaaatatactgaacataggaactcacatgactcccaatttttgaagtaaccataatttctaaaaaaaattcaaatgagctgagttacatttataccactcctgggaattattagaatagcatatgttctctgtttatgctctttgtaaaattggaaaagtaatgtgtagctctttttagtagtgccctgtgtgtagtttctgtaacagttctgtaactgtaacttaccattccagtctatttctgaatggttagtggagctgcccgtcaaagccagacctattacaagggatgatatttcccctgtcatgaatagaaactattgatgactcgattaacatacaaggatgatacagttcatggttaaagggagcatgcttccttttgctggtgaaggaacattaactgtagatttcatctagaagatcactagaaaaagcagcctcccatgtttgagcgtgtcctgcatgtcagtttccatgcagatgctttctgtacgtcttcacgtcctcctcatccatgaggttggaggtgaaagttacgtaactgacttgctcagggaacacatttcatgttgcaaccgggctccatagccacatttcagaccatttttcttttctttttttttttttttgggacagactctcgctctgttgcccaggctggagtgcagtggcgagatctcggctcgctgcaagctccgcctcctgggttcacaccattcttttgcctcagcctcagcctcccaagtagctgggactgcaggcacccgccaccacacccggctaattttttgtatttttagtagtgatggggtttcactgtgttagctaggatggtcttgatctcctgacctcatgatctgcctgccttggcctcccaaagtgctgggattacagcgcctggcctgaccatttttcatttaaccagcattcagattattaagtcaaacggaaaaaaaaaacagggatataaacctattagaaaccaatgtgactgtttcatgccttacatttatgtctggaaagttgaatataaggaaaaagttgttttttgaaatagtttttcattggttccaatgattattcgagagttttccgtgaaagaagtataggtaacataataaaagttaaagttaacagtcttaacacttcaattgtaagaatattttgtggtgtcagtgtattaatagctcctgaaagaaaattgtcaaatgtaatcagtctacatttttttcatgtgtatcaaagctacccatttattaaatcacagaagttaattgtgtttcattgggaattaatattgactttataggtcttgggtagattatttaaatagccctgctagctaatatgttaacccctgcccttattacaaatacatcctgacggataagggcaaaatattattgactagattatgcttgaatatctcaaaatgaaaacagaatgaagcagctaaccaaggaaacgattggacttaaagtgtacgtacttgatcacgttaaagaggcctcactgctgtgtaacaatagatgcttaaaataatccaccagccaacactcactacatgtgaaagtggtttactttcttgtgtctgtggggaagctctaattatatgattataattaagctacagtttattttctcattttctctgattaaattgtggtgggaaatatctggccaaatctagtcttttcttagtcatgttatttgttaattccattgacacatcttattaaaatttgcagcaaggtgttttcctgttaaagtaattgaagatttcagagtatcttatatctaaaaattgtgaatattctctgaaactagacctaaagttcttaaaatataaatgcgtcattcacgtagattatggagttacttttaaaatgtagctatccactgaagaaaattgtgaaaatgtcccattaacgatttgcaaatttatttatttagagatggggtcttgctttgttgcctggggtggagtgcaatggtgcgatcgtagctcgccatggcctccaactcctgtgctcaagcagtcttcctgctgcctcagcctcccatgttgcttgcaattacaggcctgagccactgggcctggctgccatttgtaaatttaaatcttaacacttatgtggtgtttccagttagatttcttctccgttctttgcatcaccttcttagatcttccccattcttctcaatcccctgttccctccatcttcacggtacctttcatggaggaaatagaagccatcactgggaataccctcagctttccaccgacaaatctattcctgcagacacccgtcattgcaatttatattttaacaaaggcttctgatcctaatttcaggaaatagcctctaaactcatctattagtcccaaattctttacccatttaatctgctattttatgcctcctatattcttaccttcagatgttgagaggttggggcataaaactttgcagcatgtctgcagtcttccctctagagtgaacttgatcctgctgtttgttctttttattctcttcaaagttaaatcatgttccagcattcatggtatttctccagcttgtcctccacgctcaccccattgtcatgaggactgcactgaacaaatagacaccttatagtgcttataggccatagttgctgacagataacacggtttaaaaaggaagtttcacagccttgtagcttatgaattcccatgtcagcctcattagcttttacaagctattttcttagcttgtaagaatgttgctagggattcacagttaatataaatatctgtagttttggaaaattgagacagtgcttgcccttctctagtcatcctgtaccttttagatttgacctcttttttggggggtgggggttggtggtgaaatataacaaagtgcataaagcagatgtacagttcaaccaactgtaaaataaacatctgggcagttgccgtgcacatcaagaagtaggacgctgccagctctcggaagccctcgtgtttgttaccgctctttaaagattgaggcaggtgttccatgaccttatccccaagtctctgtgttataattcatacgagttgggaggctgcagtatatttggatgatctaagacctcctcctttatttttgcttaccattggattttagttttctctttccaatgtttattttctgtgtgtattctgaagataattttatctgaccaagaaagtaggtatagaactaagtgtgttgtctgtaattgtttgttacaatataatataactaaggaaactttttcaatttttgcaaacccaattttattctgctattgtttcctgataggaattttgggaattttagagatccctgcgttcttttgtacaaaaaatacatctttctgaggccaggcacggtggctcatgcctgtaatcccagcactttgggaggccgaggccagtggatcacgaggtcaggagttcaagaccagcctgaccaacatggtgaaaccccatctctactaaaaatataaaattagctgggcatggtggtgcgtgcttctaatcccagctactcaggaggctgaggcagaagaaccgcttgaacctgggaggcagaggttgcagtgagccgagatagtgccactgcactccagcctgggtgacagagcgagactctctcgaaaaaaaaaaaaaaaaaaaaaagatacttctttctgttaaacatttcctttaaaaatctaaactcatcagaaaaatacctgcttgaccacattaatttcttgaagtatctctttcttttccttttggaatcatgtgtttgtaaagtcacatgatttaatcttctagagactctggatgcttctgttgttgatgtatatgtgcacactcacagtcttaaggaatttggcattttatgtttcactgtctttttactcttgctccccttcttttagtgtttttttttttttttttttttttttttttttttttttttgaggcagggtctcactctgttgcccaggctggagtgcaatggtgcgatcacggctcactgcagcctcagtctccctgggctcaggtgatcttcccacctcagtctccctggcatctgggtttcaggtgcatgccacgatacctggcttaatttttttttttgtagagatggggtcttgttgtgttgcccaggctagccttgaacacctgtgctcaagcaatcctcctcccttggcctcccgaagtgctgggatgacaggcatgagccgcacgcccagcccactccccttcctcaccagtcttgagcctcctgttctcctttttcccctgtctaggccctcacatccctccacttttctctttttccccatgacttggtcatgacacagaaacaaagtccccagtgacagtatcttctcaaaaaccaaacagtaaactctgaactttctttgctattggattcatgatttgtgattaagcgtattttcccctttgcaggctcttagttatgtgtggtagatgtacttctaaattacatttgctttaaaaatataaaaagtatagagtaacataaatgatgtagcataataaaactttaaatcattaatgatattcatagattgacatataagctattcccagtcattttctttttttctttttttttgggggatggacagagtcttactctgtgtcccaggctggagtgcagtgacaggatctcggctcactgcaacctctgcctcctggattccagcgattctcctgcgtcagcttcctgagtagctcagactacaggcccatgccaccacccccagctaatttttgtatttttagtagaggcagggtttcaccatgttggccaggttggttttgaactcccgacctcaagtgatctgcccgtctcagcctcccaaagtgctgggattagaagcatggaccaccatgcccagccctcattcatttcttgtactagaagtggtgatctttgacaatttgttttaatatgaagttgttttaatgaggggcaaatatttggagcaattagctaatcattacaacgttttttttttttttcttgttttgtttttctcttttctttttttcccccagctactgctcctcgcagagcagggctaacccataggtagtgtgcccagagtcagccatcattacattgttcacgcttacagcataagttaaggtaggactcaaaaaatttttctgtaaagacaatctcagaattaagtgctttcaggaattactatgcagctagaattttctgtaggattgaaggttctagcagctttgagcattgatactgatcttgagaatgaatccaattggcagtcatcccctggaagacttaatttgaggtctttatacgtacttgcgctacagtaaataagaatgtgtcctagatggaggcaaaatggggtgggtttcaagcatttaataaatgtgttaaacattttaactattatttcctcttttcaatttcaaatagtgttaaatgattgttatgggtaggaatagggtaaacccatttctagggcatggtttagaacattggtgcagtttttttcccaagaatatcttaatcacagccctggtttttagtctgtttttctaagaactccgggagttatgctggtttcctcagggattgtttttggcattttcctcatcatagaaccttatggcatcaccttggagacacagcgttagtttaaggaatggacatgtgatcacgcaggtcaattggagtcccatttggtgcttttctgtaggagtagcagggagagactgcctcttctggttggattgctagtggtgtgtgggctgccaagtggcccccttcctggcaccaagcagaatgcagcacacacagggagcagagcccggaggcttgagcctgatggcacttgaggaatctgggtcctggaatggtagatgtcctccatgctacccacttgcatagtgaatacattgcctttttgtctaaggttaagttttcgttgttgttgttacatgcagaattgagaaatatggccaatatcttagggaaggtggcaagttaggaactgtactagcaggctattaaaagaatcacagaggctagtagcctttagtttttaattttttgattgtctatttttgcttgtttgtgatgagtatttctacacctggccagggatgcattcagataaacattttggatacctcctctaaagtgtctgtccacaccacaggatcaccgcctggtcccttagtgctgacattccactccaggagatgctgggctcccgggtggcgcgctgtgaggatgctcgagctgtatcaattgtgaacctcactttcaggagttcagtaattgtgagacggtatcttcaggcattgtggaactctttgggggatgtgacattccagggcattctggagaaaggaataatgttcagtaataaaaccctggagacaggaattcttactgtacctgtgacccatgaagtcttagggcaaatgtagaaggctctgtttggctgaatgaatcttgaggcatccaccttgccttggagttactttatttacagcaacagacacactcacaaagaaagtttgtaagcaaaatattacaacactttgttttgcttctggttctgccattctgctgtcatctttgcaagctgcaaaatgtgagggacaggagaagagaagtttttttcctcttatgtcatggccttcagcattcttagaccagagcctgctttctttaacactctaaccacttttattagtttgcttattcagtggtagaatgtaaactccaagaggtcaggagtcacactagtcactatattcctggatagccccagccaaatacctgacacagcaggtgcttgatagacaatctgttgaattatatgcaatctgttgaatgaagctcttaagttatctagattttaggaactactggggcagattctcatcagacaggtgcaaagaatgggtattttaaagcaattagatttaacagaacatcattatgcaaatgtagctctgggatgtcccactcagatgccaggcttataatgttattgaagtgttacatgaatttgtgtgtgtttgtgggcggagtggattctcttgttaatattgggcctcaggtttattgatattttcgatagaaataacttgaaaattgctgatgaaagatacaaatgtttctttcccaggtgttttaaattttcttaggaatatatgacaagctggcgttggattgcgtgtcctaggttttgttaccttggcccagtgctgctgtcactatcccaaccacctggtctgtctgatcctggagcactgggtgagaagctgtttattctgtcagtctgactgtattagcagtcccccctccccacagaggcagagaagactccactctgttatgtaattgtgagtgctgggagatagtggggggagttataatttagggaatttccatattggagatagtactgcctatgtgtcatgatgcatttgacatcatatgggttattcatcgatgggttattcaacacgtttgaatagtaaggcctccaattgccatttatagcatatgtgctaaagaaacaaaatggtgtgttgggagttacatccatcatctttcccctttggttgaaatttaaagtgacagactgttgtactttaaaaaccgtattgatcaaatcatcttaaacacatactaaattcctagaaaaaaatctgcaattgatactgtagttttttctatattacaattatttatggccaggtgtggtggctcatgcctgtaaactcttcgggagattgaaacgggaggattgcactcgcatctggataacagagtgagaccgtgtcccttaaaaaattcattttaaaacccgaattgaaattagtcgtaaatttttaaacacttatggtgagaacatttgcatttctatcataggacctctgtgttccttgttcttctattccactttcttgtcccaccttctggtaactgtggttcttgctttttctgtttcaagttcttgcccttggcttctcttcccttcccagcatctctgcctgccttgggtttctttctactctctcaccttcgtttcccacatcttctctatttgttctccgccctgtgattcactctatatttaaatctacaattttaccctccctcgttggtttattttttaattgtttctaaatctcagtaagcaatttgaaataagagcaaggtgtggtgcctgatcaattaccctatggctgccacctctttagaactattggcttagaaatcacctttggtcacacgaaatagggcatttattgcaggtttattagtggggagaaataacaattgttccatgcacagtattggtgcgtttctattctcaatcaatcaagaataaccggtgaattttccaagatggttatttaaagtgctatactaataatactgaaagtaagccatatgcacaacctggcaattttttaaaatatcttttaagtactatatatctaagagcagattacattttcagtggcagtcctcattttctccacattgagttatgtcttggtaccacgctttattgcaaaactctcacaactaaaggatttaaagtttattattgcgattttaaagcaggatagaaaggaaaggagagaaaaataatttttctgagtgaagggacctagttcttataatagcattttgatctgaggactgtgctgtgataaataactcttactgtagaatctagatgaaattaaccctgggagaaccctatatatccctgaggcatttggtggccgactacgacagtgtgtaatctgttttcacatagtatagtacacagatgtatatgtgagctgagtgtaaatgcagacttctttcacctttttgaagactatctttttgaagacttttcttggagaggatttatctaacacctgtttgaatcttctctttttgttatcgtggtgatcttatttgagtagtattttggtgattgtgtttgatcataaatatatagcagcagaaaatttttgcagcaccaaactcataattcttggatttaccatatctaaaggaatgccaattttgcatattttttcctatatctttacaagcctcattaaaatattaaacttaaaaattttttaaagcataattgcgtttttcttttcaaacttctgaagaaatgtacaagatttaaaattaattttgataaattaatttgcatttactttgtaagccagcactttgtagtgtgaaataatattgaaaatgggaaacaatatgtattgataattaaatgaatatacaaccagttttcttcccggaagacattttcatgtaccatgtaaaaggtactttttggaattatttatacttttatagttttccatgcgtgtgtgattagacttctgagaaaaccttggataattttacgatgataaacatttatatttcatttcagtgtagttcagtcacttaaaaatatccacttaattttattttggggacaactgtagattcacaagcggttataagaaataatacagagaaatcctctgcccccttcatcagtttccccttatggtggcatcttgttaaatgtggagcaatgccacatctaggatattgactttagtacagtcaagaaacagaacgtttccatcaccacaaggatctctcatgttgcccttctgcagccacactgacctctcctatctccttccacactgctcggcaaccatgaatctgttctccatttctataaatttatcatttcaaaaatgttatataaatagaattatactttggatattgctcttttttcattcagcatagttccctgacgattcatctagattgttttctatttcagtaattcatttcttttttattaagtagtgttccatggaaactgtgtaccacagattgtttaaccattcacctattaaagacatctgggttgtttccatgtttcggtggttacaaataaagtcgctataaacatttgtctatagattttattgtgtatccatttttttctgtgataagtgcctaggaattcagttgttggcttgtatgttaattgtatgtttgttgtttaagacagcggcccccaacctttttggcaccagggaccggtttcttcaaagacagtttttccatggaccaagggtgggaggtggtgtggatggttttgggatgaaactgttccacctcacgtcatcaggcattaggttttcacaagaagcacgcagtctagatccctcacctgtgcagttcacagtagggtttgtgctcctatgagaatctaatgctgctgctgatttgcccggaggagctcaggcgggaatgctccttcgtccactgctcccctcctgctgtgcagcctggttcctaacaggtcatggactggtaacagttgttggcctgggggttggggacccctggtttaagaaaccttttttgaagtgttatactattttacgttgtcaccagaaatgtgtgaatgtgatccagtttcacatcctcatcattatttggtgttaccattatctttcattttggccattctgagatgtatgtggtgataccttattttggttttaatttgcattcccctaatgttgaacattgttttttcatgtgcttgtttgtcatctctatatcctcttcagtgaaacgtttatgtcttttatccattttctaactggatcgtttttcactgttgaattttaagagttctttatatattttagatactaggcatttgttgaacatttggcgtacaaatatattctcactctgtagactctatttccattcttttaacagggtcttttgcgtagaaaatgtttttaattttgatgaagtcagattgataagttttttcttttatgggtcatgcttttgctgtcgagactaagaattctgcctagacttggatcctgaaaattttctcgtgtgttggtttcttttaaaagttctgtagttttatgtttcacattaaagtccatggcacattttgagttaacttttgtatatggttgaggttctttttttgcttttaaacccatggatatgcaattgctcctgcaccatttgttgaaaagcctattttttctccattgaattttttttgcacctctctcaaaaatcacttggacatatctgttcatctgtttttgcattttctactctatttcattgatctgtgtatgtcccccagctgataatatattgtcttgattactatagctatataataagctttgaaatcaggtacactgatgattgcccctttattttctttttcaaaattgtttctggttattctagttcctttgtcttttcagataaattttagcatacacttttctgtatctagaaaaaaatcttgctgtgattttgataggaattgcatcaaatctttggaagaattgacatctttactgtgttgagtcttccaatctatgaacatggtatgtctcaccatttgtttacatcattgatttctttcatcagcatttttagttttcagtatatgagtcctgtacatgtttcggtagctttacacttaagaacttaattttctttggagcgattgtaagtagtattgtattttaaattttggtgtcagtgtgttcactgctagcatataggagtttttatcttatatcctgtgaccttgctgatttgaggccgcaacttctgcagtgtaatgtaaagccattgaacatggagagggcaaaacaaaaaagtaaattggagtgcctcatacaggagtagattgtttgctagagaatggtggtagtggacatgtgtctcaattgtattcattttcagtttgagtgagtcacttttcatcttgtgcttttctaacacctggaacctcttttccaagaaactctggttccttttaggggagaataatttgaaaaccaagattctgggtaccattgcaataggaggccattacttcagaactctttcagtggtcggaactaagaaataaaaataattgagtttgtatcaatgttttcaattcaaatttagcagaaaaattcttccccttaacttatttcattatatatttctattcattttctcttacactgaaaatagtgatttcttaatgatatcaacttatttgctttatcttactatacacataaatgttttaaaattgctgtattaaaattaaaactattgaataaaatttaagatttccttgcaggtttttttgaagggcatagtcctttcaatatatactgctgaggatgtagagacagaacactgactttagaagtctcttcaagtcttttttccaggctgggcgtggtggctcatgcctgtagtcccagcactttgggaggccgaggtgggtgtatcacctgaggtcagtcaggagtttgagaccagcctggccaacatggtgaaactctgtctctactaaaaatacaaaaaaattagctaggcgtggtggcgggcaccggtaatcccagccacttgggaggctgaggcaggagaattgcttgaacctgcgaggcagaggttgcaatgagccgagattgtgccattgcactccagcttgggcgacaagaatgaaattctgtctcaaaaaaaaaaaaaagtctcttcatatattttttctgtgtagatattttaccgattcgatgttaatagtggtttatttctgtttctctaattctgagttttcaatttctggattaattctttccatataaataggtttgaagtcaaaattaaataaaaagttctacatagagaagcattctctgttttcattcttcccagtatcaccctataggtaaccatttttattacttttttgttgtaaaagaaagtacttgctttttcttccttctcatacacaatgtagtagtctatggtctctggtctcctcctttctttttttttttatttcacaatatattttggagattactccattatagcacatagagatcttcctcactcctttttacagttacattaagtactgggtaattttgccatgtgtacttttattagatcctgcagaattcccctttatggggattttattttgtactttcatcaacagtgtttgtgacgttcagtttcttctgaggcttgtcacaagagcagatttttgccagataggtgagaagtgctatttcagtgtagtttttatttacatttatggggatagttgaacatctttaaaaacatttaaagacttttgtctttttgtcaactgttggttcatgtcttttgcctatttgtatattggatttttgataattattgtttttattttatttatttatttattttgagacagagtcttgctctgtcaccaggttggagtgcagtggcgtgatctcagctcactgcaacctctgcctcctgggttcaagcaattctcctgcctcagcctcccaagtaactgggattacaggcatgcaccaccatgcccagctaatttttgtatttttagtagagacagggttttaccatgttggccaggatggtctcgatctcctgacctcgtgatccacctgcctcagcctcccaaagtgctgggattacaggcgtgagctaccgcgcccggcctattgtttttatttctaaagaggaaggaagattatttatttggaagataagttgtgaaagttacttcccagtttgccattggtcttttgactttgcctacaattttattttatttatttatttatttatttttatttttattttttgccaggaatgagttttaaagaatgtatcttttttatatttgtaatttgtcatcgttgtaatttcatgtgatctggatctttaggtacatgtttcacaatggatggaatagaaaagttaggaattttgtgtaggaaagcaaggaatagaatagaaaataaaatagaaaagttaggaattactttttatgtttgcattctctagctgctcactttttttgactatatttcaagccaactgtcacagggcatcattccaggtcctattttggtttctttcctcagtcaatactagaaaaccacagagtgccattcccggcatttcatctatcccatacttgtcatttgtaaaacaagtgcctagtgatgttaattatttctgtagagttgcatttatgctcttttaatttttctgtatttgtgctgaatttccatagtctgtggacagatttgctctgggtgctatagtcagctgagttggagtctagaccatttataacttaactcttcgacctatttaactgtctgcttccttgctcttagtttgagttactcaaattccagttgccttaactgtaaaattggctagtagagccatgtacctccagggaattcagtgtattgtttagatgatgattaggtcttatttatgttttcatataagctattataacaaaattgcagtttaaaatgaatatataggaaaatgttttctttagaaacttagaataaaccagaacattcttaaatttccacttattgcatgttgatggagcttgactctcttccctgtaaggatgaacattgcagaaagactgtgaaaaagtggtgccatcacatcatcagatctcttattgcagaagttataattctaagagaaaacaatctgcaataaggagttctatcatatttttgtaagtatattattgacttccaattaaaattagtcctagtaataatggcatctgtgaataaggaaatctgaaaccaataacgtgtaaaattgagttaaatattgttgagccagttatataagtcatgttaatttctaggtgttacaaacagaagaaagtgttctcaagcttctccgttccccagacagaatctgctgggttcctgctattgacatcaaagttacttgttctcccattaggctgctgttaaaacgaacacttaaaaattatcttttgtccatcatacttttgtgggaaacatttttctccaatggatttcaaatcccatatctcttactatggtatttccatccaattttcatggttttgaagcagagcaatcagtatggagtagggggatggagtgaaaatgataactttataattaaaatcggcacggaagggtttggatcacgggatggtgggattaaaggtgtaacctgtgaggacagtaacagaggagacccactggaaacattgtaggacttggagagcctgtcgggtgagtgccctggggatctttatgtgcccatttgtcattttcacttctagaagtgagaagcatcaggacactgtctgtgccacctctgtcttcccactctattccaaacctcctgggctggtaggagggctgaatgagataacacaaagcacttagaaccgtgtgtgacatgtattaggaactgaagaagagttagctattacacataacatttgattggtattaaataatataaacattgcttcctgtactctctattatataaataaagagcaaggaatggtgtgtaattctgtgaaactgtgtagtctcagatttggatctgtctttgcatgtgctgcttcctcctgccccagttagtaagtgtcaataatcatgtaaattcttttttttctttccttttcttttttcttttttttctttttgagacagagtcttgctctgttggccaggctggtgtgcaatggtgtgatattggctcactgcaacctctgcctcccaggctcaagcaattgtcatgcctcagtttccttagtagctgggattacaggtgtgtgctaccatgcttggctgattttttgtatttttagtagagacggggtttcaccatgttggcgaggctggtctcaaactccttaagcagtccacctgcctcggcctcccaaagtgctgggattacagacgtgacccagtgcacccaccaataatgtaaattcttactgaaacagtcatgcttgtgtaggtactgtctgtggtcacttttgttctacaatgacagagctgtgtagatgtgacagagattatacagcctgcaaaacaaaatacttagtatctggcctgttatagggcaagcttgccaactcttacatacagagtgttctgatccaaggaaaaagtaataaaaagtacccaattatagagcagcttcctgaaatcaacatttgttctttcttttacatctcctattgaagaataggatgttgtatataagaggatagcacaaaatgtttcctcaagttttcatttatgtcactgaagagttgactttaaagaattattataaattaataaaatgtaaccatttggaataagctatgtaaatgaatttgaaagtttgaagttgttgcttttctttagtaatgaaaaactaacccatgaaatgtgtggtagatttttcacttattaagagtaaatatgcgcatttatggcgtgcagtgtttcacttaagaaagtgggtatttcagggcagcacctagccactgctggtgtacagtgcggactgggagcacagtgccctaggcacaggcagcctgtgagtatccgtggcagttcgtttctaactagcaaaggaaaaggacttctaaaatcaatactggttttaaaatgtatcattactgttatttggctcagttggattcagagccataataaatagtatgaacatcggcctaagttaaagtttgcatttagacctgattgtgaatggaaagatgtacatatgacttgagagagtatggttttgacagagtggttgttaatgcctcagaactaaagaggtttcatgaatacataggttttcagtacagtctccttaccggcaggggaatatcagacaagtggtgtttttcagacagtgaagcagatggctctttctcttcagtacagggtgtaccaacaaagagagacagttacacaaatgttaacccctgagggagagagaaaacaattgcagtcagttgttctttataagtctgtatcttgacttcacagtggtgtgaaaaagtaatttcttcttttataaaaagcattaaatgcacaggagcagcctgtaatctgagtccaactaaaatggtggaagatgatgtaatcacttaaaaaggaaacagactgttatgtttgacatttctggagtaacgtggtggtggactacttgggcccgatataccgcttccaaattctcgttaaaacgtccagcagttgtgctataaagcaaattgccatatgccaagatctgggcagaatgttcttcaatatggctggtgaaacagattgcgaatggtcttggactatatagcacatgttctattctctgaactagaacaagacaaatgccccacgctgggtaggacatgttttaaaattcatgtacacagtgtgcatagctttgggaggccttgggtcatgctgagtggtccaagtttgtcattcccagtctgtggagccagtcatacctgggtccctcacctgctcctcctctgtctccactagctcctttctctccactttgacttaaaaacccaaactcccaacatgcagccccgcagcaggaggcagagggaggtgctaagggtgccgtccaaccctgactgcaaatcacttaaaagctttttgaaacggaggaagagccgtgcatccccgtgtttcgtgtacaacatatgatacatgtgacagttgacaagagtgcctgagtctcagagcaggaagagttatcctgcctccacatgcattgaagggaatatatgtcacacgttactagccaggctcagaggagaacacatctcatttacaagttcaaatctgaaagggagaaatgtgctagtatttagtggatcttgaggaaactagggatgtgttacccatctgtgcaggaacattagatctagatggggctctcctagtcaaaacgctgagcatgtggcgtaggaaaaaatttccaggatgcaggggaaggacagaatgacttggaggacagtgtctctctctgaaaatggttacatgtgaaacacaggtaacaaatttaggataaatctggtatcttaaaaaaagaaacatgactttgggaaaagaagaaaccagggggccctaagggggaaaagactgagatgaaaacagaaacatacaaacaaaaaagctgatcgaaataaaagaatgcgaggaaaccaaaactgcaatgagacttaaaatccctactaagataatcagaagacttgatctccaaaaatagaagaggagtatggatggcaaacttggacactctcaggatgcagaggagaaaaagataaaagtgggtaaatacgaaaggtagacgtggaggacagataatggatccttcacccaagaggagttcctgaacaggaaactgaagtcatctggaaaaccacaattaaattgactgcactgcagaagagtgtgagtaaatagcataagaaaccctgacagtcggccaaaattaacgaacagaggtttctacttagatctatcctcacaatttgaatttttaggataaaacaatcccaggagatagagcaggttgtgaaga

SEQ ID NO: 1100 - DNA, 101090 bp, Homo sapiens
acccctaatgtgtttctccttctcaactgaaatacacagaaggcattacttattacttgtttcgtgaccttttgtcttaccttggttgtccttttcttccaattccatagtttatcttctctcctacttacctcctgaacttatccccaacaaatgttacatatttcttttactttttgagttttcttggcctgttgatgaatatattgacctagcatagcccttgccattgcattaggtaccatcattgttggttttagtactagaaaaactcaacaaagaaggaatattttcttggtgatgctccagagtgaatttaatattgacaatcaaatttattcaagtcactagacaggatgattccttttgtgattgggatttcagctgggatagaactgagatttggatacagatggtacctggcagacgggaataaatgtggggctgaaatgccacagaagcagttagcagtgtgggcctatctgggggtggcctgaggaaggacattcatgaggggggagtaggtggggatgggaaggacaaaaaaccgcattgttaaattaattggcatgacaactctggcagtggggcctcacggagaatgaatgatatgcagggtgtggtgtatgtatgtgtggaaaatagaaaaatgtggtgtgtagaaactggaagaactgtctccctgggttattttaacgttctgcttcagagtacaagcagtttagctgtgggaagcccccacccttttccacaggagagggatggctctcatttgacacaagctgtcatgcttgtaggagtcaggattgttgcacccagaaatgcttgtggagggtcttgtaaggggttgagtgcctgtaagagcatctgggggcttagaccggtggccctcaaggtattaattccttatcagtgtgttcccatctacacccatggctggtgtggcctaaccaagctggcttaccttttagaagtttctttttattatctcctcaagagtacatgctctggcttcttggcctggcaggctttcattacttacatgatacatatatgtactctttgataatcttatgtttttgtcccttgtaagtttctgcaattgtatactgcattgatgaaggagggtctgctctcctctcccagggtgtctagtgatggcctgcatgtctctggtctgtttattgccaactcaagtaccttttttgccattccatcgtgaaagaaatcaaaatatagcattttgaaatacatttgaaatgttctgtttaaggatttcactttagttatactgtttctactttatattacaaatctggtttcctcttccatttgcctatatctaacccattcttagtctttttttttttttttttgcatttgcttttctgaaaatttgagcattgaaagggagggcagcttgatcatggaccagggctttctgagaatgcgaaaaaatgaatttcaccttgccaaatagaattgcctggatgtggtggagggatatgatgaggcagaatcacaattcttctacacttttgaaattgttctccccaatttattccccctttcctcattctcttctgatgtatgggtttaggaagctccggatgactgtttcacacacgcactcccctctcattctctcctgcccgtccttcccaccgcacacatgcgctgaaggaggtgagcattctggagacctgagtctcatttccagatatctttgccatcgtttgcagttacagctttttttttctatttttttccccctatctcttgtaagttctcatattatacatactttgaactgtggagatagccacaagtaaaataaaagtatatgtttttatattctatggagtaagaactcatgttactatagtaacatgctgctctgtagcagtcagaattgtgtatttcagtgtcagagttccctgttaaaaaattagccttaatattgatttcctcctgctcccaccttggttggtatatgaaaaccctaaagatgaagcatttttaactaatttttgttctttacacataatcagaaatcaaactaaatccatctgtgatgttagcttatggtctttctagattttagccaaagatcttgtatattttaagcagttgccctgttttaatattaatcatggccatcccagaataagtcctgcttgacacagggcatttgttcaactagttatctttgttaaaaaagaaaataccataagaccagtcatattttgctgcatctagagtgagaccaaactttataatatagtgataagcttgaccaaaaaaatgtttaacaattttggtatgtttcaggaattggagaaattagtatgttggtactgtaaggaaaaatgtgggttaaaaaaaaaatccagctaggactcagcagtcttaatttaaaccttgtgcttgacaaaaattgaatgttgcctgtatactccagacacaatcgtgaagctcagtttctgtatttttcttctgaaatttaacttctgctaatataacataggatatgtggatgtcttgcaatcctaaaattttaagatatttcagggcttatcaactgaaggctcttgaaatgaaaactactacatgtattcatcatacgtgaaataaaatctttttgaaactaaaaatcctttaaaaaattcacaagcaagatgatactatagaatttcttttgacagattccttagaaacgtcaaaatcaaagtgaaaacaagttggaaaatcctctttgattttgctgggtcacttaatttgagttgatttcttcagagcacataacgtttcttaaagtacagtactaatgacagagtcccaggtggccagccttgtgagctgcgaactttgtcctgttgtactacctctggctctagagactcagcctaggaatgtgaattggtgagaatatgtcagaacctggcttcctattgtaggaactcagtgcacttatttggttgatactgagtcgctataaaaatcattgacatgaatgacaagttgtgtttttttccccaacagttaaagacattttacatacagtatgtgaagttactttccaaagaaacattcttcatgttttcgcaagtttttttttaaacctaatatttaatgcaatgaatgtgggttggtttctcttcttccttcttccttctcctcctcctcctccccctccctctcccctctccctcccatcccctcccccctccttcccctccctcccttccttccttccttctccttccttccttccttccttccttccttccttccttccttccttccttcctccttttctctctctctctctctctttctctctttgtttccattgtaaacatatttgcaggattcagaggtgaaactgtagcggaatgtatacacagaagctctgcttatacctttgttcccccagcctgtttgccctctccctctacaggtcatcatttttattagcttctttctaaagttttttttttttttcacttaggtgccacacagcatcgagtgaactattttaaagtgaacagttgagtagtgttgaatacatccagagtgctgtgtgatcaccacctctagttccgggacagtttcatcccccaccaaaggaagtcccatacgtattaagcagcccctaatgaccatccacccgtgttctgcttctatggatttatctattctgaatattttatatacaggaataagactttgtgtctggctgcttttgcctggtgtgatgtttgaggttcatctgggttgtgttttgtcattacatcatatctttttatgactgaataatattccattgtatgtatgtgccacagtttgtttatccattcatctgttaatggatatctgtgttgtttccaccttttggctattgtgaatagtgttgctgtgaacatgtatgtgtgtttgaacacctgttttctcttctttttggtatatgcctagaagttgcattactgggtcatatggcaatcctgtgtttcacttttcaaggaaccaccaaactctctcccacagtggaaatggaacaatttccaccaacaatgtagaagaattccagttggtcagattgttgcctacacttactttccttttttaaaaaaaattcagtggcattcagggatcttcataatctgagctttgttttcctttgcagtgtaatctcttcctggtttcacatgccactttcagaatactggattatggtaattgcactcttttgctcccttctcttcacctaatgtgttgtccccacctgcccttttcccccacccataagaccttgtctctgtctctgtcgcccaggctggggtgtggtggtgtgatcacagctcactacagcgtctacctcccaggttcaaacagtcctcccacctcagccttccaagtagctgggatcacaggtgtgtgccgccacacctggctcatttttgtttttgtttttgttttgccatgttgccgaggctcgtctcaaactcctggacccaagcaagctgcccatctcggcctcctagagtgctgaaattacaggcgtgaaccaatgcaccagaccaggttttgcccttttgtttgcaggtccctttaactgtgatgctgtctcctagcccccttcccccactcgaccgagggccaggcaaattccaactcatttgctgagtttcagtcttcaccaagtctgtgaacttcaaaagacgttattcattgttacattccctgcatccggcacagtacctgatgtctgatgggaacccaatacatgtttgagtgaatgaatatgttgtataattcttttttctttatcacgattgctgctggtgccgattgaatttccagagcttgctgtaaaagataggaagaaaatatgtggtaacattggccagtgtttgggccataagatgtgtagaggttctaaggaaaaatacacttccaaactcattcacattgctggtcatgttcagttcctgtggctgtaggactgaggctcctgttttcttgctggcagtcagctggggccacacactgcttctagaggtcaacttgaattccttttcgtgtgccccactccatcttcaaaccagcaatggtgtgtcaggtcctttgtatgctttgagtatttctgacttacgtttttagttggagaaactctgggttcatgtacctagatcaggtccaccttaattatttccctgccttcaggttaaatgtgctgtagaatatgacattgtcacagaagtgagatctcatctttagttacaggttccagagtatggggcagaacatttttgaattctgcctagcacagtgtttatagtttattgatctgtagataggttgggtaaaggttcttcttcagccagtaaaatgtcatcttctctgtcttttgattgcagggtttctattacctatgtccatttctttaagccgtttggtctcatattcctctgtgtgttacaagaattgtatcatgttatctatttcatgtagaagtaagcatgagagaaatgagtgtaaatgggctgttggccctcacagtaaaatctggtatctattctagggagatactcatgtttttctcctttttcacattgctgtcgtagggtcagattcatttttcatggtcatttttctggttctcttttagcatttgaaattgagtagattgttttgattgtaagaatgttttttaaaagtaaatttttattaaaatgtatatatggaaaggaagacaaatagtatattgcttgataaattttcacaaagagacatgcacatgtaattaatacccaaatcaaagcattagaatatttactagtaccctagaagccttacctactcaatagctcccttaaaggcagttttttgcttgcctgttaatttgatgaactttcagcctttgaaaagtcgttacaaaaagccgatgtgtaaaatgtttggaggataggataagaataggaggtggctcttggaagtttgtttgctcctgagtatgggacctagtgatcaaagatgaagtggaactagatactttatcttccctgtaataggaaatacactcccattgtataactgtaatttttactcataaaaatgggttttgcactcaaagcaaaagtaggctcttacttttactgttaaaatagaaactggaaaactgttctttagaaaagtcatcctaatgggttcaatttgaggtagttgctggtttttatatttttatttttttgaccagtgctttaagtttttctcctgtaattttattaaacctatgcccaggaaaaagtaaacggcaagatttcagaatctgaaagtttcttacgtttgaaagaaagtcctcccatgcttcatttttcctaacagaaggtaaactttccatgctgaacttgtctctatttttaacagaggacaagctttaggaaactgtattcaagccacatatagtgtggtagattctggtggtggagcagctattagttatgtttctctggaactgcatttatcatcactgttaccaaaagcatcctaggttccttgggaagaagatcttaaagttctctaccaaaccactttttttttttggtgatgcttcagtctcacaggtgatgcttaaaacacagattctgatgtggagatttgagatcttacaaccatagaccatatgttaaacattgactacacaaggattcgtgatctgagcattaatagcctgtttttttcctaattgcatgttttatagtaatcctaacctttaatatataagatcctaacctttatatttaacgtcttaacctattgctctgtatttctttaatgccatggattattgcttacagttataaatgaaataagtaattttactttatattttcattgatattcaacgaataccaatttaaggagagaaacatagatatacttttaaagaatttaagcgtggcacttaagattctttttattataataagcatgtgaagaagctctttttctgtaatcctagttcccaggggccaaaatgatgattaattacagacaataggtttataaaagtaaccgtttccatcatagaagtgtcataaaagattaaagggtgtatcaacaaaatgaaccagcttcctgtgtaaaattattaatattgctaaataatgtagccttatatctgttacaaaagtaccagaaaaattgctggataatgtgttacaaattttttacaaattacatagataatcctcagttctgttgaatttctctgacattctgctcaactagtttttcctgtgcagaaaaatcttaacaggttgatgttacaggaaaagtggcatgcttttagaaaccatgactaggctgcctgaatcaaacatcctcccctttgagaggcctaggaaagaaccatctcgcttggttgtatccagggtacactctcatagggataaagagccaaccaaataaaagggcagacatatacttagctgtacctatctatcctaatgtgtgtatatatagtgaagctattgtacaatatttcttaatgtaacttaataaggtagttagttttttagcctcctaatggcttagtgtttataaaaatgatactcgttcactgcaaattgtagagtatataaaagtgtagagaaagtagaaatcaacagaaatccttttccctcgagataaccgttgtgaacattttggtgaacatgtttctagaaatctctatggttatatacatatgtaaaagtgtacatatctaatgggatcaaattatatgctgttttgtattctctcagtccacaacttgccagttttcaaatctgtaaatgtagatatatattattttcaatggatgtatgctcttccactgtgagtcatagtttagtttactctgatatcactagacattgaagttgttttagttcttcattataaactatgctatgatgaatacagttgtctggtaattctgttagtttagggtaaatactttgaagtaggattgctggctcatacagtatgtcttgtttcccgccacagagctgccctttggaaaggtagtgttagtttacacatccactgagtcctcattgctacatcttctcaccaacactgctttctaaattaattatttcaattcatttattttttatttaattttttatcatggaaaatgtaaatacatgcaatggtagagtatgcatctatcactcagtttaagtaatttcaactcatggctaattttggttcatctacatcccacctgttttccttcttttcattttgtgaagcaagaggcttctcaggctgtcatttaacctgtgatacctcacttttatttacatctgtttattactgaaatgagtattttttaaatatacttactgggtacaaagtggttataaactttaatagtgagttaattgattttcttcctgtgggtttacaccaattgcaaaagtgtaatttagctcttaggttgaataatcttaagctgatttaatcttaagtcagatgtaaagataatgttcagttccagaaaggtaaccagactctgagctggttaggtagcagctgcagcgtttggtcctgggtgtgacatcttaagaagaatattgacaaatgagcatttccagaagagagtgaccagcatggtgatattagagaatagtgtcacacagggaatggttgaaggaaccaggtggggatcttcagtttagagaagacagaaatttgagggaagaggctgatgaatggagacagctatctgcagatttgtcatgtggaaggtttcagggataacaaggaagaagctgctaattaagtagcaataaattttatctcctctctggctgcttagcttttattgattttatttatatacagctgctggaagcaagcgactggttttgtgattaaaatgatgcttttgggtttctaggaaaccctgagatgatctttgtcaggttttacttcacatacccatctctccaaacagggatttagcgttgagatttaaagcggttttgccatataagaaaatatttttcagtagagaaaaataatattccaactgaaagctgtccagtataggcccagaatcccatatctgtagttccaaaataaaaaaaaaatcctgacagcagaatgtttcctaactcatttagaagcaaaacttgacctgaatgactgtgtctttatttatcctacttgatgtgaatattcatacatttctttgcagaaatagtaatgtgtttgattacggtatgcttttccataccccaggaatattatgtaatgctgtaattacccatcgaaaactcatgtctgaattcttaacacttctggcacagagggtgtgtatacctatagttgtcgttctgtcgtatgttgaattatatgcggtgtattttgataccctatcactatgcatgtgtaaaaagggaatgatagtgcttttcctgtttgtccctctggaggctgtgaaaattagattactatgtggagcatattcagaatagaactgcctaaaaataacgtgttactggtatggtattcttattctgtgtgtgtttaactttctgcccgaagataattgggaagaataatgtggaaatctgtagttgaaatattataactgttgaacaaagagatgtcttccagaggcaaaatgacaaatgatatttaaaaaatattttcactttatccaatctgattagtatattgtggtgttattttgaattatttgaaatgaagtaatatatcataaaacagaattaggcttattttaaggtctacacttatgagctcttacaatttgcttttagatatatatattgaagttacttgtaaatgatgatgatgatttcattttagatcatgctaacattctagttcagatgatctgggttgcttgtattagtgtggcaagacccaaacttcacacagaaaggaaaggcagtatgatttctaaaatatttacttatatatataaaaaaacttggttaaaatcaaacagcagaaaaatgtattacataaaagtctccttcccctaatccttgtactcaaagataactggtatgattttttttgtgtatttttttcataaaatctttttatgttagtatatatttcaaaaattcatacaaataggatgatgcgctctccatttcatccctcttttacttatgtgccttagaaatctttccatgaccacacacatagatctattctccttttagtgactgaagtattccacatggactatacagttcagttagttcaggtcatgggctgttaggttgtttggttgtcttttttgtttgttttaaagtaagtagaagtgatcatgcagtgaacaactttgtgcagtttgacatatttttctaagaaaatcaaaaggtagattcctagcatggaaatgtaaggaatcatttaaatatactgataatgctggattacccaaaccaaaggtctcatcaatgtagtcttttacgatgttcaccgatgccgtttatcccctctcttgctactgctagacattatttaagtaggtacgtctttaaatgcatttttcatttaaattaatttatattttgttaatgacaaattaaatttgaagaaaaggttatatatgtatgaggcatatcattttacattttgcagataatggttggtactcatttaagctcccaaaactcttggttctaaaccacgtccatgaggcactctttgatgactctggggaaaagcagattctttcctctcttctcattttgatctccttgggaggaaacaagctcctttttcacatacttttttgaaaacagctttattcaagatacaattcacctaccatataattcatctattgaaagtgtacaattcaatagtttttaggatatttagagttcagagttgtgcaactctcagtagtcaatttcagagtattttcttctccctaaaagaagcctcacccttcttagctataatcacgccacatcttcacaccctaccctaggggaaccattaatctactttgcgtctctatagatttgccttttctggacatttcatataagtagaatcatccgggatgtcatttttgactggctgctttaacttggtgtgctgttttccacactcatccattttgtggtatgtattactacagttggttctctgcattggtgcattctacatctggtgttcaaccacagattaagaatacttaaaaaactgcatctgtactgaacatatgcacacttatttttgtcattattccctaaccaatgcagtataacaactacttatatagcatttatactttattaggtattataagtaatctagcgatgacttaatatatgagagggtgtgcatagcttatatgcaaatactatgctgttttatatcagctacttgagcattcatggattttggtatgcataggaggtcctggaaccaatccgctatggataccaagtagatgtctatacttcattcctttttatggctaaatagtatttcattgtatgtatatgtcaccttttttttcccatttaccagttgattaacagatatttgggttattttcactttctggtgtctgtgaataatgctggcacatactgatttcatgtggacatatgttttcatttctcttgggtatgtacctacaggtggaattgctgggtcatatagtaactgtttaagcatttgatgaactgctagtttcctaagtggctgcattagtttacatttccaataccagtgtgtgagggttccaatttctaacacttattttccttttttaaaataatcatctcctgtggtttaaatgtgttccctaaattttatgtgttggaaacttcaccctcaaattcatatgttgattggaggtgggcctgtgggaggtaattaggattagataaaggtcatcagggtgaggcctccatgatgagactgttggctttgtaagaagagaaagagatttgcactgacatgcatgtgtttgcattgttttgtcatgtgatgcgtcttgccatgtcatgatacagcaggaaggccctcaccagatgccagtgccatggtcttggacttcatagcctccagaaccatgagctatgtcaacttttctttatgaattacccagtctagggctaggcacggtgactcatgcctgcaatctcaacactttgggaggccaaggcaagaagactgcttgagaacaggaattcgagacaatgtgggcaacataacaaaaccatttcgcttaaaaaaaaaaaaaaaaaaaaaccaggtgtggtggtgtacctgtagtcctatctacttggaaggctgagttgggaggattgcttgagtccaggaggctgcagtaaactttgatcctgtcattgcactccagcctggatgacagagtaagaccctgtctcttaaaaaacataaaaatagggctggttgcagtggctcacgtctgtaatcctgcactttgggaggccaaggcaggtggatcacgaggtcaggagtttgagactagtctggccaacatggtgaaaccccgtctctactaaaaatacaaaaattagctgggtgtggtggtgtgcgcctgtaatcctagctacttgggaggctgaggcaggagaatcacttgaatctgggaggcagagattgcagtgagccgagattgcaccactgcactccagtctggcaacaaagcgagactctgtctgaaaaaaagaaaacaaaaaacaaaacacccagtctatggtgttctgttacagcaacagaatatagacaagtgcatgatcctaataagtgtgaagtggtattttgtggtttttacttgtacttcctcaatggctaataatgttgagcatcttttcatgtgcgtattgtccatttgcatatcttctttggggaaatacatatcagatcctttgcccgttttttacattagttgtcttactgagttgtaataattctttttatattagatataagtgctttatcaggtatgattttcaatctgtgggtcctcttttcactttcttgatggcattcattgaagtgcaaaagcgtttaattctgatgtccactttatcttttgttgtgcttttggtgtcatatctgaacacaagtctttaaaggatgaatttgcttggtgaaacacctttcctttggataccaggttcataagattggacacagtcaacatttttttttttgatctcaatcacttattccttgaagataatctcagatgcagcttattttaaggcagtcccaattagttgactttcagatgtgttatttggaaatacttttaaaggtattttgataagaaaatttaagttttacaataaaatgtaaccttgcaatgtagctttgcattttatggtaaacattagttactgcttactttacaggtactaaaaatcaactacttcaatttcagaatgtaactttctcatgccttattttatttcgaccagtattaagcctctttatgcttagaagatggtgttgaatctgtttcaggttaaaaaatactttattcaaactattattttcttaaaagttaatatgtctaaagtttttgaaagacactgatcactgagatgtttggagatttaaactggtttatttttggttatccatggaaaactttaaaaaatttctttattgaattatagttttaagtctccttattttattctcgatgattaatgtacagggcgtggcttacttataagtgtgactaaagttgtgcaaattaatcctagcagggctccatcctttaatgtcagtgccgtcagttgttctccccttattcctattattctggcattatatcttatctgtatgtaaattcttattctgtgggtgaaaagggatatggttcaacaggatccaagaacttaaaaattgccctttttcacatttctcataagtagtaagtctcctaaagcgaagtcagagtcattataaaggcatgataatggagtctgttatctatttggaaaaacaacttttattgccatttataataaatgtaaatggcctgccatttattttagaattactctgtttctaggccctagaaaggctctgcattttataattaaagttagtagaggctagaagaacttataggaatgtcataatgtgctgtaggggacagtgatacttttaaaggttctgacattcagccagtaaggtgcttctagttccagataacttcttttccccccaggaatagatacagaaaatatttttggtaaatctgccaagttttttatgtgattctcattatgttaaattttattatcagtgcctaaataatgctaacattttaagttaaacagttattcagcttaccactttgacattaccactgattagaattgaaggctaagttgagcctggggaacgagcctctttgtccagaaaagggctcttagatttttccctgtcagtgtattgtaaccttttataagggcagcgccaagaaaggagaagctgctacttggggcattgtgtttgactttggtattctcacaggtatgctgtctaggaaagagttcaggtctcctgcttaagaaattgggaactaggctgcttcctgtggttctgttgctttgtcgggggagggagggtacctgatttctactgaaggccaaaatgcagagtcaatatggccggttattggcaaaaattatgatatttagaaacttttggaatgtctgcaatgttttctagacattctagggaggtcactggtgtttggaaagtacatacaaatggtgtatgaaaggagtgtgccattttctgcagaggtgttcgttacatttcataaccttatgttgccatttaatgaggtcaaagaggtttcttgactgtgactatggaatgcttatcttttgttctgtcttgatctcctcctgtctgtgtctctcattatctctgactacttgtatgttggcagtggctttatttcctttcacactcagcctggattccaggctcatctctaactcctacatcagaaccctgaactggcttgtctgttttgtaatctgccctaccatgcatacccctaacctagcacaaacgccctacccttcccttctcttgtacccatgtggctcagcacttctggataaattagaacaactttgacgatggtattggtcagggttcgattatcgaggacagactctaattcttcctactttaagcagaaagcagtttattacagggaattaaatttcttggtgaattgttgagggtacttagaaacgctcctagcaggttgtgctagagtataattcccaaggctgccctgtggaactggactgccagggtggccagcatcctagcccaggcatggggctgctgatttggctgttgctgctccactgctggccccagaaccacaccaccttggccgctgtccacaagagtaaagtggctacatcacacttagtttctctccccacttagttcagtttcattcttaacccagttggaccataccatttgtgttttgcatggttcatgtttatcatgatctgaaggaacctaaatctagagcagaaccccaatgtggtttttcagctttccagactctgcagagctagaaggtgggagtagattgaagtgagtcaatctgcagtattttccacatttatggtttccgagtatagctggctcttcaagattgttttgtagtcctttcacctttccttgataggttgacttgtttgctgatgaaagcagcagttctcattctacgctggcctctttcattctcattagatggtggagcctacgcttgagagaagaagctgtcgggtacgaactccacttaattgtcctcctgttcttccctgccgtccctttcaaatgaccacaggtagctgtcatagccccgtagagagtgtgagaaagcacaggcaggagtcagcaaggttgctgggaggactgaggctctcggaggtggatcctggaggtgagagggccaggtgtgaggacaggagcacgttccagaggccccacgacagcctcgcccagcacatggcaccattcttcacttacaatccagggcactctactttcctgtcttgctggtggcagctcattctgttcccttcgttgaatcttcccttcctatcctcaggttcagtccttattctgttcttgacttctctttgtggacaatctccttagtttatctctagcttcaacctttcccagaagtctagaggtatatttccaatggtcggtcatcttagatagctcataggcttctcacatctaatatgtttgaaaccactcttgatttttcttttttttcaaatctctctcacttagtgtctcccattttaataagtggctttatcatttacccagtaactcaggccccaaatcttggagttatccttcattttttttcttctctaatttatcaccctgaatcccattagtaaattctgttttctctgcttttaaaacataccctgaaaccagtcacttataatcagccttattgctgccattccaggccaccatcatcactaataagccttataaatggtggccctaacttttaacttctgtatccagttgccagagtgacataaacctaaatcatgtctttccactgctcacttagattataaatactattgcacttagaatacaatttaaaatccttgctgtggcctacaaggttctgtgtggatggtcccagttatctttctttatttaccccctaagcattatccacctggcttaccaagttacttccaagctgtctcctgattgttctctatttaaaacaactgctttattaacttactgggataagatacataatggtacttatcttttttttttttttctgttccccagtagactataagcttcataggtaggaatgttattttgcttcttgtgttatcttttcttcacctggtacatagtaggtgctcaaatatttgccaaatggaagatggggacagggaaattattctacaggtcttgtcttaattggaagattgaaggataagagggtctttgtggagaaagtagtctgtaagaaatagtagtaaaatatgggactgatcactactgccaggaagaggaaagtaagcactagaactttcaaattcacagaagcaaaaatgaaatgaatagtaatccaaccagaccagtgggagtcaggaaaggaaaagtagaaactgcaagatagaaaagaaagatgaagaaatgggaatgggccagagatttactgtcttaccaaggtggagcagccccatttctctctaccctcttaggactcaaaatccctggacttcatataacaaagaagcataggaagatgctgaaaggtggagagaagactgtggccactctagagtcctggggacttgagaaatgacaagggtgtcagttcccctccttactatctcccacatgtctagtacagggcactgcagaagcctccatccctgaaccaccagtaggcacagacagcaaaactctgagaagagcctgttccccatagccagaggacaggggaagggagggtggtctaacaaaacagagcttttgtcagtactcactctgctccagctaaaccaaggaaactgccctcctcccttcccaggcttcgagagcaggcagcatgcttcggttccccacccagaggctgaaggcatgcctgagcagagagttaatctttcatatcctgcctggcagaagcaggtggtacttcaattcccctgtcaggtggtgctgacagcgcctagtggggagctgatcttccaccctctgcctggtaggagcaggtgatgctctgacttctctgccagggtagtgtcagcaaggcccaggttagggccatatccagcccccaccagccacaatgaggtggtgctagcagggggctaattaccattacacttgacctcttccatccccatcatcccctggtggggaggtgtgagcctccacacccactggtggcaaatgaggtatggaggagcggagcatgctggcactccccacctccccgcccctcctttggtataaatagggcccccgggggtcctgaacttctgctcctggatgcagcaacaaactggcatggcttagcccttggctttcccttccctgtggtagcttggcccagagggtagctgatcttacacagaggcaacagaaatggtgagttggagccacactttggctgggaaagtgtcagtgagctgaactctcaccccatctgtctgcaacaaggcaatgtgagtcatcaccccacttttgtcagggtgatggtggggagtggggggctagtgggtaactgaatgtgcatacccactcatccctggtattaatgcctttttagcagggaagctgcccactaaaagattaaatttgatctggggtctcttaatatcaaaaacatataggatacaattcataccaatttatacaattctacagatcactcataccaagatccaggaatatcacctatgaatgagaaaggaccatcagcaggtgctaactgatttatctgacaaggatttgaaagctgctatgataaaatgtttcaacaagctattacaaattcttttgaaacaaaacattagaaattctcagccaagaaataaaaataatttattaaaaaccaaaaagaaatgatagaactgaaaaataatgatagtttaaaaatactgaatgggctcaatagagtggcaatggcaggctgagaatcagtgaacttgaagacagaaaattagaatctgcccaatgtgaaaaaaatagactggaaaaaaaaagtctcatagacctctggagtgatgataaaagagataacacttgtgttgttgcagtttcagaaggaaagaatagagtgggaccaaaaaaaaaaaatctgaagaaataatctgactataatttctcaaatttggtgaaagacagaaagctgtagatctaagaagctgagtgagccccagacaggatcaacccaaaggaatctgtgccaagacacatcctgattaaacttgtgcaaggcagatacaggaaagctactgaaagtagctggagtttaacaatgtgtaatttgtaggggaaaaccagtccaaatgagaggagccttctcatctggaatgatggtggccagaagaaaagcagcacaacatttttcaagtactgaaagaaacaaccattaaccaccaattctatatgcaacaaaaatgtctttcaggaatgaggggaaaaggaaaactttcttgcatgaaggaaaacaagttgtggttggttaccaagcatacccttaaaaactaggtaaaagttctttaaatgaatggaaacgaaaacataaggctctgaatttcagaaaggactggaatgggcaaatataggggcacatgtaatagactttttatgagttatatttggttgaagcaaaattttaatgtaatatgatgtagtaaatatatgccgcggaaatatttaagacatgcttaaaaagtggggaagggccttttggctggaaccaaccatcttctgttaatttgccaaaatgatgaacgacaaagagaaaagggagaggcacctggtatgttctctaggccttttagaaaacatggacttgttcttttggccacatacctgcaaatctataagaaagatgatattggagacatcaagggaatgggtactgttcagaaaggaagccccacaagtgttaccatggcaaaactgcaagagtctacgatgttactcagcatgctgttggcattgtaaacaaacaaggtcagggcacgactcttgccaagagaactaatgtgcgtgttgagcacattaagcactcttaagagccaagatagcttcctgaaacatgtgaaggaaaatgatcagaaaaagaaggaagccaaagagaaatgtaccagggttcagctgaagagccagcctgttcccagagaagcacactttgtgagaagcagtggagaggaacctgagctgctggggtgtctctcctatgaatccatggcatgataggtgttaaaaacaaacaaacaaacaaacaaaaaaaaacaccaaaacaagaaaatactctggactgtgtttaaagaaaaaaaaaagtggggagagtaaaggcaacttacatggaagcatggaagcctgtttttcctattttgcttgtgctggtaaaaatgttgataccggtagagtgtgataagttacatatgcttactgtagtccttagagcagccattatgaaaactggtatactcgagcactatgaataaatgaaggtggaattattaaaaaattgacataatccacaggaagaaaggagaaacagaagaaacaaaataacagaaataattaaatggcaggcttaggcttgtcatactaataattggcttaaatatagatgatctgaatacaccaattaaaggatagagattggcacagtggttaagaaaacatccaaaactgtgttgttcaagaaattctcttaaaccaatgacacaggtaggttgaaagtaaaggatggaaaaagatatgccatacaaacatgaatttaaacaagagtggccatattaacattcaaaaataatttcagaataaattaataaagacagaggcataaggatcaaataatgaacacattaggaagacatgatgatcctaaatatgtacacaccaaacagaacctcaagatacatgaagcaaaaactgagctgaaaggagaaataaatttaacaaatactatatacatataaataaatgtaataaataactgaagtcttaaacaccatattcttagcaattagtaaaactatacaccaaatcagcaagaatataggacttacacaattgaccaacagaatctgacatttagaacaatttacccgaaacaatagaataccctactttttaagtgcccatgggacatcatagacattattctgggctataaaataaaaaacgtaaaaggattgaaatcctacagaatttgttctgtggcaataatggaatcaaactaaaaatagtaaaggcaacaggaaaatttctaaataacacatttataaataattcatacgtcagtctcaaaggaaaatattaaacataaaaatgaaaatatgttattaaatatgtgggatgtagcttaaagcagtcccaagagggaaatttatagcactgttataaattaagttgaaaagtggaaaggtctcaagtcaatttaagctcctacctcaagaaactagaaaagagcaaaacaagcctaagcaagcagaacgaagagcagaagtcagtgaaattgaaaagaggaaaaagaaaaatcataaaaatcataaaaagttatttctttgaaaagatcaatgaaatttagcaagactgacacagataaaaaggaataagacccaaatcagtgaacaggaatgaaatagaggatatcactacagaggctgcagccattgaaaggataattaggaaatcccacagataactttgtgctcataaatttgacaatgtagaggaaatatctttagttttaattagctttttattttagtttttctcaaaaactaaaacttaataaaactcaaccaagacaaaatagacaatcagaatgtaggcatacctcagagatgtggcggatttggtttcagactactgcaataaaccaaatatggcaataaaaggagtcacagaaagtggtttcccagtgtatatatataaaagttacatttactctatgaagtgcaataacattttgtctaaaaatacacacagtaattgttgctagaaaatgctgacacaaagtgagcacatgctgttggaaaaatggtgctgatagacttgctgaaagcagcgttgtcactaatcttcaatttgtaaaaaaacaagtaaaattaaaaaaattggccaggtatggtggctcacgcctgtaatcccagcactttgggaggccaaggtgggtggctcacgagctcaggagatcgagaccatcctggctaacacggtgaaaccccgtctctactaaaaataccaaaaaaatagcggggcatggtggcaggcgcctgtagtcccagctactcaggaggctgaggcaggagaatggcatgaacctgggaggtggagcttgcagtgagctgagattggaccactgcactccctggagcctgggaaacagagcaagaccccgtctcaaaaaaaaaaaaaaaatcatctatgaagcacaataaagtgcaataaaacaaggtatactgtaatgttaaagccattaaagaaattgaattcttaattgaaatgctcccttaaaaaagaaaaaatctctgggtccagatggtttcactggacaatttaccaacatttaaagaagaattaacaccacttttattcagtctcttctagaaaacaggagagaagacctagaaaacaggagagaagacctacaaagtcattttgtgagtctagtattaccctgacagcaaaatcagagacagcaaaaaagaaactccacagttcagtatcgctcatgaacttaaaggcaatgatcctcaagaaaatattagcaaatcaaatagagtaattaataaaaaatatttaacatgaccaaatgagatttatgccagccatgcaagactggttcaacgttcgaaaatctatgccacccaccatatcaacagaccaaagaaaaatcagcatctatcagttgacctataaaaagcatctgacaaaatccaacattcattcatgattaaaaattcagaaaactagcaataaagaactttctcaactaaagagcatctaacaaaagccttctccagctaagaccatacttcatgatgaaagatggaatgtctttcctctcaggttgggaacaaggccaggatgttcagtcttacctttgctgtccaaaacagtagtactaaaagatatccagaccaaaaaggaggagcaaaacagtcccagtttacggattacatcattgtttatcctaagaaatctagaaaaaaaacttcttgaactgaggagttcaacatagttgctgcatacaggatcaacacaaaaaccatgtttctataccctaacaaaaaatatgcagaaactgaaattaaaaacacaatgccatttatgttctaaaaattgtgaaaaagatacaaacttcaacatgtgtaggatatttgtgctgaaaattacaaaactgatgaaacaaatcagaggacccaaatgttgccacaaaccatattgacatactggaatattcaacacggtaaatgtgtcagttctccctgaattatcgtagcttttatgcagttcctatataaaatcccagcaaagatttttggtagatacataaaaaggttattgaaaaacctgtatggaaaggcataggccccagaataactaaaacgatctagtaaaagaataaagcagttggaatcactctactgatattaaagctttcccttatagtgatagtaatcaagatacacagatcaatgcggtggaacagagaactaaaaaaatacataaatatgccaaattaatttttgacaaaggtgaaaaagcaattcactgatagattattcttctcaacaaatggtgttggagcagaaattggacatccatagacgaaatgatcaaccttgatctaaattttatattttatacaaaattaactcaaaatagattatggacataaatgtaaaattgtaaaactcttaggcaaaaaaggagaaagttagccaggtgcggtggctcatgcctgtaatcccagaactttgggaggccgaagtgggtggatcacctgaggtcgggagtttgagatcagcctgaccgacatggagaaacaccgtctctactaaaaatacaaaatcagccaggtgtggtggcacatgcctgtaatcccagttactcaggaggctgaggcaggagactcgcttgaacccaggaggtggaggttgcggtgagccgagatcgcatcgttgcactccagcctaggcaacaagagcgaaactccatctcaaaaaaaagaaaaaaaaaaggaagtcttcagaatccagaactaagcaataagttcttagtctttacaccaaaatcacaatccataaaagaaaaacttggtaagttagaaccagttaaagactttttctccatgaaagagcatattaagaggatggaaagacaaggtacatactagtagaaaatattttcatctgtctgccaagagactaatacctagaatatgtaaagaactttcaaaattcaataggaaaaaacaatccagttggaaaatggacaaaagacatcaacagacttttcaccaaagaggatatttaagtggcaaataatcacagaaaaagacatacattcagtattactagccattagggaaatggaaattaaagccatagggagaaaacttctgctaaatggctgaaaaaaaaaaaaaagcaccaaatgttggtgaagatgcagagaaacattgctcatacattgctagtgggaatgtaaaatggtacagccactctagaaaacagtttggcggtttcttataaaactaaacgtagaactatgatacaacttggcaagtgtactcttggatagttatctcagagaaatgaacacataatcatgcaaaaacctgtacaccaatgcttagagaagctttatttataataaatacccctacacaggaaacagcccagatgtccttcagtgaacgcattattgaaccacagtacttctgtatcatgattacttctcacaataaaaagggccaaagtattgatgcacctactgtgaatctccacatcgagtgataaaaagcctattctaaaaggttatatgttgtataattccattgatgtaatatttatgaaatgacaaaattctagaactggattagtggcttccagtggctaaagagcagaagagagtaggacggacatggatgtggctaatgaaagagtgacatgtgggatccttgtggtggtggaaatactctatcttggctgtatcgatgtcaataatctgtatgtggtattgcactagctgttcaaagtgtcattgttgtgggaaacttggtcaagggtgaatgggatctctgtagtatttcttacaactgcttgtgaatctgtaattatctcttaataaaaagttaaatatgaatggactgacttctattagaagacaagattggaaagtgccttaaaatacaggtgataacaagtaactcttcaattgttaaaggggaagatgaaagtgaagagatgggcaaaaagataccatacaaacaaaaaacagaatggcagtgttgatatcagatcagttgagactaacagttgaaagcagtaaacatattacggacatattattgataaaagacatttatgaagaggataaactgtgaaggtgtacagacactaaaccatagttgctaaacacatacaaccaaaaaaaaaaaaaaaaaactagaaatgcatgtatattttcactaagtttagttagatcaaacaaagcaataaaaggaatattttgtaccaaagcctatggacacagtgaaaactgtgtgcaggggaaaaaatctacagaattaaatgtcttcaggattagagaatacaaagtaaaaagtgaacaatgaaactccctacatgttcaattttaaaaaatgttttaaaaatggtggtaaaatatatcctaatttttcatctgaatcattaagtatacagttcagtagcatcaaatacgttcacattgtcgtgcatctagtctccacagctacttttatcttggaaagctgaagctctgtacctagctcaggatccaattttttttctcgttagttgtataagaaaattccgacttacttaagtagtggcagttattagcttttgagaacagtttctcttgcagtttcaagatgtgctttgcttatgttgatatggaagcttaaaagaagaattgtagacagtttatttccaggctgaataaaaatgtgacagttgctcttgttatcataaatagaagataccccaaaatttgcaacaaatgttaaaactgcattaccattctcagaataggtggatatcgtgttcttcttcgttgttgctggactggacgtaatggcatgctgatagcacgtttcaatcagatgggcctgagccctgtctagtgtataatttaccttttcatatatactgcaggagtgtccctggtagtaagttctgagagaatgaacgtaaaagttcagcagtcctaaattcagaaaatgatgagtggtgagcctttgtagttaatgacatgattactgccagtcttactgttgtacagtaataacaagagatgcttcatttccaggtccacacaagcacaaattgacctaccacacagggtagtgctttggggacaacttatgtaaaaatctgaatagtacccatctgattatgactgttgtgctttattacagattttaaaacatattgcaagaagttaagcgtttatagaagtctttgaagtcttgttgtagaacttcgggtctccacggaatgtggtttgatcactgctgcattgaagtacacagagggcatgttattaggaactgcattttggatttggaggattttattttcagataacttacggattttatagtgaaaatgcttatgctgatacctatttcctggtttctctgggacctgacttcttccagataaataatatcttcaaaagaatacattgaaaaaagatattgggacatgacatatgttaggaaacaaaaagagactgaactaaccttttaatataaacgtagtatgtcagcaaaccaaagtagctgtcattaagagatgagaatttcctgaaaaaaattacgtaaaatcctactcagtgatattaacacattaaatatatttaacttagacattcttacaataagcatgatttgcaatgccattttatttaaatggcagagaaaccccaccattcaataacatgagttatctttttttccaggaaattatttctgatttgaagatgggagtatagtaacatatcagggcttgtaacatgttttcagaaacccaaattccaggatggtggcacggctgaaaagactcctcagcgttatctgttttcccaggcgatgccttgccgtctctttcctgtttcagtgcttctctagagtattgcctcctcagtagtaaataatgttgttccatgaaatttgagatttttcatattgaatagcttctcgcagtaatgtttgatcctttatgatgcaggtcaccccatctagatgacacagcttgggctgccgtgacattggtagtcaggcgttcagtctgttggaattgcagtgtcatcacccactgcagttattcggttcttgttttctgtcttttaagcataataattaaaacagttcttttagaataaccccattgttagatgtttctggcacttgtactcctggataaaatgtttttgggtctaatttttaagatttagagtctcagtttttccacattgcaacttgtgatactgcatcctcttctgcttaaaatctttcagggaggttcctactgtcttaagaataaatttcagactcctgtgcatgcacaaatgctgctcataataaagctgattgtgccctgcatgtgggcaccagcgagaagaggagtcctgccagcttgtctgcagctctggggctggtttcggtgggtggggacctttccccttcactgagaggtgtcacctgggctagtggagctcctgtgagcctccgtgcaaggctgttcatctagcttcactttcttcctaggcttgtctctccttcctgccagcactacaacgtacgtatggtcctgatcgatgaagctacttcagattccacaagtgtgctgtgctttctggtgcccttgtggtaataacaatagagttaacatttatttatttttaatttttttaatagtcaaggtctcactctgtcacccaggctggagctcagtgatgtgatcatgactcaactgcagtctccaactcgtgctcaggcagtcctcctaccttagccttctgcacccccacacctggctaatttagtttctttttttttttttggtgtgtgtgtgtatgtgtgtttgtgtgtgtgtgtatatatgtatacatatatatatacacgtatatatatgtgtgtgtgtatatatgtatatatgtatacatatatatgtatgtgtgtgtgtgtgtgtatatatatatatatatatattttttttttttttttttttttttggtatagcagtgttttgctatgttgcccaggctggtctcgaactcctgggctcaagtgatcctcctgattctgcctcccaaagtgctagaattataggcatgagctactgcacccagccctgagagaattatttattctcctccttctctgctaaactaattggagagagtttcacttcatacaccaaagtctgcagttaaattcttgctgttccctgaaagactttgcatcttcgtgcttctgttggttgcccatgccattccctctgcttgctttcactgcctcttgcatccagacgttagccggttaagtggagttgtacttgatgccacttcttccaagaactcttctccaggtgcacaaaccagatttttttttatattcttttagcaattttgtagtactctgacaacacttggcacatatcttcttatactcttttgtatatggagcagtatttttataggtgaaagagtctaattttgcattattagtgtatatatgatatgttggataccagttggagatctggtgatgtcataaagctgttggtcttactatgcctttcccagaagtacctgatgaagttggaacaaaataacttttcacctattctctgattactacagtcaaggctccagaaccctagccattgggctcaaatgtgccgttgaaggtgattttctgttcctagatattttcaacctccctgtttcatttctgaccaatttttagggccagaggctaatccactagaacaatatttccctgtggcatggtttttaattttgttctgaatttagtttatattcctaagtggctttacaagttttttctccccatgccctcagaggaagttatgttcttctgaaccttctgggtaccattttagtaaattaagaattcagttcactgaatgctacccctgtggcctgaaagagttaatacaagtttcttaagtactttattaattctcagggaataatttatgcactagagcgtggcttagtatcgagccagttacaaacacattaaatatgtttttttttttttccttttgtgtagtaagtctctgaaaataagtggaggttcactttaagtgtaagtattttgcttcctaagtacttaaatatgtataattccacaatgagagaaggagtattataacagaggatgaggtggattcaggtcctagctcagccctgcacttctgtgaggccttggtgtgtttacctccctaaatgtctctcacctctaaagtggggacgatgtttacatcacagacagcaaagctcaatgatgatgcacttaggttttaatgcatagcccaggcttactgcttgggtttgattcttggcttcactacttgataactgtgtgatccgaggcaattttattaccctctctgactcagctttttccactgtaagctggaataatgctagtacctgactcacagttgttacgaaggtaagtgtgcagtaaatgtgagccattcatatacatcatggactactatgcagccataaaaaggaacaaaatcatgtcatttgtagcaaggtgggtgcagctggaggttgttagtgaattaacacaggagcagaaaaccgaaaacaacatgttctcgtaagggagaactaaacatcgagtgcatatggacataaagatgggaacagtagacacttgagactactagagcgggagggaggaagacgcagggcggtgaaaacctacctgttgggtactatgcccactacctgggctatgggctcgtctgcaccccaaacctcagcatcatttagtatccccatgtaacctgtgtatgtacccccaaatctgaaataaaagttgaaattgtttttcaaaaagtgagctgttattttttttaaatactcatttggaggactttctgagctgatcaagtgaaataaaataaaaagtgccaagtactatgcctggaacatggcagcaaacagtgaatagaggatgacttttgcttttattaactacttaaggtttatctatagcaagttccagtcttaagatgcacatgtgaaaagctgcctgtcacatgaaagagtttgatgccatgtagcttgtcatgttgtcagactctgtccctggagtgtgcccctcacgtttttgtgcatgtcactgtggcatttatgtgactggtctgcgcttctttctcctttttacccctttggctgcaggatgttgaagtgcacttcagttttgtcgttctcatttcccttctggattcttgctcctctcctacttctgctgcctccttcctcagtcccccattgccttcagctgccctgtggttgcagtttaaaaaaaaacaacaaaaaaaacacaacaaaacaaacacacaacagcctatttagatgtatacctttgactttatgagggctgtggttttgtgggaagagcagggtctcacccttattagactgtggttcataatcacttaaagagaacgtcattcttggagttactcatctgaaaaagaagcctgctcctccaactggaaggggaatggggctggggagggagggggttactgttggatggaactgtgcttggctattggacctgagtgactgaacacagtgtccatgaaggagctggctaggcatgtgttctgcggggaccagccctgtgagggcagaggactaagaagcgaaggatatgggcaaggaaactgtggaagtcatacctgcctttttgggccagagtacatgtatcttttatttttttttgagacgtagtctggctcggtcgcccaggctgcagtgcagtggtaagatctcggctcactgcaagctccacctcccgggttcacgcccttctcctgcctcagcctcccgagtggctgggcctacaggcacctgccaccacgcctggttaatttttttttgtatttttagtagagacggggtttcaccgtgttagccaggatggtctcgatctcctgacctcattatctgcccgcctcggcctcccaaagtgctgggattacaggcatgagccaccgtgcccggcctaagagtacatgtatcttaagaccacatcctggattggtagatacagaaggtttactccttgggcagtgctggactcttgatgaagtagcaggtagaggatgaagtttggggactttgtgcctctcacatttatgcctgctttttaatgtagcccaataacaaaaggtcatgctattggtgatgggtgggtaaggtacctactaacagtaagtttagcttagggagaggtaagccattttaagtctatcagtatataatggatcacagaaggagagagtgggagacactcagtctatcagaaaacataggatggatgtgccacagaggaagaagttgtcacttaacaatgagtgtggaaaaaaacaaagtttatcagtgtctgtgtgggcgttatttatttggggacagcatcctaaggcaggcatattcccacagtggaaatggatgtggtgtgatgccatgaacttgtgaagcaagtgagtccctttgttgtgattccaaatttactcagcacataactgattattatctgctccccagtgtagttgtagtgggacagattacattgcccagaagagttcagtattcagtcttcttggtggttattttgttgtaaattaataatactgatagtatgtcattttgctttttataattgattgtctttaactttgccctgaggcatttttcctaatcaactctagaccatgatagagcctttgggccacaagactaacagtcttaccttgaaccaccagtcagtgaggtgtttgggaaaaccttttcctggtgatgtctcatcttttccttctacagtcaccaatgtcatatttactgtgttaagatgctaggctttgtactggcttgtttacttctcacgatttatcttgcagtatgatagtttgtgtgacactgaaaaaaattagtaggactgttaaaatagttttttccccccattaaaagtagaatgacaccgttttgcttctgaagaatttggctttaactggtttatattttgagctgggtattaaaggagaattatggtagggtaaacacaattagtgacatctggttgccccaagaatcaataatatctgatactacatacataaatagatatctatgttgtgataatatatcttagtttcactgggtaaaactagaagaataaaaaatttgaaaacagcttggttactgactaagctgcagcagttctgagagcctactgttgtcatttttaatgggcagccttgtacttccatagattggttaatcttaaaggccagatggtagttgtattgtaatttcataaagattttatgtcctatgttttgctttcaactagaagcatgagaatttaggaaagttatattgagacatataaataataaaaattggtgaatcattttacctaacaatttattgatattactcaacacaaggagaaaaattagaaaatggaccttaacaccactgtctactatgaagacagtatagaggaggcaggaaaaacagaaagcacacaataacatgatagctataaattcaagtgtcagtaattacaataaatgtaaatagactagaggattctgctaaaagacacgtcagattggattaaaaacatctgagatactaggtttacaagaagcatatctaaaaacaaagatacagaaggcaaaataatggaaaattttatttcaggctcactttaagcaaaataaagctggtataacatgttgatatcagacaacatagaaatcaaggcaaaaggcattagagatgaagaggatcactgcacagtggtaaaaggttcagttcagatataggtacatattatataaagcaaaaatatacagaaacaagaaaaatagctgaatgcacaatcctagtgggaagttaacatacctttctgaatagtacaacttgcagacagaaatcttaggatatggaagacttaaagaacatgatcaatgaacaaatctgacctcatggacattcatagaatgttacagttcctgtataatccattcttttcaagcacatggagcatctgacattgattacatataggaatataaagcaagtattgataaatttcaaatgattgaaatcatgtagagtatttttcttacggaattatagaaggaatcaaccaaaagataacaggaaaatccttgtatgtcaataaattaagaagtatatttcttataatgtataatatataattttataaatatataaatatatatttataaaagtttcatttaaaaagttttacaaaatggaaaaatctgtcacttaaatacaaaatcactgtacttctgaccctactaaatgtaaaaattgtcaggatttgggaggttttttttttgatgtccaaatacttgatacacgttccagagatccccaatatttttgtgaattcttcttaggaggctagtgatcatgtatgtgggattaggaaagtaattgtttgagctaaatgggggaagagatcattcctgctggtagcagggagggtgtgccacgacgagagatctgtggatttactgaaaacacgagatttacatccagagcttagttcacaggctgtggctcctgtttttattcatttagaggctgatagaccagctgtgcctgtagttacgtgttctttggccagacacctaaggaaatttgaggctcagacaagctgaagtagatatttctgtttccatgttgaataacagagccactcatgggctgtcacagatacactgtttggggttttaccattccttcccatttccattcctgaaggaaaaagagaagagatttttctttttttttcagattattactgtgttggtgacctagggaaaccctttttttttctcttctcttttcacaaagttctgaggagcatgaaaaaattgaggtattcacagtgtctggggaggaaatgagttctgtcctgtattttccgaagagtgggaatctaaatcggaacaggcaccaggttgaagaaataatttgtcacatcatggatgcaggaacaagctctacatgggaatactttgttgtagttagggtctgtcttgagggaaaacaagacataaagggtatgtgaaatgttttctggtgatcatatcccaccgtgtcattagttcttttaaagtactttttctatattatcccaatttagctttttttgcaccctgcagcaattctatttctattttgtttcctgttatcattgttcccttttctgagtagaggatagataggtaagtggtgtaagtaatggcatggaaagatccaagaaccattaagtagattatatccctttttactatccttttcttaaagtgcttgacttaattctgaatagccacttacaaactttgatgagtatctttcatcttgggggttattttgaaaattgatggcatttggaataaaagttgctataaccttagtgtacgtttgggtttataaaatatactgaacataggaactcacatgactcccaatttttgaagtaaccataatttctaaaaaaaattcaaatgagctgagttacatttataccactcctgggaattattagaatagcatatgttctctgtttatgctctttgtaaaattggaaaagtaatgtgtagctctttttagtagtgccctgtgtgtagtttctgtaacagttctgtaactgtaacttaccattccagtctatttctgaatggttagtggagctgcccgtcaaagccagacctattacaagggatgatatttcccctgtcatgaatagaaactattgatgactcgattaacatacaaggatgatacagttcatggttaaagggagcatgcttccttttgctggtgaaggaacattaactgtagatttcatctagaagatcactagaaaaagcagcctcccatgtttgagcgtgtcctgcatgtcagtttccatgcagatgctttctgtacgtcttcacgtcctcctcatccatgaggttggaggtgaaagttacgtaactgacttgctcagggaacacatttcatgttgcaaccgggctccatagccacatttcagaccatttttcttttctttttttttttttttgggacagactctcgctctgttgcccaggctggagtgcagtggcgagatctcggctcgctgcaagctccgcctcctgggttcacaccattcttttgcctcagcctcagcctcccaagtagctgggactgcaggcacccgccaccacacccggctaattttttgtatttttagtagtgatggggtttcactgtgttagctaggatggtcttgatctcctgacctcatgatctgcctgccttggcctcccaaagtgctgggattacagcgcctggcctgaccatttttcatttaaccagcattcagattattaagtcaaacggaaaaaaaaaacagggatataaacctattagaaaccaatgtgactgtttcatgccttacatttatgtctggaaagttgaatataaggaaaaagttgttttttgaaatagtttttcattggttccaatgattattcgagagttttccgtgaaagaagtataggtaacataataaaagttaaagttaacagtcttaacacttcaattgtaagaatattttgtggtgtcagtgtattaatagctcctgaaagaaaattgtcaaatgtaatcagtctacatttttttcatgtgtatcaaagctacccatttattaaatcacagaagttaattgtgtttcattgggaattaatattgactttataggtcttgggtagattatttaaatagccctgctagctaatatgttaacccctgcccttattacaaatacatcctgacggataagggcaaaatattattgactagattatgcttgaatatctcaaaatgaaaacagaatgaagcagctaaccaaggaaacgattggacttaaagtgtacgtacttgatcacgttaaagaggcctcactgctgtgtaacaatagatgcttaaaataatccaccagccaacactcactacatgtgaaagtggtttactttcttgtgtctgtggggaagctctaattatatgattataattaagctacagtttattttctcattttctctgattaaattgtggtgggaaatatctggccaaatctagtcttttcttagtcatgttatttgttaattccattgacacatcttattaaaatttgcagcaaggtgttttcctgttaaagtaattgaagatttcagagtatcttatatctaaaaattgtgaatattctctgaaactagacctaaagttcttaaaatataaatgcgtcattcacgtagattatggagttacttttaaaatgtagctatccactgaagaaaattgtgaaaatgtcccattaacgatttgcaaatttatttatttagagatggggtcttgctttgttgcctggggtggagtgcaatggtgcgatcgtagctcgccatggcctccaactcctgtgctcaagcagtcttcctgctgcctcagcctcccatgttgcttgcaattacaggcctgagccactgggcctggctgccatttgtaaatttaaatcttaacacttatgtggtgtttccagttagatttcttctccgttctttgcatcaccttcttagatcttccccattcttctcaatcccctgttccctccatcttcacggtacctttcatggaggaaatagaagccatcactgggaataccctcagctttccaccgacaaatctattcctgcagacacccgtcattgcaatttatattttaacaaaggcttctgatcctaatttcaggaaatagcctctaaactcatctattagtcccaaattctttacccatttaatctgctattttatgcctcctatattcttaccttcagatgttgagaggttggggcataaaactttgcagcatgtctgcagtcttccctctagagtgaacttgatcctgctgtttgttctttttattctcttcaaagttaaatcatgttccagcattcatggtatttctccagcttgtcctccacgctcaccccattgtcatgaggactgcactgaacaaatagacaccttatagtgcttataggccatagttgctgacagataacacggtttaaaaaggaagtttcacagccttgtagcttatgaattcccatgtcagcctcattagcttttacaagctattttcttagcttgtaagaatgttgctagggattcacagttaatataaatatctgtagttttggaaaattgagacagtgcttgcccttctctagtcatcctgtaccttttagatttgacctcttttttggggggtgggggttggtggtgaaatataacaaagtgcataaagcagatgtacagttcaaccaactgtaaaataaacatctgggcagttgccgtgcacatcaagaagtaggacgctgccagctctcggaagccctcgtgtttgttaccgctctttaaagattgaggcaggtgttccatgaccttatccccaagtctctgtgttataattcatacgagttgggaggctgcagtatatttggatgatctaagacctcctcctttatttttgcttaccattggattttagttttctctttccaatgtttattttctgtgtgtattctgaagataattttatctgaccaagaaagtaggtatagaactaagtgtgttgtctgtaattgtttgttacaatataatataactaaggaaactttttcaatttttgcaaacccaattttattctgctattgtttcctgataggaattttgggaattttagagatccctgcgttcttttgtacaaaaaatacatctttctgaggccaggcacggtggctcatgcctgtaatcccagcactttgggaggccgaggccagtggatcacgaggtcaggagttcaagaccagcctgaccaacatggtgaaaccccatctctactaaaaatataaaattagctgggcatggtggtgcgtgcttctaatcccagctactcaggaggctgaggcagaagaaccgcttgaacctgggaggcagaggttgcagtgagccgagatagtgccactgcactccagcctgggtgacagagcgagactctctcgaaaaaaaaaaaaaaaaaaaaaagatacttctttctgttaaacatttcctttaaaaatctaaactcatcagaaaaatacctgcttgaccacattaatttcttgaagtatctctttcttttccttttggaatcatgtgtttgtaaagtcacatgatttaatcttctagagactctggatgcttctgttgttgatgtatatgtgcacactcacagtcttaaggaatttggcattttatgtttcactgtctttttactcttgctccccttcttttagtgtttttttttttttttttttttttttttttttttttttttgaggcagggtctcactctgttgcccaggctggagtgcaatggtgcgatcacggctcactgcagcctcagtctccctgggctcaggtgatcttcccacctcagtctccctggcatctgggtttcaggtgcatgccacgatacctggcttaatttttttttttgtagagatggggtcttgttgtgttgcccaggctagccttgaacacctgtgctcaagcaatcctcctcccttggcctcccgaagtgctgggatgacaggcatgagccgcacgcccagcccactccccttcctcaccagtcttgagcctcctgttctcctttttcccctgtctaggccctcacatccctccacttttctctttttccccatgacttggtcatgacacagaaacaaagtccccagtgacagtatcttctcaaaaaccaaacagtaaactctgaactttctttgctattggattcatgatttgtgattaagcgtattttcccctttgcaggctcttagttatgtgtggtagatgtacttctaaattacatttgctttaaaaatataaaaagtatagagtaacataaatgatgtagcataataaaactttaaatcattaatgatattcatagattgacatataagctattcccagtcattttctttttttctttttttttgggggatggacagagtcttactctgtgtcccaggctggagtgcagtgacaggatctcggctcactgcaacctctgcctcctggattccagcgattctcctgcgtcagcttcctgagtagctcagactacaggcccatgccaccacccccagctaatttttgtatttttagtagaggcagggtttcaccatgttggccaggttggttttgaactcccgacctcaagtgatctgcccgtctcagcctcccaaagtgctgggattagaagcatggaccaccatgcccagccctcattcatttcttgtactagaagtggtgatctttgacaatttgttttaatatgaagttgttttaatgaggggcaaatatttggagcaattagctaatcattacaacgttttttttttttttcttgttttgtttttctcttttctttttttcccccagctactgctcctcgcagagcagggctaacccataggtagtgtgcccagagtcagccatcattacattgttcacgcttacagcataagttaaggtaggactcaaaaaatttttctgtaaagacaatctcagaattaagtgctttcaggaattactatgcagctagaattttctgtaggattgaaggttctagcagctttgagcattgatactgatcttgagaatgaatccaattggcagtcatcccctggaagacttaatttgaggtctttatacgtacttgcgctacagtaaataagaatgtgtcctagatggaggcaaaatggggtgggtttcaagcatttaataaatgtgttaaacattttaactattatttcctcttttcaatttcaaatagtgttaaatgattgttatgggtaggaatagggtaaacccatttctagggcatggtttagaacattggtgcagtttttttcccaagaatatcttaatcacagccctggtttttagtctgtttttctaagaactccgggagttatgctggtttcctcagggattgtttttggcattttcctcatcatagaaccttatggcatcaccttggagacacagcgttagtttaaggaatggacatgtgatcacgcaggtcaattggagtcccatttggtgcttttctgtaggagtagcagggagagactgcctcttctggttggattgctagtggtgtgtgggctgccaagtggcccccttcctggcaccaagcagaatgcagcacacacagggagcagagcccggaggcttgagcctgatggcacttgaggaatctgggtcctggaatggtagatgtcctccatgctacccacttgcatagtgaatacattgcctttttgtctaaggttaagttttcgttgttgttgttacatgcagaattgagaaatatggccaatatcttagggaaggtggcaagttaggaactgtactagcaggctattaaaagaatcacagaggctagtagcctttagtttttaattttttgattgtctatttttgcttgtttgtgatgagtatttctacacctggccagggatgcattcagataaacattttggatacctcctctaaagtgtctgtccacaccacaggatcaccgcctggtcccttagtgctgacattccactccaggagatgctgggctcccgggtggcgcgctgtgaggatgctcgagctgtatcaattgtgaacctcactttcaggagttcagtaattgtgagacggtatcttcaggcattgtggaactctttgggggatgtgacattccagggcattctggagaaaggaataatgttcagtaataaaaccctggagacaggaattcttactgtacctgtgacccatgaagtcttagggcaaatgtagaaggctctgtttggctgaatgaatcttgaggcatccaccttgccttggagttactttatttacagcaacagacacactcacaaagaaagtttgtaagcaaaatattacaacactttgttttgcttctggttctgccattctgctgtcatctttgcaagctgcaaaatgtgagggacaggagaagagaagtttttttcctcttatgtcatggccttcagcattcttagaccagagcctgctttctttaacactctaaccacttttattagtttgcttattcagtggtagaatgtaaactccaagaggtcaggagtcacactagtcactatattcctggatagccccagccaaatacctgacacagcaggtgcttgatagacaatctgttgaattatatgcaatctgttgaatgaagctcttaagttatctagattttaggaactactggggcagattctcatcagacaggtgcaaagaatgggtattttaaagcaattagatttaacagaacatcattatgcaaatgtagctctgggatgtcccactcagatgccaggcttataatgttattgaagtgttacatgaatttgtgtgtgtttgtgggcggagtggattctcttgttaatattgggcctcaggtttattgatattttcgatagaaataacttgaaaattgctgatgaaagatacaaatgtttctttcccaggtgttttaaattttcttaggaatatatgacaagctggcgttggattgcgtgtcctaggttttgttaccttggcccagtgctgctgtcactatcccaaccacctggtctgtctgatcctggagcactgggtgagaagctgtttattctgtcagtctgactgtattagcagtcccccctccccacagaggcagagaagactccactctgttatgtaattgtgagtgctgggagatagtggggggagttataatttagggaatttccatattggagatagtactgcctatgtgtcatgatgcatttgacatcatatgggttattcatcgatgggttattcaacacgtttgaatagtaaggcctccaattgccatttatagcatatgtgctaaagaaacaaaatggtgtgttgggagttacatccatcatctttcccctttggttgaaatttaaagtgacagactgttgtactttaaaaaccgtattgatcaaatcatcttaaacacatactaaattcctagaaaaaaatctgcaattgatactgtagttttttctatattacaattatttatggccaggtgtggtggctcatgcctgtaaactcttcgggagattgaaacgggaggattgcactcgcatctggataacagagtgagaccgtgtcccttaaaaaattcattttaaaacccgaattgaaattagtcgtaaatttttaaacacttatggtgagaacatttgcatttctatcataggacctctgtgttccttgttcttctattccactttcttgtcccaccttctggtaactgtggttcttgctttttctgtttcaagttcttgcccttggcttctcttcccttcccagcatctctgcctgccttgggtttctttctactctctcaccttcgtttcccacatcttctctatttgttctccgccctgtgattcactctatatttaaatctacaattttaccctccctcgttggtttattttttaattgtttctaaatctcagtaagcaatttgaaataagagcaaggtgtggtgcctgatcaattaccctatggctgccacctctttagaactattggcttagaaatcacctttggtcacacgaaatagggcatttattgcaggtttattagtggggagaaataacaattgttccatgcacagtattggtgcgtttctattctcaatcaatcaagaataaccggtgaattttccaagatggttatttaaagtgctatactaataatactgaaagtaagccatatgcacaacctggcaattttttaaaatatcttttaagtactatatatctaagagcagattacattttcagtggcagtcctcattttctccacattgagttatgtcttggtaccacgctttattgcaaaactctcacaactaaaggatttaaagtttattattgcgattttaaagcaggatagaaaggaaaggagagaaaaataatttttctgagtgaagggacctagttcttataatagcattttgatctgaggactgtgctgtgataaataactcttactgtagaatctagatgaaattaaccctgggagaaccctatatatccctgaggcatttggtggccgactacgacagtgtgtaatctgttttcacatagtatagtacacagatgtatatgtgagctgagtgtaaatgcagacttctttcacctttttgaagactatctttttgaagacttttcttggagaggatttatctaacacctgtttgaatcttctctttttgttatcgtggtgatcttatttgagtagtattttggtgattgtgtttgatcataaatatatagcagcagaaaatttttgcagcaccaaactcataattcttggatttaccatatctaaaggaatgccaattttgcatattttttcctatatctttacaagcctcattaaaatattaaacttaaaaattttttaaagcataattgcgtttttcttttcaaacttctgaagaaatgtacaagatttaaaattaattttgataaattaatttgcatttactttgtaagccagcactttgtagtgtgaaataatattgaaaatgggaaacaatatgtattgataattaaatgaatatacaaccagttttcttcccggaagacattttcatgtaccatgtaaaaggtactttttggaattatttatacttttatagttttccatgcgtgtgtgattagacttctgagaaaaccttggataattttacgatgataaacatttatatttcatttcagtgtagttcagtcacttaaaaatatccacttaattttattttggggacaactgtagattcacaagcggttataagaaataatacagagaaatcctctgcccccttcatcagtttccccttatggtggcatcttgttaaatgtggagcaatgccacatctaggatattgactttagtacagtcaagaaacagaacgtttccatcaccacaaggatctctcatgttgcccttctgcagccacactgacctctcctatctccttccacactgctcggcaaccatgaatctgttctccatttctataaatttatcatttcaaaaatgttatataaatagaattatactttggatattgctcttttttcattcagcatagttccctgacgattcatctagattgttttctatttcagtaattcatttcttttttattaagtagtgttccatggaaactgtgtaccacagattgtttaaccattcacctattaaagacatctgggttgtttccatgtttcggtggttacaaataaagtcgctataaacatttgtctatagattttattgtgtatccatttttttctgtgataagtgcctaggaattcagttgttggcttgtatgttaattgtatgtttgttgtttaagacagcggcccccaacctttttggcaccagggaccggtttcttcaaagacagtttttccatggaccaagggtgggaggtggtgtggatggttttgggatgaaactgttccacctcacgtcatcaggcattaggttttcacaagaagcacgcagtctagatccctcacctgtgcagttcacagtagggtttgtgctcctatgagaatctaatgctgctgctgatttgcccggaggagctcaggcgggaatgctccttcgtccactgctcccctcctgctgtgcagcctggttcctaacaggtcatggactggtaacagttgttggcctgggggttggggacccctggtttaagaaaccttttttgaagtgttatactattttacgttgtcaccagaaatgtgtgaatgtgatccagtttcacatcctcatcattatttggtgttaccattatctttcattttggccattctgagatgtatgtggtgataccttattttggttttaatttgcattcccctaatgttgaacattgttttttcatgtgcttgtttgtcatctctatatcctcttcagtgaaacgtttatgtcttttatccattttctaactggatcgtttttcactgttgaattttaagagttctttatatattttagatactaggcatttgttgaacatttggcgtacaaatatattctcactctgtagactctatttccattcttttaacagggtcttttgcgtagaaaatgtttttaattttgatgaagtcagattgataagttttttcttttatgggtcatgcttttgctgtcgagactaagaattctgcctagacttggatcctgaaaattttctcgtgtgttggtttcttttaaaagttctgtagttttatgtttcacattaaagtccatggcacattttgagttaacttttgtatatggttgaggttctttttttgcttttaaacccatggatatgcaattgctcctgcaccatttgttgaaaagcctattttttctccattgaattttttttgcacctctctcaaaaatcacttggacatatctgttcatctgtttttgcattttctactctatttcattgatctgtgtatgtcccccagctgataatatattgtcttgattactatagctatataataagctttgaaatcaggtacactgatgattgcccctttattttctttttcaaaattgtttctggttattctagttcctttgtcttttcagataaattttagcatacacttttctgtatctagaaaaaaatcttgctgtgattttgataggaattgcatcaaatctttggaagaattgacatctttactgtgttgagtcttccaatctatgaacatggtatgtctcaccatttgtttacatcattgatttctttcatcagcatttttagttttcagtatatgagtcctgtacatgtttcggtagctttacacttaagaacttaattttctttggagcgattgtaagtagtattgtattttaaattttggtgtcagtgtgttcactgctagcatataggagtttttatcttatatcctgtgaccttgctgatttgaggccgcaacttctgcagtgtaatgtaaagccattgaacatggagagggcaaaacaaaaaagtaaattggagtgcctcatacaggagtagattgtttgctagagaatggtggtagtggacatgtgtctcaattgtattcattttcagtttgagtgagtcacttttcatcttgtgcttttctaacacctggaacctcttttccaagaaactctggttccttttaggggagaataatttgaaaaccaagattctgggtaccattgcaataggaggccattacttcagaactctttcagtggtcggaactaagaaataaaaataattgagtttgtatcaatgttttcaattcaaatttagcagaaaaattcttccccttaacttatttcattatatatttctattcattttctcttacactgaaaatagtgatttcttaatgatatcaacttatttgctttatcttactatacacataaatgttttaaaattgctgtattaaaattaaaactattgaataaaatttaagatttccttgcaggtttttttgaagggcatagtcctttcaatatatactgctgaggatgtagagacagaacactgactttagaagtctcttcaagtcttttttccaggctgggcgtggtggctcatgcctgtagtcccagcactttgggaggccgaggtgggtgtatcacctgaggtcagtcaggagtttgagaccagcctggccaacatggtgaaactctgtctctactaaaaatacaaaaaaattagctaggcgtggtggcgggcaccggtaatcccagccacttgggaggctgaggcaggagaattgcttgaacctgcgaggcagaggttgcaatgagccgagattgtgccattgcactccagcttgggcgacaagaatgaaattctgtctcaaaaaaaaaaaaaagtctcttcatatattttttctgtgtagatattttaccgattcgatgttaatagtggtttatttctgtttctctaattctgagttttcaatttctggattaattctttccatataaataggtttgaagtcaaaattaaataaaaagttctacatagagaagcattctctgttttcattcttcccagtatcaccctataggtaaccatttttattacttttttgttgtaaaagaaagtacttgctttttcttccttctcatacacaatgtagtagtctatggtctctggtctcctcctttctttttttttttatttcacaatatattttggagattactccattatagcacatagagatcttcctcactcctttttacagttacattaagtactgggtaattttgccatgtgtacttttattagatcctgcagaattcccctttatggggattttattttgtactttcatcaacagtgtttgtgacgttcagtttcttctgaggcttgtcacaagagcagatttttgccagataggtgagaagtgctatttcagtgtagtttttatttacatttatggggatagttgaacatctttaaaaacatttaaagacttttgtctttttgtcaactgttggttcatgtcttttgcctatttgtatattggatttttgataattattgtttttattttatttatttatttattttgagacagagtcttgctctgtcaccaggttggagtgcagtggcgtgatctcagctcactgcaacctctgcctcctgggttcaagcaattctcctgcctcagcctcccaagtaactgggattacaggcatgcaccaccatgcccagctaatttttgtatttttagtagagacagggttttaccatgttggccaggatggtctcgatctcctgacctcgtgatccacctgcctcagcctcccaaagtgctgggattacaggcgtgagctaccgcgcccggcctattgtttttatttctaaagaggaaggaagattatttatttggaagataagttgtgaaagttacttcccagtttgccattggtcttttgactttgcctacaattttattttatttatttatttatttatttttatttttattttttgccaggaatgagttttaaagaatgtatcttttttatatttgtaatttgtcatcgttgtaatttcatgtgatctggatctttaggtacatgtttcacaatggatggaatagaaaagttaggaattttgtgtaggaaagcaaggaatagaatagaaaataaaatagaaaagttaggaattactttttatgtttgcattctctagctgctcactttttttgactatatttcaagccaactgtcacagggcatcattccaggtcctattttggtttctttcctcagtcaatactagaaaaccacagagtgccattcccggcatttcatctatcccatacttgtcatttgtaaaacaagtgcctagtgatgttaattatttctgtagagttgcatttatgctcttttaatttttctgtatttgtgctgaatttccatagtctgtggacagatttgctctgggtgctatagtcagctgagttggagtctagaccatttataacttaactcttcgacctatttaactgtctgcttccttgctcttagtttgagttactcaaattccagttgccttaactgtaaaattggctagtagagccatgtacctccagggaattcagtgtattgtttagatgatgattaggtcttatttatgttttcatataagctattataacaaaattgcagtttaaaatgaatatataggaaaatgttttctttagaaacttagaataaaccagaacattcttaaatttccacttattgcatgttgatggagcttgactctcttccctgtaaggatgaacattgcagaaagactgtgaaaaagtggtgccatcacatcatcagatctcttattgcagaagttataattctaagagaaaacaatctgcaataaggagttctatcatatttttgtaagtatattattgacttccaattaaaattagtcctagtaataatggcatctgtgaataaggaaatctgaaaccaataacgtgtaaaattgagttaaatattgttgagccagttatataagtcatgttaatttctaggtgttacaaacagaagaaagtgttctcaagcttctccgttccccagacagaatctgctgggttcctgctattgacatcaaagttacttgttctcccattaggctgctgttaaaacgaacacttaaaaattatcttttgtccatcatacttttgtgggaaacatttttctccaatggatttcaaatcccatatctcttactatggtatttccatccaattttcatggttttgaagcagagcaatcagtatggagtagggggatggagtgaaaatgataactttataattaaaatcggcacggaagggtttggatcacgggatggtgggattaaaggtgtaacctgtgaggacagtaacagaggagacccactggaaacattgtaggacttggagagcctgtcgggtgagtgccctggggatctttatgtgcccatttgtcattttcacttctagaagtgagaagcatcaggacactgtctgtgccacctctgtcttcccactctattccaaacctcctgggctggtaggagggctgaatgagataacacaaagcacttagaaccgtgtgtgacatgtattaggaactgaagaagagttagctattacacataacatttgattggtattaaataatataaacattgcttcctgtactctctattatataaataaagagcaaggaatggtgtgtaattctgtgaaactgtgtagtctcagatttggatctgtctttgcatgtgctgcttcctcctgccccagttagtaagtgtcaataatcatgtaaattcttttttttctttccttttcttttttcttttttttctttttgagacagagtcttgctctgttggccaggctggtgtgcaatggtgtgatattggctcactgcaacctctgcctcccaggctcaagcaattgtcatgcctcagtttccttagtagctgggattacaggtgtgtgctaccatgcttggctgattttttgtatttttagtagagacggggtttcaccatgttggcgaggctggtctcaaactccttaagcagtccacctgcctcggcctcccaaagtgctgggattacagacgtgacccagtgcacccaccaataatgtaaattcttactgaaacagtcatgcttgtgtaggtactgtctgtggtcacttttgttctacaatgacagagctgtgtagatgtgacagagattatacagcctgcaaaacaaaatacttagtatctggcctgttatagggcaagcttgccaactcttacatacagagtgttctgatccaaggaaaaagtaataaaaagtacccaattatagagcagcttcctgaaatcaacatttgttctttcttttacatctcctattgaagaataggatgttgtatataagaggatagcacaaaatgtttcctcaagttttcatttatgtcactgaagagttgactttaaagaattattataaattaataaaatgtaaccatttggaataagctatgtaaatgaatttgaaagtttgaagttgttgcttttctttagtaatgaaaaactaacccatgaaatgtgtggtagatttttcacttattaagagtaaatatgcgcatttatggcgtgcagtgtttcacttaagaaagtgggtatttcagggcagcacctagccactgctggtgtacagtgcggactgggagcacagtgccctaggcacaggcagcctgtgagtatccgtggcagttcgtttctaactagcaaaggaaaaggacttctaaaatcaatactggttttaaaatgtatcattactgttatttggctcagttggattcagagccataataaatagtatgaacatcggcctaagttaaagtttgcatttagacctgattgtgaatggaaagatgtacatatgacttgagagagtatggttttgacagagtggttgttaatgcctcagaactaaagaggtttcatgaatacataggttttcagtacagtctccttaccggcaggggaatatcagacaagtggtgtttttcagacagtgaagcagatggctctttctcttcagtacagggtgtaccaacaaagagagacagttacacaaatgttaacccctgagggagagagaaaacaattgcagtcagttgttctttataagtctgtatcttgacttcacagtggtgtgaaaaagtaatttcttcttttataaaaagcattaaatgcacaggagcagcctgtaatctgagtccaactaaaatggtggaagatgatgtaatcacttaaaaaggaaacagactgttatgtttgacatttctggagtaacgtggtggtggactacttgggcccgatataccgcttccaaattctcgttaaaacgtccagcagttgtgctataaagcaaattgccatatgccaagatctgggcagaatgttcttcaatatggctggtgaaacagattgcgaatggtcttggactatatagcacatgttctattctctgaactagaacaagacaaatgccccacgctgggtaggacatgttttaaaattcatgtacacagtgtgcatagctttgggaggccttgggtcatgctgagtggtccaagtttgtcattcccagtctgtggagccagtcatacctgggtccctcacctgctcctcctctgtctccactagctcctttctctccactttgacttaaaaacccaaactcccaacatgcagccccgcagcaggaggcagagggaggtgctaagggtgccgtccaaccctgactgcaaatcacttaaaagctttttgaaacggaggaagagccgtgcatccccgtgtttcgtgtacaacatatgatacatgtgacagttgacaagagtgcctgagtctcagagcaggaagagttatcctgcctccacatgcattgaagggaatatatgtcacacgttactagccaggctcagaggagaacacatctcatttacaagttcaaatctgaaagggagaaatgtgctagtatttagtggatcttgaggaaactagggatgtgttacccatctgtgcaggaacattagatctagatggggctctcctagtcaaaacgctgagcatgtggcgtaggaaaaaatttccaggatgcaggggaaggacagaatgacttggaggacagtgtctctctctgaaaatggttacatgtgaaacacaggtaacaaatttaggataaatctggtatcttaaaaaaagaaacatgactttgggaaaagaagaaaccagggggccctaagggggaaaagactgagatgaaaacagaaacatacaaacaaaaaagctgatcgaaataaaagaatgcgaggaaaccaaaactgcaatgagacttaaaatccctactaagataatcagaagacttgatctccaaaaatagaagaggagtatggatggcaaacttggacactctcaggatgcagaggagaaaaagataaaagtgggtaaatacgaaaggtagacgtggaggacagataatggatccttcacccaagaggagttcctgaacaggaaactgaagtcatctggaaaaccacaattaaattgactgcactgcagaagagtgtgagtaaatagcataagaaaccctgacagtcggccaaaattaacgaacagaggtttctacttagatctatcctcacaatttgaatttttaggataaaacaatcccaggagatagagcaggttgtgaagaaacacaggttaggtttgtctcaggtatcttgtctattaaatgctaggaatctgtaaggctgtggttcagtaactgtcatcagctacgttgttaacatacagtttacaggctattcagatgtaaaacaacagcatttatgttccattcaccccttaaaaagctacataaatatgagtttcatccacggaggagaccacccttagattttaggttatgtctctgactttgaagggagagagtctggagcagtgcgaagtcttacagcttcctgaccttttgggaggttgggaaatatttatgtgtgtcctgtgactggtagttagcagaaaaggctcccaagctagtccaacacaactgatcaggaagttgggtcatccaacagaaaatgtagcccacgttacagttagaaaattaaaaatccagggctaggcaaatgctttcttaaatatgatatgaaaagcacaagcaataaaaggaaaatgataaattgaacttaatcaaaatggaaaacctctgtgcttcagaacacgccctattgcctcttaccctgtgtaactaggagggagcccatctgaggacaattcaatacctcaggagggcagagcggaagagggcaagaccctgagctttgagaacgtcactgggcccccaaaatgaaccctgtaacttgctgtacctctgggttgattgttgtgtgagatggtcagtttctctgttgtgagagttggagtttgttacttgcagctgactacatccttagtgatccatgctgaaagaaaaagttaatgccagcccaggaagagagcacacagtgtaggagagcgtgcattgcaggctttactggcagaattgcaaatgtgtaaaggtgatggattttatttcaaaagccagagttacctaaattctcacattgtagaaacttgcttcagtctgtttcttatattcccaattttaaaatactttatacaagacataggaaaagaaaaatgcaggcttttgatgctgaaacttaaattttgtaaactaaaatccagtggttaatttgaaaagtaacatcaagtagagtttattctatgctcaatattaagaattattgcttagtattaagaaatttcctatacggatgtagtgtgttttacagtggcgctatgtccttataaactgataagctgaaaatattgtaagttgaaaatgcatacacctaacctactgaacatcatagcctagcctaccctaccttaaacgtgctcagagcacttacattagcctagaagggcagaatcacctaacacgaatcctgtcttataatcaagtgttgaaagtctcatataatttattgaacactaagcgaaagtgaagaacagaatggttgtatgggtcccattgcaaagttgaaaaattgcaagtcaggttctctctgtaattcaaattatgaacaagtcaatgacagaaaaccatatggtctcaatagatgttagggaggtacttgacaaaacttaacatctatcccttctaaaaagaaaatcccttagtaaaaggattgaaaggtgttttccatcttaacatagtcaaaggtgtgttgcaaattaatagtcaacatcatttatgacagtgaaaccctagaaacatttaagcttcccaaataaggttgttggcaacaccattaaaaatgttctgttctttttttttttggatgtgcgatactttacttggcactaaaaagtaaatactaaatgacaagagaaagcaaaattgttatttgaagatattatatgattagaaaaacaaaggtcaacagacaaatggttagaagcaatttaataaaagtgcttgttcacaaattcagtgtacaaacttcagtagcttttgtatatattaaccatttataatcaacaacaaagaagacctcattcacaatcacaagcccaaaaacttgaaataaacttgataagtacatgatttatatgaagaaaaccataaaactttaaagaggatctttaaaaagtttgaaaacatgaagtcatactttgttttaacataagaatagctaactttgtaaaatgccatgtttctttgctctgtaaattaaatgtcatctcagtccaaattgtggatttttcttttttttaacttgacactctgatatccacggtaattggagcaatggaagtcttggatttgctgcagtgtgttttgcatagttgaaggactggggaattgggggagagctgagtctggaatcaggaacccactgttgcctaaagtggctcactccttatgagcaataccaccccacttaactgatctgaagttttccacttgggatatgttccttttctggaagacttgtgacttctgcccccaagctgtgcacaggaggactcactgtcatcagatgctgtggttacacaaaatatttttttctacaattgattttcttcacataaatcgtgtacttgtcaagtctttggaggttgggttgccttactgtagtgtcatagccagtcacagacctggcagcagtgcattgtaactctgaaagcccttcagtggctgccaccagaaggtctctctcctgcatactcctttggccactatacaggtcttccaatttaacctacactatatttttactggccttttttccagtgctttgaataaggtacgtttttccccaccccagaacctttacatattctgttccctctgcctagaccaatttctaaccatgctctgctcctccagtccccactacacacacccacacccccacacccccggtcaactctaattcacctttcaggtctcagattcagtaatatttcttcaaagagactttttaaaatttttcagaattgattaggtccccttgttatgcccattatttcagattgtatgctttttttcccacagcacttaggtgtaatcatgtattttatgcagtttctttatagtctgtcactcccattgaaggacacagactgtgtctctttagttcactatcgtatatctaacacctgtaattgtatgtgccacatagtagacattcgttaaatattttttagtgaattaatgtgcagtgattttaagcaagtattagttgaataacgttttacatgtttaatgatgctgcatacgcattttccgatagtgtctaccacggtttatcacagaggccagtgtgggctctcacatgtaataaagctaatctgaagttaatttgcaaaaaaaaaaaaaaattgtgcattgtgagaaaattttagaaaacaaacactagtggagacttgcctttacatgtcacaaacttatgctaaagctgtaattgttaaatcagtataatactgacccaggactagacagaaaatgaaataaagtctagaagtaagcccaagtacatatgggggtttagtgtgtgttcaatgtatttcattttaaagtagtgtaaaatagatggttggttatcagcctgcaagttggctcccagtgatcattgccttgtagtattcttatccgtgtatagactctccttacatgtgtagggctgacctgtgtaaccagtaggatagaatgaagaggatagtgtgtgacttccaagggtaaatcatacaagacattgtaacctctgtcttgtgctcccttgcatcatttgctcttgggggagctggctacctttcgtgaggacactcaagcaactctgtggagaagtccttgtggagaggaactgaggccttggtcaaccgccaccatcaacttgcctgccatgtgggtgagccatctgggaagtggatcctccagccccagggaagccttcagatgacggcagctctgggaggcatcttgcctgcaacctcatgtggatacagctaaaccagagccacagaactaagctgctcctgaatttctgactcacagaaatggtgtgagaaaatgctgattgctgttttaagccatgaagttttggggtaattcatatacagcaataagtaactgatcagatggattattcagtcagtggtgtggggatagccagctagaattggggaaaaaataagttggattcttactgaattctgcatcaagaaaattccagatgtgctgggcatggtagcttatgcctgcaatcctagtgctttgggaggctgaggtaggaggattgcttgggcccaggagtttgaggctgcagtgagccatgatcatgcctctgcactccagcccgggtgacagagtgagaccctgccttgggggaaaaaaagaaaatctcagatggatcaaatatttaaatgtaaaaatggaaccgttaatttattataagcctgaaaaattttaaacttttggggtggagaaggatttcctaactatgaatatgcaatccccaagccataaattaaaataacaaaccttataaacagggtgaaagataaaccaccaattaggaagatttgagcaacctgtattacaaaaggcagtgtctcggagaactcttaaaaatcagtaagaagactctataaatgggatggctgaggacacgaacaggcaattcacaaagtagaaataaatgtatgaacagatattagccaagaaatataatttagaacaatgagaggtcacattgtatttaccagattcacagaggtgaaaaagaccgacaaggttaaagagattccttgattggcaggaagattatacggtgtgggtggggacacagatttgtctgacttttctggagggcagtctagtaacatgtctcaaaatgcaaataccaaatgagtgcacattgattcagctattgtgtaaatttatgctaaggtaatcggacacacacagaaagatgtgtatactgttaaaaaaaaatcccgaatttcaaaaatgtcaaattttcttcctttttcttttctttctttttttcctctatttccccttctattgtctctctttccagttcctcttggactttcctggatctgtctccacttctcaacattgtactcataccttttaaatcttggtttcttctcaatattagtaatttctttaattttaacttccttgttgccaactctctattctgaaatcgattctaacattcagccctgcttcgaaaagtttattttggcaattacttttgcaaaactaatttctgataaattttttcttttaggattctgttctgtagtgggtgtatagctgttcaatctctctgaggatatgaattagagttttaaaaacttgccttagacacgttgattgtggctgtttctcccagggtttgtggctgtgtgtcttcatcttgctccttccctcccatgctttaagatcttcaagtcctgatggtcctcagctaaatatccatgtttaacgataaaggactaggttaattaatactgcagctgccgcaggttttctctgtagttgtgtggacattccagctgccccctgcgctaaatggaggatggactgcaggctctggaatgtggtcaggttgcttggcaagcttccccgtggggtgctgtttgggtggggaaagctgggttccccccacactgctatcataagcagtacttggtcaggaggtgcagcagtgtaccctgtcaggcagagctgctgcttttcatcccacgactccccgtctctgtgtctgttgtaacagttctgagttccctttgttctctctcaagccctaatgtccacacctgaagctctccacagagaactcatccatgttgggttcctttttcactgccacacacagggcagggggctgtgtgtgggggtgcttcctagccacgctgttccaaactatatttttattttatcatttatttattatatatttatttttggagacagagtctcactctgttgcccaggctggagtgcagtggcacgatctcggctcactgcaacctccgcctcctgggctcaagcaattctcctgcgtcagcctcccgagtagctgggattacaggtgcacgccaccatgcccagctaatttttgtattttagtaaagatgggggtttcaccatgttggccaggctggtcttgaactcctgggctcaagtgatccgcctgcctcggcttcccaaagtgctgggattacaggcatgaaccactgcgccggcccccaaactctatttttaaatcaacttcttgttgagccactcttgcctgtatttgttggctctgagcttctcttggatcccttgagaactgctctcagtcatctttcgggggctacaattaacattgttctgtcttccaagagtccctcatagttttggtctcacatattttgtgttttctaggcattccataaaatatatggtctgctgatggcactggttttttgtcttgcaggattctttaattctacttaaaaacaaaagtccttgttagttcataagaccttgggtgggacgggaggtagacatttgtgctcagatgacctgttcttttttctgtgggtgttatcacttgcgtttcttcgagcatattcactttgacattttcttctgcttactgtatcagccatgtacccaggggtcaggagtgtacacatacacatgaggaaaccttgaggtcgggcagggatttggatccaggctgtgactccaaagcctgccctcttaacctctctgctgtctcttctgtttgtgcagtggggggccctctttcatgctgtttgtttacttcaaaggcttggtgtttcttgtatttctgttcacatttgtaggtaaggatctgcaactcagcgttgcgtgaaggttctcacgcaggagctcagcttcaggtgactttgcaggggaagggcagggagcatatagcggggcagggtattcactctgctgccctgctcgctggggggccggcggggtgggcttctgctccacggagttggtcactttgtcggctctgctgtcttccttgttaggacctctcatcggagagttgcatgcatgctcaccgacctcccaccccttccccggagcagacccctgagtcagacagttcaaacgaggacttgctcagctcttccagcttctcgttaattacttggccaattatctatggcctgcttctcctggcctgtgctgcactgataatgggattatgctgagcttctgctgaggaaacttttcaactgacatgggttccttctatttctttagatttgccatcattggtcccgtcacttttctagaaatttaatctgttccacaactctttattgtgcggggcaatgtgctgggcattagaaaataatggtgaagagaagacctgtcacgatggagcttatgtatggtcttgttggggagacaggcattaaacaattaatttgcacacacgtagttcttgttctgtgaggagaagttgccctgcgctgagggggcatatgaaaaggctaacttactgggagaggggttgccatggaagtccacctggagcacgtgtgacaattgacctgagattccaaggaagaaaaggagtgactcagtgaccgggaatggggataagagtgttccaagctttggaaacaggatggggaaagacctttattcgtagatggaggggaacggggtctgccagcatcactcctcaaggacatttactattgctgtggttcattttcattctgtatttttcttctgtttaatgggatttgggaggaagaaaaagatgaacttggttttgatccaagtaacctcagagaataatgacgtgggagcattttacaatgcaaacaataaatggaaaagcatgaatttatgtactgtatgtgaaatatatagacacatacatacatataggctgaacatcccaaatccgaaatttgcaatgttccaaaatccaaaacttcttgagccacctacatgatgctcaaactgagtgctcattggagcatttcagatttcgtatttttctatttgggatgctcagctagttgatatgaggcagatattcccaaatctgaaaaagattcaaaacctaatccaaaaatccaaaggctctctggtcctgaacctttcagataagggattttcaacctgtatttaatattgggaagcaatataccaataccaaaaacgttgtctgtgagaggtgagatgacaaatgatttttattacctttttaaaactcctaatttgaatttcaacttttctatgactgtggattgtttttataatcagaaaaaaagttcctaaaatgatgtttatcttatggtttggcttatgtaaatgcagagtttgtcactaggtcaatatccgcaacattataaagatgttactgtgtacttactggaaatggcctgtgattggtgacaaagctgacttacacaaaggagaacattatccttaggaattcttgctagtatctcataatgtaattgttttaacgttgttaaatggttcacagtgatcagagacttaaaatctttgtctcctacacagcgttttaagagttacagaaaagctatcattttgagctaccttgagactgaagtgtctgcagaatagcacttacatattcaggctgacaatatgtgtttgaggaattggcggttcagtttggccaactttggtgttgtaacacttgagattgtattaagctgcaagtaacaaattcagatgaacagttgcttaaccaagtaacttaaaggcacaagctttaagcttttaacgttttcaagttcaggtcatgtaggggagctatgtcattaaggagactgactctttctgtcttcttgatttactgtagagtacggcttttgacctcatcataacagagtggctgctgcccctctagaaactccatctgtgattcaggcgaaagggaagggcctgctagttggcttgtcctttttattttttatcagaaaaatagtagctttcaaagaaaccacccccattagacttccgtttatatttcagtgaccagaactgtgagaaagccgtctttagctgcaaggaaacctgagaaatcaagcttttgtggttatgtttttcaaactggagcacattgctgttcaaaacaaaatcagagttctgttaataaataaggagagaatggatattggtaggcaacttgctgtgtcagctgcaggagttatgtgcttagaggtggtaattgaagtcaagagtgtgattaacattactcagggggagtatacagagtaagaagagaatccatgaagggactgaaaggaagtttagtgttgaagagactggcagaagaataggtattctcaaagggaaccaagaacgaggggcaagtgggaggaggtggtcacctggagggtgtggaccagtggtacacaggttaggagagggggaagggcagagtttacattgcccgtatgctggcgagtgaagtccactaggaactgagacatgaacttgaggcttagcaaaagagagcgacttagagaaagagcacccgcactggtgactgtgggctgcatggtgaaggggggcaaagcagtgacagcgggagtgagcccctctcaaaaactgatgccaactacgcaggacagagagggggcggggaagggggagtgacctgagggagactggggctcaagaaaagcctttttgtgttggttgttttaaaggctggcgatactgtagcatgcttagttctaaggagaggaagggccattaaagacgtttgagaaggatcctagaaggattgtattttccaacggaggtggaaggggttgagatccacagcccaggggatatgctttgaaggaaggagaaaagcacctctccttccctaaaagaaggcaggaaaggtgtgtggacagaaattctagagagcatgaaatgcgggtaattgggctgcaataagaatccagtcatggttagagaacctgaatttaattaaggtcagtgtatgtctgtagagtgccattatcttacatagaaattatttttgaaaattttagttgacatttttgaatgatacctactagtactacagataatagaagcataaatatgcacaaaagcagttaaaacttaaccgttcgtcttaaagtaatttataactaatacttattgatgccctactctgtctcagtcaaaaagctaaacaccttccctatgcacaagaaaaacctatgcagtaggcgttactagttgtcctcattttatttttattttttattttttttcaaacttaaacatttttttttgtgtagagacagggtctacctttgtttcccaggctggtctccaactcctgggctcaagtgatcctcccgcctctgcctcccaaagtgctgggattacaggcatgaaccatagcacccaccctttatccccattttaaagatgacaaaacctaggctcaaagaacttaacatgttctagatcacgtggctagtaagtggtgacaccagaatttgaaccacgtatctgactccagagtggtggtgccagctgctgttctgtggattgagccatatgaaattgactatttagcaagagaaatataaaacatcggcatttttatatgtctctacctaatacacttcctcacctcaatcattgccaaggtcagtggactgcttacttggtgccaggcattgccctaagtgttttgattgccataatctgttgtaatattttgaaatatttgcagtcttaattgtcctgatttaaaaaatcatgtttttgaatatgataatatactttaaatgagtatgtttgattagcgatgttgctttttcctatgttggcaaaattatattttgaggaaacgattagaaatattggcaaaacatagagaaaaatcattacacatctagtgtctcacaacatgaatagttttttggggcatttttcacaacatctgattcattgagtggtagtcccccaagagatacctgtgaattggtttttaattcagtagatttctgttttattgtatatttgttgacttgtgatcaacatatattctcttctatttttgaagcttattttgggtaaaaagaaagattacctttctatcttctcactttatccccaacttatgaataccataggtatcaaccagtgatattactagcaaatcacccactctcccactttactaataaaatgttgtcttgaattcttgcatttccgctaaaaaaaatcccattcaaaattatgaatttagaaatgggatgaaagctgagtgcagtggctcaggcctataatcctggcaatttgaaaggctgaggtggggggatcaattgagccaagaatgtgagaccagcctgggcaatagtgagaccctgtcactaccaaaacataacaaaaattagcctggtgtggtggcatgtgcctgtggttccagctactagggagactgagatggaaggatcacttgagccccagaggttaagattgcagtgaattatgattgtgccactgcactccagcctgggtgacagcgagaccctgtttctattaaaaaaacacatggggtgatttccctctccccagtttggaagtcttcaataaaaggataaaaagatgtgaagcggttttagccatctctttttggcctccatgtaatcagattttgtgcttatttgagacacttaaaaagtatctggctaattgtgctctctgttttgaggacctgatcttaaactggatggtcttgatattttcgtgtaacttttagttcaggtacaagaattctttaaagaggcatggacaattaattacacgactgagaaaaataatttcccccaagttaattgcacaaattactgtagccctaaaaggttaatgattatcaaacatctttgatgcatagagcctattaaatgccagtatcatttgaataatttaactagagtagtcctttcacaaatgggtctcatccaaaggacaacagtaaatagtgcctttaaaaatattttctctttagagaaacgtgttcaaacccttcagctggagtcaatcttatgggtcacaacacattcttacatttcagaatataagacattaaaacattttatattttaaatgatttagatcatttattatccttatagaactactgaggttttacttgaagcttgtaagttaaatttttgtattttatacagagttagcttaggccgtgattaggtagaaataatgggcagttatcactgtatttatttgaaatgaaacttcttttacagctattcatggaagaaaactttaatattgtattaaagcttttattttatctttaaatgccaactttattatgtatttcttaaaattgatcttccagtattttttatgtatactttttagtgctttatagttattagcaggttccacagtagtaactgaaatatactctgattttcatttttattttataaaactttgatttttaataacatatgctgaaggacactctgaagagtactaatttttttcagggatgcttttccaaaaaggattctgtggttcaataaacttgggaaagactgcgtcctatatgcttttagaagagtcacagtgtatactcacatactgaaggatttgagaaatgctagagcaaataaatctaacgttgtctaacccagtgtttcccaagcttgtctgaagacagacatttccactcttgttttacatcataccctcgaacatcgaaggacttcgctgatttgtgttctacacaaccgtcttgagatacgctgttagattagctgtagcttcccttgccacatcgcgaatttccagcattcaaatgcagcaggcatgtttatctgctgcacttacacctacgtgtacatatgtatataaatataccagtatacatcaatatgtacatttgaagcgtatatgcacacttacataggtacacacatatatgtatgcttgtatttttattttacttactgcagtacccgtagtatatagcagatagtgaaatcagaaaataattgttgagtaaatggatgagagagtttcaccagtctgtggcatacgccctgctgccttcttcaggatgcagaaaaccctgtcccctggcttaaagtgtgacattctggagaaagtagatgtgctctctctagagacacctgaaacatcaaacacaaacagtttgtcagtactgtttcaatattaagtctgtcagagggaaaagaccctgaattttgggtcaggagacctgggttcaggtatggattctaccactttccactcacgtcatcttaggcaagttatgggctttttctgagcctcagtttttctcctctatgaattgataataccttgtaagactgttgaaatatctatagaagacatcaaaaacttatttttaaccaattggaaggtacgctgtgaatgtattatcctgatacaggtgaaagctttattaaaaaacaaatgtaacttaacatttccatttcatatatataggggaagaaaattcccattttttggtgaagatactaattttcataagtaatgaacataaaaaaatatatttttttactgttagcagacaataattttttttctactgtttaaaaacttccatcctttttttctaataaaaaaactccagaatcttcctggattagcctcagacccatcgcacctgctggtctctctgcctggaatcttctttaaaacaaggtgacttgccatttctttccatcttatttcagctctcagtcaacctctcacttccctgcccaccaaaatacagcccccgtatgtatctctttatccctttacctactttattttcctttataattcttatcagacattttattgcacatatcattagtgaggtgagatggagatcatattttgtggcgattagtaagggattgtaatatctctcaataacaaaattgctttagaccaaatttttgtttgcttatatgatttttacacccattatttcagcactttaatgactctgtcagatgtataggttagttagtagtcatacttctgtaaaattctctagtagaatcaaaatacatgtgctctccctttcctctgcatggattttttttttccacatgagggaagctgtggtaaataatgttatagattttcactcgttagtaatattactcaaataaacgatgggaaaatgtttctcttgacaggattgagtaggtagacataggaattcatggaaccacttatgttaaaattgataactttaaaaaaaattggatagcagaaataagacttgttttatgtattagcatccagccaaattatcataactgattgtgtagtgtaaggttagtgatacaaagatgtgcaagatttggttttatactttatctattagaagtttgggtttggtgatacttttaataccatgcagattgcagttttagctatcatgaatttctgaatattttatgtaaaacaaagatgttgcctttaaaagagttaaagttgaagttttttaggctagaatgtgatttagctttatatagctttttgtcagactcttggaatcatttcaaaacacactcatattttgtttagagttaacagagctgtctagaagtaatttctagtttctcctaggctactcatgatgtttgaattattttccgtattctctgctgagagattcttgtggaagtagactttctgagcttctataaacattttccttctggaactatgcccagtccacctgttcaccatttacagggaaatgctgctttcctaatgaaaatcaagcccagattttccagttcagcttctgtaggtagggagtgcagctgtactgggcagcctccagtgagtcccggggacttgacttcttgcaggttttctgctgatggcagctgctatcaccatgtttatcttttgggggactggatgctgctccttcttcaacgttttggcccaagagtagacaacatatgtcataactaacacaaggctgtcatgtttaaagacatctttactgaatgctgcagaggaataaagagaggaaaacccagagagctccatgaatcatgaattcaggcattctaactttagagctatggcacattcatcttcagttagttgagatggttgcttgcatgtaagtggcttttcacatttcaaaaatggtttcccaagtgagcatatgtttactcttggctgacacgcctctgaaccagccccaagttggtgtgcatggtgctagggcatgatttcaggcccgactcatacccccaagctagacacctttgtgcagagtacatctatatgtgtactagggattgcctactgaggtttttcctagttctccctttaccttcagaaggcatagagcacctttaatagccctcctgccttggccctcatcctccctccccaccaacccctgaattcctttagagattcctcatctcctcaaagtccagaggtgggctgtcttctcccacctccttgtaggagctcaccctgatgaaggttatttcatttctgaagctctgtctcctttttggcaactggcaccagcaaggatcagatccttctaaaactgtctcctgtttataacagaatctgacacttccaacatcatgtaagagctgcatatgccaatcacagtggagtttttaatcctgtacccaggtctgttgtgaggataaatggtaattcccattgcatttttgtgtgtgataaagtatattgcttaagagagttctggggatgtatagtggtgatgattacacaacgatgtgaatgtatgtagtatcactgaactgtacatttaatgtttaaggtggtaatcttttgttacctgtctattaccacaataaaaatggaaaaatatattgcttaataaaataatacttgataaagtccatgcagtgtttactacatgtcagtaccattttgaacattgtacacgttgcggtttacttaatcctcacaacaaccctgttaagtagctaatattataatccttatttgacacatgagaaaaatgtgctacatagaagttacataatttgctattaagtgagagaacgagattcaaaccaaagttgtttagctccatagctcatgctgtcaaccactatgttaatacaaatctgcattgtcctaattttattctatatttatgttcagatagaaggcactctgggaatctggagactggggttctcagttctggctctgtgactgcaccacatttgtgactgtgaccagagtagcttctctagtcttcagttattttagttataaaatgagatgggataaggttcactgttaaatttctatttataaatgctgtggatgtgtatatatttttatgtatgtaaagttctgaggttgaataagccttattttctctgtggtctaaaccatacctatggaatctcatctgtcaaacgctatgtgattgaagattaaaaaaaaaatctcatctgtcaaacgctatgtgattgaagattaaaaaaaaaaaaggaaaattttatttgaagagactgggtctcattttgttgcccagacttgagtgcagtggcaagatcatagctcattgtattctcaaactcctaggctcaagcgatccccccatcttagcttcccaaagaattgttattaaatctcatttagaaaagttgaatttctcaaatattaactttgatgatataatactcaccacataagtagtagttgtgtgtactttctagtttgaaacgtataagctgtttcgtgcattagtggagatgagatattaaaaattattccttgacatttttaagagttgataaagggagaattttataaagtatgatatatgtaactatattatattatgggatgcaattttaaatgagatttctgtcacactaagtcaacgtgtgtttatcgagtacctactgtgtcaggcacatgcttgatgctagagtatacagatgataaagagaaggtggcctgcccaaatggagtttacattccagtgggaaagctggtaatcaacaagtaaacaaatgagagaatacaattaatagcagccgtgatacctgctggaaaggaaatagcattatcctgtgatacagaatcactgatggggtcaactttttggtagcgtagtttggaaaggcctctcaggaaatgacattttaagtaaaagctgacagaaggaccacaaggaatgagtggtgggaggaataagggcagatgtaaaggagtggggggagaatagcattctagacaaatgtggaaggctaaataatgttaccccaatgatgtccaggttctaattcctagaaccagtgaatgttaccttcagtgataaaatgagactacagatatgattaagttaaagattttgagatggagagattatcctggattatctgggtgggctccaaatacaattacaagtgaccttataagagagaggaaacaggatatttaactaaagagaagacaactacgagacataaacagagcaaagcagagtcagagaaaatgctacacctctggtattgaagttggaggaatgggccatgagccaaggacaagggagtgtagctctaccatcaccttcactgtcattcctttagactcatattttggacttctggcctctaggactgtaagataataaaggtatgttattttaagccataggtctattgtagtttgttacagcagcaacagaaaactaatacaggataggtgtggtggctcaagtctgtagtccaagctactcaggaggctgaggcaggggaattgcttgagcctgggaggtagagggagcagtgagctgtgatcgtgccactgcactccacagcctgggcaacagaaataaacaaaaacaaaaaactaacgtggaagttggtacctggaggtggggtgctgtggtaacaaatatctgaaaatgtggaagcagctttagaagtggtgattgagtagaggcttgaaaaattttgaggtacatgattaaaaaaccccaggttgccttgaacagactgttcaagtgtttaatgtagatattaaagactgctggtgagggcttagaaggaaatgagcttgttattggtaagtgggggaaagtggatcattgttatatagtggcagaaactgtagctgaattgtgtcttagagctctacggaaagcagaatttgtaagtgatgaagttggctatttaggaggagatttccaagcaaattgttgaaggtactgcttggattcttcttgctgcttatagtaaaatgtgagaagaaattctaactgtggtctgcagcttcagcttcatgccggagggttccagggtgccctttctgacagcctgccctacaaactatactttgaatagcagggttgtagagaatcatatttattcatttagaatgtcaaatatatctctataaaagagtttagctttgctcatcagccttttaaatgtttaccactgacagtgacttcactgatctaattacagttatcgaagccaatattgtaagaactgtgcatcctcttattgtgcacaattgatctggaagcatctttcctataccgagttaaatagtgtcaccccagaaaagttattttcacctatgaatgtgagtttatttggaaattgggcttttgcagatgtaattaaataagatgaggtcatacaggattagaccggactataatccaatgactagtatccttatatgatgagggggctttggacatagggacacatagggagagtgccatgtgcagatagacgcagatattggagttatgctgccgaagtcaataatgccaagtattgttggaaccaccagaagctaggagagaggtggaacaaattctccctttgagccctcaggaaggaaccaaagctactgaaacttgatcttggacttctggcctccagagctgagagaataaatatctgttgttttaggacattcagtttgtggcattttgttatggtagccctaggaaatgaatatgtcttctgacaagtaaaagtaaaatagtggactctaacaaattaatttttaagcacccaacagaaaatgtcactcttccacagagccaatgtctatactatggctgttttccagttttggagttctggaagtttgttagctaccattgctctttgagtaattcttaaaccttttataccaggtcacatttagaatagaatataaaaaccttggacacaaaatcaaagttcataccagatcaagaggggacaaaaatggactagaaggaaggttacataaagtggtactatgtcttctgcaatttgtttgttttcttgtaatatttgccctgagctcaccagcgaaataatagatagactccatagaagtcaactcttaaaaatgacttttctgtcattctttacctccatcctatcaagcacacatgaccttggttccattgtgcaggacttaggaacacactttgaatgtaagcagtttcttctagcattgctggaagtaaaaggatgcctcatcttaaggaatagagttgtttctggaggtcttgcttaagcgtacatttggaagtgattttttttttcctttacgttttctgttgtagaataaaaaatttctttccacaaaggaattattatacccaaaatatgtttaaaaacaatttaaaagtatatatatgtacagtggcactggctttcagagaaaagaataaaagtatatacatgtatcctgttaactgatttttttttttttttttttgagacagggtcttgctctgtctcctgggttagagtgcagtggcatgatcatggctcactgcaacctccgcttgccaggtttaagtgatcctcctgtctcagcctcccgagtagctggtgtgtgccataatgcctggctaatttttgtatttttttgtagaggtgaggttttgctatgttgcccaggctggtctcaaactcctgagctcaagcaatgcacctgcgttgccctcccaaagtgatgggatcacaggtgtcaaccgccatgtttggccaacaactgaaatatttttaaaagtatgtatatcatgtaatatatatatatatatatatatgcatgctacctaagcttaaatgcaacaaagaccatacaaggcttttatggagacaaataaatgcacctgtgtaccacattcatgatagaaagtattagtattataaagatgcccatcatgtccacattaatccataaattcagttctaatcagtaactgaacgcttaaaacctttgcataacagacattttcaaactttacagaagtaaagagaaaagcatgatgaaccccatgtactctagcaaattccacttgtgaccaatgatttcttagaaatgtatcattattaacttatgagactttaaaatacacttgaggtatttaattcatgtcattcgtttttattgaaactcaaattgtcaaatctttgtccaattgtggtgcctttaagttggatcttgtgaccttttgacatgactccattagttttcttttatatatacttttatggtggtaaaatatatatacacacatatagcatagaatttgtcattttaaccatttaaaaagtgcagttcagtgacattcattgtattcagtgttgtatggccatcaccattatttatttccaaaacgtctttgtcatttcaaacagaaactgcaacttctaagcaataatttcccatttcttcctccctccaaccctggtaacttctaatctcctttttgtctttatgaatttgtctactctaggtatttatgtaaaatcatacaacacatatctttttttacctaacttatttaataattttattttcatgatgttttcaagattcattcatattatagcatgtaacagaacttaattccttttttggctgaataataatattccagtgtatgcgtatatcgcatttcgtgtattcattcatttgttgatggacacttgggttgttgcctccttttggctattgcaaatattgctcatgatgaacattggcttacaggtatctgtttgagtccctgttttaaatttttttttttttttttttcttttttgagatggagttttgctcttgttccccaggctgtagtacagtggcgtgatctcagctcactgcaatctccgcctcctaggttcaagcgattgtcctgtctcagtctcctgagtagctgagattacaggtgcctgccaccacgcctggctaattttttgtatttttagtagaggtggggtttcatcatgttggccagcctggtcttgaactcctgacctcaggtgatccacctacctcagcctcccacagtgctgggattacaggtataagccaccacacccggcccctattttcagttcttttggatgtatacccaggagtgaagttgttcaatcatatgataattctgtgtttagctttatgaggaaatgccaaaatgtttttcacagtggctgcaccattatactacttaacagaaatgtttgagagttccaacttttttacattcttgccaacatgttatttttaattttcctttcctatagctatgtgaagtggtatctgtacagaaatgttcattgcagcacagtcaagtgaaaaacaactcaagggaatatcgggaaagagtagataaaactggattattcgcagatcagaatactacgtagcagttaaaatgaatgggctacaagttaaaatgaatgtgattctgttgcattcttcagtacttcagttacatttttcaactccagaatttctgcttgattctttttaattatttcaatctctgttaaatttatctgatagtattctgaattttttctctgtgttttcttgaatttgagtttcttcaaaacagctattttgagttcttgaaaggtcatgtatatctgtttcttaaggattgttcactgttgtcttatttagttcagtttgtgaggtcgtgttttcccggatggtcttgatgcttgtggatgtttgtcagtatctgagctttaaagagttaggcatttattatagtgttcatcatttgggcttatttgtacccatccttcttgggaaggctttccagatattcaaaaggagttgggtaagccatatctgcattagggggcaccctaaggccagtaacactggttcttgcagacttctataggtactgtcttggtagtcttggataagatccagaagaactctctggattaccagacagagatattgttctcctccttttctcccaaacacatggagtcagtctctcctctacttctcccccgaccctcattttgagttaactttgtgtagggtctaagatcatctttttgcatgtggatatccaattgttctggttttatttggtgaacgtattatctattccctagtgtattgccttggcatgtttgttaaaaatcagtggataataaatataagaatttattgctggattcgtaattatgtgccattgatcaatgatttttattagtactataatgctttgatcactgtacctttatataagatttgaaatttagaaaagacctccagttttttttcaaaattgttttgattattctaaatgttttgcattttcatttgcattttaggacctgcttatcaatttctgtgggaataagcctcctggaatttgatagggattattttgaatgtatagatcaatttggggagaattgccattttaacaatattgagtctttcgatccataaatattgaatgtctcatcatttaaaaaaacttgaattttcttcaaagctttataatttttacagtacaagtcttgttcttatgttacctttatttgtatgtacttttttaatgctattgtgaatgtgtctcttaattttacttccagattgtttattgcttatagaaatataattgatttttatatattgatcttgtattatatcctgtgaactagatgtgctttttaaaaattagttctaatagtttttttgtggactctttggggttttctatatacaggatcatgtcatcttcaaacaaagacagttttaccactttctttacaaaccgaatgtcttttatttgtttttcttgggtggttagagcttccagtgctgtgctgaatagaggagatgagagtggacatctgtgccttttaccctgtcttagaggaaaagaatttggtctttcaccaatatgtattatattcactgtaggttttttgcacatgttaccaggttctattctaaggttgctgagactttttatcttgaatgcacattggattttgtcaaatgttttctctgtacctgttgagatgttcatttggtttttattctgtattaatatgatgcattactttaattgatttttagctgttaaaacctcacatttctggggtaattaaaaaagatggcttatcatctttttttatatgttgttgaatttggttcactaatattttattgaggatttttgcatctgtgtttgtgagagatactggtttgtagttttcctttctggtaataatttgtctcgctttgctatcagggtgttattgcatcccataatgagtgggaatattctagaatgagatgtgagtaatattcttaaatctacttcttatacttctcggaagaatttgtggagtattaatattatttcctccttcagtgtttgatgaaattccccagtgaaggaatctgagcctggacttttctttgtgggaacatattttaaaagctcatttaatttttgtacttgctgtagatgtattgagattttctattccttctttagtcagttttggtcattcgtgactttttaggaatttgtctatttaagttgttgaatttgttggcgtaaagttgttaatatttctttgtctttctaatctgtgaggggtcagtggtaatcatctctctttcattcctgatttttgtggttttctttctctctctctttgccaagggtttgccaattttgtttttaaagaaccaccttttaatttttcctctgttgtttttctgttttacatttctttaatttctcctgtcatctttattttcttcattctgttttcccttgatatggtttagtcttctgttttctacattttaaaggtgaattcttagattattgatttgagatttttttctttaatataggaatgttaacactatacgtttttttctaagtcttgtgttagctgcatctcatacacttggacatgagttgtatttctattattcagattaaaatacttgctcattcccccttgtaattttaaaaaaatttttctttgacccgtatttagaaataactgcattattgttggtaaatatactttatacgattttaatccttttaaatctgctaatgctttctttgtggtccagcatatgacttatcttgggttctatggcagcttgaaaagaatgattattttgctgctgttgtgtggagtgtgctttagatgtgtgttaaggtaagttgattggcagtgttataagtcttctgtatttttgttgatcttctgtctacttgttctattcattattgaaaattgaaatgttcaactattgtttctctttaattttgtcagttttagttttatgtattttggacccctgttactgcatacatatttataaattgttatctttacctgctgaattaccctcttattataaaatttccttttctttctagtaacaatttttgtctttaaattcattttgtctgatattaatatagctgtcctctgattactgttttcatgatatatcttttcccatccttttgttttcaactgatctgtatctttgtatctaatgtgaatctcttccagacagcatatggttgtcaagtttatttttctcagtctatactgttaatctgcaccttttgattagatggtctaattcatttatatttatttatatttaatgtaattattaagatttaagtataccttttcattatatgttttctataaatgttatatattttttgttccttcattcctccatgactgctttcttttgtgttaaatggattcttttcttaaatgcatcattcttgttgtttcttttagtatatattttgagttactttcttagtggttatcctggggatcataacaaataacttaaaattcagttcaggttaatcctggcataatttcaaacatacacagaattttttctcacttgcatgctttttttgccttataaattatgtatttatatgttataagcctatcaacaaagttttataattattgctttatacagttgccttttaaaacaaataggagaaaagcgttctcaaaaacaattatattgtattttatatttacctatttaattgcctttattggtactttcaaatttttttcatatggatttgaattacttcagctggaagtaatcctttagtgtttcttgtagagcaattctgctggtgacaaattctctcattttttctttatatgggaatattttaattttcgtttttgaaggatagttttgctggatatataatttttggttcgtagtcttttctttcccccccccagcgctttgaatatgtcacatcagtgccttctggtctttatggtttctaacaagaagtcagctgttaatcttatagaggattccctgtaatatgcaagtcattttttctgttgttttacagattctgtctttgaacattttgtcttaatgtgtgtttgactctttgagttaccctatttggagttcattgaacttcttggatatgtaatttaatgtttctcatcaaactagacatttttggctatcatttctgttgtagtgtttttgcggtttttaaaaatttgttcttagggtttttatctctgcttacattacccacctcttcttgcatgttttacacttttttccattagagcttttggcatattaatcatagttatgaatttctggtttgataattacataatctctgccatatatgagtctgattctgatgcttgctttgccccttcagattgtgtgttttcttgcctttcagcatgccttgtaattttttgtggaaagccaggcatgatgtactgagtagcaggaactgaagtagtaaataggtcttcagtgtgaggttttgtttatctggcttgtaggtttaacgttttctataactgtaggtttaacgttttctgtaactgtaggttttctgtagctgtaggtttttctgtaactgtaggtttcacaggctttagtttcccgtagtatccttgcttttttctcctttattttctttgggcttccctagaaataccgccttaagtagagtctgtaccttgcagctattttagttgtaatccactgttgttctattagagccctgttgatgtagtgataaggtgttgcggagaggaaacattctataatcttgtgataaacctcagatttgtttagtaggcctgagtccctgggctgtgaccttcagaagagtttcttagcatttttttttctcctcttctgtgagacagggatgctagaggggactgagttgtataatcaccttcccctaggtcacataaagttctgacaaagtagtttcccttgggagaaggcctttattatatagaacagaaggctccgggcatatttcaaaatacttttccccagatgcattttggcatgcttacttttccccttgcccttgctgagcacatgatttatttattattttatttttatttttatttatttatttttttaacctccagtcttcaccaggagaacatagtgggacttctgggggtaaaacttatgaaagtgtatgggtcccctaagactgagcccccagtagtttttttttttttttttcctcaagctagtttatactcagcctccagcaaatagtgagttaccacttaagtgttcctacagttatttcctctagtagcgctcctcctagtaagctgtgattttgtgtctccagttttcagtgcaactatttgccctgagacctcagttctctggtgtatctaagaattgtccatgttcaagttttccactatttttcatgttgggagagtgggacttccgagctctttacatgttgcaacagaaaccagcagtattatctcttcagttattctttctctcttcttttaggaccccagttatgtgtaacttcatgcacttggggatgtcccagaggtgccagagattcttttcatttttttttcataatttattcttttcctcagaccacataatctcaatgtatctttgaatttgctgggtcttttttctgctcatttttgtcagctgtggactccttacatgaatatttcctttcagttatcatacctttcaattccagagttttaattttgttcctttttgtgatgtctgtctctttcttgacattttttattttgtgagagttaaagaattaaaggaaagtatgagcatgatggtttcctttaaagtttacgtcttaagttcaacatctaggcttcatcagggacagcttctattgactccttttcctgtgtatggtctgtacattcctatatctttgcatgcttcatattttggttaaacactataaattttaaattatttaatgtgtaaactttggaagttcaaatttgttatccccccagagtatcatcctgttgataaggctgctgttacttcgtatagtgacttctctggactaatctcataaagtttattttcttcattgtgtggggacactgaaatctctgttgggtttgattagtggtcagttgatgattggacacaaatcccttttactaagtctcccatccttctgtgaggggctctgtatatgtgttgtgtatggctctttcctcggcttgtatatggcccggtacatgtgtgtggagttccagatacccactgtggacatctcatttcacaggtctcccatttaaatttttggctggactcttggctgcccaactggtatggccgacttaatagctgtggtgttaatcaattgcagctgattgtttttgacaaatgccctagggtagagggcttctcctgcttggtgagctctgcatgacatcaagtaatgataatgccttgtgaatggggcttccctgagagctgtgaagcaggtcagacagtgacagtgctccagagagggcgcttttggggaagtctgaactgggtctgctccctctggtggctacaggactacacattttcacattgttagggaggctgctggttcttagcctactgtgaatggagcttaggagagagggatggagtagaccaagttaaaatgccatgaaccaagcctttctagccaagattcagcagctttcctaagataatgctttagattgttgtacagctttggttaattttcagaattttcaaaaaagttgattttgaaaattgtggcagcattttcattgtttttatgcatgggagcgtttccacagatcttcactccaccattctgagagtgcccccaacttcgaatggatgaatttttataacaagtgaaaaagtaagtccctgaaggttacatacagcctttacccattttatcaacttagaaacaatgaaaagaacgtatgtacttataaatacataaaaatatacacagtatttgtattacacaaaaatagataaacataaaactataaaaagtaaagtacaggattctggatagtggttacctcagatggtggcagaccaaaggatgggagtgggggttacctagaaatatatgtgtcataattaaggtccagttttattttgtagttggtgggttcatggattcttatggcgtaattaaaaatatatacacaggcaaaaacattttatggttgtgtttgccttcatgttaacacatgagatgaggaatctattatgcaacagagctttataaaggagcttcaacctcagttttcaaagccattcttacggccagaggaattgcttatggagcttatctctacccagtctcgtgtaggtctgcctcagctggccgaactccagtgtcaggacaggacagtgatgatgagaagggaagggacagcagccagtgccagttcgagatgagtagtcatctaatactgcctctgcgtgggtccctgctgccatccgcagcctcatagccctcagctccgtaatgtgtcctgatggatttagaagatacatagggagctgtcattgtgagtctgaaaaatatacagatcacgcttcacttactaaaatccatacttgatgatgtcagccacttacacgagcattcaagaggtcttctagaataatcacatgacaagatttgggggaatacacagaattccaatcaagatgagttgagcataatatcatggaggcaggatcagaatggaaaggtaactgataacttggaagtttaaacaattacaattttcctgtttactgtgtgacaagagcattatggggccttgaaaatggcagtgtcaccactgggtaatatattttattcaaagactttttgagagagagcatctgtagagtcaaatggtacttgccaaactattccatgtatggaacccataggacttcataattttatggtttgctgggggaaaataacaagaccactcatggcccaggtgagtcttgaagaggctgtggccacaatatactgagccagccgtagttcactggatgggaagacccaagtttgacttccagatttacttcttacttgcactttgggcagttacattacttctctgagccttattttttttttttattatggagataatgctactgatgtgtaataattttgtatctactagtattagaatgtatgaattaccccttaatttttcaaatacttaaactgttaacatctgaatcttggccaaaatgagcacaaatggcatttgtataaatgcctagttattaaatgttatcactatttaactatctggatttgaagaccagtgcatggcgtttgctaggagtttatatcatgttcttacgtatgtgtgtagctgtctttactgcatctgtcgattaggaggtaagaacacctgctgaatatgtaccttgagctagctattgtgggagatataaaagaagcacaaaactggatcctgtcctcatggaactcaatctggtttctgaggtttagcttttatgtgactcacagatagagcaatgtcacagaaaataatatgcggaaaataaatgcaaaaagaacttgagaaagcttcatgtggctcagtatcctgcactcagtaggatatgtggaggatatatataaaatctaattgagattcttaggaaaggctttaatgaagactggagaatgaatgatatctgttataaaggatggtgaagcttggctattcagagagtaatggaggaggtacttcagtagtttttattgtgtctgcccaagaaattcactcggaagcacaatgtttatttctgaagaggcaaagaccaagttttagaaaataaagttctcctaaatactattataaagtttgagtatttctattatgattttatgacttcccatctgtggtaggtgttttattgaaattatttgaatgttatcaagctgtgacaacaatgctttaaaggtcatacacaaagcacaattaaatttcccaagtgaaataagaatgtgcattgtgaaaggcagagaatttcaagtagttcagttttgttgttgctttttttcatctgggccatttttgaggtgtttaaatcaaaaagttgtttttcttcttgattgcagttttcccttagttatttgtgtagcttaaaaatggaaaccaatgtgtttaagttgcaatatttttgagtctattagttaatataaactttattctacactcaacagtagattgcattatagctatgtggaatgtaaagattattttgcacttatataaatgtgatagcttctgattgatacagatttaattatgcaaactttggcttattatgaattagatgaaacatttctattcctctgtttctttctttctttctttttttgagacagagtttcactctggagtgcagtggtgctatctcggctcactgcaacctctgcctcccgggttcaagtgattctcctgcctcagccttcccagtagctgggattacagctgcatgccaccacacccagctaattttgtatttttagtagaaacagggtttctccgtgttgatcaggctggtcttgaactcctgacctcaggtgatctgcccgccttagcctcccaaagtgttgggattacaggtgtgagtcaccatgcctgacctatacttctgtttcttatgagcttacttattagaagatctctaagattcctgtaatttaaaattttgtaatttcatttcattttacccatttacatcattaaagtgatgaatggttgcttctttcaaatggtgggaaatgaattttggagaattgttagttattattgctcatttaaggttatttgaacgttttgactatttgatggtgttttttgtttgatttgtgatgctgactcataaataccatgaaaaacaggtctttttgttctaaccgaaagagggattatttagcagcttaatgactttggtaaataaaagtttatttgcacctatgagaaagatgacaggtaatatctagatatctgagtaaagagtaaagagagcacaaatacaataagatatggagactcagtatcctatcagctttttgatgtaaaatggtacagtagttactacctaagagaatagtctatttccatgctggttgctcacttgtgtgctcttctgaaagagtgagggcactgtgcgtctgactggatactggggtactctgtttccaagctgcattacagggatttgaaatatcttacatatatatatatatatatatatatatatatatatatatatatataatatatatatttatttatattatatatatatttatttattccatatacaggcataccttggagatattgcaggttagggtccagaccattgcaataaagtgaatcacacaaattttgtggtttcccagtgcatataaaagttgtgtttatgctattttgtagtctgttaagtgagcaatagcattatggctaacaagagtacataccttaattaaacattttctaaaaaatgcctgcacagagacgtgaagtgagctgatgctattggaaaaatggcatcaatagacttgctggacatgggctgccacaaacctccaaaatttgtaattttacaaattaaagccctcaatttgaaaaacataatatctgtgaagcacaagaaagctaagtgcagtaagacaaggtgtgcctatatatgtttctgtgtatatttaaataacttatattaatagctgcaaacagtagatttcttccggtgtatggctttgtcattgttatcactgatttgtaataatttacctcttttttgtatgttttattattttctgccatggttgataaacaagttaatttactctcagaacagagaatctgcagtattattattaatagtgactgttgacttcttttgtcatctaaacaacttgttagtctgcccttaggcttgacattatttttgttgtgaaagaatattcagtaaaaagttttgacatgtttaaaatcattaaatacttccaaactggtttggaaagcttctctgggctgaaagccagttgattcttatcagtctttttgcatgactgaagtcaattacttcagagcttgaacaactgcagccttggtaaatggtccagtactgtccagtagtacaatatgggaggcttttaaatgctactgtaattggtagtttaacagatgtgttttggttggacaagaatgtaaaagctattttggagcattttcaaaggcatgaagtttaaaataatgtaatgttaattttgtgctctgtaatgtatatcgtaagattgaggtcttaatgtttgtattaagtaagtgaaaatattcaaatgaaacttgtgtagaaaaggaactgcctgtgttcagaaagattctgaacaaaaacaagtgaattttcagaactgaactaacagttgccagagggtgtgggttctgacgatgtcctacctgaggcaggctttgtgactttggaaagccttggttttcttatttttaaagaggatctagtccaacactggtctactcagacttcctcatttgtaaaaaaaaaccaaaaaaaaaaacaaaaacaaaaacaaaaaacactttccttaatcttggaatgcttttcacaagaactaagtgtggcatattggtggctgtatgagtactctggtattataggagttgaagtgtgaggtggagagtaagagtaactgggggtaaaacttagacccaatgtgtccagaagattcagagccttatcactgcacaaaggagcacagattttaaacactgaagtgcccaagttgcatgcaaacaggctgtgggctgaccaccggtttttgtatttattctgaatatagtatgccacaaaatttgaatgtatatgcttttacagatctctgtgctctctctagctcccccaaaatctctgcctgtctttagtttcatgctagactgttttatctgtttgttgcctttgaaagcttttgggtttaccccatgctggagtaacatgtagatctagaaggattttgagcaggaggtagtgttatcagatatggttataaggaaagctcactttagcaatagagctgacacagtagtagcaggtagtgaattctgcaagagaattaatggacactagtcatcttgattgtacttagttatttactgcttcagtgtagttctgttgtgcttaattttcttttcttttctttctttcttttttttttttttttttgagagagtcttgctttgtcgcccaggctatagtgcagtggcatgttctcagctcactgcaacctctgcctcccaggttcaagtgattcttctgcatcagcctcctgagtaggtgggattacaggcatacctcactatgcccagctaatttttgtatttttagtggagacagggtttcgccatattgctcaggctggtctcaaactcctgacctcaagtgatccacctgccttggcctcccaaagtgctgggattacaggcgtgagccaccgctcctcgtctgttgtgcttaattttctaaacaaactctagaacaagttaagtggttaatccacgtgatttttgttctcatttaaaatcctatgcattcaaaatgtgaactccattaccatctctctgatccgcccttggcatagaatttggatgtgtatattacactggactcttggctttaaaaaccgtctatctgtatctgtgggaaagcttttcagatagcccagacaatataaatagccctagatttacccttaagtaacaaatgtgtttctttctgtggagttactcgttgtgtctgagggatcctccctgggttatttttttcctctccaatggactggcttggcatatgattgtcaagaacaggcactctggtcggacagaccttgtttaaatcttctctctctctccaactgtgggccagttcgttaatctacttgagctttggttagttattctatagatcgttttgtggattaagtgaaacatcatactgaaaacacttagttttatcatccagaccagggcactaaacgagaataaaccaacctcctagtttttggatgtgtttgacacgaggggatgtttaggggaaaataatatttgaccatcagactttttgaatgctggagaaagcatgcacaatgtccatgtaggaacatacccatatatacaggagacttaaacatgtgcgtgtatacatccatatacacaaaatgaatttaggaagttaattgaatcgaggagtttctattttataagataaatgtgaacagtacatttgtaatgtaagcagtctacttttttactcaaacaagcagaaaatatccttttttagttttaaactctttgtagacaagattgaataaactagagtggatgaggcacagagaattggttgccaatgggatcaagaatgctagaggaaagggcagagattatcctttcacccagaattgctctgtctctcccttactaggtaggaaaacaaacaaataacagagacaagggctactgctctgcactaatgatgcgtggggtgaaagaagtccttgcacactggctcctctttcctgcttcgttcacaacctattcagcactttctggaactttgcgtgaaaaatttcatagatcccagcaggaattttgtaaaacacataatctttgctcatagccattacccaatgttgtgttccttcaggggctgattgaaaacagagctttcacaaggtctcttgcatgatgctagccttcatggcatttgcatcctgccaagtgatacttctggtgaccatcctgccaagtgacacttttggtgacagtgccttggttgactggtctcagcaacctgctttaatctctgcaattaaaaggtatgaatgagtgaaccagtaaaatgaaggaaaaaatcaacatagtggcgggatacttacatccagaaatatgttatctaagggtgtgatactgggcagccagctttcatttaagaaattagacgtatttttaggaaaccagctttctgctagtgacctacattataaaatattataaactcccaagctggatactataaattgaagatgaagttctttcattttgcagttacacaatggaatattatgtgtcaggtactgttctaggcattgggtatacaaggataactaagaatttgtccttctcctcaaggagttcccacttttgtggcagagagggccttgaaaacaaatcatttaactgccacttactgagtgactagcacaggtgaggcatcctaccaggctctggagaaagagggaaatatagccctgctctcagcaaacacaggtggatgagaagggtataagcagggggctgggaagcagagagagagagaacctaaaaagacttaggcaaaggcgagtgtatgataaaatggagaacgccatagttcattctttcatttttttttttgaagtagagtcttgctgtcacccaggctggaatgcagtggtgcggtctcggcttactgccacatctgcctcccaggttcaagcaattcttgtgcctcagtctcctgagtagctgggactacagatatgtgccaccatgcctggccaattttttttttcataattttagtagagatggggtttcactatgttggccaggttgatcttgaactcctgacctcaagtgatatgcctgctgtggcctcccaaagtggctgggattacaggcagaagccatggtgcttggccagttcatcctttaattttggctctaataaattcactgtatgactaaaatgttactttttcttgatgttattattaatcctgtttaaaattagagcattggctttaattatttttaaatttagacactggttattatttctaaaggaagttataaacaaaatttcatacagcatgccatttgacaaattaatgaagaaatatttaatacatgtgagtatctcatttgttttgttattcaaggggattttagcttattgctttttgctttctgtatgttgaactgatattctttttgggcacctgtttgtataaacgtatcaatttgacctgtacttgaattaactgtttattttttatatgttggacagtactacaaattgctctatttatgaactgtatgtttttcttcaatatgcagtttggaatcctgctgttggaaccttatttgcttctgtatgctcacccttattcactaatgtttgataataatgcattataaaatagcagtgctacttctttatcaaaggcttgcagtatttatttagcatttgcagtttcgaaataattaaacaatgctgatgtacagttcttattgcatttcaaaaacctaaccagttaattagcttaagtggttctctcagccctattgacagttggagacacatagtgctggcttgtcaggctgctaaaatgaaacataagaatggcataactgtggttagcttcttttccccctcacccttgagatatgagttggctttcttttgtgtgagataaaaacaaaaccagatcatatgaactgacacttctgcttcagattaacatgagccttgttattcaatttcatgttggtgtttctacactcctttgcctcactgagatttcattaatcctcatatccttaatcgcctcccctttcccttatgatggtctgttttaagattctattatggttttttttttttttttggatgcctttgaggccatctgaacaatactcttggttaacctgagaatggattacaatctgatcacatacttactgctgtgtttgtgtctcgctgcctgtacagtcaggtggctgttctgcctcttcacccttggctgactttcacccatggactttgaagtgttactgcttctattttcatcaaattttatacaaattacaccgtttttccgcaaatgtacatttagtgaagtttgtttggctccagaatccagtccttttgcaggacaggagcagaggaaatggcagtgaaggagagggaagtccacgtaggaagaaatcccaagactggaggtggattggagacagcaacagaagagaagagcgttggggatggctctgagttgaagctaggtgactgttgacccagagaaagaagttgagaggagaaccacgctttgtatttaggtgggctgtggtggggtggaggggattgaggtgtggagtttgatttttgacattcttgtgtttgtgttggtaagacaccttgtggaactctcctagcagagtttaagcgaatgagcgtatatatttgatgaggtgtatatttgagagtgacagcacagaggtgatcataacaggagccactatttgttgagtgcatactagctacagtgataagtgcttcacagacatgctgtctgtgcttcaatgtcctcacctgtaaaagggatttaatagtaggattcttgtgagaatgaaatgaattgatatatataaagtccataacaatgtctggcacataataagtaatacttaagtgttatcataatcacattttaattcagtatccctttggaaagaggtattattgcaggttgaacatccctaatctgaaacattttgagcactgacatgacacctcaaagtggaaaattctacacctgacctcatttgatgggtcacagtcaaaacttcatttcgcgcacaacattattaaaaatatataaagttagcttcaggctgtgtgtaaggtgtttatgaaacaccttatgaattgaatttcatattagacctgtgtcccatcttcaagataccgcattatgtatatgcaaatattcaaaaatctgaaaatatcagaaatcaatcacttctggtttgagacgttttggacaaaggatactcaatttgtgtacacatcttatatgggggaagctgtgactggagcaatgtaactactctgccaaaggttgcataactcataagtggcaggtgaaatgatatctttttttttttttttttttttttttggagaaggagtcttgctctgtcgcctaggctggagtgcagtggcacgatctcagcttactgcaacctccgcctcccaggttcaagcagttctcttgcctcagccttctaagtagctggggttacaggcacacactaccatgcccaactaatttttgtattttcagtagagacaggctttcaccattttggccatgctggtctcgaactcctgacctcaggtgatccgcctgcctcggcctcccacggtgctgggattacatgtttgagctaccacgcccagcccaaaccatattcttaactctgcttgtctctcacctgcctttgtggaaataaacacctcaacagaggcttcatggtgtagaggaaagacaggacaaaatacctaacacacaaggaagctgttttgcttattaaatgaacaatatgcttttaaatcgtgtaagaagagctttgtaatgaaaatcatcattataagaaagaaaaacttacagaaaggtaggagtgaggcttggtatttgagctcctgcggaagaccaagagggagaagggaagatcagtgtagggcaaagcaaatccaagagagccgggaagataagaggaagaatcatgtagtttctgcatttacggacaaaagcgcttccaaaagtacataagggttgatgctatcaagtgctgcatggaggtcattgagagtgagaactaagaaaaggcagttggagtcacattttggtgttaaccagattaaatttccttttggagcaaaaacggttgactacacatacagttataagaatcaggaacatatgatccaataacatagatgaatcaggaactgaaatttggggtgtagatttattcctttgactttctctccctttttcagttcatgttttaccaatagagtattctggtagcagcactgtctgacatttgtcagcttaattagagatcagttacaaacttggctatcttatggatctgtgatacttcccagcaaatctgaaatgcaatacgggcactgacatgaaatgatgaaaaatatgctaattttaacctgaaaaagctccctattaatgcagcaatttctcttattcatactaattctcatttttttttctgcatcctttgtgtctagtctctccacaattgaaaagctgttttgaccaccacttaagagcaatagactataaattctggagtttaatttgtttaatgtctgtgagggcttgatggggttgggactttgttcactaggtatgaacccattgcctagaaatctgaagaagggtatattgcaggttcttacgggtattcctaggaagaagaaatgatttccaaacagaattagcatgtagaggagaaacgcacaaagaaaaggagatttgatttccacaatgtaaggaaatgtaaaatttcattagaagaaagggaaagaggacattgccagcaaagatggagagaaagaaggcgtgtttaaataagctggtttccaatttagctgaaacatttgaaagtaaacagaagtagagctagatttaggggtgtaagatgtgggcaattaatacatttatatggctcaaaatttgaagagttggaaagcatctacagtgaaaagccccttttcctgccccatttcctcagccactcaggctattccccagagtcactgtgcataattacatatataatacaaacatgtatactatttctcttccctcttttatttttccaaaatggtatcaaactgtatatattcttctgcaccttgccttttttctcactcaacatgtttcttggagctgactctcaagcagtttgtgactatgtaattaggacataggcagctcctgctttttttgttaaatggcactgcaaaatgttcctttatgtgtttataccataatttatttaaccagtctcttgttcatggacattataaccttttgctcttacgcagagtgctgcaaagtgagcagtcttttccacgtgtcatttcacacatgtgcaagtaaagctgtaggataaattcctagaatggctggattaaaaggcaggggcagttacgattttgaaagatgtagccaggtggccttctccataggttgcgagtgtatgaaagacttacttccaagccagtctcttctatgctgcctgctataactaccaattaggaatttatttgggctaataagtaacccatgcctggaagatttaaggaatgtgaccttcctaatgcatattatttttaatcactgtgctttcaacctaatgaccagttgagattaagccacgtggtacatatttattgcaaacctactatttggttctagggaatcagcaaggagcaaggtgttacttctctcttggagtttatattctggtaaataaacaagattattccagagagtgataaatactgtgaaaataatacacatgacaatataattgtaacttggcagggggcaggctaattagaaggagtatactggttatggaaggccccctgaggaagtgatatttcagctaaacctggatgatgtaaaggagccagaaatgtggaaatcttgggtggcagtagcaggaacaacaactgcgaagatcttgagccaagagtaggcctagtggttctagaaacaaacagtagggtagaatagcaaagggactatcatgagcagaggggagcagggcatagcctgaagctaaagaggggcaggggtcagaccaagtagatcctcactgtggtaaggagttgcaagatttcaaatatggatgtgatgttgagatttacttgttaaaaagataacttggagccaggtgcagtggctcacatctgtaatcccagcactttgggaggccaaggcaagtggatcacttgaggtcaagagtttgagaccagcctggccaacatagtgaaactccgtctctactaaaggcatgaaaattaggcatggcggtgggcacctgtaatcccagctactgggagggctgagacaggaggatcacttgaacccagggggcggtggttgccttgagctgagatcacaccactgcactccagggcaacagagcgaaacttcatctcaaacaaacaaataaataaataactaggaggctgtgcatggtggctcacacctgcactttgcgaggccatggtgggaggatcacttgaggccaggagtttgagacagccttggcaatgtagcaagatctgccatctctacaaaaaattaaaatatcagccagatgtggcacatgtttgtggtcccagctacttgggaggattgcttgagcccaggagttcaaagttgcagtgagcagtgattgcaccattgcacttaagcctgggtgatggatgagaccctatctctaaaaaataaaaagataacttgggctgctgagtggagaatggattgggagggggcaagggattaagtggagagagtatgttttgggctgggctgtagtggcagcagcagagatagctatgccttggaagacatatttttgcagaggtggaactgttaggatttgtatgccttatgggtgataggcagaaagaggaatcaaggactcctagaattttggcttgagcaagctaggcatagaggcaggaagagacaaggttggggtgcggaggaggaggagaaatttgaagggtcctagggcattttctgagacgagtggcctggagaatgtgacggaatggactgtttggcccagcccacggaggaggagagtgctgggttttagaaatggggcatctgagaaccctgacttctgtcatggtgcctggagtctaaagtggggagcagagcatccagcgaaggtgggtagtgtccgaaaatctggagaatgtttgtttctttggtatgttttagtttttttcttttacatgaatatctatagatcttccttgatcacaaaaaatgaagttggcaaatttatggaactgtgaaagtaataccttatgtttttgtgaaactttgagagataatttgtctactataaaatttatttaaaattgcacaattgtgatttttcacataatcgtaaggttgttcaaccatcaccactatcttgactgcagaacatttttatcaccccagaaagcaaccctgcgctcactagcaattcctcctactcctccattcccccagcccctggcaaccgctaatctacttgctgtattctggacatttttacaaatggagtcatataatgtgtgttttttttggtgtgattctcttctttcacttaaaataacattttaaagatgcatccatgttgtagcatgtgtcagatctccattcttgatggctgaaaaaatatttccgtgcacggatataccacattttattaatttatcagttgatgaacatgttggttgttttgacttttcggctattatgcataacactgctatgaacatttgtgtagcagtttttttgtggacacattttctttcttttggttatacacataggagtgtaattgctgggttttgttaacttgatttttatcttttgaggttgtatccaactttatatcatttatttatcacagtagctatgaaaggaacctgaagtactgaaggatttgatgggctagaggaaaaagtgcatatgttacaaaaaatatttaaaatgaggttcattcatgcattggttaaaatagggcagacctggacacataaatgtgtcaggagaagtaaacaaaacgtgtaatacttatatagtggaagagtgtattgcaggtgtatgtgtgtagagaagtgtgtagagaagttatatctatatgtaatctcaacagaggtagataaaaaacaatgagaggtaggttaaatgagaagtagattaaaaaacaacggtgaaaaatgattaaaaaacaatgatgagtgaataagtgagttgataccatttatgtaagttaagaaaaccacaaagtaatactatgtattgctcatagatggaaatgcccatatacacacacagaagtacaaaaaggattggaaggatacccacaagtccatgatagtagttgctttgtatccctacttctgagctgcaaacccatgccagttttccttaccatatatttatatataaattatatataaatgtatatatatatattcatatacaaatcatttctgttacatgactgtacatttcttcggagtagggactatgttttcttcaccaatttccattgcctagcacttaagtgtgaacacatatttttgaatgactaactgaatgaattaaatgattttgggaacaagatagggcaggactaatgaataagccactctcccccatcctgctcattgtctctgctccctaccttcatattctgttagtgttgtcataatatgaggcttgcaattaccagagcagttccatatgacacgacatgctaataaagcagatggtgtgtgcaaataagcaggataaaagaggtctttgctgcaaaagtcattgctgtctcctttaaagtatgaagtattttatgatttctcagtagattttatcttcattgtcaaggtaatgattatggatcgtataaatctttatggctttgttgtatcaagtgtcaaattacacagcttaggtagttgtagaaagaaagatgtctgtgatcagattaggaagtcatattactaaaagtttttgccgttcagggaggagttggtctcacttttttgtgttcagatagtggagaactgtgctcccgttctagggccctccctcctttctctttattaacttctccccacgggagaaagaatggcaaattggaaagctcggggcttgacattaatatgagtgaagtcactgtatttccacatggctttcgttctttttttttttttttttgcgggggaaacaaggggtggaggcctgcagaaaggtgccagctatcctctactttttgcctgctgtcttcaggcaataaggagattagggaggtgttcccctggcaggcctaatctggtctatacttcttctagtccagcctttgcctggacaggtaaatcagttcaggtttgctctgtgaacctggccaccttcaggtctggaagaagaacataggaagccctgctgacgtcaggcttaagctgtattctccagcacatttaccagaagcctctggggttgtgtgtgaccatgcctcgaataaagcccatgttctgatccccatctgtctgtcagatgttatttgtggatgttatttgtggttatgcccagttggttagaacctagaaagtgataaaagtgagccatgcagccgggcacggtggctcatgcctgtaatcccagcactttgggaggatgaggtggatggatcacctgaggtcaggagttcaagaccagtctggccaacatggtgaaacactgtctctactaaaaaatacaaaaattagctgggcatgatggcatgcgactgtaatcctagctaccgggaaggctgaggcaggagaatcccctgaacccaggaggtggaggttgcagggagccgagactgcgccactgcactcaagcctgggcaacaagagctaaactctgtataaaaacaaaaaataacaaaaaaactagcgagccctacagctgcaggctgaggttctagttttggcaataagctaaagtgtaaataattttacatttaaaactatggaacaaatagaggtgggacatgggctgcccctgcccacctctccagccagttccccgactcttcgtcttctttctgctgcatgtggtctgaccatcttagttctcaagtttgccaaactttttttcagccatgtgtcctttgcctatgctgttttctctgctaactttctcttttttttctctctcttacttgctgcttttatggtcaagttctaactcttcaagcgtacacttaaatagtaccttctctgaccccgtaggctaggttgattgcttcagtgtactaaggcaaaaataccctgagtatctgtgctcattaacctctgtgtttcccttttgtaagatttatcacaattgtaatcaaatatttatgctatgatatatttgttgcctttctagattttctaacagtcttctttgcattgttacataaagtgtttagtgcagagctgggcactcatatttggtgcctgagggagatttgttgagtgaataaaatagcagtgtccagcagcgacatagactgctgagatatggcatgtcagagtctgaaaggcttctgtccagttggcaagtggaattcattggatgttttacaaagaatagttttagtaaggtggtggggacggaagtgagtttgcaaagtatcttataaaaagctagacttaattactcatttacgcaacattggaacccttacaagtgatttctctactgagagcaacttttcttgagttttactaactcagtagacactgtcagaatctgccagattacaacaaaggggtaaaaattcctgatcacttgaggtcaggaattcaagaccagcctgggcaacaaggtgaaacccgatctctactaaaaatgaaaaaaaaaaaaaaaaaaaaaaatagctgagctgggtggtgcgtgcctgtaatcccagctacatgggaggctgaggcaggagaattgcttgagcccgggaggcggaggttgcagtgagccgagattgcgccattgcactccagcctgggcgacagagcgagactccatctcagaaacaaacaactcccaaggcattatactatgactcttttctcaatgggtagtgaacagaatggaatattcacttcactgcaaagagtcactggcaggtggtgcagagcactgtgctccagaaagagcaaagagcctagaggtttctgatctctgcttatcactcagccaaaagtacagtcatttgcttaaaaaaagacaggtggcataaaaaaaaaagtattctttaatctctctgctctacaggacttgaaacatagccttaaatgactaagtcttcacgtgagcatgacataacctggaaatcttcctataatggaactggccttgtgaaggtatttattgttaagactttccagggtatattttgggaggtgccatgggcagatacatcggcgatactgttacatagtccaggatgttctacttttgaaaattaacaataattacactcaagaccttaggcaagttgactattctcagcactttatatatacagtcgtccctcattgtacaccgggatctcccctacccctcgcctatggtcaaatctgcacgtactcagtcttacagtcagccctgaagaactcgtatatgtaaaaagagggtatctctaggcagtgaggtagctttctgttagctcttgtagggaccatgttcttgtggacttgacaaagaatgttatatcaaaagtcgtaactcctttttcctgatttaaagatgacatttacatggtttttgtgtcccatgaatacggtatttttgatctgcatttgattgaaatgcatttgagctgctcagttgaaacctgtgttgttcaagggtcagactgtattaacctatttaatctttgcagcaaatcctgtaaggaatcagtccttttacagaggaggaacctgaagctcacagagcttaaggactttgcccgaagtggcagaattggcatttgaacctaggcatcctggcttcagaatccatgttcttcccttttaggttatactgcgtctctgtggccacttgatgataaagtcagtaattaggatccactgttgttccctcttgtgcctctgcccttttgctcatgttctcctccctgacactagagcacctgctcccccttcacctgcagtgagtgtctcggggaaacatcagcacagaggctctgctttctcccacccggcaggtccgcagggggttgctgtttcgaaagtattgagtgctctggacaccatgatctgttctgtaggattcttctgtagcaggagctttgtcatggactcagttgccttttga
